(12) United States Patent
Abad et al.

(10) Patent No.: US 8,343,764 B2
(45) Date of Patent: Jan. 1, 2013

(54) GENES ENCODING GLUTAMINE SYNTHETASE AND USES FOR PLANT IMPROVEMENT

(75) Inventors: Mark Scott Abad, Webster Groves, MO (US); Marie A. Coffin, Cary, NC (US); Barry S. Goldman, St. Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 363 days.

(21) Appl. No.: 12/459,621

(22) Filed: Jul. 2, 2009

(65) Prior Publication Data

US 2010/0017904 A1 Jan. 21, 2010

Related U.S. Application Data

(63) Continuation of application No. 11/431,855, filed on May 10, 2006, now abandoned.

(60) Provisional application No. 60/679,917, filed on May 10, 2005, provisional application No. 60/723,596, filed on Oct. 4, 2005.

(51) Int. Cl.
*C12N 15/82* (2006.01)
*A01H 5/00* (2006.01)
*A01H 5/10* (2006.01)
*A01H 1/00* (2006.01)

(52) U.S. Cl. .................. 435/419; 800/275; 800/298

(58) Field of Classification Search .................. None
See application file for complete search history.

(56) References Cited

U.S. PATENT DOCUMENTS

| | | | |
|---|---|---|---|
| 5,188,642 A | 2/1993 | Shah et al. | |
| 5,728,925 A | 3/1998 | Herrera-Estrella et al. | |
| 6,107,547 A * | 8/2000 | Coruzzi et al. | 800/290 |
| 6,559,358 B1 | 5/2003 | Murray | |
| 2004/0031072 A1 | 2/2004 | La Rosa | |
| 2007/0124833 A1 | 5/2007 | Abad et al. | |

FOREIGN PATENT DOCUMENTS

| | | |
|---|---|---|
| EP | 1086128 B | 12/1999 |
| WO | WO-00/09727 A2 | 2/2000 |
| WO | WO-2005/065339 A2 | 7/2005 |
| WO | WO-2005065339 A3 | 7/2005 |
| WO | WO-2006/076423 A2 | 7/2006 |
| WO | WO-2006076423 A3 | 7/2006 |
| WO | WO-2006138005 A2 | 12/2006 |
| WO | WO-2006138005 A3 | 12/2006 |

OTHER PUBLICATIONS

Tingey et al. GenBank Accession AAA33653, Apr. 27, 1993.*
Tingey et al. GenBank Accession AAA33669, Apr. 27, 1993.*
Tingey et al. GenBank Accession CAA28456, Apr. 18, 2005.*
Hoshida et al. Enhanced tolerance to salt stress in transgenic rice that overexpresses chloroplast glutamine synthetase. Plant Mol. Bio. May 2000;43(1):103-11.*
Sakamoto et al. GenBank Accession CAA32462, Apr. 18, 2005.*
"Chinese Application Serial No. 200680025272.0, First Office Action dated Feb. 24, 2011", (w/English Translation), 10 pgs.
"Chinese Application Serial No. 200680025272.0, Response filed Jul. 11, 2011 to Office Action mailed Feb. 24, 2011", (w/ English Translation of Claims), 26 pgs.
"Chinese Application Serial No. 200680025272.0, Second Office Action mailed Aug. 30, 2011", (English Translation), 6 pgs.
"European Application Serial No. 06799914.4, Office Action mailed Aug. 16, 2011", 3 pgs.
"European Application Serial No. 06799914.4, Amended Claims filed Jan. 16, 2009", 6 pgs.
"European Application Serial No. 06799914.4, Communication mailed Jun. 23, 2009", 3 pgs.
"European Application Serial No. 06799914.4, Communication pursuant to Rules 161 and 162 mailed Dec. 20, 2007", 2 pgs.
"European Application Serial No. 06799914.4, Response filed Jan. 14, 2008 to Communication pursuant to Rules 161 and 162 EPC", 7 pgs.
"European Application Serial No. 06799914.4, Response filed Aug. 25, 2009 to Communication mailed Jun. 23, 2009", 2 pgs.
"GenBank Accession No. AAN70749 glutamine synthetase, putative [*Pseudomonas putida* KT2440]", (Nov. 5, 2001), 1 pg.
"GenBank Accession No. AAO58736 glutamine synthetase [*Pseudomonas syringae* pv. tomato str. DC3000]", (Mar. 3, 2003), 2 pgs.
U.S. Appl. No. 11/431,855, Final Office Action mailed Apr. 7, 2009, 13 pgs.
U.S. Appl. No. 11/431,855, Non-Final Office Action mailed Sep. 30, 2008, 11 pgs.
U.S. Appl. No. 11/431,855, Response filed Jul. 7, 2008 to Restriction Requirement mailed Mar. 5, 2008, 2 pgs.
U.S. Appl. No. 11/431,855, Response filed Dec. 29, 2008 to Non-Final Office Action mailed Sep. 30, 2008, 16 pgs.
U.S. Appl. No. 11/431,855, Restriction Requirement mailed Mar. 5, 2008, 12 pgs.
European Application Serial No. 06799914.4, Office Action mailed May 4, 2010, 4 pgs.
European Application Serial No. 06799914.4, Office Action Response Filed Sep. 8, 2010, 4 pgs.
European Application Serial No. 06799914.4-2403, Supplementary European Search Report mailed Jun. 23, 2009, 3 pgs.
"Gen Bank Accession No. P42753 Cyclin-D3-1 (G1/S-specific cyclin-D3-1) (CycD3;1) (Cyclin-delta-3)(Cyclin-d3)", (May 20, 2008), 5 pgs.
International Application Serial No. PCT/US2006/018535, International Search Report mailed Oct. 21, 2008, 5 pgs.
International Application Serial No. PCT/US2006/018535, International Written Opinion mailed Oct. 21, 2008, 4 pgs.
"Pfam alignment for GenBank Accession No. P42753", Wellcome Trust, Sanger Institute, (Sep. 26, 2008), 2 pgs.
"Pfam alignment for the amino acid sequence encoded by SEQ ID No. 31 of Murray", Wellcome Trust, Sanger Institute, (Sep. 26, 2008), 2 pgs.

(Continued)

*Primary Examiner* — Cynthia Collins
(74) *Attorney, Agent, or Firm* — Schwegman Lundberg & Woessner, P.A.

(57) ABSTRACT

Transgenic seed for crops with improved traits are provided by trait-improving recombinant DNA in the nucleus of cells of the seed where plants grown from such transgenic seed exhibit one or more improved traits as compared to a control plant. The present invention provides recombinant DNA molecules for expression of a protein, including a recombinant DNA molecule for expression of a glutamine synthetase.

12 Claims, 3 Drawing Sheets

OTHER PUBLICATIONS

Bray, Elizabeth, "Genes commonly regulated by water-deficit stress in *Arabidopsis thaliana*", Journal of Experimental Botany, 55(407), doi:10.1093/jxb/erh270, (Sep. 24, 2004), 2331-2341.

Cebolla, et al., "The mitotic inhibitor ccs52 is required for endoreduplication and ploidy-dependent cell enlargement in plants", The EMBO Journal, 18, (1999), 4476-4484.

Kim, H J, et al., "A genetic link between cold responses and flowering time through FVE in *Arabidopsis thaliana*", Nat Genet. Feb. 2004, 36(2), (2004), 167-71.

Riou-Khamlichi, Catherine, et al., "Cytokinin activation of *Arabidopsis* cell division through a D-type cyclin", Science, vol. 283, (Mar. 5, 1999), 1541-1544.

"Chinese Application Serial No. 200680025272.0, Office Action mailed Jan. 6, 2012", w/English Translation, 7 pgs.

"Chinese Application Serial No. 200680025272.0, Office Action Response filed Jan. 16, 2012", 5 pgs.

"Chinese Application Serial No. 200680025272.0, Response filed May 2, 2012", (w/ English Translation of Claim 1), 4 pgs.

"European Application Serial No. 12156516.2, European Search Report mailed Jun. 26, 2012", 5 pgs.

"Chinese Application Serial No. 200680025272.0, Office Action mailed Jun. 18, 2012", 7 pgs.

* cited by examiner

Figures

Figure 1. Consensus sequence of SEQ ID NO:601 and its homologs

```
SEQ ID NO
601           --------MDITVRISGLKSSNLIRITPRFS--SSSRFRCSNNEPPRKGNESNAGGGGDK
32524         --------MDITVRISGLKSSNLIRITPRFS--SSSRFRCSNNEPPRKGNESNGGGG-DK
3404          MQMDVYTHISLPSFISHRFSSSRFQCSSLSS-YSPFKLVCSNRDSKESQRNDDNNNKGDK
2616          ---MQMDIVYTPSFISHRFSSSRHQCPSLSSSYSPFKLFCSNRDFKESQRNDDNNNKGDK
8168          --------------------MDVLLGSGRFLARRPP-LALVPRCSRGSPDKSG-SDKGET
8488          --------------------MDVLLGSGRFLARRPP-LALVPRCSRGSPDKSG-SDKGET
8557          --------------------MDVLLGSGRFLARRPP-LALVPRCSRGSPDKSG-SDKGET
7495          --------------------MDVLLGSGRFLARRPP-LALVPRCSRGSPDKSG-SDKGET
8625          --------------------MDILLGSGRFLARRTP-LMLVPRCSRGSRDRSG-SDKGET
8626          --------------------MDILLGSGRFLARRTP-LMLVPRCSRGSRDRSG-SDKGET
4535          --------------------MDILLGSGRFLARRLPPLALVPRCSRGSPDKSG-SDKGET
6255          --------------------MGILLVSGRFLARRPP-LALAPRCSRGSPDKRG-RDEGDT
4458          --------------------MDTLLGSGRFLARRPP-LALAPRCSRGSPEKGGGSDKGDT
5207          -------------------------------------------------------MISSDT
6640          ------------------------------------------------------------
consensuss    --------------------xxxxxxxxrfxxxxxxxlxxxxrxxxxsxxxxxxxxxgxx ASTDWDKAWKNFKKQSKKSLFSQFNVDKYVTWNPPRSEFDLSEEVDPIKRT-ERSNLMLW
ASTDWDKAWKNFKKQSKKSLFSQFNVDKYVTWNPPRSEFDLSEEVDPIKRT-ERSNLMLW
SSTDWDKAWSKFKKQGGKKPFSKF-SDKYVSWNPKRSEFPLSEEVDPIKRT-ERSNLSFW
SSTDWDKAWSKFKKQGGKKPFSKF-SDKYVSWNPRRSEFPLSEEVDPIKRT-ERSNLSFW
S-ADWDKAWSAFKKKGKRTLFSDFSPDKYVTWNPRRSEYPLSEEVDPIKRS-ERSNLMLW
S-ADWDKAWSAFKKKGKRTLFSDFSPDKYVIWNPRRSEYPLSEEVDPIKRS-ERSNLMLW
S-ADWDKAWSAFKKKGKRTLFSDFSPDKYVTWNPRRSEYPLSEEVDPIKRT-ERSNLMLW
S-ADWDKAWSAFKKKGKRTLFSDFSPDKYVTWNPRRSEYPLSEEVDPIKRT-ERSNLMLW
S-ADWDKAWAKFKKKGKRTLFSDFSPDKYVTWNPRRSEYPLSEEVDPIKRTERSN-LMLW
S-ADWDKAWAKFKKKGKRTLFSDFSPDKYVTWNPRRSEYPLSEEVDPIKSQLKDLNLMRC
S-TDWDKAWASFKNKGKRTLFSDFSPNKYVTWNPRRSEYPLSEEVDPIKRT-ERSNLMLW
SSTDWDKAWSTFKKKGKKTLFSEFSPNKYVTWNPRRSEYPLSEEVDPIKRA-ERSNLMLW
SSTDWDKAWSTFKKKGKKTLFSEFSPNKYVSWNPRRSEYPLSEEVDPIRRT-ERSNLMLW
SSTEWDKAWSSLRKKGKKTLFSEFSPNKYVTCNPRRIEYPLSGRSRSIXRAXRSNLML--
----------FHTTKLTSSLFHDFSRIKLVTCNPWPTQNPLPQQVDPIKRS-QTSQLXLW
sxxdwdkawxxfkkkgkxxlFsxFsxxKyVtwNPrrsexpLseevdpIkrx-ersnlmlw TSPRFTLVGAIVIVSFLLLYTILAPVK-----------------------------*
TSPRFTLVGAIVIVSFLLLYTILAPVK-----------------------------*
NSPTFTLGGAIIIVLFLLLYTILAPIK-----------------------------*
NSPTFTLGGAIIIVTFLLLYTILAPIK-----------------------------*
TSPQFTLVGAIIIVLTLLIYTLVVPPPK----------------------------*
TSPQFTLVGAIIIVLTLLIYTLVVPPPK----------------------------*
TSPQFTLVGAIIIVLTLLIYTLVVPPPK----------------------------*
TSPQFTLVGAIII-------------------------------------------*
TSPQFTLVGAIIIVLTLLIYTLVVPPK-----------------------------*
TSPQFRWVRRSSSSCHN---------------------------------------*
TSPQFTLVGAIIIVLTLLIYTLVVPPPK----------------------------*
TSPRFTLVGAIIIVSALLIYTLVVPPK-----------------------------*
TSPKFTLVMAIVIVSTLLIYTIVVPPK-----------------------------*
--------------------------------------------------------*
TSPQFPLDGAIIIVSPPLINTQVVPPPKKLHRSQPPPPLTCNLAEKKKSSLHCTFST*
tspxftlvgaixivxxllxytxxxpxxx----------------------------*
```

GENES ENCODING GLUTAMINE SYNTHETASE AND USES FOR PLANT IMPROVEMENT

CROSS REFERENCE TO RATED APPLICATIONS

This application is a continuation of U.S. application Ser. No. 11/431,855 filed on May 10, 2006 now abandoned, which claims benefit under 35USC §119(e) of U.S. provisional application Ser. No. 60/679,917, filed May 10, 2005, and U.S. provisional application Ser. No. 60/723,596, filed Oct. 4, 2005; all of which are incorporated herein by reference in their entirety including the sequence listing, the extra table, and the computer program listing.

INCORPORATION OF SEQUENCE LISTING

Two copies of the sequence listing (Copy 1 and Copy 2) and a computer readable form (CRF) of the sequence listing, all on CD-R's, each containing the file named 38-21(53708)D_seqListing.txt, which is 97,936,808 bytes (measured in MS-WINDOWS) and was created on Jul. 2, 2009, are incorporated herein by reference in their entirety.

INCORPORATION OF TABLES

Two copies of Table 2 on CD-R's, each containing the file named 38-21(53708)D_table2.txt, which is 330, 968 bytes when measured in MS-WINDOWS® operating system, was created on Jul. 2, 2009, are incorporated herein by reference in their entirety.

INCORPORATION OF COMPUTER PROGRAM LISTING

A Computer Program Listing with folders "hmmer-2.3.2" and "288pfamDir" is contained on a CD-R and is incorporated herein by reference in their entirety. Folder hmmer-2.3.2 contains the source code and other associated file for implementing the HMMer software for Pfam analysis. Folder 228pfamDir contains 288 Pfam Hidden Markov Models. Both folders were created on the disk on Jul. 2, 2009, having a total size of 24,465,168 bytes when measured in MS-WINDOWS® operating system.

FIELD OF THE INVENTION

Disclosed herein are transgenic plant cells, plants and seeds comprising recombinant DNA and methods of making and using such plant cells, plants and seeds

BACKGROUND OF THE INVENTION

Transgenic plants with improved traits such as improved yield, environmental stress tolerance, pest resistance, herbicide tolerance, modified seed compositions, and the like are desired by both farmers and consumers. Although considerable efforts in plant breeding have provided significant gains in desired traits, the ability to introduce specific DNA into plant genomes provides further opportunities for generation of plants with improved and/or unique traits. The ability to develop transgenic plants with improved traits depends in part on the identification of useful recombinant DNA for production of transformed plants with improved properties, e.g. by actually selecting a transgenic plant from a screen for such improved property.

SUMMARY OF THE INVENTION

This invention provides plant cell nuclei with recombinant that imparts enhanced agronomic traits in transgenic plants having the nuclei in their cells. Recombinant DNA in this invention is provided in a construct comprising a promoter that is functional in plant cells and that is operably linked to DNA that encodes a protein having at least one amino acid domain in a sequence that exceeds the Pfam gathering cutoff for amino acid sequence alignment with a protein domain family identified by a Pfam name in the group of Pfam domain names identified in Table 17. In more specific embodiments of the invention plant cells are provided which express a protein having amino acid sequence with at least 90% identity to a consensus amino acid sequence in the group of consensus amino acid sequences consisting of the consensus amino acid sequence constructed for SEQ ID NO: 426 and homologs thereof listed in Table 2 through the consensus amino acid sequence constructed for SEQ ID NO: 850 and homologs thereof listed in Table 2. Amino acid sequences of homologs are SEQ ID NO: 851 through 33634. In even more specific embodiments of the invention the protein expressed in plant cells is a protein selected from the group of proteins identified in Table 1 by annotation to a related protein in Genbank and alternatively identified in Table 16 by identification of protein domain family.

Other aspects of the invention are specifically directed to transgenic plant cells, and transgenic plants comprising a plurality of plant cells with such nuclei, progeny transgenic seed, embryo and transgenic pollen from such plants. Such plant cell nuclei are selected from a population of transgenic plants regenerated from plant cells with a nucleus transformed with recombinant DNA by screening the transgenic plants in the population for an enhanced trait as compared to control plants that do not have the recombinant DNA in their nucleus, where the enhanced trait is enhanced water use efficiency, enhanced cold tolerance, enhanced heat tolerance, enhanced shade tolerance, enhanced tolerance to salt exposure, increased yield, enhanced nitrogen use efficiency, enhanced seed protein and enhanced seed oil. In some aspects of the invention the recombinant DNA expresses a protein that imparts the enhanced trait; in other aspects of the invention the recombinant DNA expresses RNA for suppressing the level of an endogenous protein. In yet another aspect of the invention the nucleus of plant cells in plants, seeds, embryo and pollen further comprise DNA expressing a protein that provides tolerance from exposure to an herbicide applied at levels that are lethal to a wild type of said plant cell.

TABLES

The patent contains table(s) that have been included at the end of the specification.

Such tolerance is especially useful not only as an advantageous trait in such plants but is also useful in a selection step in the methods of the invention. In aspects of the invention the agent of such herbicide is a glyphosate, dicamba, or glufosinate compound.

Yet other aspects of the invention provide nuclei is cells of transgenic plants which are homozygous for the recombinant DNA and transgenic seed of the invention from corn, soybean, cotton, canola, alfalfa, wheat or rice plants. In other important embodiments for practice of various aspects of the invention in Argentina the recombinant DNA in the nucleus is provided in plant cells derived from corn lines that that are and maintain resistance to a virus such as the Mal de Rio Cuarto virus or a fungus such as the *Puccina sorghi* fungus or to both.

This invention also provides methods for manufacturing non-natural, transgenic seed that can be used to produce a crop of transgenic plants with an enhanced trait resulting from expression of stably-integrated, recombinant DNA in the nucleus of the plant cells. In some aspects of the invention the recombinant DNA can express a protein having at least one domain of amino acids in a sequence that exceeds the Pfam gathering cutoff for amino acid sequence alignment with a protein domain family identified by a Pfam name in the group of Pfam names identified in Table 17; in other aspects the recombinant DNA suppresses the level of a such a protein More specifically the method comprises (a) screening a population of plants for an enhanced trait and recombinant DNA, where individual plants in the population can exhibit the trait at a level less than, essentially the same as or greater than the level that the trait is exhibited in control plants which do not express the recombinant DNA; (b) selecting from the population one or more plants that exhibit the trait at a level greater than the level that said trait is exhibited in control plants; (c) verifying that the recombinant DNA is stably integrated in said selected plants; (d) analyzing tissue of a selected plant to determine the production of a protein having the function of a protein encoded by nucleotides in a sequence of one of SEQ ID NO: 1-425; and (e) collecting seed from a selected plant. In one aspect of the invention the plants in the population further comprise DNA expressing a protein that provides tolerance to exposure to an herbicide applied at levels that are lethal to wild type plant cells and where the selecting is effected by treating the population with the herbicide, e.g. a glyphosate, dicamba, or glufosinate compound. In another aspect of the invention the plants are selected by identifying plants with the enhanced trait. The methods are especially useful for manufacturing corn, soybean, cotton, alfalfa, wheat or rice seed selected as having one of the enhanced traits described above.

Another aspect of the invention provides a method of producing hybrid corn seed comprising acquiring hybrid corn seed from a herbicide tolerant corn plant which also has a nucleus of this invention with stably-integrated, recombinant DNA The method further comprises producing corn plants from said hybrid corn seed, where a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Another aspect of the invention provides a method of selecting a plant comprising a nucleus of this invention in its plant cells by using an immunoreactive antibody to detect the presence of protein expressed by recombinant DNA in seed or plant tissue. Another aspect of the invention provides anti-counterfeit milled seed having, as an indication of origin, a nucleus of this invention with unique recombinant DNA.

Aspects of the invention relating to nucleus in plant cells having recombinant DNA for suppressing the expression of a protein are identified in Table 1 and Table 16. More specific aspects of the invention provide plant cells having recombinant DNA for suppressing the expression of a protein having the function in a plant of the protein with amino acid sequence of SEQ ID NO: 426, 428, 429, 430, 524, 525, 541, 601, 602, 650, 651, 654, 655, 657, 660, 694, 698, 772, 801 or the corresponding Pfam identified in Table 16, i.e. Histone, WD40, NPH3, FHA, PB1, ADH_zinc_N, NAPRTase, ADK_lid, p450, B56, DUF231, C2, DUF568, WD40, F-box, Pkinase, Terpene_synth, respectively. Such suppression can be effected by any of a number of ways known in the art, e.g. anti-sense suppression, RNAi or mutation knockout and the like.

Another aspect of this invention relates to growing transgenic plants with enhanced water use efficiency or enhanced nitrogen use efficiency. For instance, this invention provides methods of growing a corn, cotton or soybean crop without irrigation water comprising planting seed having plant cells of the invention which are selected for enhanced water use efficiency. Alternatively methods comprise applying reduced irrigation water, e.g. providing up to 300 millimeters of ground water during the production of a corn crop. This invention also provides methods of growing a corn, cotton or soybean crop without added nitrogen fertilizer comprising planting seed having plant cells of the invention which are selected for enhanced nitrogen use efficiency. Alternatively methods comprise applying reduced amount of nitrogen input as compared to the conventional input during the production of a corn crop.

The various aspects of this invention are especially useful for transgenic plant cells in seeds and transgenic plants having any of the above-described enhanced traits in crop plants such as corn (maize), soybean, cotton, canola (rape), wheat, sunflower, sorghum, alfalfa, barley, millet, rice, tobacco, fruit and vegetable crops, and turfgrass.

The invention also provides recombinant DNA constructs comprising the DNA useful in the nuclei in plant cells for imparting enhanced traits in plants having those cells.

BRIEF DESCRIPTION OF THE DRAWINGS

FIG. 1 is a consensus amino acid sequence of SEQ ID NO: 601 and homologs.

DETAILED DESCRIPTION OF THE INVENTION

Figure 2:
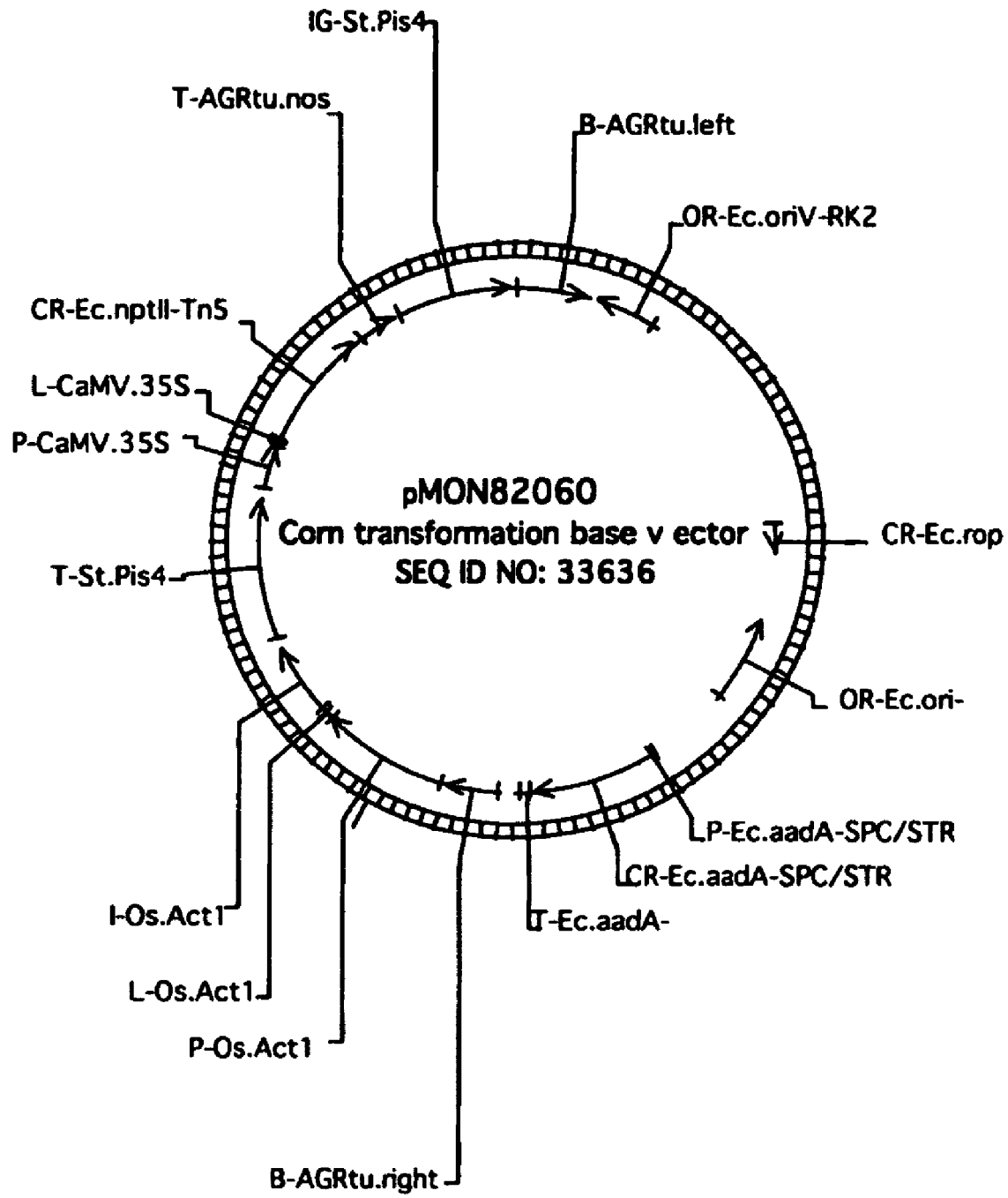
FIGS. 2 and 3 are plasmid maps.

In the attached sequence listing:
SEQ ID NO:1-425 are nucleotide sequences of the coding strand of DNA for "genes" used in the recombinant DNA imparting an enhanced trait in plant cells, i.e. each represents a coding sequence for a protein;
SEQ ID NO:426-850 are amino acid sequences of the cognate protein of the "genes" with nucleotide coding sequence 1-425;

SEQ ID NO:851-33634 are amino acid sequences of homologous proteins;

SEQ ID NO:33635 is a consensus amino acid sequence.

SEQ ID NO:33636 is a nucleotide sequence of a plasmid base vector useful for corn transformation; and SEQ ID NO:33637 is a DNA sequence of a plasmid base vector useful for soybean transformation.

The nuclei of this invention are identified by screening transgenic plants for one or more traits including improved drought stress tolerance, improved heat stress tolerance, improved cold stress tolerance, improved high salinity stress tolerance, improved low nitrogen availability stress tolerance, improved shade stress tolerance, improved plant growth and development at the stages of seed imbibition through early vegetative phase, and improved plant growth and development at the stages of leaf development, flower production and seed maturity.

"Gene" refers to chromosomal DNA, plasmid DNA, cDNA, synthetic DNA, or other DNA that encodes a peptide, polypeptide, protein, or RNA molecule, and regions flanking the coding sequences involved in the regulation of expression. In aspects of the invention where an improved trait is provided by expression of a protein, "gene" refers at least to coding nucleotide sequence for a protein or a function polypeptide fragment of a protein that imparts the trait. In aspects of the invention where an improved trait is provided by suppression of expression of an endogenous protein, "gene" refers to any part of the gene that can be a target for suppression.

"Transgenic seed" means a plant seed whose nucleus has been altered by the incorporation of recombinant DNA, e.g., by transformation as described herein. The term "transgenic plant" is used to refer to the plant produced from an original transformation event, or progeny from later generations or crosses of a plant to a transformed plant, so long as the progeny contains a nucleus with the recombinant DNA in its genome.

"Recombinant DNA" a polynucleotide having a genetically engineered modification introduced through combination of endogenous and/or exogenous elements in a transcription unit, manipulation via mutagenesis, restriction enzymes, and the like or simply by inserting multiple copies of a native transcription unit. Recombinant DNA may comprise DNA segments obtained from different sources, or DNA segments obtained from the same source, but which have been manipulated to join DNA segments which do not naturally exist in the joined form. A recombinant polynucleotide may exist outside of the cell, for example as a PCR fragment, or integrated into a genome, such as a plant genome.

"Trait" means a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g., by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance.

A "control plant" is a plant without trait-improving recombinant DNA in its nucleus. A control plant is used to measure and compare trait improvement in a transgenic plant with such trait-improving recombinant DNA. A suitable control plant may be a non-transgenic plant of the parental line used to generate a transgenic plant herein. Alternatively, a control plant may be a transgenic plant that comprises an empty vector or marker gene, but does not contain the recombinant DNA that produces the trait improvement. A control plant may also be a negative segregant progeny of hemizygous transgenic plant. In certain demonstrations of trait improvement, the use of a limited number of control plants can cause a wide variation in the control dataset. To minimize the effect of the variation within the control dataset, a "reference" is used. As use herein a "reference" is a trimmed mean of all data from both transgenic and control plants grown under the same conditions and at the same developmental stage. The trimmed mean is calculated by eliminating a specific percentage, i.e., 20%, of the smallest and largest observation from the data set and then calculating the average of the remaining observation.

"Trait improvement" means a detectable and desirable difference in a characteristic in a transgenic plant relative to a control plant or a reference. In some cases, the trait improvement can be measured quantitatively. For example, the trait improvement can entail at least a 2% desirable difference in an observed trait, at least a 5% desirable difference, at least about a 10% desirable difference, at least about a 20% desirable difference, at least about a 30% desirable difference, at least about a 50% desirable difference, at least about a 70% desirable difference, or at least about a 100% difference, or an even greater desirable difference. In other cases, the trait improvement is only measured qualitatively. It is known that there can be a natural variation in a trait. Therefore, the trait improvement observed entails a change of the normal distribution of the trait in the transgenic plant compared with the trait distribution observed in a control plant or a reference, which is evaluated by statistical methods provided herein. Trait improvement includes, but is not limited to, yield increase, including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density.

Many agronomic traits can affect "yield", including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Other traits that can affect yield include, efficiency of germination (including germination in stressed conditions), growth rate (including growth rate in stressed conditions), ear number, seed number per ear, seed size, composition of seed (starch, oil, protein) and characteristics of seed fill. Also of interest is the generation of transgenic plants that demonstrate desirable phenotypic properties that may or may not confer an increase in overall plant yield. Such properties include enhanced plant morphology, plant physiology or improved components of the mature seed harvested from the transgenic plant.

"Yield-limiting environment" means the condition under which a plant would have the limitation on yield including environmental stress conditions.

"Stress condition" means a condition unfavorable for a plant, which adversely affect plant metabolism, growth and/or development. A plant under the stress condition typically shows reduced germination rate, retarded growth and development, reduced photosynthesis rate, and eventually leading to reduction in yield. Specifically, "water deficit stress" used herein preferably refers to the sub-optimal conditions for water and humidity needed for normal growth of natural plants. Relative water content (RWC) can be used as a physiological measure of plant water deficit. It measures the effect of osmotic adjustment in plant water status, when a plant is under stressed conditions. Conditions which may result in water deficit stress include heat, drought, high salinity and PEG induced osmotic stress.

"Cold stress" means the exposure of a plant to a temperatures below (two or more degrees Celsius below) those normal for a particular species or particular strain of plant.

"Nitrogen nutrient" means any one or any mix of the nitrate salts commonly used as plant nitrogen fertilizer, including, but not limited to, potassium nitrate, calcium nitrate, sodium nitrate, ammonium nitrate. The term ammonium as used herein means any one or any mix of the ammonium salts commonly used as plant nitrogen fertilizer, e.g., ammonium nitrate, ammonium chloride, ammonium sulfate, etc.

"Low nitrogen availability stress" means a plant growth condition that does not contain sufficient nitrogen nutrient to maintain a healthy plant growth and/or for a plant to reach its typical yield under a sufficient nitrogen growth condition. For example, a limiting nitrogen condition can refers to a growth condition with 50% or less of the conventional nitrogen inputs. "Sufficient nitrogen growth condition" means a growth condition where the soil or growth medium contains or receives optimal amounts of nitrogen nutrient to sustain a healthy plant growth and/or for a plant to reach its typical yield for a particular plant species or a particular strain. One skilled in the art would recognize what constitute such soil, media and fertilizer inputs for most plant species.

"Shade stress" means a growth condition that has limited light availability that triggers the shade avoidance response in plant. Plants are subject to shade stress when localized at lower part of the canopy, or in close proximity of neighboring vegetation. Shade stress may become exacerbated when the planting density exceeds the average prevailing density for a particular plant species. The average prevailing densities per acre of a few examples of crop plants in the USA in the year 2000 were: wheat 1,000,000-1,500,000; rice 650,000-900,000; soybean 150,000-200,000, canola 260,000-350,000, sunflower 17,000-23,000 and cotton 28,000-55,000 plants per acre (Cheikh, e.g., (2003) U.S. Patent Application No. 20030101479).

"Increased yield" of a transgenic plant of the present invention is evidenced and measured in a number of ways, including test weight, seed number per plant, seed weight, seed number per unit area (i.e., seeds, or weight of seeds, per acre), bushels per acre, tons per acre, tons per acre, kilo per hectare. For example, maize yield can be measured as production of shelled corn kernels per unit of production area, e.g., in bushels per acre or metric tons per hectare, often reported on a moisture adjusted basis, e.g., at 15.5% moisture. Increased yield can result from improved utilization of key biochemical compounds, such as nitrogen, phosphorous and carbohydrate, or from improved tolerance to environmental stresses, such as cold, heat, drought, salt, and attack by pests or pathogens. Trait-improving recombinant DNA can also be used to provide transgenic plants having improved growth and development, and ultimately increased yield, as the result of modified expression of plant growth regulators or modification of cell cycle or photosynthesis pathways.

"Expression" means transcription of DNA to produce RNA. The resulting RNA may be without limitation mRNA encoding a protein, antisense RNA, or a double-stranded RNA for use in RNAi technology. Expression also refers to production of encoded protein from mRNA.

A "plant promoter" is a promoter capable of initiating transcription in plant cells whether or not its origin is a plant cell. Exemplary plant promoters include, but are not limited to, those that are obtained from plants, plant viruses, and bacteria which comprise genes expressed in plant cells such *Agrobacterium* or *Rhizobium*. Examples of promoters under developmental control include promoters that preferentially initiate transcription in certain tissues, such as leaves, roots, or seeds. Such promoters are referred to as "tissue preferred". Promoters which initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions. As used herein, "antisense orientation" includes reference to a polynucleotide sequence that is operably linked to a promoter in an orientation where the antisense strand is transcribed. The antisense strand is sufficiently complementary to an endogenous transcription product such that translation of the endogenous transcription product is often inhibited.

As used herein, "operably linked" refers to the association of two or more nucleic acid fragments on a single nucleic acid fragment so that the function of one is affected by the other. For example, a promoter is operably linked with a coding sequence when it is capable of affecting the expression of that coding sequence (i.e., that the coding sequence is under the transcriptional control of the promoter). Coding sequences can be operably linked to regulatory sequences in sense or antisense orientation.

A "consensus sequence" refers to an artificial, amino acid sequence of conserved parts of the proteins encoded by homologous genes, e.g., as determined by a CLUSTALW alignment of amino acid sequence of homolog proteins.

Homologous genes are genes which encode proteins with the same or similar biological function to the protein encoded by the second gene. Homologous genes may be generated by the event of speciation (see ortholog) or by the event of genetic duplication (see paralog). "Orthologs" refer to a set of homologous genes in different species that evolved from a common ancestral gene by specification. Normally, orthologs retain the same function in the course of evolution; and "paralogs" refer to a set of homologous genes in the same species that have diverged from each other as a consequence of genetic duplication. Thus, homologous genes can be from the same or a different organism. As used herein, "homolog" means a protein that performs the same biological function as a second protein including those identified by sequence identity search.

Percent identity refers to the extent to which two optimally aligned DNA or protein segments are invariant throughout a window of alignment of components, e.g., nucleotide sequence or amino acid sequence. An "identity fraction" for aligned segments of a test sequence and a reference sequence is the number of identical components which are shared by sequences of the two aligned segments divided by the total number of sequence components in the reference segment over a window of alignment which is the smaller of the full test sequence or the full reference sequence. "Percent identity" ("% identity") is the identity fraction times 100. "% identity to a consensus amino acid sequence" is 100 times the identity fraction in a window of alignment of an amino acid sequence of a test protein optimally aligned to consensus amino acid sequence of this invention.

"*Arabidopsis*" means plants of *Arabidopsis thaliana*.

"Pfam" refers to a large collection of multiple sequence alignments and hidden Markov models covering many common protein families, e.g. Pfam version 18.0 (August 2005) contains alignments and models for 7973 protein families and is based on the Swissprot 47.0 and SP-TREMBL 30.0 protein sequence databases. See S. R. Eddy, "Profile Hidden Markov Models", *Bioinformatics* 14:755-763, 1998. Pfam is currently maintained and updated by a Pfam Consortium. The alignments represent some evolutionary conserved structure that has implications for the protein's function. Profile hidden Markov models (profile HMMs) built from the Pfam alignments are useful for automatically recognizing that a new protein belongs to an existing protein family even if the homology by alignment appears to be low. Once one DNA is identified as encoding a protein which imparts an enhanced trait when expressed in transgenic plants, other DNA encoding proteins in the same protein family are identified by querying the amino acid sequence of protein encoded by candidate DNA against the Hidden Markov Model which characterizes the Pfam domain using HMMER software, a current version of which is provided in the appended computer listing. Candidate proteins meeting the gathering cutoff for the alignment of a particular Pfam are in the protein family and have cognate DNA that is useful in constructing recombinant DNA for the use in the plant cells of this invention. Hidden Markov Model databases for use with HMMER software in identifying DNA expressing protein in a common Pfam for recombinant DNA in the plant cells of this invention are also included in the appended computer listing. The HMMER software and Pfam databases are version 18.0 and were used to identify known domains in the proteins corresponding to amino acid sequence of SEQ ID NO: 426 through SEQ ID NO: 850. All DNA encoding proteins that have scores higher than the gathering cutoff disclosed in Table 17 by Pfam analysis disclosed herein can be used in recombinant DNA of the plant cells of this invention, e.g. for selecting transgenic plants having enhanced agronomic traits. The relevant Pfams for use in this invention, as more specifically disclosed below, are Mito_carr, 6PGD, UBX, iPGM_N, WD40, Fer4, Enolase_C, DUF1639, PBP, PLAC8, Acyl-CoA_dh_1, Isoamylase_N, Acyl-CoA_dh_2, PC4, Sugar_tr, UCH, Enolase_N, HATPase_c, PRA-PH, Pkinase, SBP56, PEP-utilizers, SIS, PCI, DUF1644, Terpene_synth, Acyl-CoA_dh_M, Acyl-CoA_dh_N, Glutaminase, Lectin_legB, Dehydrin, MatE, Ank, 2-Hacid_dh_C, Chal_sti_synt_C, DUF1070, ATP-grasp_2, Arginase, HABP4_PAI-RBP1, ABC2_membrane, DUF1723, Glyco_hydro_1, MFS_1, ARD, PDT, HMA, Pro_isomerase, Ferric_reduct, PRA-CH, Aa_trans, ACT, LisH, PGM_PMM_II, Spermine_synth, zf-MYND, LRRNT_2, Ribul_P_3_epim, PGM_PMM_IV, NPH3, DapB_C, TPR_1, TPR_2, FAE1_CUT1_RppA, K_trans, F-box, Cyclin_C, ADK, NUDIX, NIR_SIR, PEPCK_ATP, La, DapB_N, MtN3_slv, FMO-like, TIM, FKBP_C, PMEI, Peptidase_C12, Cyclin_N, DUF568, Methyltransf_11, Methyltransf_12, DUF1677, DnaJ_C, BRAP2, IF2_N, Carboxyl_trans, mTERF, Glyoxalase, TMEM14, Mlo, Beta-elim_lyase, Pyr_redox_dim, Glyco_transf_8, Nicastrin, Flavodoxin_1, Epimerase, PTPA, Lipase_3, Pyr_redox_2, GSHPx, ELM2, PGI, Aminotran_1_2, ABC_tran, GRP, PGK, Oleosin, Sulfotransfer_1, EXS, DUF1325, AMP-binding, Arm, NTP_transferase, LSM, Metalloenzyme, Molybdop_Fe4S4, MFAP1_C, Aminotran_3, PHD, B56, DUF588, PSI_PsaF, zf-CCCH, HEAT, PALP, FH2, SapB_1, Ammonium_transp, MannoseP_isomer, NOP5NT, SapB_2, Pyr_redox, Pollen_allerg_1, Asp, DUF662, FHA, YjeF_N, COX5C, GTP_EFTU_D2, Ion_trans_2, PK, DUF231, FAD_binding_1, Hrf1, FAD_binding_4, FAD_binding_6, FAD_binding_8, CBS, Smr, aPHC, DUF241, Brix, Ras, Acetyltransf_1, NAF, SPX, Na_Ca_ex, C2, p450, PP2C, Histone, 2-Hacid_dh, SBF, CCT, BCNT, PK_C, Miro, CH, PfkB, ACP_syn_III_C, Sterol_desat, ADH_zinc_N, CS, Cys_Met_Meta_PP, Lactamase_B, Bromodomain, CDI, Linker_histone, DAO, Dicty_CAR, Aldo_ket_red, zf-AN1, Methyltransf_6, DUF1005, LEA_2, NIR_SIR_ferr, DUF260, Oxidored_FMN, DUF26, Lectin_C, Pec_lyase_C, Nop, TB2_DP1_HVA22, ADH_N, YGGT, NAPRTase, NAD_binding_1, DUF914, PGM_PMM_I, NAD_binding_2, AICARFT_IMPCHas, Auxin_inducible, NAD_binding_6, Anti-silence, RuBisCO_large, Response_reg, FeThRed_A, Di19, SNARE, PGM_PMM_III, Molydop_binding, efhand, zf-CCHC, GTP_EFTU, ARID, adh_short, Fibrillarin, RuBisCO_large_N, WWE, AA_permease, PABP, OMPdecase, RRM_1, U-box, OPT, TBC, MGS, DUF786, 3Beta_HSD, zf-UBP, zf-A20, DPBB_1, GDPD, PI-PLC-X, SEP, PI-PLC-Y, NOSIC, Glycolytic, SET, ADK_lid, Alpha-amylase, EB1, PGAM, Abhydrolase_1, Glyco_hydro_14, Lung_7-TM_R, Abhydrolase_3, TCTP, GATase_2, Gln-synt_C, 2OG-FeII_Oxy, Pribosyltran, MIF, CoA_trans, RCC1, Pkinase_Tyr, MIP, DnaJ, HSCB_C, Trehalose_PPase, LRR_1, Cupin_2, LRR_2, Glyco_hydro_28, Yip1, Trp_syntA, Sedlin_N, SGS, Aldedh, CK_II_beta, zf-C3HC4, GIDA, PB1, IMPDH, Carb_kinase, PurA, Molybdopterin, Nodulin-like, Tim17, Xan_ur.permease, Hist_deacetyl, RNA_pol_Rpb8, Agenet, Myb_DNA-binding, Glyoxal_oxid_N, Ribophorin_I, and FAE_3-kCoA_syn1.

Recombinant DNA Constructs

The present invention provides recombinant DNA constructs comprising one or more polynucleotides disclosed herein for imparting one or more improved traits to transgenic plant when incorporated into the nucleus of the plant cells. Such constructs also typically comprise a promoter operatively linked to said polynucleotide to provide for expression in the plant cells. Other construct components may include additional regulatory elements, such as 5' or 3' untranslated regions (such as polyadenylation sites), intron regions, and transit or signal peptides. Such recombinant DNA constructs can be assembled using methods known to those of ordinary skill in the art.

In a preferred embodiment, a polynucleotide of the present invention is operatively linked in a recombinant DNA construct to a promoter functional in a plant to provide for expression of the polynucleotide in the sense orientation such that a desired protein or polypeptide fragment of a protein is produced. Also provided are embodiments wherein a polynucleotide is operatively linked to a promoter functional in a plant to provide for expression of gene suppression RNA to suppress the level of an endogenous protein.

Recombinant constructs prepared in accordance with the present invention also generally include a 3' untranslated DNA region (UTR) that typically contains a polyadenylation sequence following the polynucleotide coding region. Examples of useful 3' UTRs include those from the nopaline synthase gene of *Agrobacterium tumefaciens* (nos), a gene encoding the small subunit of a ribulose-1,5-bisphosphate carboxylase-oxygenase (rbcS), and the T7 transcript of *Agrobacterium tumefaciens*. Constructs and vectors may also include a transit peptide for targeting of a gene target to a plant organelle, particularly to a chloroplast, leucoplast or other plastid organelle. For descriptions of the use of chloroplast transit peptides, see U.S. Pat. No. 5,188,642 and U.S. Pat. No. 5,728,925, incorporated herein by reference.

Table 1 provides a list of genes that provide recombinant DNA that was used in a model plant to discover associated improved traits and that can be used with homologs to define a consensus amino acid sequence for characterizing recombinant DNA for use in the nuclei of this invention. An understanding of Table 1 is facilitated by the following description of the headings:

"NUC SEQ ID NO" refers to a SEQ ID NO. for particular DNA sequence in the Sequence Listing.

"PEP SEQ ID NO" refers to a SEQ ID NO. in the Sequence Listing for the amino acid sequence of a protein cognate to a particular DNA "construct_id" refers to an arbitrary number used to identify a particular recombinant DNA construct comprising the particular DNA.

"Gene ID" refers to an arbitrary name used to identify the particular DNA. "orientation" refers to the orientation of the particular DNA in a recombinant DNA construct relative to the promoter.

TABLE 1

| NUC SEQ ID NO | PEP SEQ ID NO | Gene ID | Construct ID | orientation |
|---|---|---|---|---|
| 1 | 426 | CGPG699 | 10919 | ANTI-SENSE |
| 2 | 427 | CGPG567 | 11142 | SENSE |
| 3 | 428 | CGPG267 | 11310 | ANTI-SENSE |
| 4 | 429 | CGPG1179 | 11866 | ANTI-SENSE |
| 5 | 430 | CGPG959 | 11937 | ANTI-SENSE |
| 6 | 431 | CGPG2158 | 16218 | SENSE |
| 7 | 432 | CGPG2446 | 17410 | SENSE |
| 8 | 433 | CGPG1862 | 18401 | SENSE |
| 9 | 434 | CGPG3014 | 18665 | SENSE |
| 10 | 435 | CGPG1674 | 19141 | SENSE |
| 11 | 436 | CGPG2680 | 19156 | SENSE |
| 12 | 437 | CGPG3577 | 19621 | SENSE |
| 13 | 438 | CGPG4065 | 19760 | SENSE |
| 14 | 439 | CGPG3929 | 19857 | SENSE |
| 15 | 440 | CGPG2488 | 70510 | SENSE |
| 16 | 441 | CGPG3012 | 70605 | SENSE |
| 17 | 442 | CGPG3162 | 70607 | SENSE |
| 18 | 443 | CGPG607 | 70812 | SENSE |
| 19 | 444 | CGPG4084 | 70933 | SENSE |
| 20 | 445 | CGPG3917 | 70939 | SENSE |
| 21 | 446 | CGPG4414 | 71319 | SENSE |
| 22 | 447 | CGPG185 | 71446 | SENSE |
| 23 | 448 | CGPG1679 | 71609 | SENSE |
| 24 | 449 | CGPG271 | 71649 | SENSE |
| 25 | 450 | CGPG4434 | 71814 | SENSE |
| 26 | 451 | CGPG2198 | 71945 | SENSE |
| 27 | 452 | CGPG5253 | 72005 | SENSE |
| 28 | 453 | CGPG5231 | 72026 | SENSE |
| 29 | 454 | CGPG4815 | 72533 | SENSE |
| 30 | 455 | CGPG4859 | 72637 | SENSE |
| 31 | 456 | CGPG1589 | 72782 | SENSE |
| 32 | 457 | CGPG1826 | 72794 | SENSE |
| 33 | 458 | CGPG3899 | 72919 | SENSE |
| 34 | 459 | CGPG5610 | 72983 | SENSE |
| 35 | 460 | CGPG5665 | 73025 | SENSE |
| 36 | 461 | CGPG5697 | 73050 | SENSE |
| 37 | 462 | CGPG5695 | 73092 | SENSE |
| 38 | 463 | CGPG4862 | 73338 | SENSE |
| 39 | 464 | CGPG4910 | 73344 | SENSE |
| 40 | 465 | CGPG6541 | 73536 | SENSE |
| 41 | 466 | CGPG1756 | 73644 | SENSE |
| 42 | 467 | CGPG4927 | 73662 | SENSE |
| 43 | 468 | CGPG5106 | 73672 | SENSE |
| 44 | 469 | CGPG5167 | 73733 | SENSE |
| 45 | 470 | CGPG1924 | 73846 | SENSE |
| 46 | 471 | CGPG5201 | 73863 | SENSE |
| 47 | 472 | CGPG1884 | 74059 | SENSE |
| 48 | 473 | CGPG5089 | 74205 | SENSE |
| 49 | 474 | CGPG5870 | 74321 | SENSE |
| 50 | 475 | CGPG5888 | 74337 | SENSE |
| 51 | 476 | CGPG1461 | 74388 | SENSE |
| 52 | 477 | CGPG6743 | 74412 | SENSE |
| 53 | 478 | CGPG6722 | 74445 | SENSE |
| 54 | 479 | CGPG82 | 74522 | SENSE |
| 55 | 480 | CGPG6761 | 74526 | SENSE |
| 56 | 481 | CGPG6781 | 74576 | SENSE |
| 57 | 482 | CGPG4914 | 74707 | SENSE |
| 58 | 483 | CGPG5840 | 74743 | SENSE |
| 59 | 484 | CGPG5980 | 74755 | SENSE |
| 60 | 485 | CGPG1743 | 75202 | SENSE |
| 61 | 486 | CGPG5434 | 75220 | SENSE |
| 62 | 487 | CGPG5824 | 75226 | SENSE |
| 63 | 488 | CGPG5879 | 75231 | SENSE |
| 64 | 489 | CGPG5949 | 75239 | SENSE |
| 65 | 490 | CGPG6096 | 75258 | SENSE |
| 66 | 491 | CGPG6218 | 75270 | SENSE |
| 67 | 492 | CGPG6226 | 75271 | SENSE |
| 68 | 493 | CGPG7518 | 75355 | SENSE |
| 69 | 494 | CGPG7654 | 75460 | SENSE |
| 70 | 495 | CGPG6875 | 75847 | SENSE |
| 71 | 496 | CGPG8259 | 75907 | SENSE |
| 72 | 497 | CGPG8229 | 75927 | SENSE |
| 73 | 498 | CGPG8224 | 75962 | SENSE |
| 74 | 499 | CGPG1927 | 75984 | SENSE |
| 75 | 500 | CGPG5962 | 76119 | SENSE |
| 76 | 501 | CGPG5375 | 76209 | SENSE |
| 77 | 502 | CGPG8949 | 76323 | SENSE |
| 78 | 503 | CGPG8943 | 76346 | SENSE |
| 79 | 504 | CGPG8896 | 76352 | SENSE |
| 80 | 505 | CGPG8960 | 76360 | SENSE |
| 81 | 506 | CGPG5891 | 76512 | SENSE |
| 82 | 507 | CGPG7260 | 76575 | SENSE |
| 83 | 508 | CGPG2647 | 76733 | SENSE |
| 84 | 509 | CGPG6995 | 76741 | SENSE |
| 85 | 510 | CGPG9046 | 76845 | SENSE |
| 86 | 511 | CGPG9047 | 76857 | SENSE |
| 87 | 512 | CGPG9083 | 76902 | SENSE |
| 88 | 513 | CGPG9076 | 76913 | SENSE |
| 89 | 514 | CGPG9108 | 76917 | SENSE |
| 90 | 515 | CGPG9109 | 76929 | SENSE |
| 91 | 516 | CGPG5933 | 77009 | SENSE |
| 92 | 517 | CGPG6335 | 77022 | SENSE |
| 93 | 518 | CGPG9174 | 77108 | SENSE |
| 94 | 519 | CGPG9120 | 77125 | SENSE |
| 95 | 520 | CGPG9200 | 77135 | SENSE |
| 96 | 521 | CGPG9263 | 77219 | SENSE |
| 97 | 522 | CGPG8087 | 77351 | SENSE |
| 98 | 523 | CGPG385 | 14810 | SENSE |
| 99 | 524 | CGPG1857 | 14835 | ANTI-SENSE |
| 100 | 525 | CGPG1788 | 15419 | ANTI-SENSE |
| 101 | 526 | CGPG1966 | 16223 | SENSE |
| 102 | 527 | CGPG1908 | 17903 | SENSE |
| 103 | 528 | CGPG3545 | 18279 | SENSE |
| 104 | 529 | CGPG3557 | 18284 | SENSE |
| 105 | 530 | CGPG3340 | 18332 | SENSE |
| 106 | 531 | CGPG3431 | 18349 | SENSE |
| 107 | 532 | CGPG3530 | 18623 | SENSE |
| 108 | 533 | CGPG3119 | 19551 | SENSE |
| 109 | 534 | CGPG3594 | 19627 | SENSE |
| 110 | 535 | CGPG4031 | 19785 | SENSE |
| 111 | 536 | CGPG4036 | 19944 | SENSE |
| 112 | 537 | CGPG2384 | 70125 | SENSE |
| 113 | 538 | CGPG1598 | 70504 | SENSE |
| 114 | 539 | CGPG560 | 70830 | SENSE |
| 115 | 540 | CGPG4002 | 70943 | SENSE |
| 116 | 541 | CGPG1422 | 71711 | ANTI-SENSE |
| 117 | 542 | CGPG4429 | 71962 | SENSE |
| 118 | 543 | CGPG862 | 72352 | SENSE |
| 119 | 544 | CGPG2251 | 72413 | SENSE |

TABLE 1-continued

| NUC SEQ ID NO | PEP SEQ ID NO | Gene ID | Construct ID | orientation |
|---|---|---|---|---|
| 120 | 545 | CGPG646 | 72603 | SENSE |
| 121 | 546 | CGPG2569 | 72676 | SENSE |
| 122 | 547 | CGPG5507 | 72737 | SENSE |
| 123 | 548 | CGPG5547 | 72742 | SENSE |
| 124 | 549 | CGPG5517 | 72762 | SENSE |
| 125 | 550 | CGPG5792 | 72993 | SENSE |
| 126 | 551 | CGPG5766 | 73031 | SENSE |
| 127 | 552 | CGPG5775 | 73091 | SENSE |
| 128 | 553 | CGPG4809 | 73224 | SENSE |
| 129 | 554 | CGPG4872 | 73340 | SENSE |
| 130 | 555 | CGPG6420 | 73420 | SENSE |
| 131 | 556 | CGPG6402 | 73489 | SENSE |
| 132 | 557 | CGPG5073 | 73750 | SENSE |
| 133 | 558 | CGPG5091 | 73751 | SENSE |
| 134 | 559 | CGPG3570 | 73814 | SENSE |
| 135 | 560 | CGPG4342 | 73855 | SENSE |
| 136 | 561 | CGPG4483 | 73856 | SENSE |
| 137 | 562 | CGPG1527 | 73929 | SENSE |
| 138 | 563 | CGPG4351 | 74063 | SENSE |
| 139 | 564 | CGPG4753 | 74072 | SENSE |
| 140 | 565 | CGPG4757 | 74073 | SENSE |
| 141 | 566 | CGPG4805 | 74075 | SENSE |
| 142 | 567 | CGPG6624 | 74135 | SENSE |
| 143 | 568 | CGPG3161 | 74313 | SENSE |
| 144 | 569 | CGPG3770 | 74315 | SENSE |
| 145 | 570 | CGPG6673 | 74427 | SENSE |
| 146 | 571 | CGPG6702 | 74490 | SENSE |
| 147 | 572 | CGPG21 | 74511 | SENSE |
| 148 | 573 | CGPG6801 | 74531 | SENSE |
| 149 | 574 | CGPG154 | 74532 | SENSE |
| 150 | 575 | CGPG6762 | 74538 | SENSE |
| 151 | 576 | CGPG6763 | 74550 | SENSE |
| 152 | 577 | CGPG1467 | 74579 | SENSE |
| 153 | 578 | CGPG6160 | 74644 | SENSE |
| 154 | 579 | CGPG15 | 74703 | SENSE |
| 155 | 580 | CGPG5825 | 74733 | SENSE |
| 156 | 581 | CGPG5936 | 74749 | SENSE |
| 157 | 582 | CGPG5974 | 74752 | SENSE |
| 158 | 583 | CGPG1366 | 74773 | SENSE |
| 159 | 584 | CGPG7390 | 74896 | SENSE |
| 160 | 585 | CGPG7421 | 74976 | SENSE |
| 161 | 586 | CGPG7446 | 74991 | SENSE |
| 162 | 587 | CGPG6295 | 75289 | SENSE |
| 163 | 588 | CGPG1476 | 76003 | SENSE |
| 164 | 589 | CGPG1821 | 76074 | SENSE |
| 165 | 590 | CGPG6975 | 76137 | SENSE |
| 166 | 591 | CGPG6189 | 76220 | SENSE |
| 167 | 592 | CGPG8868 | 76301 | SENSE |
| 168 | 593 | CGPG8909 | 76318 | SENSE |
| 169 | 594 | CGPG8951 | 76347 | SENSE |
| 170 | 595 | CGPG5892 | 76513 | SENSE |
| 171 | 596 | CGPG7171 | 76566 | SENSE |
| 172 | 597 | CGPG6142 | 76719 | SENSE |
| 173 | 598 | CGPG7212 | 76757 | SENSE |
| 174 | 599 | CGPG9034 | 76891 | SENSE |
| 175 | 600 | CGPG9270 | 77208 | SENSE |
| 176 | 601 | CGPG1112 | 12116 | ANTI-SENSE |
| 177 | 602 | CGPG1284 | 13053 | ANTI-SENSE |
| 178 | 603 | CGPG1640 | 14733 | SENSE |
| 179 | 604 | CGPG2136 | 16132 | SENSE |
| 180 | 605 | CGPG3542 | 18276 | SENSE |
| 181 | 606 | CGPG1691 | 70851 | SENSE |
| 182 | 607 | CGPG4067 | 70941 | SENSE |
| 183 | 608 | CGPG5335 | 72134 | SENSE |
| 184 | 609 | CGPG27 | 72326 | SENSE |
| 185 | 610 | CGPG3441 | 72978 | SENSE |
| 186 | 611 | CGPG4375 | 73619 | SENSE |
| 187 | 612 | CGPG5176 | 73737 | SENSE |
| 188 | 613 | CGPG6637 | 74196 | SENSE |
| 189 | 614 | CGPG661 | 74546 | SENSE |
| 190 | 615 | CGPG869 | 74558 | SENSE |
| 191 | 616 | CGPG6159 | 74643 | SENSE |
| 192 | 617 | CGPG5931 | 75234 | SENSE |
| 193 | 618 | CGPG6282 | 75278 | SENSE |
| 194 | 619 | CGPG7671 | 75585 | SENSE |
| 195 | 620 | CGPG1574 | 76063 | SENSE |
| 196 | 621 | CGPG9294 | 77401 | SENSE |
| 197 | 622 | CGPG2435 | 17808 | SENSE |
| 198 | 623 | CGPG3336 | 18330 | SENSE |
| 199 | 624 | CGPG3613 | 18409 | SENSE |
| 200 | 625 | CGPG4168 | 19813 | SENSE |
| 201 | 626 | CGPG6517 | 73580 | SENSE |
| 202 | 627 | CGPG993 | 73935 | SENSE |
| 203 | 628 | CGPG6631 | 74124 | SENSE |
| 204 | 629 | CGPG5393 | 74725 | SENSE |
| 205 | 630 | CGPG1313 | 76403 | SENSE |
| 206 | 631 | CGPG8150 | 77366 | SENSE |
| 207 | 632 | CGPG1661 | 72414 | SENSE |
| 208 | 633 | CGPG6427 | 73409 | SENSE |
| 209 | 634 | CGPG4906 | 73723 | SENSE |
| 210 | 635 | CGPG5092 | 73747 | SENSE |
| 211 | 636 | CGPG6146 | 74634 | SENSE |
| 212 | 637 | CGPG6022 | 74769 | SENSE |
| 213 | 638 | CGPG5883 | 75232 | SENSE |
| 214 | 639 | CGPG7596 | 75429 | SENSE |
| 215 | 640 | CGPG8248 | 75965 | SENSE |
| 216 | 641 | CGPG8233 | 75975 | SENSE |
| 217 | 642 | CGPG1573 | 76061 | SENSE |
| 218 | 643 | CGPG7141 | 76155 | SENSE |
| 219 | 644 | CGPG8941 | 76322 | SENSE |
| 220 | 645 | CGPG6337 | 76440 | SENSE |
| 221 | 646 | CGPG9005 | 76828 | SENSE |
| 222 | 647 | CGPG9208 | 77136 | SENSE |
| 223 | 648 | CGPG4348 | 77303 | SENSE |
| 224 | 649 | CGPG8099 | 77352 | SENSE |
| 225 | 650 | CGPG618 | 10913 | ANTI-SENSE |
| 226 | 651 | CGPG251 | 10925 | ANTI-SENSE |
| 227 | 652 | CGPG636 | 11357 | SENSE |
| 228 | 653 | CGPG639 | 11358 | SENSE |
| 229 | 654 | CGPG287 | 11432 | ANTI-SENSE |
| 230 | 655 | CGPG893 | 11927 | ANTI-SENSE |
| 231 | 656 | CGPG1122 | 12050 | SENSE |
| 232 | 657 | CGPG657 | 12358 | ANTI-SENSE |
| 233 | 658 | CGPG1489 | 13809 | SENSE |
| 234 | 659 | CGPG2122 | 16877 | SENSE |
| 235 | 660 | CGPG1683 | 18117 | ANTI-SENSE |
| 236 | 661 | CGPG4685 | 71651 | SENSE |
| 237 | 662 | CGPG4729 | 72449 | SENSE |
| 238 | 663 | CGPG4880 | 72649 | SENSE |
| 239 | 664 | CGPG5680 | 73107 | SENSE |
| 240 | 665 | CGPG7317 | 74875 | SENSE |
| 241 | 666 | CGPG4902 | 75079 | SENSE |
| 242 | 667 | CGPG6720 | 75180 | SENSE |
| 243 | 668 | CGPG5850 | 75228 | SENSE |
| 244 | 669 | CGPG6010 | 75246 | SENSE |
| 245 | 670 | CGPG7488 | 75375 | SENSE |
| 246 | 671 | CGPG7592 | 75476 | SENSE |
| 247 | 672 | CGPG7672 | 75502 | SENSE |
| 248 | 673 | CGPG6923 | 75857 | SENSE |
| 249 | 674 | CGPG6988 | 75873 | SENSE |
| 250 | 675 | CGPG1357 | 75970 | SENSE |
| 251 | 676 | CGPG5918 | 76115 | SENSE |
| 252 | 677 | CGPG6020 | 76217 | SENSE |
| 253 | 678 | CGPG7032 | 76287 | SENSE |
| 254 | 679 | CGPG7069 | 76294 | SENSE |
| 255 | 680 | CGPG8900 | 76305 | SENSE |
| 256 | 681 | CGPG8923 | 76391 | SENSE |
| 257 | 682 | CGPG6296 | 76438 | SENSE |
| 258 | 683 | CGPG7053 | 76452 | SENSE |
| 259 | 684 | CGPG7134 | 76563 | SENSE |
| 260 | 685 | CGPG6951 | 77055 | SENSE |
| 261 | 686 | CGPG6994 | 77059 | SENSE |
| 262 | 687 | CGPG7019 | 77062 | SENSE |
| 263 | 688 | CGPG7024 | 77063 | SENSE |
| 264 | 689 | CGPG9255 | 77218 | SENSE |
| 265 | 690 | CGPG9274 | 77256 | SENSE |
| 266 | 691 | CGPG6130 | 77314 | SENSE |
| 267 | 692 | CGPG8074 | 77344 | SENSE |
| 268 | 693 | CGPG8081 | 77348 | SENSE |
| 269 | 694 | CGPG172 | 10443 | ANTI-SENSE |

TABLE 1-continued

| NUC SEQ ID NO | PEP SEQ ID NO | Gene ID | Construct ID | orientation |
|---|---|---|---|---|
| 270 | 695 | CGPG2482 | 17814 | SENSE |
| 271 | 696 | CGPG3222 | 18537 | SENSE |
| 272 | 697 | CGPG3259 | 18831 | SENSE |
| 273 | 698 | CGPG1900 | 19044 | ANTI-SENSE |
| 274 | 699 | CGPG4128 | 19950 | SENSE |
| 275 | 700 | CGPG20 | 70221 | SENSE |
| 276 | 701 | CGPG201 | 71110 | SENSE |
| 277 | 702 | CGPG3420 | 71718 | SENSE |
| 278 | 703 | CGPG4308 | 71838 | SENSE |
| 279 | 704 | CGPG5244 | 72087 | SENSE |
| 280 | 705 | CGPG5538 | 72729 | SENSE |
| 281 | 706 | CGPG3738 | 73302 | SENSE |
| 282 | 707 | CGPG6454 | 73484 | SENSE |
| 283 | 708 | CGPG6530 | 73594 | SENSE |
| 284 | 709 | CGPG5175 | 73736 | SENSE |
| 285 | 710 | CGPG5756 | 74016 | SENSE |
| 286 | 711 | CGPG5361 | 74266 | SENSE |
| 287 | 712 | CGPG6709 | 74479 | SENSE |
| 288 | 713 | CGPG6755 | 74549 | SENSE |
| 289 | 714 | CGPG6765 | 74574 | SENSE |
| 290 | 715 | CGPG6039 | 74607 | SENSE |
| 291 | 716 | CGPG6158 | 74642 | SENSE |
| 292 | 717 | CGPG3578 | 75015 | SENSE |
| 293 | 718 | CGPG7528 | 75380 | SENSE |
| 294 | 719 | CGPG7756 | 75560 | SENSE |
| 295 | 720 | CGPG7663 | 75765 | SENSE |
| 296 | 721 | CGPG8249 | 75977 | SENSE |
| 297 | 722 | CGPG2232 | 76052 | SENSE |
| 298 | 723 | CGPG5494 | 76109 | SENSE |
| 299 | 724 | CGPG5947 | 76116 | SENSE |
| 300 | 725 | CGPG7160 | 76158 | SENSE |
| 301 | 726 | CGPG6262 | 76232 | SENSE |
| 302 | 727 | CGPG6909 | 76269 | SENSE |
| 303 | 728 | CGPG8884 | 76303 | SENSE |
| 304 | 729 | CGPG8965 | 76474 | SENSE |
| 305 | 730 | CGPG5861 | 76529 | SENSE |
| 306 | 731 | CGPG7138 | 76625 | SENSE |
| 307 | 732 | CGPG7246 | 76759 | SENSE |
| 308 | 733 | CGPG5378 | 77026 | SENSE |
| 309 | 734 | CGPG9168 | 77131 | SENSE |
| 310 | 735 | CGPG1505 | 14944 | SENSE |
| 311 | 736 | CGPG3614 | 18410 | SENSE |
| 312 | 737 | CGPG3220 | 18536 | SENSE |
| 313 | 738 | CGPG3062 | 19540 | SENSE |
| 314 | 739 | CGPG3580 | 19624 | SENSE |
| 315 | 740 | CGPG3725 | 70353 | SENSE |
| 316 | 741 | CGPG592 | 71215 | SENSE |
| 317 | 742 | CGPG4417 | 71320 | SENSE |
| 318 | 743 | CGPG2276 | 73076 | SENSE |
| 319 | 744 | CGPG4975 | 73666 | SENSE |
| 320 | 745 | CGPG2790 | 73852 | SENSE |
| 321 | 746 | CGPG4972 | 74080 | SENSE |
| 322 | 747 | CGPG5140 | 74211 | SENSE |
| 323 | 748 | CGPG19 | 74510 | SENSE |
| 324 | 749 | CGPG6769 | 74527 | SENSE |
| 325 | 750 | CGPG6770 | 74539 | SENSE |
| 326 | 751 | CGPG737 | 74556 | SENSE |
| 327 | 752 | CGPG6789 | 74577 | SENSE |
| 328 | 753 | CGPG5374 | 74729 | SENSE |
| 329 | 754 | CGPG5978 | 74753 | SENSE |
| 330 | 755 | CGPG5979 | 74754 | SENSE |
| 331 | 756 | CGPG7447 | 74908 | SENSE |
| 332 | 757 | CGPG948 | 75107 | SENSE |
| 333 | 758 | CGPG6052 | 75254 | SENSE |
| 334 | 759 | CGPG7661 | 75741 | SENSE |
| 335 | 760 | CGPG8261 | 75931 | SENSE |
| 336 | 761 | CGPG5447 | 76207 | SENSE |
| 337 | 762 | CGPG7068 | 76293 | SENSE |
| 338 | 763 | CGPG5938 | 76517 | SENSE |
| 339 | 764 | CGPG7100 | 76559 | SENSE |
| 340 | 765 | CGPG9003 | 76804 | SENSE |
| 341 | 766 | CGPG6299 | 77018 | SENSE |
| 342 | 767 | CGPG9135 | 77115 | SENSE |
| 343 | 768 | CGPG9144 | 77128 | SENSE |
| 344 | 769 | CGPG9194 | 77158 | SENSE |
| 345 | 770 | CGPG9202 | 77159 | SENSE |
| 346 | 771 | CGPG9139 | 77163 | SENSE |
| 347 | 772 | CGPG414 | 10923 | ANTI-SENSE |
| 348 | 773 | CGPG1072 | 14836 | SENSE |
| 349 | 774 | CGPG1986 | 15130 | SENSE |
| 350 | 775 | CGPG2916 | 18214 | SENSE |
| 351 | 776 | CGPG111 | 70236 | SENSE |
| 352 | 777 | CGPG4317 | 70639 | SENSE |
| 353 | 778 | CGPG4387 | 70668 | SENSE |
| 354 | 779 | CGPG4492 | 70674 | SENSE |
| 355 | 780 | CGPG597 | 70804 | SENSE |
| 356 | 781 | CGPG345 | 70821 | SENSE |
| 357 | 782 | CGPG4786 | 72505 | SENSE |
| 358 | 783 | CGPG4998 | 72824 | SENSE |
| 359 | 784 | CGPG5076 | 73283 | SENSE |
| 360 | 785 | CGPG5104 | 73292 | SENSE |
| 361 | 786 | CGPG6502 | 73578 | SENSE |
| 362 | 787 | CGPG6630 | 74112 | SENSE |
| 363 | 788 | CGPG5484 | 74249 | SENSE |
| 364 | 789 | CGPG5394 | 74278 | SENSE |
| 365 | 790 | CGPG6058 | 74359 | SENSE |
| 366 | 791 | CGPG2090 | 74393 | SENSE |
| 367 | 792 | CGPG6664 | 74414 | SENSE |
| 368 | 793 | CGPG7706 | 75530 | SENSE |
| 369 | 794 | CGPG7884 | 75752 | SENSE |
| 370 | 795 | CGPG6965 | 75867 | SENSE |
| 371 | 796 | CGPG1256 | 75910 | SENSE |
| 372 | 797 | CGPG2297 | 76101 | SENSE |
| 373 | 798 | CGPG6246 | 76431 | SENSE |
| 374 | 799 | CGPG9037 | 76832 | SENSE |
| 375 | 800 | CGPG1941 | 16023 | SENSE |
| 376 | 801 | CGPG2055 | 16424 | ANTI-SENSE |
| 377 | 802 | CGPG2427 | 17807 | SENSE |
| 378 | 803 | CGPG386 | 70802 | SENSE |
| 379 | 804 | CGPG393 | 70817 | SENSE |
| 380 | 805 | CGPG609 | 70819 | SENSE |
| 381 | 806 | CGPG4022 | 70908 | SENSE |
| 382 | 807 | CGPG942 | 72351 | SENSE |
| 383 | 808 | CGPG1800 | 73087 | SENSE |
| 384 | 809 | CGPG4783 | 73223 | SENSE |
| 385 | 810 | CGPG3257 | 73709 | SENSE |
| 386 | 811 | CGPG1696 | 73804 | SENSE |
| 387 | 812 | CGPG1982 | 73819 | SENSE |
| 388 | 813 | CGPG3780 | 73851 | SENSE |
| 389 | 814 | CGPG6602 | 74156 | SENSE |
| 390 | 815 | CGPG6621 | 74194 | SENSE |
| 391 | 816 | CGPG5493 | 74252 | SENSE |
| 392 | 817 | CGPG5811 | 74317 | SENSE |
| 393 | 818 | CGPG5902 | 74328 | SENSE |
| 394 | 819 | CGPG6791 | 74506 | SENSE |
| 395 | 820 | CGPG6778 | 74540 | SENSE |
| 396 | 821 | CGPG6166 | 74650 | SENSE |
| 397 | 822 | CGPG3735 | 74718 | SENSE |
| 398 | 823 | CGPG5854 | 74745 | SENSE |
| 399 | 824 | CGPG7451 | 74956 | SENSE |
| 400 | 825 | CGPG5024 | 75076 | SENSE |
| 401 | 826 | CGPG6054 | 75255 | SENSE |
| 402 | 827 | CGPG6207 | 75269 | SENSE |
| 403 | 828 | CGPG7620 | 75432 | SENSE |
| 404 | 829 | CGPG7623 | 75468 | SENSE |
| 405 | 830 | CGPG7775 | 75686 | SENSE |
| 406 | 831 | CGPG73 | 75911 | SENSE |
| 407 | 832 | CGPG2100 | 76064 | SENSE |
| 408 | 833 | CGPG6026 | 76121 | SENSE |
| 409 | 834 | CGPG7269 | 76193 | SENSE |
| 410 | 835 | CGPG6361 | 76237 | SENSE |
| 411 | 836 | CGPG6993 | 76281 | SENSE |
| 412 | 837 | CGPG8899 | 76388 | SENSE |
| 413 | 838 | CGPG6926 | 76557 | SENSE |
| 414 | 839 | CGPG7172 | 76567 | SENSE |
| 415 | 840 | CGPG7129 | 76624 | SENSE |
| 416 | 841 | CGPG7276 | 76764 | SENSE |
| 417 | 842 | CGPG9031 | 76855 | SENSE |
| 418 | 843 | CGPG9105 | 76976 | SENSE |
| 419 | 844 | CGPG9082 | 76985 | SENSE |

TABLE 1-continued

| NUC SEQ ID NO | PEP SEQ ID NO | Gene ID | Construct ID | orientation |
|---|---|---|---|---|
| 420 | 845 | CGPG6212 | 77014 | SENSE |
| 421 | 846 | CGPG9206 | 77112 | SENSE |
| 422 | 847 | CGPG9151 | 77117 | SENSE |
| 423 | 848 | CGPG9129 | 77138 | SENSE |
| 424 | 849 | CGPG9224 | 77226 | SENSE |
| 425 | 850 | CGPG9358 | 77418 | SENSE |

Recombinant DNA

DNA for use in the present invention to improve traits in plants have a nucleotide sequence of SEQ ID NO:1 through SEQ ID NO:425, as well as the homologs of such DNA molecules. A subset of the DNA for gene suppression aspects of the invention includes fragments of the disclosed full polynucleotides consisting of oligonucleotides of 21 or more consecutive nucleotides. Oligonucleotides the larger molecules having a sequence selected from the group consisting of SEQ ID NO:1 through SEQ ID NO:425 are useful as probes and primers for detection of the polynucleotides used in the invention. Also useful in this invention are variants of the DNA. Such variants may be naturally occurring, including DNA from homologous genes from the same or a different species, or may be non-natural variants, for example DNA synthesized using chemical synthesis methods, or generated using recombinant DNA techniques. Degeneracy of the genetic code provides the possibility to substitute at least one base of the protein encoding sequence of a gene with a different base without causing the amino acid sequence of the polypeptide produced from the gene to be changed. Hence, a DNA useful in the present invention may have any base sequence that has been changed from the sequences provided herein by substitution in accordance with degeneracy of the genetic code.

Homologs of the genes providing DNA demonstrated as useful in improving traits in model plants disclosed herein will generally have significant identity with the DNA disclosed herein. DNA is substantially identical to a reference DNA if, when the sequences of the polynucleotides are optimally aligned there is about 60% nucleotide equivalence; more preferably 70%; more preferably 80% equivalence; more preferably 85% equivalence; more preferably 90%; more preferably 95%; and/or more preferably 98% or 99% equivalence over a comparison window. A comparison window is preferably at least 50-100 nucleotides, and more preferably is the entire length of the polynucleotide provided herein. Optimal alignment of sequences for aligning a comparison window may be conducted by algorithms; preferably by computerized implementations of these algorithms (for example, the Wisconsin Genetics Software Package Release 7.0-10.0, Genetics Computer Group, 575 Science Dr., Madison, Wis.). The reference polynucleotide may be a full-length molecule or a portion of a longer molecule. Preferentially, the window of comparison for determining polynucleotide identity of protein encoding sequences is the entire coding region.

Proteins useful for imparting improved traits are entire proteins or at least a sufficient portion of the entire protein to impart the relevant biological activity of the protein. Proteins useful for generation of transgenic plants having improved traits include the proteins with an amino acid sequence provided herein as SEQ ID NO: 426 through SEQ ID NO: 850, as well as homologs of such proteins.

Homologs of the proteins useful in the invention are identified by comparison of the amino acid sequence of the protein to amino acid sequences of proteins from the same or different plant sources, e.g., manually or by using known homology-based search algorithms such as those commonly known and referred to as BLAST, FASTA, and Smith-Waterman. As used herein, a homolog is a protein from the same or a different organism that performs the same biological function as the polypeptide to which it is compared. An orthologous relation between two organisms is not necessarily manifest as a one-to-one correspondence between two genes, because a gene can be duplicated or deleted after organism phylogenetic separation, such as speciation. For a given protein, there may be no ortholog or more than one ortholog. Other complicating factors include alternatively spliced transcripts from the same gene, limited gene identification, redundant copies of the same gene with different sequence lengths or corrected sequence. A local sequence alignment program, e.g., BLAST, can be used to search a database of sequences to find similar sequences, and the summary Expectation value (E-value) used to measure the sequence base similarity. As a protein hit with the best E-value for a particular organism may not necessarily be an ortholog or the only ortholog, a reciprocal BLAST search is used in the present invention to filter hit sequences with significant E-values for ortholog identification. The reciprocal BLAST entails search of the significant hits against a database of amino acid sequences from the base organism that are similar to the sequence of the query protein. A hit is a likely ortholog, when the reciprocal BLAST's best hit is the query protein itself or a protein encoded by a duplicated gene after speciation. Thus, homolog is used herein to describe proteins that are assumed to have functional similarity by inference from sequence base similarity. The relationship of homologs with amino acid sequences of SEQ ID NO: 851 to SEQ ID NO: 33634 to the proteins with amino acid sequences of SEQ ID NO: to 426 to SEQ ID NO: 850 is found in the listing of Table 2.

Other functional homolog proteins differ in one or more amino acids from those of a trait-improving protein disclosed herein as the result of one or more of the well-known conservative amino acid substitutions, e.g., valine is a conservative substitute for alanine and threonine is a conservative substitute for serine. Conservative substitutions for an amino acid within the native sequence can be selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the invention comprises proteins that differ in one or more amino acids from those of a described protein sequence as the result of deletion or insertion of one or more amino acids in a native sequence.

Homologs of the trait-improving proteins disclosed provided herein will generally demonstrate significant sequence identity. Of particular interest are proteins having at least 50% sequence identity, more preferably at least about 70% sequence identity or higher, e.g., at least about 80% sequence identity with an amino acid sequence of SEQ ID NO: 426 through SEQ ID NO: 850. Of course useful proteins also include those with higher identity, e.g., 90% to 99% identity. Identity of protein homologs is determined by optimally aligning the amino acid sequence of a putative protein homolog with a defined amino acid sequence and by calculating the percentage of identical and conservatively substituted amino acids over the window of comparison. The window of comparison for determining identity can be the entire amino acid sequence disclosed herein, e.g., the full sequence of any of SEQ ID NO: 426 through SEQ ID NO: 850.

Genes that are homologous to each other can be grouped into families and included in multiple sequence alignments. Then a consensus sequence for each group can be derived. This analysis enables the derivation of conserved and class- (family) specific residues or motifs that are functionally important. These conserved residues and motifs can be further validated with 3D protein structure if available. The consensus sequence can be used to define the full scope of the invention, e.g., to identify proteins with a homolog relationship. Thus, the present invention contemplates that protein homologs include proteins with an amino acid sequence that has at least 90% identity to such a consensus amino acid sequence sequences.

Promoters

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens*, caulimovirus promoters such as the cauliflower mosaic virus or Figwort mosaic virus promoters. For instance, see U.S. Pat. Nos. 5,858,742 and 5,322,938 which disclose versions of the constitutive promoter derived from cauliflower mosaic virus (CaMV35S), U.S. Pat. No. 5,378,619 which discloses a Figwort Mosaic Virus (FMV) 35S promoter, U.S. Pat. No. 6,437,217 which discloses a maize RS81 promoter, U.S. Pat. No. 5,641,876 which discloses a rice actin promoter, U.S. Pat. No. 6,426,446 which discloses a maize RS324 promoter, U.S. Pat. No. 6,429,362 which discloses a maize PR-1 promoter, U.S. Pat. No. 6,232,526 which discloses a maize A3 promoter, U.S. Pat. No. 6,177,611 which discloses constitutive maize promoters, U.S. Pat. No. 6,433,252 which discloses a maize L3 oleosin promoter, U.S. Pat. No. 6,429,357 which discloses a rice actin 2 promoter and intron, U.S. Pat. No. 5,837,848 which discloses a root specific promoter, U.S. Pat. No. 6,084,089 which discloses cold inducible promoters, U.S. Pat. No. 6,294,714 which discloses light inducible promoters, U.S. Pat. No. 6,140,078 which discloses salt inducible promoters, U.S. Pat. No. 6,252,138 which discloses pathogen inducible promoters, U.S. Pat. No. 6,175,060 which discloses phosphorus deficiency inducible promoters, U.S. Patent Application Publication 2002/0192813A1 which discloses 5', 3' and intron elements useful in the design of effective plant expression vectors, U.S. patent application Ser. No. 09/078,972 which discloses a coixin promoter, U.S. patent application Ser. No. 09/757,089 which discloses a maize chloroplast aldolase promoter, and U.S. patent application Ser. No. 10/739,565 which discloses water-deficit inducible promoters, all of which are incorporated herein by reference. These and numerous other promoters that function in plant cells are known to those skilled in the art and available for use in recombinant polynucleotides of the present invention to provide for expression of desired genes in transgenic plant cells.

Furthermore, the promoters can include multiple "enhancer sequences" to assist in elevating gene expression. Such enhancers are known in the art. By including an enhancer sequence with such constructs, the expression of the selected protein may be enhanced. These enhancers often are found 5' to the start of transcription in a promoter that functions in eukaryotic cells, but can often be inserted in the forward or reverse orientation 5' or 3' to the coding sequence. In some instances, these 5' enhancing elements are introns. Deemed to be particularly useful as enhancers are the 5' introns of the rice actin 1 and rice actin 2 genes. Examples of other enhancers that can be used in accordance with the invention include elements from the CaMV 35S promoter, octopine synthase genes, the maize alcohol dehydrogenase gene, the maize shrunken 1 gene and promoters from non-plant eukaryotes.

In some aspects of the invention it is preferred that the promoter element in the DNA construct be capable of causing sufficient expression to result in the production of an effective amount of a polypeptide in water deficit conditions. Such promoters can be identified and isolated from the regulatory region of plant genes that are over expressed in water deficit conditions. Specific water-deficit-inducible promoters for use in this invention are derived from the 5' regulatory region of genes identified as a heat shock protein 17.5 gene (HSP17.5), an HVA22 gene (HVA22), a Rab17 gene and a cinnamic acid 4-hydroxylase (CA4H) gene (CA4H) of *Zea maize*. Such water-deficit-inducible promoters are disclosed in U.S. application Ser. No. 10/739,565, incorporated herein by reference.

In some aspects of the invention, sufficient expression in plant seed tissues is desired to effect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al., (1997) *Transgenic Res.* 6(2):157-166), globulin 1 (Belanger et al., (1991) *Genetics* 129:863-872), glutelin 1 (Russell (1997) supra), and peroxiredoxin antioxidant (Per1) (Stacy et al., (1996) *Plant Mol Biol.* 31(6): 1205-1216).

In some aspects of the invention, preferential expression in plant green tissues is desired. Promoters of interest for such uses include those from genes such as SSU (Fischhoff, et al., (1992) Plant Mol Biol. 20:81-93), aldolase and pyruvate orthophosphate dikinase (PPDK) (Taniguchi, et al., (2000) *Plant Cell Physiol.* 41(1):42-48).

Gene suppression includes any of the well-known methods for suppressing transcription of a gene or the accumulation of the mRNA corresponding to that gene thereby preventing translation of the transcript into protein. Posttranscriptional gene suppression is mediated by transcription of RNA that forms double-stranded RNA (dsRNA) having homology to a gene targeted for suppression. Suppression can also be achieved by insertion mutations created by transposable elements may also prevent gene function. For example, in many dicot plants, transformation with the T-DNA of *Agrobacterium* may be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants may be screened with polynucleotides encoding the polypeptide of interest to detect mutated plants having an insertion in the gene encoding the polypeptide of interest.

Gene Stacking

The present invention also contemplates that the trait-improving recombinant DNA provided herein can be used in combination with other recombinant DNA to create plants with a multiple desired traits. The combinations generated can include multiple copies of any one or more of the recombinant DNA constructs. These stacked combinations can be created by any method, including but not limited to cross breeding of transgenic plants, or multiple genetic transformation.

Transformation Methods

Numerous methods for producing plant cell nuclei with recombinant DNA are known in the art and may be used in the present invention. Two commonly used methods for plant transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn) and U.S. Pat. No. 6,153,812 (wheat) and *Agrobacterium*-mediated transformation is described in U.S. Pat. No. 5,159,135 (cotton); U.S. Pat. No. 5,824,877 (soybean); U.S. Pat. No. 5,591,616 (corn); and U.S. Pat. No. 6,384,301 (soybean), all of which are incorporated herein by reference. For *Agrobacterium tumefaciens* based plant transformation system, additional elements present on transformation constructs will include T-DNA left and right border sequences to facilitate incorporation of the recombinant polynucleotide into the plant genome.

In general it is preferred to introduce heterologous DNA randomly, i.e., at a non-specific location, in the genome of a target plant line. In special cases it may be useful to target heterologous DNA insertion in order to achieve site-specific integration, e.g., to replace an existing gene in the genome, to use an existing promoter in the plant genome, or to insert a recombinant polynucleotide at a predetermined site known to be active for gene expression. Several site specific recombination systems exist which are known to function implants include cre-lox as disclosed in U.S. Pat. No. 4,959,317 and FLP-FRT as disclosed in U.S. Pat. No. 5,527,695, both incorporated herein by reference.

Transformation methods of this invention are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos and gametic cells such as microspores, pollen, sperm and egg cells. It is contemplated that any cell from which a fertile plant may be regenerated is useful as a recipient cell. Callus may be initiated from tissue sources including, but not limited to, immature embryos, seedling apical meristems, microspores and the like. Cells capable of proliferating as callus are also recipient cells for genetic transformation. Practical transformation methods and materials for making transgenic plants of this invention, e.g., various media and recipient target cells, transformation of immature embryos and subsequent regeneration of fertile transgenic plants are disclosed in U.S. Pat. Nos. 6,194,636 and 6,232,526 and U.S. patent application Ser. No. 09/757,089, which are incorporated herein by reference.

In practice DNA is introduced into only a small percentage of target cell nuclei in any one experiment. Marker genes are used to provide an efficient system for identification of those cells with nuclei that are stably transformed by receiving and integrating a transgenic DNA construct into their genomes. Preferred marker genes provide selective markers that confer resistance to a selective agent, such as an antibiotic or herbicide. Potentially transformed cells with a nucleus of the invention are exposed to the selective agent. In the population of surviving cells will be those cells where, generally, the resistance-conferring gene has been integrated and expressed at sufficient levels to permit cell survival. Cells may be tested further to confirm stable integration of the exogenous DNA in the nucleus. Useful selective marker genes include those conferring resistance to antibiotics such as kanamycin (nptII), hygromycin B (aph IV) and gentamycin (aac3 and aacC4) or resistance to herbicides such as glufosinate (bar or pat) and glyphosate (EPSPS). Examples of such selectable are illustrated in U.S. Pat. Nos. 5,550,318; 5,633,435; 5,780,708 and 6,118,047, all of which are incorporated herein by reference. Screenable markers which provide an ability to visually identify transformants can also be employed, e.g., a gene expressing a colored or fluorescent protein such as a luciferase or green fluorescent protein (GFP) or a gene expressing a beta-glucuronidase or uidA gene (GUS) for which various chromogenic substrates are known. It is also contemplated that combinations of screenable and selectable markers will be useful for identification of transformed cells. See PCT publication WO 99/61129 which discloses use of a gene fusion between a selectable marker gene and a screenable marker gene, e.g., an NPTII gene and a GFP gene.

Cells that survive exposure to the selective agent, or cells that have been scored positive in a screening assay, may be cultured in regeneration media and allowed to mature into plants. Developing plantlets can be transferred to soil less plant growth mix, and hardened off, e.g., in an environmentally controlled chamber at about 85% relative humidity, 600 ppm $CO_2$, and 25-250 microeinsteins $m^{-2}s^{-1}$ of light, prior to transfer to a greenhouse or growth chamber for maturation. Plants are preferably matured either in a growth chamber or greenhouse. Plants are regenerated from about 6 wk to 10 months after a transformant is identified, depending on the initial tissue. During regeneration, cells are grown to plants on solid media at about 19 to 28° C. After regenerating plants have reached the stage of shoot and root development, they may be transferred to a greenhouse for further growth and testing. Plants may be pollinated using conventional plant breeding methods known to those of skill in the art and seed produced.

Progeny may be recovered from transformed plants and tested for expression of the exogenous recombinant polynucleotide. Useful assays include, for example, "molecular biological" assays, such as Southern and Northern blotting and PCR; "biochemical" assays, such as detecting the presence of RNA, e.g., double stranded RNA, or a protein product, e.g., by immunological means (ELISAs and Western blots) or by enzymatic function; plant part assays, such as leaf or root assays; and also, by analyzing the phenotype of the whole regenerated plant.

Discovery of Trait-Improving Recombinant DNA

To identify nuclei with recombinant DNA that confer improved traits to plants, *Arabidopsis thaliana* was transformed with a candidate recombinant DNA construct and screened for an improved trait.

*Arabidopsis thaliana* is used a model for genetics and metabolism in plants. *Arabidopsis* has a small genome, and well-documented studies are available. It is easy to grow in large numbers and mutants defining important genetically controlled mechanisms are either available, or can readily be obtained. Various methods to introduce and express isolated homologous genes are available (see Koncz, e.g., Methods in *Arabidopsis* Research e.g., (1992), World Scientific, New Jersey, New Jersey, in "Preface").

A two-step screening process was employed which comprised two passes of trait characterization to ensure that the trait modification was dependent on expression of the recombinant DNA, but not due to the chromosomal location of the integration of the transgene. Twelve independent transgenic lines for each recombinant DNA construct were established and assayed for the transgene expression levels. Five transgenic lines with high transgene expression levels were used in the first pass screen to evaluate the transgene's function in T2 transgenic plants. Subsequently, three transgenic events, which had been shown to have one or more improved traits, were further evaluated in the second pass screen to confirm the transgene's ability to impart an improved trait. The following Table 3 summarizes the improved traits that have been confirmed as provided by a recombinant DNA construct.

In particular, Table 3 reports:

"PEP SEQ ID" which is the amino acid sequence of the protein cognate to the DNA in the recombinant DNA construct corresponding to a protein sequence of a SEQ ID NO. in the Sequence Listing.

"construct_id" is an arbitrary name for the recombinant DNA describe more particularly in Table 1.

"annotation" refers to a description of the top hit protein obtained from an amino acid sequence query of each PEP SEQ ID NO to GenBank database of the National Center for Biotechnology Information (ncbi). More particularly, "gi" is the GenBank ID number for the top BLAST hit.

"description" refers to the description of the top BLAST hit.

"e-value" provides the expectation value for the BLAST hit.

"identity" refers to the percentage of identically matched amino acid residues along the length of the portion of the sequences which is aligned by BLAST between the sequence of interest provided herein and the hit sequence in GenBank.

"traits" identify by two letter codes the confirmed improvement in a transgenic plant provided by the recombinant DNA. The codes for improved traits are:

"CK" which indicates cold tolerance improvement identified under a cold shock tolerance screen;

"CS" which indicates cold tolerance improvement identified by a cold germination tolerance screen;

"DS" which indicates drought tolerance improvement identified by a soil drought stress tolerance screen;

"PEG" which indicates osmotic stress tolerance improvement identified by a PEG induced osmotic stress tolerance screen;

"HS" which indicates heat stress tolerance improvement identified by a heat stress tolerance screen;

"SS" which indicates high salinity stress tolerance improvement identified by a salt stress tolerance screen;

"LN" which indicates nitrogen use efficiency improvement identified by a limited nitrogen tolerance screen;

"LL" which indicates attenuated shade avoidance response identified by a shade tolerance screen under a low light condition;

"PP" which indicates improved growth and development at early stages identified by an early plant growth and development screen;

"SP" which indicates improved growth and development at late stages identified by a late plant growth and development screen provided herein.

TABLE 3

| PEP SEQ ID NO | e value | % identity | GenBank id | description | trait | | | |
|---|---|---|---|---|---|---|---|---|
| 426 | 1.00E−35 | 100 | gi\|21553646\| | histone H2A | CK | | | |
| 427 | 6.00E−59 | 100 | gi\|7327824\| | ref\|NP_195785.1\| macrophage migration inhibitory factor family protein/MIF family protein [*Arabidopsis thaliana*] | CK | | | |
| 428 | 0 | 99 | gi\|28416663\| | ref\|NP_180648.1\| transducin family protein/ WD-40 repeat family protein | CK | | | |
| 429 | 2.00E−78 | 100 | gi\|23198326\| | gb\|AAN15690.1\|unknown protein [*Arabidopsis thaliana*] | CK | | | |
| 430 | 0 | 100 | gi\|23297810\| | ref\|NP_194910.2\| phototropic-responsive NPH3 family protein | CK | LN | | |
| 431 | 8.00E−48 | 100 | gi\|12248017\| | ref\|NP_173542.1\|small nuclear ribonucleoprotein, putative/snRNP, putative/ Sm protein, putative | CK | | | |
| 432 | 1.00E−126 | 100 | gi\|16323514\| | ref\|NP_187673.1\| diadenosine 5′,5′′′-P1,P4-tetraphosphate hydrolase, putative [*Arabidopsis thaliana*] | CK | CS | PP | HS |

TABLE 3-continued

| PEP SEQ ID NO | e value | % identity | GenBank id | description | trait | | | | |
|---|---|---|---|---|---|---|---|---|---|
| 433 | 0 | 100 | gi\|30679613\| | ref\|NP_172113.1\|DNA-binding bromodomain-containing protein Contains similarity to a Ring3 protein | CK | SS | PEG | | |
| 434 | 2.00E-48 | 100 | gi\|52354271\| | gb\|AAC17827.1\|similar to late embryogenesis abundant proteins | CK | PP | | | |
| 435 | 0 | 100 | gi\|20466169\| | ref\|NP_564623.2\| sodium/calcium exchanger family protein/calcium-binding EF hand family protein | CK | | | | |
| 436 | 2.00E-87 | 100 | gi\|19310829\| | ref\|NP_179396.1\|histone H1-3 (HIS1-3) | CK | | | | |
| 437 | 1.00E-99 | 100 | gi\|21593872\| | ref\|NP_563973.1\| lactoylglutathione lyase family protein/glyoxalase I family protein | CK | | | | |
| 438 | 1.00E-159 | 66 | gi\|15220367\| | ref\|NP_176890.1\|F-box family protein [Arabidopsis thaliana] | CK | CS | HS | | |
| 439 | 0 | 78 | gi\|9757954\| | ref\|NP_199024.1\|expressed protein [Arabidopsis thaliana] | CK | | | | |
| 440 | 5.00E-51 | 100 | gi\|21618078\| | ref\|NP_176371.1\| postsynaptic protein-related [Arabidopsis thaliana] | CK | HS | SS | | |
| 441 | 0 | 100 | gi\|24030234\| | ref\|NP_027420.1\|zinc finger (CCCH-type) family protein [Arabidopsis thaliana] | CK | CS | SS | LL | PEG |
| 442 | 0 | 100 | gi\|21618116\| | ref\|NP_567671.1\|bile acid:sodium symporter family protein | CK | | | | |
| 443 | 1.00E-168 | 100 | gi\|16930405\| | ref\|NP_850182.1\|PUR alpha-1 protein [Arabidopsis thaliana] | CK | PP | HS | SS | |
| 444 | 0 | 83 | gi\|23397029\| | ref\|NP_567709.1\|26S proteasome regulatory subunit, putative (RPN7) | CK | CS | PP | | |
| 445 | 0 | 83 | gi\|30349498\| | ref\|NP_850094.1\|CBL-interacting protein kinase 3 (CIPK3) | CK | SS | PEG | | |
| 446 | 0 | 100 | gi\|9294291\| | dbj\|BAB02193.1\|cytochrome p450 | CK | PP | | | |
| 447 | 0 | 100 | gi\|7270365\| | emb\|CAB80133.1\|cyclin delta-3 | CK | PP | HS | SS | PEG |
| 448 | 0 | 100 | gi\|31580811\| | gb\|AAP51420.1\|ferric-chelate reductase [Arabidopsis thaliana] | CK | | | | |
| 449 | 0 | 99 | gi\|8439909\| | ref\|NP_563791.1\|protein phosphatase 2C family protein/PP2C family protein | CK | | | | |
| 450 | 0 | 100 | gi\|15238701\| | ref\|NP_197894.1\|cytochrome P450 family protein [Arabidopsis thaliana] | CK | DS | | | |
| 451 | 1.00E-178 | 100 | gi\|21553567\| | gb\|AAM62660.1\|unknown [Arabidopsis thaliana] | CK | | | | |
| 452 | 0 | 100 | gi\|23198354\| | ref\|NP_193140.1\| selenium-binding protein, putative [Arabidopsis thaliana] | CK | HS | | | |
| 453 | 0 | 100 | gi\|22655117\| | ref\|NP_565411.2\|calcium-dependent protein kinase isoform 6 (CPK6) | CK | CS | HS | SS | LL |
| 454 | 4.00E-83 | 100 | gi\|21537110\| | ref\|NP_197849.1\| expressed protein [Arabidopsis thaliana] | CK | LN | | | |
| 455 | 1.00E-122 | 100 | gi\|23397082\| | ref\|NP_174418.1\| photosystem I reaction center subunit III family protein | CK | PEG | | | |

TABLE 3-continued

| PEP SEQ ID NO | e value | % identity | GenBank id | annotation description | | trait | |
|---|---|---|---|---|---|---|---|
| 456 | 0 | 100 | gi\|30680112\| | ref\|NP_179369.2\|expressed protein [*Arabidopsis thaliana*] | CK | | |
| 457 | 0 | 100 | gi\|4678321\| | ref\|NP_190390.1\| expressed protein [*Arabidopsis thaliana*] | CK | | |
| 458 | 0 | 100 | gi\|3169180\| | ref\|NP_179889.1\|casein kinase II alpha chain, putative [*Arabidopsis thaliana*] | CK | | |
| 459 | 0 | 100 | gi\|30725494\| | ref\|NP_851182.1\|protein kinase family protein [*Arabidopsis thaliana*] | CK | SS | |
| 460 | 0 | 100 | gi\|26986957\| | ref\|NP_742382.1\|4-aminobutyrate aminotransferase [*Pseudomonas putida* KT2440] | CK | DS | |
| 461 | 0 | 91 | gi\|37526249\| | ref\|NP_929593.1\|4-aminobutyrate aminotransferase (gamma-amino-N-butyrate transaminase) (GABA transaminase) | CK | | |
| 462 | 0 | 83 | gi\|37527865\| | ref\|NP_931210.1\|glutamate synthase [NADPH] small chain (glutamate synthase beta subunit) (NADPH-GOGAT) (GLTS beta chain) | CK | | |
| 463 | 0 | 100 | gi\|23308229\| | ref\|NP_175649.1\|glycosyl hydrolase family 1 protein/ beta-glucosidase, putative a | CK | PP | |
| 464 | 0 | 100 | gi\|30685484\| | ref\|NP_849681.1\|serine/threonine protein phosphatase 2A (PP2A) 55 kDa regulatory subunit B [*Arabidopsis thaliana*] | CK | LL | LN |
| 465 | 0 | 99 | gi\|16080446\| | ref\|NP_391273.1\|phosphoglycerate kinase [*Bacillus subtilis* subsp. *subtilis* str. 168] | CK | PP | |
| 466 | 0 | 100 | gi\|6729016\| | gb\|AAF27012.1\|putative SAR DNA-binding protein-1 [*Arabidopsis thaliana*] | CK | | |
| 467 | 0 | 100 | gi\|42569691\| | ref\|NP_181253.2\|transducin family protein/WD-40 repeat family protein | CK | HS | |
| 468 | 5.00E-96 | 100 | gi\|38603990\| | ref\|NP_177237.1\|C2 domain-containing protein | CK | | |
| 469 | 0 | 100 | gi\|22136622\| | ref\|NP_193273.1\| cytochrome P450 family protein [*Arabidopsis thaliana*] | CK | PP | |
| 470 | 0 | 100 | gi\|22331742\| | ref\|NP_190771.2\|F-box family protein/WD-40 repeat family protein [*Arabidopsis thaliana*] | CK | | |
| 471 | 1.00E-162 | 100 | gi\|7021738\| | ref\|NP_566517.1\|expressed protein [*Arabidopsis thaliana*] | CK CS | SS | |
| 472 | 0 | 98 | gi\|10176804\| | dbj\|BAB09992.1\|serine/threonine protein kinase-like [*Arabidopsis thaliana*] | CK | SS | LL |
| 473 | 0 | 100 | gi\|28827534\| | ref\|NP_568971.1\|leucine-rich repeat transmembrane protein kinase, putative | CK | | |
| 474 | 0 | 100 | gi\|12321664\| | gb\|AAG50866.1\|protein kinase, putative [*Arabidopsis thaliana*] | CK | | |
| 475 | 1.00E-177 | 100 | gi\|2651299\| | ref\|NP_181590.1\|protein kinase family protein | CK | | |

TABLE 3-continued

| PEP SEQ ID NO | e value | % identity | GenBank id | annotation description | trait | | | | |
|---|---|---|---|---|---|---|---|---|---|
| 476 | 0 | 100 | gi\|56381947\| | ref\|NP_564161.1\| phosphoglycerate/bisphosphoglycerate mutase family protein | CK | SS | | | |
| 477 | 0 | 100 | gi\|15075789\| | ref\|NP_386871.1\| PROBABLE PHOSPHOGLYCERATE KINASE PROTEIN | CK | | | | |
| 478 | 0 | 96 | gi\|28872422\| | ref\|NP_795041.1\|glutamine synthetase | CK | CS | | | |
| 479 | 0 | 100 | gi\|21595073\| | ref\|NP_192046.1\|mitogen-activated protein kinase, putative/MAPK, putative (MPK4) | CK | SS | PEG | | |
| 480 | 0 | 100 | gi\|10174347\| | ref\|NP_242595.1\|glutamate synthase (small subunit) | CK | | | | |
| 481 | 0 | 100 | gi\|16081086\| | ref\|NP_391914.1\|ornithine aminotransferase | CK | PP | | | |
| 482 | 0 | 100 | gi\|18400003\| | ref\|NP_564469.1\|WD-40 repeat family protein [Arabidopsis thaliana] | CK | HS | SS | LL | PEG |
| 483 | 0 | 100 | gi\|4559336\| | ref\|NP_181783.1\|protein kinase family protein [Arabidopsis thaliana] | CK | | | | |
| 484 | 0 | 100 | gi\|11994319\| | ref\|NP_188976.1\|casein kinase, putative [Arabidopsis thaliana] | CK | CS | PP | SS | PEG |
| 485 | 0 | 100 | gi\|23507789\| | ref\|NP_176390.1\| mitochondrial transcription termination factor-related/ mTERF-related [Arabidopsis thaliana] | CK | LN | | | |
| 486 | 1.00E-120 | 100 | gi\|10177463\| | dbj\|BAB10854.1\|unnamed protein product [Arabidopsis thaliana] | CK | LL | | | |
| 487 | 0 | 100 | gi\|15221219\| | ref\|NP_177573.1\|protein kinase, putative [Arabidopsis thaliana] | CK | LL | | | |
| 488 | 0 | 100 | gi\|15218854\| | ref\|NP_174217.1\|CBL-interacting protein kinase 18 (CIPK18) | CK | CS | LL | PEG | |
| 489 | 0 | 100 | gi\|22136780\| | ref\|NP_189420.1\| monodehydroascorbate reductase, putative [Arabidopsis thaliana] | CK | PP | LL | | |
| 490 | 1.00E-132 | 100 | gi\|17104619\| | gb\|AAL34198.1\|putative glutathione peroxidase [Arabidopsis thaliana] | CK | | | | |
| 491 | 0 | 100 | gi\|7268589\| | ref\|NP_192114.1\|sugar transporter, putative [Arabidopsis thaliana] | CK | | | | |
| 492 | 0 | 100 | gi\|56381949\| | ref\|NP_200733.2\|sugar transporter family protein [Arabidopsis thaliana] | CK | | | | |
| 493 | 7.00E-60 | 83 | gi\|31433365\| | ref\|NP_922597.1\|unknown protein | CK | SS | LL | | |
| 494 | 1.00E-171 | 79 | gi\|34910712\| | ref\|NP_916703.1\|putative nuclear RNA binding protein A [Oryza sativa | CK | | | | |
| 495 | 1.00E-139 | 100 | gi\|51536564\| | ref\|NP_189139.1\|zinc finger (C3HC4-type RING finger) family protein | CK | PP | | | |
| 496 | 1.00E-136 | 98 | gi\|22995109\| | ref\|ZP_00039591.1\|COG0149: Triosephosphate isomerase | CK | PEG | | | |
| 497 | 0 | 74 | gi\|32488446\| | ref\|XP_473139.1\| OSJNBa0004N05.3 [Oryza sativa (japonica cultivar-group)] | CK | | | | |
| 498 | 0 | 100 | gi\|23126040\| | ref\|ZP_00107950.1\|COG0155: Sulfite reductase, beta subunit (hemoprotein) [Nostoc punctiforme PCC 73102] | CK | | | | |

TABLE 3-continued

| PEP SEQ ID NO | e value | % identity | GenBank id | description | trait | | | |
|---|---|---|---|---|---|---|---|---|
| 499 | 0 | 100 | gi|7287983| | ref|NP_191594.1| armadillo/beta-catenin repeat family protein/F-box family protein [*Arabidopsis thaliana*] | CK | PEG | | |
| 500 | 0 | 100 | gi|9758604| | dbj|BAB09237.1|beta-amylase [*Arabidopsis thaliana*] | CK | | | |
| 501 | 0 | 100 | gi|23463051| | ref|NP_178065.1|inosine-5'-monophosphate dehydrogenase [*Arabidopsis thaliana*] | CK | | | |
| 502 | 1.00E-100 | 77 | gi|55168250| | gb|AAV44116.1|unknown protein [*Oryza sativa* (*japonica* cultivar-group)] | CK | | | |
| 503 | 0 | 83 | gi|50942175| | ref|XP_480615.1|putative aminoimidazolecarboxamide ribonucleotide transformylase | CK | | | |
| 504 | 1.00E-159 | 100 | gi|10177927| | ref|NP_199602.1| respiratory burst oxidase protein D (RbohD)/NADPH oxidase | CK | | | |
| 505 | 1.00E-172 | 86 | gi|57899142| | dbj|BAD87004.1|unknown protein [*Oryza sativa* (*japonica* cultivar-group)] | CK | | | |
| 506 | 0 | 100 | gi|15223469| | ref|NP_171679.1|protein kinase family protein [*Arabidopsis thaliana*] | CK | | | |
| 507 | 0 | 100 | gi|3482918| | ref|NP_172414.1|ATP-citrate synthase (ATP-citrate (pro-S-)-lyase/citrate cleavage enzyme), putative | CK | SS | | |
| 508 | 0 | 100 | gi|23297150| | ref|NP_567724.1|fibrillarin 2 (FIB2) [*Arabidopsis thaliana*] | CK | | | |
| 509 | 0 | 100 | gi|7268631| | ref|NP_193573.1|F-box family protein [*Arabidopsis thaliana*] | CK | LL | PEG | |
| 510 | 6.00E-87 | 79 | gi|21553981| | ref|NP_564267.1|peptidyl-prolyl cis-trans isomerase cyclophilin-type family protein [*Arabidopsis thaliana*] | CK | | | |
| 511 | 1.00E-151 | 68 | gi|34913784| | ref|NP_918239.1|pectate lyase-like protein | CK | | | |
| 512 | 4.00E-91 | 75 | gi|53793523| | dbj|BAD54684.1|unknown protein [*Oryza sativa* (*japonica* cultivar-group)] | CK | | | |
| 513 | 1.00E-41 | 63 | gi|50948309| | ref|XP_483682.1|putative auxin induced protein | CK | LL | | |
| 514 | 1.00E-53 | 58 | gi|56202166| | dbj|BAD73644.1|60S ribosomal protein L18A-like | CK | CS | PEG | |
| 515 | 7.00E-85 | 93 | gi|34910948| | dbj|BAB84492.1|nuclear movement protein-like | CK | | | |
| 516 | 0 | 100 | gi|6513938| | ref|NP_566157.1|nodulin family protein [*Arabidopsis thaliana*] | CK | | | |
| 517 | 1.00E-171 | 100 | gi|6957722| | ref|NP_186908.1|delta 7-sterol-C5-desaturase, putative [*Arabidopsis thaliana*] | CK | LL | | |
| 518 | 0 | 100 | gi|17132051| | ref|NP_486997.1| hypothetical protein alr2957 [*Nostoc* sp. PCC 7120] | CK | PP | | |
| 519 | 0 | 71 | gi|34911116| | ref|NP_916905.1|putative glyoxal oxidase | CK | | | |
| 520 | 6.00E-24 | 42 | gi|4803925| | ref|NP_565499.1|expressed protein [*Arabidopsis thaliana*] | CK | SS | | |
| 521 | 0 | 81 | gi|50934555| | ref|XP_476805.1|unknown protein | CK | SS | LN | PEG |
| 522 | 8.00E-94 | 100 | gi|26453028| | ref|NP_197956.1| expressed protein | CK | PP | SS | PEG |

TABLE 3-continued

| PEP SEQ ID NO | e value | % identity | GenBank id | annotation GenBank id description | trait | | | |
|---|---|---|---|---|---|---|---|---|
| 523 | 1.00E−167 | 100 | gi\|9795142\| | emb\|CAB67657.2\|splicing factor-like protein [*Arabidopsis thaliana*] ref\|NP_190918.3\|zinc knuckle (CCHC-type) family protein [*Arabidopsis thaliana*] | CS | PP | | |
| 524 | 1.00E−146 | 100 | gi\|6642639\| | ref\|NP_187382.1\|forkhead-associated domain-containing protein/FHA domain-containing protein | CS | PEG | | |
| 525 | 0 | 100 | gi\|9279657\| | ref\|NP_188451.1\| octicosapeptide/Phox/Bem1 p (PB1) domain-containing protein [*Arabidopsis thaliana*] | CS | PP | HS | LN |
| 526 | 0 | 100 | gi\|9759010\| | dbj\|BAB09537.1\|unnamed protein product [*Arabidopsis thaliana*] | CS | | | |
| 527 | 0 | 100 | gi\|18390671\| | ref\|NP_563769.1\|F-box family protein | CS | PP | HS | SS |
| 528 | 0 | 100 | gi\|12248033\| | ref\|NP_172880.1\| phytochrome kinase, putative [*Arabidopsis thaliana*] | CS | | | |
| 529 | 0 | 100 | gi\|21554404\| | ref\|NP_179646.1\|DNAJ heat shock family protein [*Arabidopsis thaliana*] | CS | PP | SS | |
| 530 | 1.00E−111 | 100 | gi\|10177521\| | ref\|NP_201441.1\|dehydrin (RAB18) rab18 protein - *Arabidopsis thaliana* sp\|P30185\|DHR18_ARATH Dehydrin Rab18 | CS | PEG | | |
| 531 | 0 | 100 | gi\|20260458\| | dbj\|BAB70612.1\| anthocyanin-related membrane protein 1 | CS | SS | | |
| 532 | 0 | 100 | gi\|21553568\| | ref\|NP_849480.1\|expressed protein | CS | PP | PEG | |
| 533 | 0 | 100 | gi\|21553616\| | ref\|NP_568089.1\| expressed protein | CS | | | |
| 534 | 1.00E−158 | 100 | gi\|21554409\| | ref\|NP_174469.1\|histidine biosynthesis bifunctional protein (HISIE) [*Arabidopsis thaliana*] pir\|\|T51812 phosphoribosyl-AMP cyclohydrolase (EC 3.5.4.19) | CS | | | |
| 535 | 1.00E−156 | 68 | gi\|50949063\| | ref\|XP_493889.1\|putative protein kinase [*Oryza sativa*] | CS | | | |
| 536 | 0 | 76 | gi\|31455393\| | emb\|CAD92450.1\|amino acid permease 6 [*Brassica napus*] | CS | SS | | |
| 537 | 0 | 100 | gi\|6324421\| | sp\|Q12068\|GRE2_YEAST NADPH-dependent methylglyoxal reductase GRE2 (Genes de respuesta a estres protein 2) | CS | | | |
| 538 | 0 | 99 | gi\|18401915\| | ref\|NP_566612.1\|histone deacetylase family protein [*Arabidopsis thaliana*] | CS | | | |
| 539 | 0 | 100 | gi\|30685903\| | ref\|NP_851041.1\|zinc finger (CCCH-type) family protein [*Arabidopsis thaliana*] | CS | PEG | | |
| 540 | 1.00E−134 | 68 | gi\|31432120\| | ref\|NP_921503.1\|putative polyprotein [*Oryza sativa* (*japonica* cultivar-group)] | CS | PP | | |
| 541 | 0 | 100 | gi\|22136556\| | emb\|CAB80464.1\| cinnamyl-alcohol dehydrogenase ELI3-2 [*Arabidopsis thaliana*] | CS | | | |
| 542 | 0 | 100 | gi\|7413528\| | ref\|NP_196086.1\| cytochrome P450, putative [*Arabidopsis thaliana*] | CS | | | |

TABLE 3-continued

| PEP SEQ ID NO | e value | % identity | GenBank id | annotation description | trait | | | |
|---|---|---|---|---|---|---|---|---|
| 543 | 0 | 99 | gi\|42568440\| | ref\|NP_199845.2\|DNA repair protein-related [*Arabidopsis thaliana*] | CS | PEG | | |
| 544 | 0 | 100 | gi\|30102478\| | ref\|NP_195917.1\|hydrolase, alpha/beta fold family protein [*Arabidopsis thaliana*] | CS | PEG | | |
| 545 | 0 | 100 | gi\|21280881\| | ref\|NP_176968.1\|glycerate dehydrogenase/NADH-dependent hydroxypyruvate reductase | CS | HS | SS | PEG |
| 546 | 0 | 100 | gi\|10177967\| | ref\|NP_198904.1\|WD-40 repeat family protein/zfwd3 protein (ZFWD3) [*Arabidopsis thaliana*] | CS | PEG | | |
| 547 | 0 | 100 | gi\|7269306\| | ref\|NP_567705.1\|ubiquitin-specific protease 16, putative (UBP16) | CS | | | |
| 548 | 0 | 99 | gi\|6324066\| | sp\|P53845\|YN03_YEAST Hypothetical 35.5 kDa protein in PIK1-POL2 intergenic region | CS | | | |
| 549 | 0 | 99 | gi\|6323074\| | ref\|NP_013146.1\|Microtubule-associated protein (MAP) of the XMAP215/Dis1 family; regulates microtubule dynamics during spindle orientation and metaphase chromosome alignment; interacts with spindle pole body component Spc72p [*Saccharomyces cerevisiae*] | CS | | | |
| 550 | 0 | 100 | gi\|6324990\| | ref\|NP_015058.1\|Dicarboxylic amino acid permease, mediates high-affinity and high-capacity transport of L-glutamate and L-aspartate; also a transporter for Gln, Asn, Ser, Ala, and Gly [*Saccharomyces cerevisiae*] | CS | PP | | |
| 551 | 0 | 100 | gi\|51013603\| | sp\|P50947\|YNJ7_YEAST Hypothetical 37.0 kDa protein in RAS2-RPS7B intergenic region | CS | PEG | | |
| 552 | 0 | 100 | gi\|6319413\| | ref\|NP_009495.1\|Shp1p [*Saccharomyces cerevisiae*] emb\|CAA80789.1\| YBLO515 [*Saccharomyces cerevisiae*] emb\|CAA84878.1\|SHP1 | CS | | | |
| 553 | 0 | 100 | gi\|22136824\| | ref\|NP_197455.1\| expressed protein [*Arabidopsis thaliana*] | CS | PP | | |
| 554 | 0 | 100 | gi\|22655036\| | ref\|NP_566453.1\|WD-40 repeat family protein [*Arabidopsis thaliana*] | CS | | | |
| 555 | 0 | 100 | gi\|48771699\| | ref\|ZP_00276041.1\|COG1062: Zn-dependent alcohol dehydrogenases, class III [*Ralstonia metallidurans* CH34] | CS | | | |
| 556 | 0 | 100 | gi\|49176169\| | ref\|NP_416429.3\|D-cysteine desulfhydrase, PLP-dependent enzyme cysteine desulfhydrase, PLP-dependent enzyme | CS | | | |
| 557 | 0 | 100 | gi\|9294512\| | gb\|AAK21273.1\|aberrant lateral root formation 5 [*Arabidopsis thaliana*] ref\|NP_566730.1\|MATE efflux family protein [*Arabidopsis thaliana*] | CS | PP | SS | |

TABLE 3-continued

| PEP SEQ ID NO | e value | % identity | GenBank id | description | | trait | |
|---|---|---|---|---|---|---|---|
| 558 | 0 | 100 | gi\|31711972\| | ref\|NP_175641.1\|protein kinase family protein/C-type lectin domain-containing protein | CS | SS | |
| 559 | 8.00E-61 | 100 | gi\|21592962\| | ref\|NP_564579.1\|expressed protein [Arabidopsis thaliana] | CS | SS | |
| 560 | 0 | 100 | gi\|30102452\| | ref\|NP_195770.1\| mitochondrial substrate carrier family protein [Arabidopsis thaliana] | CS | LL | |
| 561 | 0 | 100 | gi\|6056406\| | gb\|AAF02870.1\|Hypothetical protein [Arabidopsis thaliana] | CS | | |
| 562 | 1.00E-143 | 100 | gi\|21689635\| | emb\|CAB78986.1\|lectin like protein [Arabidopsis thaliana] | CS | SS | |
| 563 | 0 | 100 | gi\|22135769\| | ref\|NP_188127.1\| oxidoreductase, zinc-binding dehydrogenase family protein | CS | | |
| 564 | 6.00E-91 | 100 | gi\|21553433\| | ref\|NP_199669.1\|FK506-binding protein 2-2 (FKBP15-2)/immunophilin/peptidyl-prolyl cis-trans isomerase/rotamase | CS | PEG | |
| 565 | 1.00E-151 | 100 | gi\|21592742\| | ref\|NP_195534.1\|expansin, putative (EXP20) | CS | PP | |
| 566 | 8.00E-64 | 100 | gi\|21537125\| | ref\|NP_196975.1\|expressed protein [Arabidopsis thaliana] | CS | | |
| 567 | 1.00E-49 | 100 | gi\|16331623\| | ref\|NP_442351.1\|hypothetical protein ssl0353 [Synechocystis sp. PCC 6803] | CS | LN | |
| 568 | 0 | 100 | gi\|21618054\| | ref\|NP_564383.1\|ABC transporter family protein [Arabidopsis thaliana] | CS | | |
| 569 | 0 | 100 | gi\|7321037\| | ref\|NP_192879.1\| ARID/BRIGHT DNA-binding domain-containing protein/ELM2 domain-containing protein/Myb-like DNA-binding domain-containing protein | CS | PP | SS |
| 570 | 1.00E-44 | 100 | gi\|58299\| | emb\|CAA48415.1\|unnamed protein product [synthetic construct] | CS | | |
| 571 | 0 | 99 | gi\|10172815\| | dbj\|BAB03922.1\|glycine betaine aldehyde dehydrogenase [Bacillus halodurans C-125] | CS | PEG | |
| 572 | 1.00E-165 | 100 | gi\|3928103\| | ref\|NP_181434.1\|aquaporin, putative [Arabidopsis thaliana] | CS | PP | |
| 573 | 0 | 91 | gi\|37524126\| | ref\|NP_927470.1\|phosphoenolpyruvate carboxykinase [ATP] [Photorhabdus luminescens subsp. laumondii TTO1] | CS | | |
| 574 | 0 | 100 | gi\|9293860\| | ref\|NP_564217.1\|lysine and histidine specific transporter, putative [Arabidopsis thaliana] | CS | | |
| 575 | 0 | 100 | gi\|10175358\| | ref\|NP_243603.1\|1-pyrroline-5-carboxylate dehydrogenase [Bacillus halodurans C-125] | CS | | |
| 576 | 0 | 100 | gi\|10175785\| | ref\|NP_244029.1\|pyruvate kinase [Bacillus halodurans C-125] | CS | PP | |
| 577 | 8.00E-45 | 100 | gi\|9758890\| | dbj\|BAB09466.1\|auxin-induced protein-like [Arabidopsis thaliana] | CS | | |

TABLE 3-continued

| PEP SEQ ID NO | e value | % identity | GenBank id | description | | trait | | |
|---|---|---|---|---|---|---|---|---|
| 578 | 1.00E−108 | 100 | gi\|17104761\| | ref\|NP_193699.1\|Ras-related GTP-binding protein, putative [*Arabidopsis thaliana*] | CS | LN | | |
| 579 | 0 | 100 | gi\|5915859\| | sp\|O22203\|C98A3__ARATH Cytochrome P450 98A3 | CS | | | |
| 580 | 0 | 100 | gi\|6729015\| | ref\|NP_187156.1\|protein kinase family protein [*Arabidopsis thaliana*] | CS | SS | PEG | |
| 581 | 0 | 100 | gi\|21689671\| | ref\|NP_195397.1\| transporter-related [*Arabidopsis thaliana*] | CS | PP | SS | |
| 582 | 0 | 100 | gi\|20148451\| | ref\|NP_564797.1\|flavin-containing monooxygenase family protein/FMO family protein | CS | SS | PEG | |
| 583 | 0 | 100 | gi\|21280977\| | gb\|AAM45011.1\|putative protein kinase [*Arabidopsis thaliana*] | CS | | | |
| 584 | 1.00E−116 | 82 | gi\|27452901\| | gb\|AAO15285.1\|Putative dihydrodipicolinate reductase-like protein [*Oryza sativa* (*japonica* cultivar-group)] | CS | | | |
| 585 | 1.00E−123 | 99 | gi\|23113896\| | ref\|ZP_00099233.1\|COG0036: Pentose-5-phosphate-3-epimerase [*Desulfitobacterium hafniense* DCB-2] | CS | | | |
| 586 | 8.00E−95 | 99 | gi\|16330731\| | \|YCF3_SYNY3 Photosystem I assembly protein ycf3 | CS | | | |
| 587 | 0 | 100 | gi\|21700831\| | ref\|NP_191332.2\|protein kinase, putative [*Arabidopsis thaliana*] | CS | DS | SS | PEG |
| 588 | 0 | 100 | gi\|4415911\| | gb\|AAD20142.1\|putative poly(A) binding protein [*Arabidopsis thaliana*] | CS | | | |
| 589 | 0 | 100 | gi\|5733869\| | gb\|AAD49757.1\|Contains F-box domain PF\|00646. [*Arabidopsis thaliana*] | CS | | | |
| 590 | 1.00E−149 | 100 | gi\|29824243\| | ref\|NP_192170.1\|tryptophan synthase, alpha subunit, putative [*Arabidopsis thaliana*] | CS | | | |
| 591 | 0 | 100 | gi\|26449849\| | ref\|NP_198924.1\| glycerophosphoryl diester phosphodiesterase family protein | CS | HS | | |
| 592 | 0 | 78 | gi\|56783874\| | dbj\|BAD81286.1\|putative dual specificity kinase 1 | CS | | | |
| 593 | 0 | 100 | gi\|6321857\| | ref\|NP_011933.1\|Ssf1p [*Saccharomyces cerevisiae*] sp\|P38789\|SSF1_YEAST Ribosome biogenesis protein SSF1 | CS | DS | | |
| 594 | 1.00E−180 | 89 | gi\|50906987\| | ref\|XP_464982.1\|lipase class 3-like [*Oryza sativa* (*japonica* cultivar-group)] dbj\|BAD21500.1\|lipase class 3-like [*Oryza sativa* (*japonica* cultivar-group)] | CS | | | |
| 595 | 0 | 100 | gi\|2558659\| | gb\|AAB81672.1\|putative protein kinase [*Arabidopsis thaliana*] | CS | HS | PEG | |
| 596 | 0 | 100 | gi\|9758547\| | ref\|NP_201503.1\| expressed protein [*Arabidopsis thaliana*] | CS | | | |
| 597 | 0 | 100 | gi\|4678335\| | ref\|NP_190376.1\|L-galactono-1,4-lactone dehydrogenase, putative | CS | SS | | |
| 598 | 1.00E−173 | 100 | gi\|21553608\| | ref\|NP_564800.1\|expressed protein [*Arabidopsis thaliana*] | CS | | | |

TABLE 3-continued

| PEP SEQ ID NO | e value | % identity | GenBank id | description | annotation | | | |
|---|---|---|---|---|---|---|---|---|
| | | | | | trait | | | |
| 599 | 0 | 79 | gi|50912531| | ref|XP_467673.1|putative nicastrin [*Oryza sativa* (*japonica* cultivar-group)] | CS | DS | SS | PEG |
| 600 | 0 | 80 | gi|50898642| | ref|XP_450109.1|nodulation receptor kinase-like protein | CS | PP | SS | |
| 601 | 5.00E-74 | 100 | gi|30693828| | ref|NP_850693.1|expressed protein [*Arabidopsis thaliana*] | DS | | | |
| 602 | 0 | 100 | gi|25054896| | ref|NP_179923.2| nicotinate phosphoribosyltransferase family protein/NAPRTase family protein [*Arabidopsis thaliana*] | DS | | | |
| 603 | 1.00E-121 | 100 | gi|6006854| | gb|AAF00630.1|hypothetical protein [*Arabidopsis thaliana*] | DS | LN | | |
| 604 | 0 | 100 | gi|6862917| | ref|NP_566273.1|heavy-metal-associated domain-containing protein | DS | | | |
| 605 | 0 | 100 | gi|56382003| | ref|NP_177794.1|12-oxophytodienoate reductase (OPR1) [*Arabidopsis thaliana*] | DS | | | |
| 606 | 0 | 100 | gi|21280825| | gb|AAM45040.1|putative AtMlo-h1 protein [*Arabidopsis thaliana*] | DS | | | |
| 607 | 0 | 61 | gi|22136432| | ref|NP_191438.2|glycosyl transferase family 8 protein [*Arabidopsis thaliana*] | DS | SS | | |
| 608 | 0 | 69 | gi|22136270| | ref|NP_190235.1| armadillo/beta-catenin repeat family protein/U-box domain-containing family protein | DS | | | |
| 609 | 0 | 100 | gi|4678377| | ref|NP_193087.1| ammonium transporter 1, member 1 (AMT1.1) | DS | | | |
| 610 | 1.00E-143 | 99 | gi|27754217| | ref|NP_187413.1|expressed protein [*Arabidopsis thaliana*] | DS | LN | PEG | |
| 611 | 1.00E-123 | 100 | gi|21554344| | ref|NP_198627.1|ASF1-like anti-silencing family protein [*Arabidopsis thaliana*] | DS | PP | HS | |
| 612 | 0 | 77 | gi|25402857| | pir||A86318protein F15H18.11 [imported] - *Arabidopsis thaliana* gb|AAF25996.1|F15H18.11 | DS | PP | | |
| 613 | 1.00E-139 | 99 | gi|16329950| | ref|NP_440678.1|hypothetical protein slr1900 [*Synechocystis* sp. PCC 6803] | DS | | | |
| 614 | 0 | 100 | gi|30725526| | gb|AAP37785.1|At4g24520 [*Arabidopsis thaliana*] emb|CAB79362.1|NADPH-ferrihemoprotein reductase ATR1 | DS | SS | | |
| 615 | 0 | 98 | gi|3335345| | gb|AAC27147.1|Contains similarity to ABC transporter gb|1651790 from *Synechocystis* sp. | DS | LL | PEG | |
| 616 | 1.00E-120 | 100 | gi|38603932| | ref|NP_193578.1|Ras-related GTP-binding protein, putative [*Arabidopsis thaliana*] | DS | | | |
| 617 | 0 | 100 | gi|15810337| | ref|NP_565310.1|expressed protein [*Arabidopsis thaliana*] | DS | PEG | | |
| 618 | 0 | 100 | gi|8978074| | ref|NP_199518.1|protein kinase, putative [*Arabidopsis thaliana*] | DS | | | |

TABLE 3-continued

| PEP SEQ ID NO | e value | % identity | GenBank id | description | annotation | | trait | |
|---|---|---|---|---|---|---|---|---|
| 619 | 0 | 75 | gi\|9294678\| | dbj\|BAB03027.1\|glutamine-fructose-6-phosphate transaminase 2 [*Arabidopsis thaliana*] | DS | | | |
| 620 | 0 | 100 | gi\|42567142\| | ref\|NP_194265.2\|EXS family protein/ ERD1/XPR1/SYG1 family protein [*Arabidopsis thaliana*] gb\|AAR99486.1\| PHO1-like protein [*Arabidopsis thaliana*] | DS | | | |
| 621 | 1.00E-151 | 89 | gi\|50938765\| | ref\|XP_478910.1\|serine/threonine protein kinase PKPA-like protein [*Oryza sativa* | DS | SS | PEG | |
| 622 | 0 | 100 | gi\|16323410\| | gb\|AAD49980.1\|Similar to gb\|AF110333 PrMC3 protein from *Pinus radiata* and is a member of PF\|00135 Carboxylesterases family. | HS | | | |
| 623 | 7.00E-86 | 100 | gi\|23397128\| | ref\|NP_178620.1\|glycine-rich protein (GRP) [*Arabidopsis thaliana*] | HS | SS | | |
| 624 | 1.00E-104 | 100 | gi\|24417354\| | ref\|NP_564833.1\| expressed protein [*Arabidopsis thaliana*] | HS | | | |
| 625 | 1.00E-48 | 57 | gi\|21553397\| | ref\|NP_180326.1\|zinc finger (AN1-like) family protein [*Arabidopsis thaliana*] | HS | | | |
| 626 | 0 | 100 | gi\|16130575\| | ref\|NP_417147.1\|succinate-semialdehyde dehydrogenase I, NADP-dependent [*Escherichia coli* K12] | HS | | | |
| 627 | 0 | 100 | gi\|15218645\| | ref\|NP_176713.1\|cytochrome P450, putative [*Arabidopsis thaliana*] | HS | PEG | | |
| 628 | 0 | 100 | gi\|16329269\| | ref\|NP_439997.1\|hypothetical protein slr0731 [*Synechocystis* sp. PCC 6803] | HS | | | |
| 629 | 0 | 99 | gi\|12322845\| | gb\|AAG51407.1\|putative cysteine synthase; 39489-37437 [*Arabidopsis thaliana*] | HS | | | |
| 630 | 1.00E-126 | 100 | gi\|28827686\| | gb\|AAO50687.1\|unknown protein [*Arabidopsis thaliana*] | HS | PEG | | |
| 631 | 1.00E-143 | 100 | gi\|23197714\| | ref\|NP_196259.2\|DNAJ heat shock N-terminal domain-containing protein | HS | SS | LL | |
| 632 | 0 | 100 | gi\|21554091\| | gb\|AAM63172.1\|putative integral membrane protein [*Arabidopsis thaliana*] | LL | | | |
| 633 | 0 | 100 | gi\|16329756\| | ref\|NP_440484.1\|formaldehyde dehydrogenase (glutathione) | LL | | | |
| 634 | 0 | 100 | gi\|26450489\| | ref\|NP_190148.1\| transducin family protein/ WD-40 repeat family protein | LL | | | |
| 635 | 0 | 100 | gi\|3980410\| | ref\|NP_180485.1\|lectin protein kinase, putative [*Arabidopsis thaliana*] | LL | LN | | |
| 636 | 1.00E-153 | 100 | gi\|6572061\| | ref\|NP_190708.1\| expressed protein [*Arabidopsis thaliana*] | LL | LN | | |
| 637 | 1.00E-141 | 100 | gi\|22328141\| | ref\|NP_201402.2\|heterogeneous nuclear ribonucleoprotein, putative/ hnRNP, putative | LL | LN | | |
| 638 | 0 | 100 | gi\|15219657\| | ref\|NP_176819.1\|protein kinase family protein [*Arabidopsis thaliana*] | LL | | | |

TABLE 3-continued

| PEP SEQ ID NO | e value | % identity | GenBank id | description | | trait | |
|---|---|---|---|---|---|---|---|
| 639 | 5.00E−53 | 55 | gi\|34906632\| | ref\|NP_914663.1\|P0431G06.11 [*Oryza sativa* (*japonica* cultivar-group)] | LL | | |
| 640 | 1.00E−169 | 100 | gi\|21674686\| | ref\|NP_662751.1\|6-phosphogluconate dehydrogenase, decarboxylating, putative [*Chlorobium tepidum* TLS] | LL | | |
| 641 | 1.00E−69 | 96 | gi\|32490260\| | ref\|XP_473078.1\| OSJNBa0014K14.9 [*Oryza sativa* (*japonica* cultivar-group)] | LL | PEG | |
| 642 | 0 | 100 | gi\|52354393\| | gb\|AAU44517.1\|hypothetical protein AT4G22980 [*Arabidopsis thaliana*] | LL | PEG | |
| 643 | 2.00E−90 | 100 | gi\|9758347\| | ref\|NP_200586.1\|expressed protein [*Arabidopsis thaliana*] | LL | LN | |
| 644 | 0 | 82 | gi\|50946759\| | ref\|XP_482907.1\|putative glycoprotein 3-alpha-L-fucosyltransferase | LL | LN | |
| 645 | 1.00E−131 | 83 | gi\|7269121\| | emb\|CAB79230.1\|predicted protein [*Arabidopsis thaliana*] | LL | | |
| 646 | 1.00E−130 | 88 | gi\|50929089\| | ref\|XP_474072.1\|OSJNBb0079B02.14 [*Oryza sativa* (*japonica* cultivar-group)] | LL | LN | |
| 647 | 0 | 100 | gi\|10176523\| | ref\|NP_244766.1\|acetyl-CoA: acetoacetyl-CoA transferase [*Bacillus halodurans* C-125] | LL | | |
| 648 | 0 | 100 | gi\|34365735\| | ref\|NP_566384.1\| xanthine/uracil permease family protein [*Arabidopsis thaliana*] | LL | | |
| 649 | 1.00E−84 | 100 | gi\|10177539\| | ref\|NP_201459.1\|expressed protein [*Arabidopsis thaliana*] | LL | | |
| 650 | 1.00E−137 | 100 | gi\|21537398\| | ref\|NP_201145.1\|adenylate kinase [*Arabidopsis thaliana*] | LN | | |
| 651 | 0 | 100 | gi\|10177005\| | ref\|NP_851136.1\| cytochrome P450 family protein [*Arabidopsis thaliana*] | LN | | |
| 652 | 0 | 99 | gi\|9758597\| | ref\|NP_851196.1\|outward rectifying potassium channel (KCO1) [*Arabidopsis thaliana*] | LN | | |
| 653 | 1.00E−126 | 100 | gi\|20453405\| | ref\|NP_180901.1\|plastid developmental protein DAG, putative [*Arabidopsis thaliana*] | LN | | |
| 654 | 0 | 100 | gi\|7378631\| | ref\|NP_195967.1\| serine/threonine protein phosphatase 2A (PP2A) regulatory subunit B' (B'alpha) | LN | | |
| 655 | 0 | 100 | gi\|50058955\| | gb\|AAT69222.1\|hypothetical protein At2g30900 [*Arabidopsis thaliana*] | LN | | |
| 656 | 3.00E−36 | 100 | gi\|26453058\| | ]ref\|NP_191804.1\| expressed protein [*Arabidopsis thaliana*] | LN | | |
| 657 | 0 | 100 | gi\|28973131\| | ref\|NP_190313.1\| phosphoinositide-specific phospholipase C family protein | LN | | |
| 658 | 0 | 100 | gi\|23297411\| | gb\|AAN12963.1\|enolase (2-phospho-D-glycerate hydroylase) [*Arabidopsis thaliana*] | LN | | |

TABLE 3-continued

| PEP SEQ ID NO | e value | % identity | GenBank id | description | trait |
|---|---|---|---|---|---|
| 659 | 1.00E−157 | 100 | gi\|22136938\| | ref\|NP_566528.1\|expressed protein [*Arabidopsis thaliana*] | LN |
| 660 | 0 | 100 | gi\|9294186\| | ref\|NP_566763.1\|auxin-responsive family protein [*Arabidopsis thaliana*] | LN |
| 661 | 0 | 100 | gi\|7269372\| | ref\|NP_194252.1\| transporter, putative [*Arabidopsis thaliana*] | LN |
| 662 | 3.00E−93 | 100 | gi\|28393887\| | ref\|NP_182046.1\|auxin-responsive protein-related [*Arabidopsis thaliana*] | LN |
| 663 | 0 | 100 | gi\|4725942\| | ref\|NP_192980.1\|trehalose-6-phosphate phosphatase, putative | LN |
| 664 | 0 | 100 | gi\|15074657\| | ref\|NP_385829.1\| PROBABLE AMINOTRANSFERASE PROTEIN | LN |
| 665 | 1.00E−179 | 81 | gi\|35215000\| | ref\|NP_927371.1\| glutathione dependent formaldehyde dehydrogenase | LN |
| 666 | 1.00E−142 | 100 | gi\|23507799\| | ref\|NP_565973.1\|LOB domain protein 16/lateral organ boundaries domain protein 16 | LN |
| 667 | 0 | 99 | gi\|48731145\| | ref\|ZP_00264891.1\|COG1012: NAD-dependent aldehyde dehydrogenases [*Pseudomonas fluorescens* PfO-1] | LN |
| 668 | 0 | 99 | gi\|15223033\| | ref\|NP_177763.1\|protein kinase, putative [*Arabidopsis thaliana*] | LN |
| 669 | 0 | 100 | gi\|22137136\| | ref\|NP_181639.1\|RNA recognition motif (RRM)-containing protein | LN |
| 670 | 0 | 100 | gi\|50904773\| | ref\|XP_463875.1\|putative iron-phytosiderophore transporter protein yellow stripe 1 | LN |
| 671 | 5.00E−40 | 48 | gi\|15232064\| | ref\|NP_189339.1\|expressed protein [*Arabidopsis thaliana*] | LN |
| 672 | 0 | 88 | gi\|51535369\| | dbj\|BAD37240.1\|putative phosphotyrosyl phosphatase activator [*Oryza sativa* (*japonica* cultivar-group)] | LN |
| 673 | 8.00E−93 | 100 | gi\|21555349\| | ref\|NP_190798.1\|ATP synthase D chain-related [*Arabidopsis thaliana*] | LN |
| 674 | 0 | 100 | gi\|9795597\| | ref\|NP_173294.1\| sulfotransferase family protein [*Arabidopsis thaliana*] | LN |
| 675 | 0 | 100 | gi\|42567054\| | ref\|NP_194058.2\|protein kinase family protein [*Arabidopsis thaliana*] | LN |
| 676 | 0 | 100 | gi\|31711846\| | ref\|NP_177412.1\| cinnamyl-alcohol dehydrogenase, putative | LN |
| 677 | 0 | 100 | gi\|23308375\| | ref\|NP_851141.1\|RNA recognition motif (RRM)-containing protein | LN |
| 678 | 0 | 100 | gi\|7329658\| | emb\|CAB82755.1\|protein kinase ATN1-like protein [*Arabidopsis thaliana*] | LN |
| 679 | 0 | 100 | gi\|22655386\| | ref\|NP_197288.1\|cation exchanger, putative (CAX7) [*Arabidopsis thaliana*] | LN |

TABLE 3-continued

| PEP SEQ ID NO | e value | % identity | GenBank id | annotation description | | trait |
|---|---|---|---|---|---|---|
| 680 | 1.00E−162 | 100 | gi\|20197230\| | gb\|AAM14984.1\|high affinity K+ transporter (AtKUP1 AtKT1p) [*Arabidopsis thaliana*] | LN | |
| 681 | 0 | 100 | gi\|15219169\| | ref\|NP_175713.1\|protein kinase family protein [*Arabidopsis thaliana*] | LN | |
| 682 | 0 | 100 | gi\|9758951\| | ref\|NP_568809.2\|protein kinase family protein [*Arabidopsis thaliana*] | LN | |
| 683 | 0 | 100 | gi\|7573368\| | ref\|NP_196762.1\|expressed protein [*Arabidopsis thaliana*] | LN | |
| 684 | 0 | 100 | gi\|20259017\| | ref\|NP_200323.1\| expressed protein [*Arabidopsis thaliana*] | LN | |
| 685 | 6.00E−80 | 100 | gi\|30793811\| | ref\|NP_191519.1\|DNA-directed RNA polymerase I, II, and III, putative | LN | PEG |
| 686 | 0 | 100 | gi\|7268609\| | ref\|NP_193550.1\|outward rectifying potassium channel, putative (KCO6) | LN | |
| 687 | 1.00E−111 | 71 | gi\|7270315\| | ref\|NP_195093.1\|L-galactose dehydrogenase (L-GalDH) [*Arabidopsis thaliana*] | LN | |
| 688 | 5.00E−98 | 100 | gi\|29824277\| | ref\|NP_568016.1\|expressed protein [*Arabidopsis thaliana*] | LN | |
| 689 | 1.00E−170 | 69 | gi\|7269325\| | emb\|CAB79384.1\|protein kinase (AFC2) [*Arabidopsis thaliana*] | LN | |
| 690 | 3.00E−96 | 79 | gi\|57899263\| | dbj\|BAD87508.1\|putative calcyclin-binding protein [*Oryza sativa (japonica cultivar-group)*] | LN | |
| 691 | 1.00E−164 | 100 | gi\|11994637\| | emb\|CAD44270.1\| monomeric G-protein [*Arabidopsis thaliana*] | LN | |
| 692 | 1.00E−109 | 100 | gi\|7269377\| | ref\|NP_194256.1\| invertase/pectin methylesterase inhibitor family protein | LN | |
| 693 | 1.00E−57 | 100 | gi\|7340686\| | ref\|NP_195832.1\|thylakoid membrane one helix protein (OHP) [*Arabidopsis thaliana*] | LN | |
| 694 | 0 | 100 | gi\|21689839\| | gb\|AAM67563.1\|putative protein transport protein SEC12p [*Arabidopsis thaliana*] | PEG | |
| 695 | 1.00E−36 | 100 | gi\|10177015\| | ref\|NP_199045.1\|ubiquitin family protein [*Arabidopsis thaliana*] | PEG | |
| 696 | 1.00E−106 | 100 | gi\|20466087\| | ref\|NP_179457.1\|zinc finger (C3HC4-type RING finger) family protein | PEG | |
| 697 | 0 | 100 | gi\|7267203\| | ref\|NP_192355.1\|aspartyl protease family protein [*Arabidopsis thaliana*] | PEG | |
| 698 | 0 | 100 | gi\|46931342\| | ref\|NP_850347.1\|F-box family protein [*Arabidopsis thaliana*] | PEG | |
| 699 | 0 | 60 | gi\|46931354\| | gb\|AAT06481.1\|At3g23540 [*Arabidopsis thaliana*] | PEG | |
| 700 | 1.00E−161 | 100 | gi\|21594556\| | gb\|AAM66021.1\|plasma membrane intrinsic protein SIMIP [*Arabidopsis thaliana*] | PEG | |
| 701 | 0 | 100 | gi\|902923\| | dbj\|BAA07547.1\|phosphoinositide specific phospholipase C [*Arabidopsis thaliana*] | PEG | |

TABLE 3-continued

| PEP SEQ ID NO | e value | % identity | GenBank id | annotation description | trait |
|---|---|---|---|---|---|
| 702 | 0 | 100 | gi|26449713| | ref|NP_195154.2|transducin family protein/WD-40 repeat family protein | PEG |
| 703 | 0 | 94 | gi|15232616| | ref|NP_188176.1|phototropic-responsive NPH3 family protein [Arabidopsis thaliana] | PEG |
| 704 | 0 | 100 | gi|23296692| | ref|NP_189177.1|formin homology 2 domain-containing protein/FH2 domain-containing protein [Arabidopsis thaliana] | PEG |
| 705 | 0 | 100 | gi|51013899| | ref|NP_015238.1|Ydc1p [Saccharomyces cerevisiae] gb|AAB68212.1|Lpg21p gb|AAG22594.1|alkaline ceramidase Ydc1p | PEG |
| 706 | 0 | 100 | gi|23297093| | ref|NP_565508.1|fructose-bisphosphate aldolase, putative [Arabidopsis thaliana] | PEG |
| 707 | 0 | 99 | gi|6322722| | ref|NP_012795.1|Pgm1p [Saccharomyces cerevisiae] emb|CAA50895.1| phosphoglucomutase | PEG |
| 708 | 0 | 99 | gi|10175338| | ref|NP_243583.1| glutaminase [Bacillus halodurans C-125] | PEG |
| 709 | 0 | 94 | gi|7268277| | ref|NP_193265.1| cytochrome P450 family protein [Arabidopsis thaliana] | PEG |
| 710 | 0 | 100 | gi|6322296| | sp|P38970|HAL5_YEAST Serine/threonine-protein kinase HAL5 | PEG |
| 711 | 0 | 100 | gi|17104779| | ref|NP_564866.1|U-box domain-containing protein | PEG |
| 712 | 0 | 99 | gi|16080934| | ref|NP_391762.1|aldehyde dehydrogenase [Bacillus subtilis subsp. subtilis str. 168] | PEG |
| 713 | 0 | 87 | gi|37524894| | ref|NP_928238.1|glutamate-1-semialdehyde 2,1-aminomutase [Photorhabdus luminescens subsp. laumondii TTO1] | PEG |
| 714 | 0 | 100 | gi|16077848| | ref|NP_388662.1|trehalose-6-phosphate hydrolase [Bacillus subtilis subsp. subtilis str. 168] | PEG |
| 715 | 1.00E-81 | 100 | gi|1922244| | ref|NP_171654.1|late embryogenesis abundant protein, putative/LEA protein, putative | PEG |
| 716 | 1.00E-112 | 100 | gi|7268505| | ref|NP_193486.1|Ras-related GTP-binding protein, putative [Arabidopsis thaliana] | PEG |
| 717 | 3.00E-44 | 100 | gi|21592597| | ref|NP_563987.1| expressed protein [Arabidopsis thaliana] gb|AAF18498.1|Identical to gb|Y10291 GAG1 protein | PEG |
| 718 | 3.00E-97 | 44 | gi|52353666| | gb|AAU44232.1|hypothetical protein [Oryza sativa (japonica cultivar-group)] | PEG |
| 719 | 1.00E-175 | 63 | gi|53850529| | gb|AAC31235.1| hypothetical protein [Arabidopsis thaliana] gb|AAT71954.1| | PEG |
| 720 | 1.00E-131 | 99 | gi|16330417| | ref|NP_441145.1|hypothetical protein sll1162 [Synechocystis sp. PCC 6803] | PEG |

TABLE 3-continued

| PEP SEQ ID NO | e value | % identity | GenBank id | annotation description | | | trait | | |
|---|---|---|---|---|---|---|---|---|---|
| 721 | 0 | 100 | gi\|17129862\| | ref\|NP_484561.1\| fructokinase [*Nostoc* sp. PCC 7120] | | | PEG | | |
| 722 | 0 | 100 | gi\|15293245\| | ref\|NP_567109.1\|COP9 signalosome complex subunit 1/CSN complex subunit 1 (CSN1)/COP11 protein (COP11)/FUSCA protein (FUS6) [*Arabidopsis thaliana*] | | | PEG | | |
| 723 | 0 | 100 | gi\|20259583\| | ref\|NP_180431.1\|beta-ketoacyl-CoA synthase family protein [*Arabidopsis thaliana*] | | | PEG | | |
| 724 | 0 | 100 | gi\|20465963\| | ref\|NP_189034.1\|beta-amylase, putative/1,4-alpha-D-glucan maltohydrolase, putative [*Arabidopsis thaliana*] | | | PEG | | |
| 725 | 4.00E-72 | 100 | gi\|32815911\| | ref\|NP_201100.1\|expressed protein [*Arabidopsis thaliana*] | | | PEG | | |
| 726 | 1.00E-179 | 100 | gi\|8953402\| | ref\|NP_196701.1\|protein kinase-related [*Arabidopsis thaliana*] | | | PEG | | |
| 727 | 0 | 100 | gi\|6522600\| | emb\|CAB61965.1\|1-aminocyclopropane-1-carboxylic acid oxidase-like protein | | | PEG | | |
| 728 | 1.00E-145 | 85 | gi\|57899179\| | dbj\|BAD87231.1\|membrane protein-like [*Oryza sativa* (*japonica* cultivar-group)] | | | PEG | | |
| 729 | 0 | 87 | gi\|50909427\| | ref\|XP_466202.1\|putative DNA J domain protein [*Oryza sativa* (*japonica* cultivar-group)] | | | PEG | | |
| 730 | 0 | 100 | gi\|53828613\| | ref\|NP_179479.1\|protein kinase family protein [*Arabidopsis thaliana*] | | | PEG | | |
| 731 | 1.00E-93 | 100 | gi\|23306374\| | ref\|NP_200428.1\|expressed protein [*Arabidopsis thaliana*] | | | PEG | | |
| 732 | 1.00E-172 | 100 | gi\|56121884\| | ref\|NP_178191.1\|major intrinsic family protein/ MIP family protein | | | PEG | | |
| 733 | 0 | 98 | gi\|24762199\| | gb\|AAN64166.1\|unknown protein [*Arabidopsis thaliana*] | | | PEG | | |
| 734 | 0 | 100 | gi\|21230100\| | ref\|NP_636017.1\|phosphomannose isomerase/GDP-mannose pyrophosphorylase | | | PEG | | |
| 735 | 0 | 100 | gi\|10177277\| | dbj\|BAB10630.1\|glucose-6-phosphate isomerase, cytosolic [*Arabidopsis thaliana*] | | | PP | | |
| 736 | 3.00E-61 | 100 | gi\|21537079\| | ref\|NP_564835.1\|expressed protein [*Arabidopsis thaliana*] | | | PP | HS | |
| 737 | 3.00E-91 | 100 | gi\|26452507\| | ref\|NP_197149.1\| dimethylmenaquinone methyltransferase family protein | | | PP | PEG | |
| 738 | 0 | 100 | gi\|5734730\| | ref\|NP_172592.1\|glucose transporter (STP1) [*Arabidopsis thaliana*] | | | PP | | |
| 739 | 1.00E-113 | 100 | gi\|5734748\| | ref\|NP_564017.1\|integral membrane family protein [*Arabidopsis thaliana*] | | | PP | SS | PEG |
| 740 | 1.00E-153 | 100 | gi\|30693623\| | ref\|NP_198871.2\|expressed protein [*Arabidopsis thaliana*] | | | PP | | |

TABLE 3-continued

| PEP SEQ ID NO | e value | % identity | annotation GenBank id | description | | trait | | |
|---|---|---|---|---|---|---|---|---|
| 741 | 0 | 100 | gi\|56381993\| | ref\|NP_177188.1\| spermidine synthase 2 (SPDSYN2)/putrescine aminopropyltransferase 2 | PP | SS | PEG | |
| 742 | 0 | 100 | gi\|4678359\| | emb\|CAB41169.1\|cytochrome P450-like protein [*Arabidopsis thaliana*] | PP | | | |
| 743 | 0 | 100 | gi\|15220055\| | ref\|NP_173165.1\|translation initiation factor IF-2, chloroplast, putative [*Arabidopsis thaliana*] | PP | | | |
| 744 | 1.00E−168 | 100 | gi\|21593654\| | ref\|NP_181996.1\|casein kinase II beta chain, putative [*Arabidopsis thaliana*] | PP | LL | LN | PEG |
| 745 | 0 | 100 | gi\|9758987\| | dbj\|BAB09497.1\|chloroplast nucleoid DNA-binding protein-like [*Arabidopsis thaliana*] ref\|NP_199325.1\| aspartyl protease family protein [*Arabidopsis thaliana*] | PP | | | |
| 746 | 0 | 100 | gi\|12642918\| | ref\|NP_180133.1\|protein phosphatase 2C, putative/ PP2C, putative | PP | SS | | |
| 747 | 0 | 100 | gi\|7270935\| | ref\|NP_195661.1\| cytochrome P450 family protein [*Arabidopsis thaliana*] | PP | | | |
| 748 | 1.00E−138 | 100 | gi\|21554052\| | gb\|AAM63133.1\|delta tonoplast integral protein delta-TIP [*Arabidopsis thaliana*] | PP | | | |
| 749 | 0 | 85 | gi\|28872439\| | ref\|NP_795058.1\|phosphoglycerate mutase, 2,3- bisphosphoglycerate- independent | PP | | | |
| 750 | 0 | 100 | gi\|25284116\| | pir\|\|A95262probable formate dehydrogenase (EC 1.2.1.2) alpha chain FdoG [imported] - *SinoRhizobium meliloti* (strain 1021) magaplasmid pSymA | PP | PEG | | |
| 751 | 1.00E−55 | 100 | gi\|7629997\| | ref\|NP_190945.1\|late embryogenesis abundant protein-related/LEA protein-related | PP | SS | PEG | |
| 752 | 0 | 100 | gi\|23126243\| | ref\|ZP_00108145.1\|COG1523: Type II secretory pathway, pullulanase PulA and related glycosidases [*Nostoc punctiforme* PCC 73102] | PP | SS | | |
| 753 | 0 | 100 | gi\|42563087\| | ref\|NP_564975.2\|CBS domain-containing protein [*Arabidopsis thaliana*] | PP | | | |
| 754 | 0 | 100 | gi\|17104597\| | ref\|NP_566716.1\|protein kinase, putative [*Arabidopsis thaliana*] | PP | SS | LL | |
| 755 | 0 | 100 | gi\|15810541\| | ref\|NP_566876.3\|protein kinase family protein [*Arabidopsis thaliana*] | PP | SS | | |
| 756 | 3.00E−84 | 99 | gi\|16331120\| | ref\|NP_441848.1\|hypothetical protein sll0359 [*Synechocystis* sp. PCC 6803] | PP | | | |
| 757 | 0 | 99 | gi\|4835235\| | emb\|CAB42913.1\|putative protein [*Arabidopsis thaliana*] pir\|\|T08405 hypothetical protein F18B3.120 - *Arabidopsis thaliana* | PP | | | |
| 758 | 0 | 100 | gi\|18394553\| | ref\|NP_564042.1\|expressed protein [*Arabidopsis thaliana*] | PP | | | |

TABLE 3-continued

| PEP SEQ ID NO | e value | % identity | GenBank id | annotation description | | trait | | | |
|---|---|---|---|---|---|---|---|---|---|
| 759 | 0 | 99 | gi\|49176911\| | ref\|NP_858035.1\|mercuric reductase [uncultured bacterium] | PP | | | | |
| 760 | 0 | 100 | gi\|53794956\| | ref\|ZP_00356067.1\|COG4992: Ornithine/acetylornithine aminotransferase [*Chloroflexus aurantiacus*] | PP | SS | | | |
| 761 | 0 | 100 | gi\|6714476\| | ref\|NP_186761.1\| cystathionine gamma-synthase, chloroplast/O-succinylhomoserine (Thiol)-lyase (CGS) | PP | LL | | | |
| 762 | 0 | 100 | gi\|9755789\| | ref\|NP_197266.1\|expressed protein [*Arabidopsis thaliana*] | PP | SS | LL | LN | PEG |
| 763 | 0 | 100 | gi\|15810649\| | pir\|\|T48630 high affinity nitrate transporter-like protein - *Arabidopsis thaliana* | PP | | | | |
| 764 | 1.00E-129 | 100 | gi\|26451800\| | ref\|NP_850901.1\| expressed protein [*Arabidopsis thaliana*] | PP | | | | |
| 765 | 4.00E-58 | 91 | gi\|50948565\| | ref\|XP_483810.1\|putative Bet1/Sft1-related SNARE (AtBS14a) [*Oryza sativa*] | PP | PEG | | | |
| 766 | 0 | 100 | gi\|7630064\| | emb\|CAB88286.1\|serine/threonine-specific protein kinase-like protein | PP | | | | |
| 767 | 0 | 92 | gi\|50932239\| | ref\|XP_475647.1\|putative glutaryl-CoA dehydrogenase | PP | HS | PEG | | |
| 768 | 1.00E-104 | 50 | gi\|30684716\| | ref\|NP_196906.2\|expressed protein [*Arabidopsis thaliana*] | PP | SS | | | |
| 769 | 2.00E-87 | 89 | gi\|50912633\| | ref\|XP_467724.1\|unknown protein [*Oryza sativa* (*japonica* cultivar-group)] | PP | PEG | | | |
| 770 | 9.00E-13 | 94 | gi\|6682226\| | gb\|AAF23278.1\|unknown protein [*Arabidopsis thaliana*] | PP | HS | SS | PEG | |
| 771 | 2.00E-90 | 49 | gi\|31430516\| | ref\|NP_920131.1\|putative *Magnaporthe grisea* pathogenicity protein | PP | | | | |
| 772 | 0 | 100 | gi\|23297753\| | ref\|NP_192381.1\|calcium-dependent protein kinase, putative/CDPK, putative | SP | HS | PEG | | |
| 773 | 3.00E-54 | 100 | gi\|4417292\| | ref\|NP_179791.1\| expressed protein [*Arabidopsis thaliana*] | SP | CK | PP | PEG | |
| 774 | 0 | 100 | gi\|20148423\| | ref\|NP_177550.1\| sulfotransferase family protein [*Arabidopsis thaliana*] | SP | | | | |
| 775 | 4.00E-88 | 100 | gi\|21554027\| | ref\|NP_192830.1\| transcriptional coactivator p15 (PC4) family protein (KELP) | SP | SS | | | |
| 776 | 1.00E-100 | 100 | gi\|22136806\| | ref\|NP_176726.1\|flowering locus T protein (FT) [*Arabidopsis thaliana*] | SP | SS | PEG | | |
| 777 | 6.00E-93 | 100 | gi\|21592464\| | ref\|NP_565844.1\|zinc finger (AN1-like) family protein [*Arabidopsis thaliana*] | SP | LN | | | |
| 778 | 1.00E-101 | 100 | gi\|8778645\| | gb\|AAF79653.1\|F5O11.17 [*Arabidopsis thaliana*] | SP | LN | | | |
| 779 | 2.00E-80 | 100 | gi\|28973123\| | ref\|NP_196373.1\|glycine-rich protein (GRP20) [*Arabidopsis thaliana*] | SP | CK | | | |
| 780 | 0 | 100 | gi\|11994377\| | ref\|NP_188020.1\| exopolygalacturonase/ galacturan 1,4-alpha-galacturonidase/pectinase | SP | PP | PEG | | |
| 781 | 0 | 100 | gi\|20465689\| | ref\|NP_200440.1\| peroxisomal targeting signal type 1 receptor (PEX5) | SP | CK | | | |

TABLE 3-continued

| PEP SEQ ID NO | e value | % identity | GenBank id | annotation description | | trait | | |
|---|---|---|---|---|---|---|---|---|
| 782 | 8.00E−51 | 100 | gi\|21536923\| | ref\|NP_194774.1\|glycine-rich protein [*Arabidopsis thaliana*] | SP | CK | | |
| 783 | 1.00E−124 | 100 | gi\|30023686\| | ref\|NP_197608.1\|leucine-rich repeat protein, putative [*Arabidopsis thaliana*] | SP | DS | PEG | |
| 784 | 3.00E−76 | 100 | gi\|26453292\| | ref\|NP_563653.2\| NPR1/NIM1-interacting protein 1 (NIMIN-1) [*Arabidopsis thaliana*] | SP | SS | LN | |
| 785 | 1.00E−90 | 100 | gi\|15220022\| | ref\|NP_173727.1\|C2 domain-containing protein [*Arabidopsis thaliana*] | SP | CS | PEG | |
| 786 | 2.00E−97 | 100 | gi\|56479608\| | ref\|NP_706078.2\|hypoxanthine phosphoribosyltransferase [*Shigella flexneri* 2a str. 301] EDL933] | SP | SS | PEG | |
| 787 | 1.00E−130 | 99 | gi\|16331548\| | ref\|NP_442276.1\|hypothetical protein slr0630 [*Synechocystis* sp. PCC 6803] | SP | SS | | |
| 788 | 0 | 100 | gi\|20259167\| | ref\|NP_568786.1\|protein phosphatase 2C, putative/ PP2C, putative | SP | | | |
| 789 | 0 | 100 | gi\|6466946\| | ref\|NP_974249.1\| prephenate dehydratase family protein [*Arabidopsis thaliana*] | SP | PEG | | |
| 790 | 1.00E−130 | 100 | gi\|20465721\| | ref\|NP_174536.1\|plastid developmental protein DAG, putative | SP | CS | PEG | |
| 791 | 1.00E−63 | 84 | gi\|10177620\| | dbj\|BAB10767.1\|unnamed protein product [*Arabidopsis thaliana*] | SP | SS | | |
| 792 | 1.00E−44 | 100 | gi\|58299\| | emb\|CAA48415.1\|unnamed protein product [synthetic construct] | SP | CK | PEG | |
| 793 | 1.00E−108 | 54 | gi\|3150411\| | ref\|NP_180570.1\|GCN5-related N-acetyltransferase (GNAT) family protein | SP | CS | | |
| 794 | 0 | 100 | gi\|16331766\| | ref\|NP_442494.1\|aldehyde dehydrogenase [*Synechocystis* sp. PCC 6803] | SP | SS | PEG | |
| 795 | 1.00E−30 | 100 | gi\|7340711\| | emb\|CAB82954.1\|cytochrome c oxidase subunit 5c-like protein [*Arabidopsis thaliana*] | SP | CK | CS | PEG |
| 796 | 1.00E−137 | 100 | gi\|5430750\| | ref\|NP_175374.2\| expressed protein [*Arabidopsis thaliana*] | SP | CS | HS | PEG |
| 797 | 1.00E−93 | 100 | gi\|19310667\| | ref\|NP_188286.1\| translationally controlled tumor family protein [*Arabidopsis thaliana*] | SP | PP | SS | |
| 798 | 0 | 100 | gi\|15293235\| | ref\|NP_194825.1\|CBL-interacting protein kinase 6 (CIPK6) [*Arabidopsis thaliana*] | SP | LN | | |
| 799 | 1.00E−165 | 62 | gi\|4220476\| | gb\|AAD12699.1\|putative ribophorin I [*Arabidopsis thaliana*] | SP | | | |
| 800 | 0 | 100 | gi\|20908080\| | ref\|NP_200169.1\| RabGAP/TBC domain-containing protein [*Arabidopsis thaliana*] | SS | | | |
| 801 | 1.00E−68 | 99 | gi\|51449987\| | ref\|NP_189210.2\| myrcene/ocimene synthase, putative [*Arabidopsis thaliana*] | SS | PEG | | |
| 802 | 2.00E−94 | 100 | gi\|21592517\| | ref\|NP_564266.1\| expressed protein [*Arabidopsis thaliana*] | SS | | | |

TABLE 3-continued

| PEP SEQ ID NO | e value | % identity | annotation GenBank id | description | trait | |
|---|---|---|---|---|---|---|
| 803 | 0 | 100 | gi\|42572237\| | ref\|NP_974213.1\|ankyrin repeat family protein/ regulator of chromosome condensation (RCC1) family protein [*Arabidopsis thaliana*] | SS | PEG |
| 804 | 1.00E−115 | 100 | gi\|21593862\| | ref\|NP_190632.1\|kip-related protein 2 (KRP2)/ cyclin-dependent kinase inhibitor 2 (ICK2)/cdc2a-interacting protein [*Arabidopsis thaliana*] | SS | |
| 805 | 0 | 100 | gi\|8843792\| | ref\|NP_200680.1\|PRLI-interacting factor, putative [*Arabidopsis thaliana*] | SS | LN |
| 806 | 0 | 90 | gi\|21586474\| | gb\|AAM55306.1\|auxin influx carrier protein [*Medicago truncatula*] | SS | |
| 807 | 0 | 99 | gi\|20799715\| | gb\|Aref\|NP_190468.1\| AMP-dependent synthetase and ligase family protein | SS | |
| 808 | 0 | 100 | gi\|15293255\| | ref\|NP_564424.1\|PHD finger family protein [*Arabidopsis thaliana*] | SS | |
| 809 | 0 | 100 | gi\|24030409\| | ref\|NP_194207.1\| expressed protein [*Arabidopsis thaliana*] | SS | LN |
| 810 | 0 | 100 | gi\|6728973\| | ref\|NP_186938.1\|leucine-rich repeat transmembrane protein kinase, putative | SS | PEG |
| 811 | 1.00E−133 | 100 | gi\|27754697\| | gb\|AAO22792.1\|putative cytochrome c oxidoreductase [*Arabidopsis thaliana*] | SS | PEG |
| 812 | 0 | 91 | gi\|4539445\| | ref\|NP_192805.1\| transcription elongation factor-related [*Arabidopsis thaliana*] | SS | |
| 813 | 0 | 100 | gi\|23296600\| | ref\|NP_568107.1\|pseudo-response regulator 7 (APRR7) [*Arabidopsis thaliana*] sp\|Q93WK5\|APRR7_ARATH Two-component response regulator-like APRR7 (Pseudo-response regulator 7) | SS | |
| 814 | 0 | 99 | gi\|16331392\| | ref\|NP_442120.1\|ribulose bisphosphate carboxylase large subunit | SS | |
| 815 | 0 | 99 | gi\|16329673\| | ref\|NP_440401.1\|mercuric reductase [*Synechocystis* sp. PCC 6803] | SS | |
| 816 | 0 | 100 | gi\|23506207\| | gb\|AAN31115.1\|At2g26250/ T1D16.11 [*Arabidopsis thaliana*] gb\|AAG60062.1\| putative beta-ketoacyl-CoA synthase FIDDLEHEAD | SS | |
| 817 | 0 | 99 | gi\|6016708\| | ref\|NP_186798.1\|protein kinase, putative [*Arabidopsis thaliana*] | SS | |
| 818 | 0 | 100 | gi\|21593811\| | gb\|AAM65778.1\|putative NADPH quinone oxidoreductase [*Arabidopsis thaliana*] | SS | |
| 819 | 0 | 100 | gi\|23125809\| | ref\|ZP_00107727.1\|COG0166: Glucose-6-phosphate isomerase [*Nostoc punctiforme* PCC 73102] | SS | |
| 820 | 0 | 100 | gi\|16077353\| | ref\|NP_388166.1\|hypothetical protein BSU02840 [*Bacillus subtilis* subsp. *subtilis* str. 168] | SS | PEG |

TABLE 3-continued

| PEP SEQ ID NO | annotation | | | | |
|---|---|---|---|---|---|
| | e value | % identity | GenBank id | description | trait |
| 821 | 1.00E-117 | 100 | gi|7269793| | ref|NP_194624.1|Rac-like GTP-binding protein (ARAC7) [*Arabidopsis thaliana*] | SS |
| 822 | 1.00E-128 | 96 | gi|27808548| | gb|AAO24554.1|At1g61150 [*Arabidopsis thaliana*] | SS PEG |
| 823 | 0 | 97 | gi|30684071| | ref|NP_850128.1|protein kinase family protein [*Arabidopsis thaliana*] | SS |
| 824 | 2.00E-77 | 99 | gi|16330866| | ref|NP_441594.1|hypothetical protein slr1273 [*Synechocystis* sp. PCC 6803] | SS LL |
| 825 | 1.00E-177 | 100 | gi|23297050| | ref|NP_194073.2|short-chain dehydrogenase/reductase (SDR) family protein | SS |
| 826 | 1.00E-109 | 100 | gi|12083284| | ref|NP_173437.1|Rac-like GTP-binding protein (ARAC4)/Rho-like GTP-binding protein (ROP2) | SS |
| 827 | 0 | 100 | gi|20465939| | ref|NP_850393.1|sugar transporter family protein [*Arabidopsis thaliana*] | SS |
| 828 | 0 | 98 | gi|2661128| | gb|AAC04613.1|arginase [*Glycine max*] pir||T06222 probable arginase (EC 3.5.3.1) - soybean sp|O49046|ARGI_SOYBN Arginase | SS |
| 829 | 0 | 64 | gi|40539114| | gb|AAR87370.1|expressed protein [*Oryza sativa* (*japonica* cultivar-group)] | SS |
| 830 | 0 | 91 | gi|52137615| | emb|CAH40838.1|protein-O-fucosyltransferase 1 [*Saccharum officinarum*] | SS |
| 831 | 0 | 100 | gi|5733881| | ref|NP_175261.1|G protein coupled receptor-related [*Arabidopsis thaliana*] | SS |
| 832 | 8.00E-88 | 100 | gi|15217930| | ref|NP_176128.1|hypothetical protein [*Arabidopsis thaliana*] | SS |
| 833 | 1.00E-29 | 75 | gi|20465895| | ref|NP_974937.1|RNA recognition motif (RRM)-containing protein | SS LN |
| 834 | 5.00E-79 | 100 | gi|3927837| | ref|NP_180456.1| mitochondrial import inner membrane translocase subunit Tim17/Tim22/Tim23 family protein [*Arabidopsis thaliana*] | SS |
| 835 | 1.00E-115 | 100 | gi|21554015| | ref|NP_565766.1| glycolipid transfer protein-related [*Arabidopsis thaliana*] | SS |
| 836 | 1.00E-131 | 100 | gi|26452816| | ref|NP_193484.1|ubiquitin carboxyl-terminal hydrolase | SS |
| 837 | 1.00E-102 | 99 | gi|10177705| | ref|NP_199436.1|inward rectifying potassium channel (KAT1) | SS LN |
| 838 | 1.00E-144 | 100 | gi|7669950| | ref|NP_190844.1|integral membrane Yip1 family protein [*Arabidopsis thaliana*] | SS PEG |
| 839 | 0 | 100 | gi|10177595| | ref|NP_201509.1|protein kinase family protein [*Arabidopsis thaliana*] | SS LN |
| 840 | 4.00E-27 | 100 | gi|38566508| | ref|NP_200137.1| arabinogalactan-protein, putative (AGP22) [*Arabidopsis thaliana*] | SS |

TABLE 3-continued

| PEP SEQ ID NO | e value | % identity | GenBank id | description | trait | |
|---|---|---|---|---|---|---|
| 841 | 0 | 100 | gi\|18391117\| | ref\|NP_563862.1\|expressed protein [*Arabidopsis thaliana*] | SS | PEG |
| 842 | 0 | 92 | gi\|50251322\| | dbj\|BAD28194.1\|putative MFAP1 protein [*Oryza sativa* (*japonica* cultivar-group)] | SS | |
| 843 | 1.00E-112 | 95 | gi\|3201969\| | gb\|AAC19375.1\|submergence induced protein 2A [*Oryza sativa*] | SS | |
| 844 | 1.00E-74 | 88 | gi\|29371519\| | gb\|AAO72703.1\|unknown [*Oryza sativa* (*japonica* cultivar-group)] | SS | |
| 845 | 0 | 100 | gi\|28416475\| | ref\|NP_187911.1\| transporter-related [*Arabidopsis thaliana*] | SS | PEG |
| 846 | 0 | 100 | gi\|21323473\| | ref\|NP_599939.1\|detergent sensitivity rescuer dtsR2 [*Corynebacterium glutamicum* ATCC 13032] | SS | LN |
| 847 | 0 | 82 | gi\|50928705\| | gb\|AAQ14479.1\|putative aminotransferase [*Oryza sativa*] | SS | |
| 848 | 0 | 99 | gi\|3695005\| | gb\|AAC63962.1\|pyruvate dehydrogenase kinase isoform 2; PDK2 [*Zea mays*] | SS | |
| 849 | 0 | 100 | gi\|10175838\| | ref\|NP_244081.1\| hypothetical protein BH3215 [*Bacillus halodurans* C-125] | SS | PEG |
| 850 | 0 | 100 | gi\|33589668\| | ref\|NP_564285.1\| calmodulin-binding protein [*Arabidopsis thaliana*] | SS | PEG |

Trait Improvement Screens

DS-Improvement of drought tolerance identified by a soil drought stress tolerance screen: Drought or water deficit conditions impose mainly osmotic stress on plants. Plants are particularly vulnerable to drought during the flowering stage. The drought condition in the screening process disclosed in Example 1B started from the flowering time and was sustained to the end of harvesting. The present invention provides recombinant DNA that can improve the plant survival rate under such sustained drought condition. Exemplary recombinant DNA for conferring such drought tolerance are identified as such in Table 3. Such recombinant DNA may find particular use in generating transgenic plants that are tolerant to the drought condition imposed during flowering time and in other stages of the plant life cycle. As demonstrated from the model plant screen, in some embodiments of transgenic plants with trait-improving recombinant DNA grown under such sustained drought condition can also have increased total seed weight per plant in addition to the increased survival rate within a transgenic population, providing a higher yield potential as compared to control plants.

PEG-Improvement of drought tolerance identified by PEG induced osmotic stress tolerance screen: Various drought levels can be artificially induced by using various concentrations of polyethylene glycol (PEG) to produce different osmotic potentials (Pilon-Smits e.g., (1995) Plant Physiol. 107:125-130). Several physiological characteristics have been reported as being reliable indications for selection of plants possessing drought tolerance. These characteristics include the rate of seed germination and seedling growth. The traits can be assayed relatively easily by measuring the growth rate of seedling in PEG solution. Thus, a PEG-induced osmotic stress tolerance screen is a useful surrogate for drought tolerance screen. As demonstrated from the model plant screen, embodiments of transgenic plants with trait-improving recombinant DNA identified in the PEG-induced osmotic stress tolerance screen can survive better drought conditions providing a higher yield potential as compared to control plants.

SS-Improvement of drought tolerance identified by high salinity stress tolerance screen: Three different factors are responsible for salt damages: (1) osmotic effects, (2) disturbances in the mineralization process, (3) toxic effects caused by the salt ions, e.g., inactivation of enzymes. While the first factor of salt stress results in the wilting of the plants that is similar to drought effect, the ionic aspect of salt stress is clearly distinct from drought. The present invention provides genes that help plants to maintain biomass, root growth, and/or plant development in high salinity conditions, which are identified as such in Table 3. Since osmotic effect is one of the major components of salt stress, which is common to the drought stress, trait-improving recombinant DNA identified in a high salinity stress tolerance screen can also provide transgenic crops with improved drought tolerance. As demonstrated from the model plant screen, embodiments of transgenic plants with trait-improving recombinant DNA identified in a high salinity stress tolerance screen can survive better drought conditions and/or high salinity conditions providing a higher yield potential as compared to control plants.

HS-Improvement of drought tolerance identified by heat stress tolerance screen: Heat and drought stress often occur simultaneously, limiting plant growth. Heat stress can cause the reduction in photosynthesis rate, inhibition of leaf growth and osmotic potential in plants. Thus, genes identified by the present invention as heat stress tolerance conferring genes may also impart improved drought tolerance to plants. As demonstrated from the model plant screen, embodiments of transgenic plants with trait-improving recombinant DNA identified in a heat stress tolerance screen can survive better heat stress conditions and/or drought conditions providing a higher yield potential as compared to control plants.

CK and CS-Improvement of tolerance to cold stress: Low temperature may immediately result in mechanical constraints, changes in activities of macromolecules, and reduced osmotic potential. In the present invention, two screening conditions, i.e., cold shock tolerance screen (CK) and cold germination tolerance screen (CS), were set up to look for transgenic plants that display visual growth advantage at lower temperature. In cold germination tolerance screen, the transgenic *Arabidopsis* plants were exposed to a constant temperature of 8° C. from planting until day 28 post plating. The trait-improving recombinant DNA identified by such screen are particular useful for the production of transgenic plant that can germinate more robustly in a cold temperature as compared to the wild type plants. In cold shock tolerance screen, the transgenic plants were first grown under the normal growth temperature of 22° C. until day 8 post plating, and subsequently were placed under 8° C. until day 28 post plating. As demonstrated from the model plant screen, embodiments of transgenic plants with trait-improving recombinant DNA identified in a cold shock stress tolerance screen and/or a cold germination stress tolerance screen can survive better cold conditions providing a higher yield potential as compared to control plants.

Improvement of tolerance to multiple stresses: Different kinds of stresses often lead to identical or similar reaction in the plants. Genes that are activated or inactivated as a reaction to stress can either act directly in a way the genetic product reduces a specific stress, or they can act indirectly by activating other specific stress genes. By manipulating the activity of such regulatory genes, i.e., multiple stress tolerance genes, the plant can be enabled to react to different kinds of stresses. For examples, PEP SEQ ID NO: 459 can be used to improve both salt stress tolerance and cold stress tolerance in plants. Of particular interest, plants transformed with PEP SEQ ID NO: 440 can resist heat stress, salt stress and cold stress. In addition to these multiple stress tolerance genes, the stress tolerance conferring genes provided by the present invention may be used in combinations to generate transgenic plants that can resist multiple stress conditions.

PP-Improvement of early plant growth and development: It has been known in the art that to minimize the impact of disease on crop profitability, it is important to start the season with healthy vigorous plants. This means avoiding seed and seedling diseases, leading to increased nutrient uptake and increased yield potential. Traditionally early planting and applying fertilizer are the methods used for promoting early seedling vigor. In early development stage, plant embryos establish only the basic root-shoot axis, a cotyledon storage organ(s), and stem cell populations, called the root and shoot apical meristems, that continuously generate new organs throughout post-embryonic development. "Early growth and development" used herein encompasses the stages of seed imbibition through the early vegetative phase. The present invention provides genes that are useful to produce transgenic plants that have advantages in one or more processes including, but not limited to, germination, seedling vigor, root growth and root morphology under non-stressed conditions. The transgenic plants starting from a more robust seedling are less susceptible to the fungal and bacterial pathogens that attach germinating seeds and seedling. Furthermore, seedlings with advantage in root growth are more resistant to drought stress due to extensive and deeper root architecture. Therefore, it can be recognized by those skilled in the art that genes conferring the growth advantage in early stages to plants may also be used to generate transgenic plants that are more resistant to various stress conditions due to improved early plant development. The present invention provides such exemplary recombinant DNA that confer both the stress tolerance and growth advantages to plants, identified as such in Table 3, e.g., PEP SEQ ID NO: 529 which can improve the plant early growth and development, and impart salt and cold tolerance to plants. As demonstrated from the model plant screen, embodiments of transgenic plants with trait-improving recombinant DNA identified in the early plant development screen can grow better under non-stress conditions and/or stress conditions providing a higher yield potential as compared to control plants.

SP-Improvement of late plant growth and development: "Late growth and development" used herein encompasses the stages of leaf development, flower production, and seed maturity. In certain embodiments, transgenic plants produced using genes that confer growth advantages to plants provided by the present invention, identified as such in Table 3, exhibit at least one phenotypic characteristics including, but not limited to, increased rosette radius, increased rosette dry weight, seed dry weight, silique dry weight, and silique length. On one hand, the rosette radius and rosette dry weight are used as the indexes of photosynthesis capacity, and thereby plant source strength and yield potential of a plant. On the other hand, the seed dry weight, silique dry weight and silique length are used as the indexes for plant sink strength, which are considered as the direct determinants of yield. As demonstrated from the model plant screen, embodiments of transgenic plants with trait-improving recombinant DNA identified in the late development screen can grow better and/or have improved development during leaf development and seed maturation providing a higher yield potential as compared to control plants.

LL-Improvement of tolerance to shade stress identified in a low light screen: The effects of light on plant development are especially prominent at the seedling stage. Under normal light conditions with unobstructed direct light, a plant seeding develops according to a characteristic photomorphogenic pattern, in which plants have open and expanded cotyledons and short hypocotyls. Then the plant's energy is devoted to cotyledon and leaf development while longitudinal extension growth is minimized. Under low light condition where light quality and intensity are reduced by shading, obstruction or high population density, a seedling displays a shade-avoidance pattern, in which the seedling displays a reduced cotyledon expansion, and hypocotyls extension is greatly increased. As the result, a plant under low light condition increases significantly its stem length at the expanse of leaf, seed or fruit and storage organ development, thereby adversely affecting of yield. The present invention provides recombinant DNA that enable plants to have an attenuated shade avoidance response so that the source of plant can be contributed to reproductive growth efficiently, resulting higher yield as compared to the wild type plants. As demonstrated from the model plant screen, embodiments of transgenic plants with trait-improving recombinant DNA identified in a shade stress tolerance screen can have attenuated shade response under shade conditions providing a higher yield potential as compared to control plants. The transgenic plants generated by the present invention may be suitable for a higher density planting, thereby resulting increased yield per unit area.

LN-Improvement of Tolerance to Low Nitrogen Availability Stress

Nitrogen is a key factor in plant growth and crop yield. The metabolism, growth and development of plants are profoundly affected by their nitrogen supply. Restricted nitrogen supply alters shoot to root ratio, root development, activity of enzymes of primary metabolism and the rate of senescence (death) of older leaves. All field crops have a fundamental dependence on inorganic nitrogenous fertilizer. Since fertilizer is rapidly depleted from most soil types, it must be supplied to growing crops two or three times during the growing season. Enhanced nitrogen use efficiency by plants should enable crops cultivated under low nitrogen availability stress condition resulted from low fertilizer input or poor soil quality.

According to the present invention, transgenic plants generated using the recombinant nucleotides, which confer enhanced nitrogen use efficiency, identified as such in Table 3, exhibit one or more desirable traits including, but not limited to, increased seedling weight, greener leaves, increased number of rosette leaves, increased or decreased root length. One skilled in the art may recognize that the transgenic plants provided by the present invention with enhanced nitrogen use efficiency may also have altered amino acid or protein compositions, increased yield and/or better seed quality. The transgenic plants of the present invention may be productively cultivated under low nitrogen growth conditions, i.e., nitrogen-poor soils and low nitrogen fertilizer inputs, which would cause the growth of wild type plants to cease or to be so diminished as to make the wild type plants practically useless. The transgenic plants also may be advantageously used to achieve earlier maturing, faster growing, and/or higher yielding crops and/or produce more nutritious foods and animal feedstocks when cultivated using nitrogen non-limiting growth conditions.

Stacked Traits: The present invention also encompasses transgenic plants with stacked engineered traits, e.g., a crop having an improved phenotype resulting from expression of a trait-improving recombinant DNA, in combination with herbicide and/or pest resistance traits. For example, genes of the current invention can be stacked with other traits of agronomic interest, such as a trait providing herbicide resistance, for example a RoundUp Ready® trait, or insect resistance, such as using a gene from *Bacillus thuringensis* to provide resistance against lepidopteran, coliopteran, homopteran, hemiopteran, and other insects. Herbicides for which resistance is useful in a plant include glyphosate herbicides, phosphinothricin herbicides, oxynil herbicides, imidazolinone herbicides, dinitroaniline herbicides, pyridine herbicides, sulfonylurea herbicides, bialaphos herbicides, sulfonamide herbicides and gluphosinate herbicides. To illustrate that the production of transgenic plants with herbicide resistance is a capability of those of ordinary skill in the art, reference is made to U.S. patent application publications 2003/0106096A1 and 2002/0112260A1 and U.S. Pat. Nos. 5,034,322; 5,776,760, 6,107,549 and 6,376,754, all of which are incorporated herein by reference. To illustrate that the production of transgenic plants with pest resistance is a capability of those of ordinary skill in the art reference is made to U.S. Pat. Nos. 5,250,515 and 5,880,275 which disclose plants expressing an endotoxin of *Bacillus thuringiensis* bacteria, to U.S. Pat. No. 6,506,599 which discloses control of invertebrates which feed on transgenic plants which express dsRNA for suppressing a target gene in the invertebrate, to U.S. Pat. No. 5,986,175 which discloses the control of viral pests by transgenic plants which express viral replicase, and to U.S. Patent Application Publication 2003/0150017 A1 which discloses control of pests by a transgenic plant which express a dsRNA targeted to suppressing a gene in the pest, all of which are incorporated herein by reference.

Once one recombinant DNA has been identified as conferring an improved trait of interest in transgenic *Arabidopsis* plants, several methods are available for using the sequence of that recombinant DNA and knowledge about the protein it encodes to identify homologs of that sequence from the same plant or different plant species or other organisms, e.g., bacteria and yeast. Thus, in one aspect, the invention provides methods for identifying a homologous gene with a DNA sequence homologous to any of SEQ ID NO: 1 through SEQ ID NO: 425, or a homologous protein with an amino acid sequence homologous to any of SEQ ID NO: 426 through SEQ ID NO: 850. In another aspect, the present invention provides the protein sequences of identified homologs for a sequence listed as SEQ ID NO: 851 through SEQ ID NO: 33634. In yet another aspect, the present invention also includes linking or associating one or more desired traits, or gene function with a homolog sequence provided herein.

The trait-improving recombinant DNA and methods of using such trait-improving recombinant DNA for generating transgenic plants with improved traits provided by the present invention are not limited to any particular plant species. Indeed, the plants according to the present invention may be of any plant species, i.e., may be monocotyledonous or dicotyledonous. Preferably, they will be agricultural useful plants, i.e., plants cultivated by man for purposes of food production or technical, particularly industrial applications. Of particular interest in the present invention are corn and soybean plants. The recombinant DNA constructs optimized for soybean transformation and recombinant DNA constructs optimized for corn transformation are provided by the present invention. Other plants of interest in the present invention for production of transgenic plants having improved traits include, without limitation, cotton, canola, wheat, sunflower, sorghum, alfalfa, barley, millet, rice, tobacco, fruit and vegetable crops, and turfgrass.

In certain embodiments, the present invention contemplates to use an orthologous gene in generating the transgenic plants with similarly improved traits as the transgenic *Arabidopsis* counterpart. Improved physiological properties in transgenic plants of the present invention may be confirmed in responses to stress conditions, for example in assays using imposed stress conditions to detect improved responses to drought stress, nitrogen deficiency, cold growing conditions, or alternatively, under naturally present stress conditions, for example under field conditions. Biomass measures may be made on greenhouse or field grown plants and may include such measurements as plant height, stem diameter, root and shoot dry weights, and, for corn plants, ear length and diameter.

Trait data on morphological changes may be collected by visual observation during the process of plant regeneration as well as in regenerated plants transferred to soil. Such trait data includes characteristics such as normal plants, bushy plants, taller plants, thicker stalks, narrow leaves, striped leaves, knotted phenotype, chlorosis, albino, anthocyanin production, or altered tassels, ears or roots. Other enhanced traits may be identified by measurements taken under field conditions, such as days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy, green snap, and pest resistance. In addition, trait characteristics of harvested grain may be confirmed, including number of kernels per row on the ear, number of rows of kernels on the ear, kernel abortion, kernel weight, kernel size, kernel density and physical grain quality.

To confirm hybrid yield in transgenic corn plants expressing genes of the present invention, it may be desirable to test hybrids over multiple years at multiple locations in a geographical location where maize is conventionally grown, e.g., in Iowa, Illinois or other locations in the midwestern United States, under "normal" field conditions as well as under stress conditions, e.g., under drought or population density stress.

Transgenic plants can be used to provide plant parts according to the invention for regeneration or tissue culture of cells or tissues containing the constructs described herein. Plant parts for these purposes can include leaves, stems, roots, flowers, tissues, epicotyl, meristems, hypocotyls, cotyledons, pollen, ovaries, cells and protoplasts, or any other portion of the plant which can be used to regenerate additional transgenic plants, cells, protoplasts or tissue culture. Seeds of transgenic plants are provided by this invention can be used to propagate more plants containing the trait-improving recombinant DNA constructs of this invention. These descendants are intended to be included in the scope of this invention if they contain a trait-improving recombinant DNA construct of this invention, whether or not these plants are selfed or crossed with different varieties of plants.

The various aspects of the invention are illustrated by means of the following examples which are in no way intended to limit the full breath and scope of claims.

EXAMPLES

Example 1

Identification of Recombinant DNA that Confers Improved Trait(s) to Plants

A. Expression Constructs for *Arabidopsis* Plant Transformation

Each gene of interest was amplified from a genomic or cDNA library using primers specific to sequences upstream and downstream of the coding region. Transformation vectors were prepared to constitutively transcribe DNA in either sense orientation (for enhanced protein expression) or antisense orientation (for endogenous gene suppression) under the control of an enhanced Cauliflower Mosaic Virus 35S promoter (U.S. Pat. No. 5,359,142) directly or indirectly (Moore, e.g., PNAS 95:376-381, 1998; Guyer, e.g., Genetics 149: 633-639, 1998; International patent application NO. PCT/EP98/07577). The transformation vectors also contain a bar gene as a selectable marker for resistance to glufosinate herbicide. The transformation of *Arabidopsis* plants was carried out using the vacuum infiltration method known in the art (Bethtold, e.g., Methods Mol. Biol. 82:259-66, 1998). Seeds harvested from the plants, named as T1 seeds, were subsequently grown in a glufosinate-containing selective medium to select for plants which were actually transformed and which produced T2 transgenic seed.

B. Soil Drought Tolerance Screen

This example describes a soil drought tolerance screen to identify *Arabidopsis* plants transformed with recombinant DNA that wilt less rapidly and/or produce higher seed yield when grown in soil under drought conditions T2 seeds were sown in flats filled with Metro/Mix® 200 (The Scotts® Company, USA). Humidity domes were added to each flat and flats were assigned locations and placed in climate-controlled growth chambers. Plants were grown under a temperature regime of 22° C. at day and 20° C. at night, with a photoperiod of 16 hours and average light intensity of 170 µmol/m²/s. After the first true leaves appeared, humidity domes were removed. The plants were sprayed with glufosinate herbicide and put back in the growth chamber for 3 additional days. Flats were watered for 1 hour the week following the herbicide treatment. Watering was continued every seven days until the flower bud primordia became apparent, at which time plants were watered for the last time.

To identify drought tolerant plants, plants were evaluated for wilting response and seed yield. Beginning ten days after the last watering, plants were examined daily until 4 plants/line had wilted. In the next six days, plants were monitored for wilting response. Five drought scores were assigned according to the visual inspection of the phenotypes: 1 for healthy, 2 for dark green, 3 for wilting, 4 severe wilting, and 5 for dead. A score of 3 or higher was considered as wilted.

At the end of this assay, seed yield measured as seed weight per plant under the drought condition was characterized for the transgenic plants and their controls and analyzed as a quantitative response according to example 1M.

Two approaches were used for statistical analysis on the wilting response. First, the risk score was analyzed for wilting phenotype and treated as a qualitative response according to the example 1L. Alternatively, the survival analysis was carried out in which the proportions of wilted and non-wilted transgenic and control plants were compared over each of the six days under scoring and an overall log rank test was performed to compare the two survival curves using S-PLUS statistical software (S-PLUS 6, Guide to statistics, Insightful, Seattle, Wash., USA). Table 4 provides a list of recombinant DNA constructs that improve drought tolerance in transgenic plants.

TABLE 4

| PEP SEQ ID NO | Construct ID | Nomination ID | Orientation | Drought score Delta mean | P-value | Seed yield Delta mean | P-value | Time to wilting Risk score mean | P-value |
|---|---|---|---|---|---|---|---|---|---|
| 601 | 12116 | CGPG1112 | ANTI-SENSE | 0.119 | 0.496 | 0.736 | 0.014 | −0.026 | 1.000 |
| 602 | 13053 | CGPG1284 | ANTI-SENSE | 0.122 | 0.532 | 0.785 | 0.028 | −0.122 | 1.000 |
| 603 | 14733 | CGPG1640 | SENSE | 0.469 | 0.016 | −0.225 | 0.363 | 0.263 | 1.000 |
| 604 | 16132 | CGPG2136 | SENSE | 0.149 | 0.529 | 0.472 | 0.046 | / | / |
| 605 | 18276 | CGPG3542 | SENSE | 0.320 | 0.088 | 0.433 | 0.264 | 0.362 | 1.000 |
| 606 | 70851 | CGPG1691 | SENSE | 0.267 | 0.065 | 0.427 | 0.017 | / | / |
| 607 | 70941 | CGPG4067 | SENSE | 0.254 | 0.056 | 0.533 | 0.006 | / | / |
| 450 | 71814 | CGPG4434 | SENSE | 0.241 | 0.186 | 0.719 | 0.020 | 0.348 | 1.000 |

TABLE 4-continued

| PEP SEQ ID NO | Construct ID | Nomination ID | Orientation | Drought score Delta mean | P-value | Seed yield Delta mean | P-value | Time to wilting Risk score mean | P-value |
|---|---|---|---|---|---|---|---|---|---|
| 609 | 72326 | CGPG27 | SENSE | 0.300 | 0.149 | 0.674 | 0.036 | 0.152 | 1.000 |
| 608 | 72134 | CGPG5335 | SENSE | 0.239 | 0.169 | 0.613 | 0.077 | 0.010 | 1.000 |
| 783 | 72824 | CGPG4998 | SENSE | 0.254 | 0.180 | 0.608 | 0.046 | / | / |
| 610 | 72978 | CGPG3441 | SENSE | 0.447 | 0.094 | −0.973 | 0.071 | / | / |
| 611 | 73619 | CGPG4375 | SENSE | 0.990 | 0.022 | −0.204 | 0.283 | 0.900 | 1.000 |
| 612 | 73737 | CGPG5176 | SENSE | 0.162 | 0.293 | 1.126 | 0.000 | 0.333 | 1.000 |
| 460 | 73025 | CGPG5665 | SENSE | 0.065 | 0.731 | 0.489 | 0.095 | / | / |
| 613 | 74196 | CGPG6637 | SENSE | 0.172 | 0.230 | 1.533 | 0.001 | / | / |
| 614 | 74546 | CGPG661 | SENSE | −0.052 | 0.727 | 0.777 | 0.030 | −0.226 | 1.000 |
| 615 | 74558 | CGPG869 | SENSE | 0.344 | 0.072 | −0.138 | 0.117 | 0.033 | 0.955 |
| 616 | 74643 | CGPG6159 | SENSE | 0.369 | 0.042 | −1.232 | 0.125 | 0.556 | 1.000 |
| 617 | 75234 | CGPG5931 | SENSE | 0.157 | 0.038 | −0.095 | 0.479 | 0.026 | 0.881 |
| 618 | 75278 | CGPG6282 | SENSE | 0.110 | 0.200 | 1.027 | 0.003 | 0.057 | 0.789 |
| 587 | 75289 | CGPG6295 | SENSE | 0.627 | 0.004 | −0.074 | 0.267 | 0.196 | 0.883 |
| 619 | 75585 | CGPG7671 | SENSE | 0.474 | 0.008 | −0.452 | 0.259 | / | / |
| 620 | 76063 | CGPG1574 | SENSE | 0.105 | 0.637 | 0.985 | 0.062 | 0.023 | 1.000 |
| 593 | 76318 | CGPG8909 | SENSE | 0.509 | 0.009 | 1.093 | 0.005 | 0.471 | 0.952 |
| 599 | 76891 | CGPG9034 | SENSE | 0.186 | 0.115 | 0.796 | 0.003 | 0.128 | 1.000 |
| 621 | 77401 | CGPG9294 | SENSE | −0.072 | 0.643 | 0.554 | 0.061 | −0.090 | 1.000 |

If p<0.05 and delta or risk score mean >0, the transgenic plants showed statistically significant trait improvement as compared to the reference (p value, of the delta of a quantitative response or of the risk score of a qualitative response, is the probability that the observed difference between the transgenic plants and the reference occur by chance) If p<0.2 and delta or risk score mean >0, the transgenic plants showed a trend of trait improvement as compared to the reference.

C. Heat Stress Tolerance Screen

Under high temperatures, *Arabidopsis* seedlings become chlorotic and root growth is inhibited. This example sets forth the heat stress tolerance screen to identify *Arabidopsis* plants transformed with the gene of interest that are more resistant to heat stress based on primarily their seedling weight and root growth under high temperature. T2 seeds were plated on ½× MS salts, 1/% phytagel, with 10 µg/ml BASTA (7 per plate with 2 control seeds; 9 seeds total per plate). Plates were placed at 4° C. for 3 days to stratify seeds. Plates were then incubated at room temperature for 3 hours and then held vertically for 11 additional days at temperature of 34° C. at day and 20° C. at night. Photoperiod was 16 h. Average light intensity was ~140 µmol/m²/s. After 14 days of growth, plants were scored for glufosinate resistance, root length, final growth stage, visual color, and seedling fresh weight. A photograph of the whole plate was taken on day 14.

The seedling weight and root length were analyzed as quantitative responses according to example 1M. The final grow stage at day 14 was scored as success if 50% of the plants had reached 3 rosette leaves and size of leaves are greater than 1 mm (Boyes, e.g., (2001) The Plant Cell 13, 1499-1510). The growth stage data was analyzed as a qualitative response according to example 1 L. Table 5 provides a list of recombinant DNA constructs that improve heat tolerance in transgenic plants.

TABLE 5

| PEP seq id | Construct ID | Nomination ID | Orientation | Root length at day 14 | | Growth stage at day 14 Risk | | Seedling weight at day 14 | |
|---|---|---|---|---|---|---|---|---|---|
| | | | | Delta mean | P-value | score mean | P-value | Delta mean | P-value |
| 772 | 10923 | CGPG414 | ANTI-SENSE | 0.443 | 0.032 | / | / | / | / |
| 525 | 15419 | CGPG1788 | ANTI-SENSE | 0.385 | 0.040 | −0.070 | / | 0.416 | 0.076 |
| 527 | 17903 | CGPG1908 | SENSE | 0.125 | 0.091 | / | / | / | / |
| 623 | 18330 | CGPG3336 | SENSE | 0.274 | 0.174 | 1.014 | 0.310 | 1.279 | 0.012 |
| 624 | 18409 | CGPG3613 | SENSE | 0.181 | 0.098 | / | / | / | / |
| 736 | 18410 | CGPG3614 | SENSE | 0.398 | 0.094 | / | / | / | / |
| 432 | 17410 | CGPG2446 | SENSE | 0.199 | 0.067 | 0.241 | 0.304 | 0.828 | 0.271 |
| 622 | 17808 | CGPG2435 | SENSE | 0.266 | 0.040 | / | / | / | / |
| 438 | 19760 | CGPG4065 | SENSE | 0.015 | 0.771 | −0.111 | / | 1.611 | 0.005 |
| 625 | 19813 | CGPG4168 | SENSE | 0.183 | 0.088 | 0.643 | 0.344 | 0.807 | 0.038 |
| 440 | 70510 | CGPG2488 | SENSE | 0.607 | 0.056 | 0.171 | 0.184 | 0.863 | 0.021 |
| 443 | 70812 | CGPG607 | SENSE | 0.319 | 0.080 | 0.882 | 0.345 | 0.934 | 0.055 |
| 447 | 71446 | CGPG185 | SENSE | 0.427 | 0.110 | 0.184 | 0.160 | 0.470 | 0.068 |
| 452 | 72005 | CGPG5253 | SENSE | 0.209 | 0.098 | 0.331 | 0.586 | 1.178 | 0.122 |
| 545 | 72603 | CGPG646 | SENSE | 0.476 | 0.029 | −0.170 | 0.149 | 1.272 | 0.185 |
| 611 | 73619 | CGPG4375 | SENSE | 0.368 | 0.058 | 0.853 | 0.241 | 0.746 | 0.102 |
| 467 | 73662 | CGPG4927 | SENSE | 0.205 | 0.053 | / | / | / | / |
| 453 | 72026 | CGPG5231 | SENSE | 0.589 | 0.012 | / | / | / | / |

TABLE 5-continued

| PEP seq id | Construct ID | Nomination ID | Orientation | Root length at day 14 | | Growth stage at day 14 Risk | | Seedling weight at day 14 | |
|---|---|---|---|---|---|---|---|---|---|
| | | | | Delta mean | P-value | score mean | P-value | Delta mean | P-value |
| 626 | 73580 | CGPG6517 | SENSE | −0.077 | 0.602 | −0.195 | / | 1.106 | 0.052 |
| 628 | 74124 | CGPG6631 | SENSE | 0.256 | 0.055 | 0.460 | 0.013 | 0.512 | 0.110 |
| 627 | 73935 | CGPG993 | SENSE | 0.284 | 0.089 | 1.102 | 0.262 | 1.098 | 0.115 |
| 482 | 74707 | CGPG4914 | SENSE | 0.077 | 0.680 | 0.099 | 0.745 | 0.773 | 0.058 |
| 629 | 74725 | CGPG5393 | SENSE | 0.351 | 0.038 | / | / | / | / |
| 591 | 76220 | CGPG6189 | SENSE | 0.381 | 0.039 | / | / | / | / |
| 796 | 75910 | CGPG1256 | SENSE | 0.514 | 0.081 | / | / | / | / |
| 630 | 76403 | CGPG1313 | SENSE | 0.158 | 0.075 | −0.033 | 0.864 | 0.252 | 0.581 |
| 595 | 76513 | CGPG5892 | SENSE | 0.281 | 0.051 | / | / | / | / |
| 631 | 77366 | CGPG8150 | SENSE | 0.259 | 0.044 | −0.116 | 0.058 | 0.354 | 0.369 |
| 767 | 77115 | CGPG9135 | SENSE | 0.269 | 0.094 | / | / | / | / |
| 770 | 77159 | CGPG9202 | SENSE | 0.170 | 0.502 | −0.014 | 0.887 | 0.389 | 0.048 |

If p<0.05 and delta or risk score mean >0, the transgenic plants showed statistically significant trait improvement as compared to the reference. If p<0.2 and delta or risk score mean >0, the transgenic plants showed a trend of trait improvement as compared to the reference.

D. Salt Stress Tolerance Screen

This example sets forth the high salinity stress screen to identify *Arabidopsis* plants transformed with the gene of interest that are tolerant to high levels of salt based on their rate of development, root growth and chlorophyll accumulation under high salt conditions.

T2 seeds were plated on glufosinate selection plates containing 90 mM NaCl and grown under standard light and temperature conditions. All seedlings used in the experiment were grown at a temperature of 22° C. at day and 20° C. at night, a 16-hour photoperiod, an average light intensity of approximately 120 umol/m$^2$. On day 11, plants were measured for primary root length. After 3 more days of growth (day 14), plants were scored for transgenic status, primary root length, growth stage, visual color, and the seedlings were pooled for fresh weight measurement. A photograph of the whole plate was also taken on day 14.

The seedling weight and root length were analyzed as quantitative responses according to example 1M. The final growth stage at day 14 was scored as success if 50% of the plants reached 3 rosette leaves and size of leaves are greater than 1 mm (Boyes, D. C., et al., (2001), The Plant Cell 13, 1499/1510). The growth stage data was analyzed as a qualitative response according to example 1 L. Table 6 provides a list of recombinant DNA constructs that improve high salinity tolerance in transgenic plants

TABLE 6

| PEP SEQ ID NO | Construct ID | Orientation | Root length at day 11 | | Root length at day 14 | | Growth stage at day 14 | | Seedling weight at day 14 | |
|---|---|---|---|---|---|---|---|---|---|---|
| | | | Delta mean | P-value | Delta mean | P-value | RS mean | P-value | Delta mean | P-value |
| 800 | 16023 | SENSE | 0.333 | 0.007 | 0.308 | 0.005 | 0.400 | 0.311 | 0.469 | 0.033 |
| 801 | 16424 | ANTI-SENSE | 0.193 | 0.059 | 0.184 | 0.033 | 0.312 | 0.470 | 0.303 | 0.068 |
| 527 | 17903 | SENSE | 0.094 | 0.034 | 0.028 | 0.432 | 1.109 | 0.283 | 0.185 | 0.041 |
| 529 | 18284 | SENSE | 0.183 | 0.063 | 0.290 | 0.046 | −0.043 | 0.739 | 0.584 | 0.100 |
| 623 | 18330 | SENSE | 0.583 | 0.018 | 0.584 | 0.022 | 0.672 | 0.063 | 1.267 | 0.039 |
| 531 | 18349 | SENSE | 0.191 | 0.046 | 0.218 | 0.107 | −0.013 | 0.726 | 0.147 | 0.628 |
| 802 | 17807 | SENSE | 0.162 | 0.175 | 0.238 | 0.094 | 1.412 | 0.081 | 0.606 | 0.043 |
| 775 | 18214 | SENSE | 0.233 | 0.067 | 0.306 | 0.032 | 0.608 | 0.128 | 0.859 | 0.035 |
| 433 | 18401 | SENSE | 0.229 | 0.117 | 0.261 | 0.161 | 1.721 | 0.138 | 0.691 | 0.057 |
| 739 | 19624 | SENSE | 0.150 | 0.071 | 0.074 | 0.285 | 0.071 | 0.348 | 0.163 | 0.086 |
| 536 | 19944 | SENSE | 0.200 | 0.018 | 0.284 | 0.106 | 0.704 | 0.356 | 0.578 | 0.038 |
| 776 | 70236 | SENSE | 0.265 | 0.000 | 0.262 | 0.019 | 1.387 | 0.280 | 0.628 | 0.027 |
| 440 | 70510 | SENSE | 0.037 | 0.763 | 0.021 | 0.799 | 1.329 | 0.020 | 0.220 | 0.011 |
| 441 | 70605 | SENSE | 0.341 | 0.058 | 0.390 | 0.036 | 0.802 | 0.002 | 0.668 | 0.008 |
| 803 | 70802 | SENSE | 0.244 | 0.025 | 0.221 | 0.030 | 0.948 | 0.275 | 0.540 | 0.035 |
| 443 | 70812 | SENSE | 0.229 | 0.150 | 0.259 | 0.036 | 0.644 | 0.181 | 0.483 | 0.054 |
| 804 | 70817 | SENSE | 0.346 | 0.008 | 0.322 | 0.010 | 0.417 | 0.147 | 0.613 | 0.050 |
| 805 | 70819 | SENSE | 0.018 | 0.846 | 0.100 | 0.108 | −0.250 | 0.009 | 0.062 | 0.097 |
| 806 | 70908 | SENSE | 0.284 | 0.070 | 0.327 | 0.028 | 0.955 | 0.158 | 0.935 | 0.002 |
| 445 | 70939 | SENSE | 0.241 | 0.025 | 0.162 | 0.001 | 1.414 | 0.143 | 0.376 | 0.056 |
| 607 | 70941 | SENSE | 0.648 | 0.008 | 0.656 | 0.002 | 3.713 | 0.006 | 1.061 | 0.009 |
| 741 | 71215 | SENSE | 0.253 | 0.023 | 0.193 | 0.026 | 2.155 | 0.037 | 0.561 | 0.019 |
| 447 | 71446 | SENSE | 0.288 | 0.014 | 0.312 | 0.014 | 1.490 | 0.088 | 0.794 | 0.011 |
| 807 | 72351 | SENSE | 0.234 | 0.026 | 0.213 | 0.000 | 1.041 | 0.134 | 0.247 | 0.062 |

TABLE 6-continued

| PEP SEQ ID NO | Construct ID | Orientation | Root length at day 11 Delta mean | Root length at day 11 P-value | Root length at day 14 Delta mean | Root length at day 14 P-value | Growth stage at day 14 RS mean | Growth stage at day 14 P-value | Seedling weight at day 14 Delta mean | Seedling weight at day 14 P-value |
|---|---|---|---|---|---|---|---|---|---|---|
| 545 | 72603 | SENSE | 0.688 | 0.007 | 0.570 | 0.007 | 0.854 | 0.070 | 1.029 | 0.028 |
| 459 | 72983 | SENSE | 0.113 | 0.198 | 0.119 | 0.079 | 1.072 | 0.576 | 0.304 | 0.081 |
| 453 | 72026 | SENSE | 0.222 | 0.149 | 0.255 | 0.054 | 3.706 | 0.006 | 0.715 | 0.053 |
| 810 | 73709 | SENSE | 0.180 | 0.055 | 0.173 | 0.055 | 0.209 | 0.342 | 0.493 | 0.114 |
| 557 | 73750 | SENSE | 0.184 | 0.037 | 0.168 | 0.021 | 0.111 | 0.585 | 0.573 | 0.002 |
| 558 | 73751 | SENSE | 0.039 | 0.765 | 0.129 | 0.101 | 1.961 | 0.091 | 0.487 | 0.055 |
| 786 | 73578 | SENSE | 0.194 | 0.004 | 0.103 | 0.008 | 0.330 | 0.137 | −0.017 | 0.929 |
| 813 | 73851 | SENSE | 0.644 | 0.005 | 0.500 | 0.000 | 3.097 | 0.026 | 0.955 | 0.005 |
| 787 | 74112 | SENSE | 0.390 | 0.007 | 0.257 | 0.001 | 0.636 | 0.178 | 0.337 | 0.156 |
| 814 | 74156 | SENSE | 0.395 | 0.001 | 0.328 | 0.004 | 0.829 | 0.079 | 0.454 | 0.000 |
| 815 | 74194 | SENSE | 0.062 | 0.352 | 0.057 | 0.218 | 0.995 | 0.082 | 0.173 | 0.040 |
| 562 | 73929 | SENSE | 0.211 | 0.311 | 0.245 | 0.125 | 0.822 | 0.111 | 0.621 | 0.071 |
| 816 | 74252 | SENSE | 0.678 | 0.010 | 0.604 | 0.018 | 1.627 | 0.027 | 1.330 | 0.028 |
| 569 | 74315 | SENSE | −0.087 | 0.327 | −0.042 | 0.472 | 0.088 | 0.600 | 0.282 | 0.094 |
| 817 | 74317 | SENSE | 0.227 | 0.082 | 0.205 | 0.122 | 3.190 | 0.059 | 0.424 | 0.011 |
| 476 | 74388 | SENSE | 0.185 | 0.112 | 0.140 | 0.084 | 1.750 | 0.110 | 0.533 | 0.032 |
| 819 | 74506 | SENSE | 0.211 | 0.032 | 0.220 | 0.038 | 1.329 | 0.203 | 0.525 | 0.016 |
| 479 | 74522 | SENSE | 0.262 | 0.022 | 0.188 | 0.076 | 0.562 | 0.265 | 0.184 | 0.494 |
| 820 | 74540 | SENSE | 0.318 | 0.066 | 0.219 | 0.094 | 0.137 | 0.610 | 0.299 | 0.316 |
| 752 | 74577 | SENSE | 0.216 | 0.144 | 0.183 | 0.041 | 1.105 | 0.296 | 0.518 | 0.020 |
| 808 | 73087 | SENSE | 0.125 | 0.466 | 0.200 | 0.059 | 0.067 | 0.398 | 0.446 | 0.043 |
| 818 | 74328 | SENSE | 0.069 | 0.309 | 0.092 | 0.005 | 0.544 | 0.442 | 0.354 | 0.000 |
| 821 | 74650 | SENSE | 0.015 | 0.657 | 0.008 | 0.919 | 1.307 | 0.031 | 0.352 | 0.026 |
| 614 | 74546 | SENSE | 0.318 | 0.003 | 0.307 | 0.001 | 1.709 | 0.071 | 0.524 | 0.005 |
| 824 | 74956 | SENSE | 0.194 | 0.005 | 0.199 | 0.064 | 1.553 | 0.063 | 0.455 | 0.024 |
| 751 | 74556 | SENSE | 0.006 | 0.952 | 0.109 | 0.212 | 0.334 | 0.283 | 0.419 | 0.080 |
| 791 | 74393 | SENSE | 0.410 | 0.023 | 0.384 | 0.057 | 0.656 | 0.002 | 0.696 | 0.020 |
| 826 | 75255 | SENSE | −0.002 | 0.984 | 0.033 | 0.689 | 0.518 | 0.504 | 0.490 | 0.093 |
| 827 | 75269 | SENSE | 0.122 | 0.095 | 0.095 | 0.278 | 1.520 | 0.292 | 0.519 | 0.046 |
| 587 | 75289 | SENSE | 0.218 | 0.001 | 0.213 | 0.024 | 2.926 | 0.112 | 0.543 | 0.021 |
| 809 | 73223 | SENSE | 0.340 | 0.140 | 0.249 | 0.179 | 0.420 | 0.351 | 0.729 | 0.073 |
| 784 | 73283 | SENSE | 0.128 | 0.292 | 0.320 | 0.200 | −0.006 |  | 0.682 | 0.032 |
| 811 | 73804 | SENSE | 0.174 | 0.069 | 0.090 | 0.328 | 0.140 | 0.536 | 0.095 | 0.609 |
| 559 | 73814 | SENSE | 0.135 | 0.100 | 0.185 | 0.082 | 0.800 | 0.293 | 0.375 | 0.104 |
| 812 | 73819 | SENSE | 0.344 | 0.017 | 0.321 | 0.021 | 2.159 | 0.117 | 0.672 | 0.027 |
| 471 | 73863 | SENSE | 0.335 | 0.030 | 0.251 | 0.041 | 1.905 | 0.220 | 0.563 | 0.050 |
| 472 | 74059 | SENSE | 0.265 | 0.039 | 0.293 | 0.022 | −0.146 | 0.035 | 0.298 | 0.161 |
| 746 | 74080 | SENSE | 0.107 | 0.509 | 0.130 | 0.133 | 1.101 | 0.293 | 0.584 | 0.071 |
| 482 | 74707 | SENSE | 0.544 | 0.029 | 0.623 | 0.013 | 0.966 | 0.104 | 1.122 | 0.007 |
| 822 | 74718 | SENSE | 0.289 | 0.111 | 0.382 | 0.021 | 0.648 | 0.404 | 0.646 | 0.112 |
| 580 | 74733 | SENSE | 0.152 | 0.138 | 0.129 | 0.095 | 0.190 | 0.685 | 0.220 | 0.338 |
| 823 | 74745 | SENSE | 0.166 | 0.035 | 0.123 | 0.240 | 1.102 | 0.100 | 0.580 | 0.014 |
| 581 | 74749 | SENSE | 0.444 | 0.048 | 0.478 | 0.010 | 0.796 | 0.173 | 1.076 | 0.008 |
| 582 | 74752 | SENSE | 0.260 | 0.310 | 0.450 | 0.088 | 0.467 | 0.284 | 0.947 | 0.022 |
| 754 | 74753 | SENSE | −0.058 | 0.235 | 0.082 | 0.326 |  |  | 0.330 | 0.005 |
| 755 | 74754 | SENSE | 0.230 | 0.088 | 0.228 | 0.077 | 0.966 | 0.353 | 0.407 | 0.118 |
| 484 | 74755 | SENSE | 0.070 | 0.574 | −0.020 | 0.470 | 0.265 | 0.208 | 0.455 | 0.073 |
| 493 | 75355 | SENSE | 0.290 | 0.057 | 0.305 | 0.000 | 0.440 | 0.425 | 0.360 | 0.301 |
| 828 | 75432 | SENSE | 0.249 | 0.020 | 0.178 | 0.100 | 0.475 | 0.196 | 0.216 | 0.454 |
| 829 | 75468 | SENSE | 0.146 | 0.344 | 0.185 | 0.054 | 1.373 | 0.268 | 0.311 | 0.141 |
| 794 | 75752 | SENSE | 0.402 | 0.058 | 0.394 | 0.049 | 0.521 | 0.335 | 0.672 | 0.027 |
| 760 | 75931 | SENSE | 0.104 | 0.239 | 0.074 | 0.433 | 1.121 | 0.209 | 0.321 | 0.069 |
| 832 | 76064 | SENSE | 0.349 | 0.011 | 0.270 | 0.046 | 0.152 | 0.360 | 0.250 | 0.295 |
| 797 | 76101 | SENSE | 0.527 | 0.064 | 0.542 | 0.107 | 0.724 | 0.367 | 1.480 | 0.024 |
| 833 | 76121 | SENSE | −0.026 | 0.849 | 0.019 | 0.829 | 2.841 | 0.059 | 0.069 | 0.822 |
| 834 | 76193 | SENSE | 0.262 | 0.020 | 0.254 | 0.021 | 0.834 | 0.097 | 0.441 | 0.054 |
| 835 | 76237 | SENSE | 0.334 | 0.098 | 0.365 | 0.047 | 0.727 | 0.042 | 0.786 | 0.137 |
| 836 | 76281 | SENSE | 0.167 | 0.154 | 0.181 | 0.184 | 0.572 | 0.096 | 0.598 | 0.092 |
| 762 | 76293 | SENSE | 0.042 | 0.763 | −0.044 | 0.776 | 0.769 | 0.270 | 0.610 | 0.017 |
| 831 | 75911 | SENSE | 0.179 | 0.041 | 0.143 | 0.083 | 1.508 | 0.266 | 0.464 | 0.001 |
| 830 | 75686 | SENSE | 0.378 | 0.036 | 0.358 | 0.039 | 1.039 | 0.057 | 0.666 | 0.014 |
| 837 | 76388 | SENSE | 0.209 | 0.054 | 0.163 | 0.136 | 0.853 | 0.367 | 0.485 | 0.013 |
| 838 | 76557 | SENSE | 0.165 | 0.042 | 0.104 | 0.095 | 1.943 | 0.027 | 0.395 | 0.031 |
| 839 | 76567 | SENSE | −0.046 | 0.551 | 0.067 | 0.196 | 1.685 | 0.108 | 0.273 | 0.053 |
| 507 | 76575 | SENSE | 0.101 | 0.302 | 0.183 | 0.067 | 0.121 | 0.496 | 0.298 | 0.306 |
| 840 | 76624 | SENSE | 0.399 | 0.047 | 0.367 | 0.041 | 0.652 | 0.122 | 0.622 | 0.069 |
| 597 | 76719 | SENSE | 0.229 | 0.051 | 0.140 | 0.317 | 0.726 | 0.330 | 0.487 | 0.083 |
| 841 | 76764 | SENSE | 0.482 | 0.036 | 0.376 | 0.036 | 2.259 | 0.163 | 0.670 | 0.127 |
| 825 | 75076 | SENSE | 0.186 | 0.139 | 0.233 | 0.016 | 2.197 | 0.062 | 0.538 | 0.031 |
| 843 | 76976 | SENSE | 0.455 | 0.013 | 0.375 | 0.044 | 3.499 | 0.020 | 0.737 | 0.007 |
| 844 | 76985 | SENSE | 0.313 | 0.050 | 0.299 | 0.037 | 3.310 | 0.041 | 0.587 | 0.048 |
| 842 | 76855 | SENSE | 0.463 | 0.026 | 0.636 | 0.010 | 0.188 | 0.020 | 1.334 | 0.001 |
| 599 | 76891 | SENSE | 0.325 | 0.000 | 0.368 | 0.003 | 0.445 | 0.087 | 0.795 | 0.003 |

TABLE 6-continued

| PEP SEQ ID NO | Construct ID | Orientation | Root length at day 11 | | Root length at day 14 | | Growth stage at day 14 | | Seedling weight at day 14 | |
|---|---|---|---|---|---|---|---|---|---|---|
| | | | Delta mean | P-value | Delta mean | P-value | RS mean | P-value | Delta mean | P-value |
| 845 | 77014 | SENSE | 0.005 | 0.889 | −0.040 | 0.597 | 0.024 | 0.932 | 0.265 | 0.098 |
| 522 | 77351 | SENSE | 0.392 | 0.048 | 0.454 | 0.014 | 2.912 | 0.052 | 1.340 | 0.006 |
| 631 | 77366 | SENSE | 0.214 | 0.007 | 0.159 | 0.017 | 0.205 | 0.076 | 0.382 | 0.029 |
| 846 | 77112 | SENSE | −0.001 | 0.986 | 0.020 | 0.801 | 1.640 | 0.020 | 0.583 | 0.025 |
| 847 | 77117 | SENSE | 0.219 | 0.058 | 0.234 | 0.116 | 1.406 | 0.172 | 0.516 | 0.072 |
| 768 | 77128 | SENSE | 0.239 | 0.020 | 0.312 | 0.019 | 0.324 | 0.523 | 0.470 | 0.028 |
| 520 | 77135 | SENSE | 0.153 | 0.070 | 0.133 | 0.059 | 0.386 | 0.503 | 0.344 | 0.064 |
| 848 | 77138 | SENSE | 0.171 | 0.030 | 0.271 | 0.012 | 1.211 | 0.256 | 0.482 | 0.035 |
| 770 | 77159 | SENSE | 0.188 | 0.115 | 0.220 | 0.110 | 1.176 | 0.381 | 0.589 | 0.039 |
| 600 | 77208 | SENSE | 0.321 | 0.075 | 0.254 | 0.154 | 0.183 | 0.578 | 0.540 | 0.059 |
| 521 | 77219 | SENSE | 0.297 | 0.090 | 0.413 | 0.018 | 2.299 | 0.024 | 1.010 | 0.014 |
| 849 | 77226 | SENSE | 0.164 | 0.193 | 0.098 | 0.413 | 1.279 | 0.142 | 0.264 | 0.043 |
| 621 | 77401 | SENSE | 0.317 | 0.068 | 0.274 | 0.018 | 1.134 | 0.258 | 0.502 | 0.213 |
| 850 | 77418 | SENSE | 0.204 | 0.096 | 0.201 | 0.110 | 0.344 | 0.184 | 0.626 | 0.005 |

If $p<0.05$ and delta or risk score mean $>0$, the transgenic plants showed statistically significant trait improvement as compared to the reference. If $p<0.2$ and delta or risk score mean $>0$, the transgenic plants showed a trend of trait improvement as compared to the reference.

E. Polyethylene Glycol (PEG) Induced Osmotic Stress Tolerance Screen

There are numerous factors, which can influence seed germination and subsequent seedling growth, one being the availability of water. Genes, which can directly affect the success rate of germination and early seedling growth, are potentially useful agronomic traits for improving the germination and growth of crop plants under drought stress. In this assay, PEG was used to induce osmotic stress on germinating transgenic lines of *Arabidopsis thaliana* seeds in order to screen for osmotically resistant seed lines.

T2 seeds were plated on BASTA selection plates containing 3% PEG and grown under standard light and temperature conditions. Seeds were plated on each plate containing 3% PEG, ½× MS salts, 1% phytagel, and 10 µg/ml glufosinate. Plates were placed at 4° C. for 3 days to stratify seeds. On day 11, plants were measured for primary root length. After 3 more days of growth, i.e., at day 14, plants were scored for transgenic status, primary root length, growth stage, visual color, and the seedlings were pooled for fresh weight measurement. A photograph of the whole plate was taken on day 14.

Seedling weight and root length were analyzed as quantitative responses according to example 1M. The final growth stage at day 14 was scored as success or failure based on whether the plants reached 3 rosette leaves and size of leaves are greater than 1 mm. The growth stage data was analyzed as a qualitative response according to example 1 L. Table 7 provides a list of recombinant DNA constructs that improve osmotic stress tolerance in transgenic plants.

TABLE 7

| PEP SEQ ID NO | Construct ID | Orientation | Root length at day 11 | | Root length at day 14 | | Growth stage at day 14 | | Seedling weight at day 14 | |
|---|---|---|---|---|---|---|---|---|---|---|
| | | | Delta mean | P-value | Delta mean | P-value | RS mean | P-value | Delta mean | P-value |
| 694 | 10443 | ANTI-SENSE | 0.162 | 0.251 | 0.127 | 0.118 | 3.475 | 0.022 | 0.547 | 0.157 |
| 772 | 10923 | ANTI-SENSE | 0.235 | 0.033 | 0.332 | 0.010 | 3.496 | 0.020 | 0.284 | 0.098 |
| 524 | 14835 | ANTI-SENSE | 0.195 | 0.134 | 0.126 | 0.173 | 1.477 | 0.362 | 0.300 | 0.050 |
| 773 | 14836 | SENSE | 0.210 | 0.159 | 0.037 | 0.707 | 2.867 | 0.040 | 0.205 | 0.332 |
| 801 | 16424 | ANTI-SENSE | 0.309 | 0.055 | 0.201 | 0.210 | 2.261 | 0.150 | 0.375 | 0.012 |
| 530 | 18332 | SENSE | 0.129 | 0.095 | 0.141 | 0.028 | 2.205 | 0.134 | 0.062 | 0.379 |
| 737 | 18536 | SENSE | 0.214 | 0.036 | 0.228 | 0.065 | 3.062 | 0.082 | 0.323 | 0.153 |
| 696 | 18537 | SENSE | 0.206 | 0.030 | 0.197 | 0.034 | 2.641 | 0.076 | 0.399 | 0.112 |
| 697 | 18831 | SENSE | 0.002 | 0.988 | 0.030 | 0.828 | 3.243 | 0.050 | −0.170 | 0.134 |
| 698 | 19044 | ANTI-SENSE | 0.300 | 0.082 | 0.220 | 0.006 | 2.465 | 0.113 | 0.284 | 0.113 |
| 695 | 17814 | SENSE | 0.215 | 0.056 | 0.057 | 0.542 | 4.000 | 0.000 | 0.573 | 0.004 |
| 433 | 18401 | SENSE | 0.229 | 0.017 | 0.143 | 0.252 | 1.670 | 0.065 | 0.503 | 0.004 |
| 532 | 18623 | SENSE | 0.246 | 0.028 | 0.205 | 0.050 | 1.836 | 0.002 | 0.356 | 0.009 |
| 739 | 19624 | SENSE | 0.088 | 0.232 | −0.011 | 0.867 | 1.317 | 0.075 | 0.458 | 0.135 |
| 699 | 19950 | SENSE | 0.225 | 0.119 | 0.214 | 0.072 | 3.393 | 0.030 | 0.335 | 0.078 |
| 700 | 70221 | SENSE | 0.148 | 0.179 | 0.076 | 0.152 | 3.183 | 0.060 | 0.351 | 0.088 |
| 776 | 70236 | SENSE | 0.094 | 0.489 | 0.115 | 0.414 | 2.368 | 0.033 | 0.116 | 0.179 |

TABLE 7-continued

| PEP SEQ ID NO | Construct ID | Orientation | Root length at day 11 Delta mean | Root length at day 11 P-value | Root length at day 14 Delta mean | Root length at day 14 P-value | Growth stage at day 14 RS mean | Growth stage at day 14 P-value | Seedling weight at day 14 Delta mean | Seedling weight at day 14 P-value |
|---|---|---|---|---|---|---|---|---|---|---|
| 441 | 70605 | SENSE | 0.423 | 0.020 | 0.355 | 0.042 | 3.087 | 0.021 | 0.588 | 0.075 |
| 803 | 70802 | SENSE | 0.182 | 0.345 | 0.089 | 0.596 | 3.228 | 0.053 | 0.183 | 0.477 |
| 780 | 70804 | SENSE | 0.244 | 0.053 | 0.108 | 0.207 | 2.514 | 0.233 | 0.434 | 0.011 |
| 539 | 70830 | SENSE | 0.226 | 0.030 | 0.064 | 0.387 | 0.914 | 0.354 | 0.272 | 0.028 |
| 445 | 70939 | SENSE | 0.086 | 0.396 | −0.040 | 0.508 | 3.390 | 0.031 | 0.335 | 0.058 |
| 701 | 71110 | SENSE | −0.206 | 0.153 | −0.164 | 0.212 | 1.410 | 0.018 | −0.318 | 0.079 |
| 741 | 71215 | SENSE | 0.337 | 0.025 | 0.152 | 0.047 | 2.979 | 0.000 | 0.566 | 0.032 |
| 447 | 71446 | SENSE | 0.263 | 0.003 | 0.129 | 0.155 | 2.672 | 0.057 | 0.500 | 0.011 |
| 702 | 71718 | SENSE | 0.197 | 0.031 | 0.257 | 0.036 | 3.310 | 0.041 | 0.189 | 0.137 |
| 703 | 71838 | SENSE | 0.234 | 0.039 | 0.260 | 0.016 | 3.164 | 0.063 | 0.079 | 0.583 |
| 704 | 72087 | SENSE | 0.242 | 0.052 | 0.216 | 0.060 | 4.000 | 0.000 | 0.299 | 0.177 |
| 543 | 72352 | SENSE | 0.194 | 0.185 | 0.259 | 0.053 | 1.666 | 0.069 | 0.227 | 0.080 |
| 544 | 72413 | SENSE | 0.082 | 0.241 | 0.158 | 0.024 | 3.196 | 0.058 | −0.040 | 0.748 |
| 545 | 72603 | SENSE | 0.178 | 0.197 | 0.180 | 0.208 | 3.093 | 0.076 | 0.127 | 0.489 |
| 455 | 72637 | SENSE | 0.247 | 0.002 | 0.197 | 0.017 | 3.274 | 0.046 | 0.348 | 0.041 |
| 546 | 72676 | SENSE | 0.141 | 0.015 | 0.181 | 0.094 | 4.000 | 0.000 | 0.301 | 0.017 |
| 705 | 72729 | SENSE | 0.402 | 0.017 | 0.242 | 0.001 | 2.119 | 0.090 | 0.568 | 0.005 |
| 783 | 72824 | SENSE | 0.166 | 0.281 | 0.349 | 0.071 | 2.355 | 0.107 | 0.278 | 0.212 |
| 610 | 72978 | SENSE | 0.190 | 0.112 | 0.304 | 0.032 | 1.328 | 0.494 | −0.047 | 0.654 |
| 706 | 73302 | SENSE | 0.400 | 0.001 | 0.346 | 0.026 | 3.489 | 0.021 | 0.497 | 0.010 |
| 744 | 73666 | SENSE | 0.361 | 0.017 | 0.177 | 0.258 | 3.488 | 0.021 | 0.757 | 0.008 |
| 810 | 73709 | SENSE | 0.222 | 0.041 | 0.130 | 0.258 | 2.104 | 0.106 | 0.426 | 0.009 |
| 709 | 73736 | SENSE | 0.275 | 0.026 | 0.210 | 0.006 | 2.536 | 0.115 | 0.378 | 0.112 |
| 551 | 73031 | SENSE | 0.095 | 0.109 | 0.201 | 0.033 | 3.122 | 0.019 | 0.178 | 0.262 |
| 707 | 73484 | SENSE | 0.365 | 0.104 | 0.185 | 0.315 | 2.980 | 0.029 | 0.489 | 0.017 |
| 786 | 73578 | SENSE | 0.113 | 0.118 | 0.125 | 0.209 | 2.516 | 0.083 | 0.156 | 0.251 |
| 708 | 73594 | SENSE | 0.087 | 0.625 | 0.183 | 0.201 | 1.230 | 0.041 | 0.140 | 0.232 |
| 627 | 73935 | SENSE | 0.378 | 0.000 | 0.261 | 0.037 | 3.484 | 0.021 | 0.489 | 0.023 |
| 711 | 74266 | SENSE | −0.005 | 0.943 | −0.050 | 0.648 | 2.571 | 0.074 | 0.287 | 0.074 |
| 789 | 74278 | SENSE | 0.145 | 0.299 | 0.134 | 0.452 | 3.666 | 0.008 | 0.350 | 0.140 |
| 790 | 74359 | SENSE | 0.365 | 0.026 | 0.291 | 0.112 | 2.220 | 0.053 | 0.351 | 0.030 |
| 792 | 74414 | SENSE | 0.310 | 0.035 | 0.272 | 0.054 | 2.515 | 0.037 | 0.323 | 0.015 |
| 479 | 74522 | SENSE | 0.224 | 0.077 | 0.169 | 0.016 | 2.547 | 0.086 | 0.178 | 0.333 |
| 750 | 74539 | SENSE | 0.327 | 0.102 | 0.197 | 0.371 | 3.356 | 0.012 | 0.496 | 0.011 |
| 820 | 74540 | SENSE | 0.290 | 0.007 | 0.376 | 0.013 | 3.350 | 0.036 | 0.458 | 0.096 |
| 714 | 74574 | SENSE | 0.236 | 0.096 | 0.155 | 0.053 | 2.448 | 0.255 | 0.179 | 0.475 |
| 715 | 74607 | SENSE | 0.274 | 0.007 | 0.285 | 0.004 | 2.783 | 0.053 | 0.341 | 0.007 |
| 716 | 74642 | SENSE | 0.386 | 0.022 | 0.273 | 0.089 | 2.308 | 0.009 | 0.378 | 0.141 |
| 615 | 74558 | SENSE | 0.184 | 0.012 | 0.053 | 0.528 | 2.052 | 0.036 | 0.097 | 0.259 |
| 751 | 74556 | SENSE | 0.258 | 0.186 | 0.160 | 0.362 | 2.253 | 0.042 | 0.477 | 0.059 |
| 488 | 75231 | SENSE | 0.035 | 0.555 | 0.061 | 0.577 | 3.350 | 0.036 | 0.253 | 0.059 |
| 617 | 75234 | SENSE | 0.053 | 0.310 | 0.018 | 0.240 | 3.273 | 0.046 | 0.197 | 0.096 |
| 587 | 75289 | SENSE | 0.226 | 0.032 | 0.245 | 0.019 | 3.458 | 0.024 | 0.506 | 0.052 |
| 785 | 73292 | SENSE | −0.003 | 0.956 | 0.008 | 0.746 | 2.088 | 0.079 | 0.274 | 0.120 |
| 811 | 73804 | SENSE | 0.305 | 0.051 | 0.273 | 0.170 | 2.250 | 0.150 | 0.377 | 0.021 |
| 717 | 75015 | SENSE | −0.036 | 0.360 | −0.065 | 0.167 | 3.362 | 0.034 | 0.111 | 0.227 |
| 710 | 74016 | SENSE | 0.176 | 0.019 | 0.207 | 0.007 | 2.898 | 0.035 | 0.255 | 0.133 |
| 564 | 74072 | SENSE | 0.025 | 0.522 | 0.027 | 0.699 | 3.304 | 0.042 | 0.109 | 0.274 |
| 712 | 74479 | SENSE | 0.059 | 0.362 | 0.152 | 0.184 | 2.226 | 0.130 | 0.226 | 0.076 |
| 571 | 74490 | SENSE | 0.002 | 0.956 | 0.097 | 0.405 | 3.332 | 0.038 | 0.268 | 0.136 |
| 713 | 74549 | SENSE | 0.152 | 0.027 | 0.069 | 0.254 | 3.392 | 0.031 | 0.244 | 0.056 |
| 482 | 74707 | SENSE | 0.322 | 0.002 | 0.148 | 0.040 | 2.228 | 0.164 | 0.392 | 0.021 |
| 822 | 74718 | SENSE | 0.248 | 0.176 | 0.188 | 0.320 | 3.180 | 0.061 | 0.630 | 0.091 |
| 580 | 74733 | SENSE | 0.207 | 0.021 | 0.216 | 0.036 | 4.000 | 0.000 | 0.156 | 0.062 |
| 582 | 74752 | SENSE | −0.020 | 0.679 | −0.035 | 0.616 | 1.181 | 0.182 | 0.188 | 0.054 |
| 484 | 74755 | SENSE | 0.517 | 0.002 | 0.386 | 0.016 | 4.000 | 0.000 | 0.686 | 0.005 |
| 718 | 75380 | SENSE | 0.038 | 0.789 | −0.045 | 0.789 | 3.336 | 0.037 | 0.135 | 0.401 |
| 720 | 75765 | SENSE | 0.256 | 0.182 | 0.165 | 0.185 | 2.481 | 0.244 | 0.445 | 0.035 |
| 795 | 75867 | SENSE | −0.430 | 0.150 | −0.192 | 0.321 | 0.708 | 0.082 | −0.315 | 0.193 |
| 719 | 75560 | SENSE | 0.089 | 0.012 | 0.107 | 0.281 | 1.805 | 0.144 | 0.125 | 0.416 |
| 794 | 75752 | SENSE | 0.236 | 0.022 | 0.217 | 0.003 | 2.872 | 0.036 | 0.332 | 0.017 |
| 721 | 75977 | SENSE | 0.148 | 0.019 | 0.169 | 0.012 | 3.354 | 0.035 | 0.069 | 0.615 |
| 499 | 75984 | SENSE | 0.389 | 0.049 | 0.237 | 0.199 | 2.581 | 0.098 | 0.501 | 0.064 |
| 722 | 76052 | SENSE | 0.133 | 0.135 | 0.095 | 0.201 | 3.291 | 0.043 | 0.274 | 0.266 |
| 642 | 76061 | SENSE | 0.006 | 0.945 | 0.032 | 0.601 | 1.860 | 0.002 | 0.036 | 0.606 |
| 723 | 76109 | SENSE | 0.284 | 0.026 | 0.162 | 0.082 | 2.427 | 0.263 | 0.481 | 0.009 |
| 724 | 76116 | SENSE | 0.264 | 0.066 | 0.218 | 0.018 | 1.973 | 0.220 | 0.304 | 0.309 |
| 725 | 76158 | SENSE | 0.230 | 0.016 | 0.279 | 0.051 | 2.217 | 0.160 | −0.038 | 0.034 |
| 726 | 76232 | SENSE | 0.170 | 0.133 | 0.159 | 0.071 | 1.626 | 0.203 | 0.294 | 0.060 |
| 727 | 76269 | SENSE | 0.281 | 0.030 | 0.304 | 0.034 | 3.131 | 0.069 | 0.243 | 0.096 |
| 496 | 75907 | SENSE | 0.196 | 0.063 | 0.063 | 0.324 | 0.875 | 0.462 | 0.259 | 0.122 |
| 796 | 75910 | SENSE | 0.196 | 0.135 | 0.246 | 0.025 | 2.591 | 0.069 | 0.357 | 0.009 |
| 641 | 75975 | SENSE | 0.285 | 0.114 | 0.307 | 0.256 | 3.032 | 0.088 | 0.485 | 0.063 |

TABLE 7-continued

| PEP SEQ ID NO | Construct ID | Orientation | Root length at day 11 Delta mean | Root length at day 11 P-value | Root length at day 14 Delta mean | Root length at day 14 P-value | Growth stage at day 14 RS mean | Growth stage at day 14 P-value | Seedling weight at day 14 Delta mean | Seedling weight at day 14 P-value |
|---|---|---|---|---|---|---|---|---|---|---|
| 762 | 76293 | SENSE | 0.212 | 0.059 | −0.018 | 0.602 | 3.456 | 0.024 | 0.525 | 0.053 |
| 728 | 76303 | SENSE | −0.023 | 0.677 | 0.168 | 0.007 | 2.556 | 0.079 | 0.076 | 0.171 |
| 729 | 76474 | SENSE | 0.286 | 0.038 | 0.277 | 0.046 | 3.590 | 0.013 | 0.424 | 0.047 |
| 630 | 76403 | SENSE | 0.163 | 0.047 | 0.110 | 0.085 | 2.768 | 0.154 | 0.185 | 0.318 |
| 730 | 76529 | SENSE | 0.232 | 0.213 | 0.382 | 0.040 | 2.989 | 0.098 | −0.084 | 0.591 |
| 838 | 76557 | SENSE | 0.056 | 0.461 | 0.046 | 0.675 | 3.376 | 0.033 | 0.249 | 0.045 |
| 595 | 76513 | SENSE | 0.120 | 0.072 | 0.126 | 0.062 | 1.867 | 0.292 | 0.035 | 0.463 |
| 731 | 76625 | SENSE | 0.091 | 0.042 | 0.123 | 0.011 | 3.184 | 0.060 | 0.200 | 0.024 |
| 509 | 76741 | SENSE | −0.022 | 0.760 | 0.226 | 0.018 | 2.136 | 0.002 | −0.231 | 0.026 |
| 732 | 76759 | SENSE | −0.105 | 0.298 | −0.115 | 0.233 | 2.647 | 0.060 | −0.037 | 0.672 |
| 841 | 76764 | SENSE | 0.082 | 0.410 | −0.022 | 0.862 | 4.000 | 0.000 | 0.230 | 0.045 |
| 514 | 76917 | SENSE | 0.305 | 0.073 | 0.275 | 0.066 | 3.294 | 0.043 | 0.387 | 0.027 |
| 765 | 76804 | SENSE | 0.123 | 0.131 | 0.072 | 0.462 | 2.766 | 0.046 | 0.468 | 0.028 |
| 599 | 76891 | SENSE | 0.377 | 0.014 | 0.318 | 0.058 | 4.000 | 0.000 | 0.676 | 0.036 |
| 845 | 77014 | SENSE | 0.010 | 0.673 | 0.099 | 0.050 | 2.138 | 0.175 | −0.063 | 0.668 |
| 733 | 77026 | SENSE | 0.458 | 0.024 | 0.329 | 0.003 | 1.410 | 0.109 | 0.752 | 0.031 |
| 685 | 77055 | SENSE | 0.636 | 0.026 | 0.512 | 0.016 | 4.000 | 0.000 | 0.536 | 0.061 |
| 522 | 77351 | SENSE | 0.137 | 0.055 | 0.116 | 0.023 | 2.509 | 0.096 | 0.738 | 0.009 |
| 767 | 77115 | SENSE | 0.301 | 0.032 | 0.234 | 0.062 | 4.000 | 0.000 | 0.855 | 0.005 |
| 734 | 77131 | SENSE | 0.251 | 0.081 | 0.211 | 0.005 | 1.240 | 0.394 | 0.169 | 0.340 |
| 769 | 77158 | SENSE | 0.258 | 0.149 | 0.223 | 0.193 | 4.000 | 0.000 | 0.519 | 0.045 |
| 770 | 77159 | SENSE | 0.054 | 0.713 | −0.101 | 0.107 | 3.028 | 0.089 | 0.481 | 0.112 |
| 521 | 77219 | SENSE | 0.187 | 0.242 | 0.207 | 0.103 | 1.728 | 0.268 | 0.419 | 0.022 |
| 849 | 77226 | SENSE | 0.353 | 0.033 | 0.373 | 0.016 | 4.000 | 0.000 | 0.542 | 0.022 |
| 621 | 77401 | SENSE | 0.264 | 0.045 | 0.174 | 0.196 | 3.288 | 0.044 | 0.404 | 0.003 |
| 850 | 77418 | SENSE | 0.210 | 0.089 | 0.132 | 0.222 | 3.024 | 0.090 | 0.440 | 0.027 |

If $p<0.05$ and delta or risk score mean $>0$, the transgenic plants showed statistically significant trait improvement as compared to the reference.

If $p<0.2$ and delta or risk score mean $>0$, the transgenic plants showed a trend of trait improvement as compared to the reference.

F. Cold Shock Tolerance Screen

This example set forth a screen to identify *Arabidopsis* plants transformed with the genes of interest that are more tolerant to cold stress subjected during day 8 to day 28 after seed planting. During these crucial early stages, seedling growth and leaf area increase were measured to assess tolerance when *Arabidopsis* seedlings were exposed to low temperatures. Using this screen, genetic alterations can be found that enable plants to germinate and grow better than wild type plants under sudden exposure to low temperatures.

Eleven seedlings from T2 seeds of each transgenic line plus one control line were plated together on a plate containing ½× Gamborg Salts with 0.8 Phytagel™, 1% Phytagel, and 0.3% Sucrose. Plates were then oriented horizontally and stratified for three days at 4° C. At day three, plates were removed from stratification and exposed to standard conditions (16 hr photoperiod, 22° C. at day and 20° C. at night) until day 8. At day eight, plates were removed from standard conditions and exposed to cold shock conditions (24 hr photoperiod, 8° C. at both day and night) until the final day of the assay, i.e., day 28. Rosette areas were measured at day 8 and day 28, which were analyzed as quantitative responses according to example 1M. Table 8 provides a list of recombinant nucleotides that improve cold shock stress tolerance in plants.

TABLE 8

| PEP SEQ ID NO | Construct ID | Nomination ID | Orientation | Rosette area at day 8 Delta mean | Rosette area at day 8 P-value | Rosette area at day 28 Risk score mean | Rosette area at day 28 P-value | Rosette area difference Delta mean | Rosette area difference P-value |
|---|---|---|---|---|---|---|---|---|---|
| 426 | 10919 | CGPG699 | ANTI-SENSE | 0.437 | 0.036 | 0.247 | 0.108 | 0.265 | 0.013 |
| 428 | 11310 | CGPG267 | ANTI-SENSE | 0.224 | 0.560 | 0.497 | 0.218 | 0.832 | 0.055 |
| 429 | 11866 | CGPG1179 | ANTI-SENSE | 0.354 | 0.018 | 0.422 | 0.090 | 0.428 | 0.073 |
| 430 | 11937 | CGPG959 | ANTI-SENSE | −0.510 | 0.004 | −0.010 | 0.939 | 0.331 | 0.048 |
| 773 | 14836 | CGPG1072 | SENSE | 0.862 | 0.055 | 0.187 | 0.379 | 0.147 | 0.611 |
| 432 | 17410 | CGPG2446 | SENSE | 0.282 | 0.076 | 0.397 | 0.170 | 0.536 | 0.246 |
| 433 | 18401 | CGPG1862 | SENSE | 0.134 | 0.597 | 0.801 | 0.008 | 0.582 | 0.009 |
| 434 | 18665 | CGPG3014 | SENSE | 1.273 | 0.026 | 1.142 | 0.003 | 1.215 | 0.004 |

TABLE 8-continued

| PEP SEQ ID NO | Construct ID | Nomination ID | Orientation | Rosette area at day 8 Delta mean | P-value | Rosette area at day 28 Risk score mean | P-value | Rosette area difference Delta mean | P-value |
|---|---|---|---|---|---|---|---|---|---|
| 427 | 11142 | CGPG567 | SENSE | 0.916 | 0.053 | 0.255 | 0.234 | 0.048 | 0.792 |
| 431 | 16218 | CGPG2158 | SENSE | 0.443 | 0.278 | 0.475 | 0.081 | 0.501 | 0.074 |
| 435 | 19141 | CGPG1674 | SENSE | 0.901 | 0.002 | 0.935 | 0.000 | 0.956 | 0.000 |
| 436 | 19156 | CGPG2680 | SENSE | −0.483 | 0.002 | 0.610 | 0.002 | 0.576 | 0.052 |
| 437 | 19621 | CGPG3577 | SENSE | 0.231 | 0.388 | 1.265 | 0.058 | 1.486 | 0.059 |
| 438 | 19760 | CGPG4065 | SENSE | 0.759 | 0.043 | 0.833 | 0.029 | 0.983 | 0.021 |
| 439 | 19857 | CGPG3929 | SENSE | 0.060 | 0.931 | 0.766 | 0.090 | 0.853 | 0.097 |
| 440 | 70510 | CGPG2488 | SENSE | 0.591 | 0.010 | 0.146 | 0.520 | −0.009 | 0.978 |
| 441 | 70605 | CGPG3012 | SENSE | 0.442 | 0.088 | −0.167 | 0.612 | −0.624 | 0.107 |
| 442 | 70607 | CGPG3162 | SENSE | 0.747 | 0.209 | 1.688 | 0.001 | 1.929 | 0.001 |
| 443 | 70812 | CGPG607 | SENSE | 0.767 | 0.126 | 0.823 | 0.091 | 1.442 | 0.149 |
| 781 | 70821 | CGPG345 | SENSE | 0.523 | 0.039 | 0.380 | 0.019 | 0.584 | 0.070 |
| 444 | 70933 | CGPG4084 | SENSE | 0.506 | 0.071 | 1.352 | 0.009 | 1.660 | 0.012 |
| 445 | 70939 | CGPG3917 | SENSE | 0.310 | 0.057 | 1.473 | 0.012 | 1.787 | 0.014 |
| 779 | 70674 | CGPG4492 | SENSE | 0.060 | 0.625 | 1.600 | 0.013 | 1.904 | 0.012 |
| 446 | 71319 | CGPG4414 | SENSE | 0.292 | 0.299 | 0.516 | 0.089 | 0.494 | 0.090 |
| 447 | 71446 | CGPG185 | SENSE | 0.740 | 0.040 | 0.508 | 0.034 | 0.304 | 0.053 |
| 448 | 71609 | CGPG1679 | SENSE | 0.373 | 0.408 | 1.184 | 0.076 | 1.318 | 0.073 |
| 449 | 71649 | CGPG271 | SENSE | 0.652 | 0.037 | 0.656 | 0.157 | 1.012 | 0.060 |
| 450 | 71814 | CGPG4434 | SENSE | 0.311 | 0.066 | 0.548 | 0.006 | 0.498 | 0.008 |
| 451 | 71945 | CGPG2198 | SENSE | −0.140 | 0.232 | 0.603 | 0.013 | 0.755 | 0.011 |
| 452 | 72005 | CGPG5253 | SENSE | 0.369 | 0.180 | 1.152 | 0.012 | 1.410 | 0.015 |
| 782 | 72505 | CGPG4786 | SENSE | 0.487 | 0.021 | 0.632 | 0.086 | 0.714 | 0.077 |
| 454 | 72533 | CGPG4815 | SENSE | 0.099 | 0.817 | 0.286 | 0.087 | 0.158 | 0.077 |
| 455 | 72637 | CGPG4859 | SENSE | −0.231 | 0.461 | 0.641 | 0.034 | 0.698 | 0.025 |
| 456 | 72782 | CGPG1589 | SENSE | 1.087 | 0.013 | 0.655 | 0.050 | 0.274 | 0.208 |
| 457 | 72794 | CGPG1826 | SENSE | 0.375 | 0.150 | 0.648 | 0.076 | 0.528 | 0.074 |
| 458 | 72919 | CGPG3899 | SENSE | 0.628 | 0.039 | −0.151 | 0.385 | −0.346 | 0.155 |
| 459 | 72983 | CGPG5610 | SENSE | 0.760 | 0.006 | −0.077 | 0.605 | −0.453 | 0.195 |
| 463 | 73338 | CGPG4862 | SENSE | 0.473 | 0.301 | 0.600 | 0.053 | 0.833 | 0.039 |
| 464 | 73344 | CGPG4910 | SENSE | 0.350 | 0.074 | 0.394 | 0.170 | 0.280 | 0.453 |
| 466 | 73644 | CGPG1756 | SENSE | 0.637 | 0.050 | 0.893 | 0.069 | 0.968 | 0.007 |
| 467 | 73662 | CGPG4927 | SENSE | 0.402 | 0.133 | 1.524 | 0.005 | 1.791 | 0.002 |
| 468 | 73672 | CGPG5106 | SENSE | 0.943 | 0.012 | 0.901 | 0.038 | 0.991 | 0.033 |
| 453 | 72026 | CGPG5231 | SENSE | 0.447 | 0.104 | 0.699 | 0.124 | 0.705 | 0.084 |
| 469 | 73733 | CGPG5167 | SENSE | 0.308 | 0.336 | 0.295 | 0.015 | 0.197 | 0.108 |
| 460 | 73025 | CGPG5665 | SENSE | −0.139 | 0.244 | 0.441 | 0.012 | 0.585 | 0.004 |
| 462 | 73092 | CGPG5695 | SENSE | 0.183 | 0.396 | 1.011 | 0.035 | 0.986 | 0.069 |
| 465 | 73536 | CGPG6541 | SENSE | 0.767 | 0.043 | 0.731 | 0.024 | 0.826 | 0.024 |
| 473 | 74205 | CGPG5089 | SENSE | 0.443 | 0.198 | 0.824 | 0.078 | 0.728 | 0.159 |
| 474 | 74321 | CGPG5870 | SENSE | 0.132 | 0.257 | 0.715 | 0.002 | 0.789 | 0.000 |
| 475 | 74337 | CGPG5888 | SENSE | 1.176 | 0.010 | 0.981 | 0.003 | 0.987 | 0.001 |
| 476 | 74388 | CGPG1461 | SENSE | 0.489 | 0.116 | 0.480 | 0.092 | 0.297 | 0.287 |
| 792 | 74414 | CGPG6664 | SENSE | 1.118 | 0.037 | 0.557 | 0.021 | 0.388 | 0.040 |
| 479 | 74522 | CGPG82 | SENSE | 0.928 | 0.013 | 1.382 | 0.018 | 1.327 | 0.019 |
| 480 | 74526 | CGPG6761 | SENSE | 0.315 | 0.422 | 0.679 | 0.020 | 0.604 | 0.013 |
| 481 | 74576 | CGPG6781 | SENSE | 0.620 | 0.012 | −0.164 | 0.143 | −0.410 | 0.032 |
| 461 | 73050 | CGPG5697 | SENSE | 0.646 | 0.212 | 1.284 | 0.023 | 1.751 | 0.010 |
| 485 | 75202 | CGPG1743 | SENSE | 0.413 | 0.012 | 0.422 | 0.007 | 0.292 | 0.026 |
| 486 | 75220 | CGPG5434 | SENSE | 0.791 | 0.037 | 0.778 | 0.015 | 0.787 | 0.020 |
| 487 | 75226 | CGPG5824 | SENSE | 0.788 | 0.007 | 0.595 | 0.119 | 0.619 | 0.173 |
| 488 | 75231 | CGPG5879 | SENSE | 0.976 | 0.017 | 0.663 | 0.004 | 0.496 | 0.029 |
| 489 | 75239 | CGPG5949 | SENSE | 1.048 | 0.011 | 0.570 | 0.242 | 0.547 | 0.290 |
| 490 | 75258 | CGPG6096 | SENSE | 0.808 | 0.047 | 0.435 | 0.135 | 0.585 | 0.025 |
| 491 | 75270 | CGPG6218 | SENSE | 0.526 | 0.011 | 0.746 | 0.141 | 0.866 | 0.193 |
| 492 | 75271 | CGPG6226 | SENSE | 0.092 | 0.698 | 0.963 | 0.083 | 0.982 | 0.128 |
| 470 | 73846 | CGPG1924 | SENSE | 0.807 | 0.032 | 0.175 | 0.623 | 0.014 | 0.973 |
| 471 | 73863 | CGPG5201 | SENSE | 0.285 | 0.404 | 0.740 | 0.021 | 0.797 | 0.016 |
| 472 | 74059 | CGPG1884 | SENSE | 0.364 | 0.014 | 0.162 | 0.137 | −0.131 | 0.424 |
| 477 | 74412 | CGPG6743 | SENSE | 0.163 | 0.522 | 0.670 | 0.026 | 0.626 | 0.131 |
| 478 | 74445 | CGPG6722 | SENSE | 0.805 | 0.065 | 0.361 | 0.164 | 0.584 | 0.145 |
| 482 | 74707 | CGPG4914 | SENSE | 0.584 | 0.005 | 0.453 | 0.248 | 0.239 | 0.415 |
| 483 | 74743 | CGPG5840 | SENSE | 0.187 | 0.245 | 0.843 | 0.040 | 0.976 | 0.045 |
| 484 | 74755 | CGPG5980 | SENSE | 0.959 | 0.083 | 0.680 | 0.205 | 0.768 | 0.206 |
| 493 | 75355 | CGPG7518 | SENSE | 0.268 | 0.006 | 0.715 | 0.053 | 0.799 | 0.038 |
| 494 | 75460 | CGPG7654 | SENSE | 0.214 | 0.120 | 0.649 | 0.053 | 0.713 | 0.094 |
| 795 | 75867 | CGPG6965 | SENSE | 0.817 | 0.040 | 0.707 | 0.058 | 0.588 | 0.128 |
| 497 | 75927 | CGPG8229 | SENSE | 0.360 | 0.163 | 0.808 | 0.017 | 0.955 | 0.007 |
| 498 | 75962 | CGPG8224 | SENSE | −0.337 | 0.167 | 0.398 | 0.061 | 0.706 | 0.030 |
| 499 | 75984 | CGPG1927 | SENSE | 1.141 | 0.050 | 0.220 | 0.073 | 0.076 | 0.202 |
| 500 | 76119 | CGPG5962 | SENSE | 0.206 | 0.445 | 1.056 | 0.011 | 1.364 | 0.015 |

TABLE 8-continued

| PEP SEQ ID NO | Construct ID | Nomination ID | Orientation | Rosette area at day 8 Delta mean | P-value | Rosette area at day 28 Risk score mean | P-value | Rosette area difference Delta mean | P-value |
|---|---|---|---|---|---|---|---|---|---|
| 501 | 76209 | CGPG5375 | SENSE | 0.598 | 0.078 | 0.737 | 0.112 | 0.834 | 0.075 |
| 496 | 75907 | CGPG8259 | SENSE | 0.730 | 0.002 | 0.376 | 0.023 | 0.494 | 0.065 |
| 495 | 75847 | CGPG6875 | SENSE | 0.568 | 0.129 | 0.927 | 0.025 | 1.062 | 0.033 |
| 502 | 76323 | CGPG8949 | SENSE | 0.592 | 0.042 | 0.736 | 0.049 | 0.844 | 0.048 |
| 503 | 76346 | CGPG8943 | SENSE | 0.150 | 0.647 | 0.588 | 0.061 | 0.656 | 0.044 |
| 504 | 76352 | CGPG8896 | SENSE | 0.464 | 0.551 | 1.124 | 0.109 | 1.375 | 0.049 |
| 505 | 76360 | CGPG8960 | SENSE | 0.442 | 0.274 | 0.646 | 0.072 | 0.830 | 0.038 |
| 507 | 76575 | CGPG7260 | SENSE | 0.444 | 0.030 | 0.813 | 0.023 | 1.123 | 0.050 |
| 506 | 76512 | CGPG5891 | SENSE | −0.060 | 0.669 | 0.486 | 0.005 | 0.799 | 0.014 |
| 508 | 76733 | CGPG2647 | SENSE | 0.304 | 0.312 | 1.028 | 0.019 | 0.976 | 0.034 |
| 509 | 76741 | CGPG6995 | SENSE | 1.007 | 0.040 | 0.344 | 0.008 | 0.302 | 0.033 |
| 512 | 76902 | CGPG9083 | SENSE | 0.343 | 0.097 | 0.551 | 0.034 | 0.496 | 0.082 |
| 513 | 76913 | CGPG9076 | SENSE | 0.524 | 0.021 | 0.257 | 0.530 | 0.149 | 0.719 |
| 514 | 76917 | CGPG9108 | SENSE | 0.728 | 0.063 | 0.804 | 0.015 | 0.779 | 0.036 |
| 515 | 76929 | CGPG9109 | SENSE | 0.335 | 0.220 | 0.628 | 0.031 | 0.844 | 0.027 |
| 510 | 76845 | CGPG9046 | SENSE | 0.123 | 0.751 | 0.877 | 0.081 | 1.232 | 0.027 |
| 511 | 76857 | CGPG9047 | SENSE | 1.055 | 0.053 | 1.170 | 0.023 | 1.286 | 0.020 |
| 516 | 77009 | CGPG5933 | SENSE | 0.604 | 0.051 | 0.853 | 0.104 | 0.864 | 0.120 |
| 517 | 77022 | CGPG6335 | SENSE | 0.301 | 0.356 | 0.444 | 0.024 | 0.554 | 0.001 |
| 522 | 77351 | CGPG8087 | SENSE | 0.749 | 0.023 | 1.023 | 0.012 | 1.031 | 0.032 |
| 518 | 77108 | CGPG9174 | SENSE | 0.651 | 0.025 | 0.788 | 0.020 | 0.723 | 0.133 |
| 519 | 77125 | CGPG9120 | SENSE | 0.945 | 0.049 | 1.641 | 0.013 | 1.794 | 0.011 |
| 520 | 77135 | CGPG9200 | SENSE | 0.648 | 0.253 | 1.299 | 0.019 | 1.486 | 0.034 |
| 521 | 77219 | CGPG9263 | SENSE | 0.636 | 0.005 | 0.300 | 0.355 | 0.763 | 0.003 |

If p<0.05 and delta or risk score mean >0, the transgenic plants showed statistically significant trait improvement as compared to the reference (p value, of the delta of a quantitative response or of the risk score of a qualitative response, is the probability that the observed difference between the transgenic plants and the reference occur by chance) If p<0.2 and delta or risk score mean >0, the transgenic plants showed a trend of trait improvement as compared to the reference.

G. Cold Germination Tolerance Screen

This example sets forth a screen to identify *Arabidopsis* plants transformed with the genes of interests are resistant to cold stress based on their rate of development, root growth and chlorophyll accumulation under low temperature conditions. T2 seeds were plated and all seedlings used in the experiment were grown at 8° C. Seeds were first surface disinfested using chlorine gas and then seeded on assay plates containing an aqueous solution of ½× Gamborg's B/5 Basal Salt Mixture (Sigma/Aldrich Corp., St. Louis, Mo., USA G/5788), 1% Phytagel™ (Sigma-Aldrich, P-8169), and 10 ug/ml glufosinate with the final pH adjusted to 5.8 using KOH. Test plates were held vertically for 28 days at a constant temperature of 8° C., a photoperiod of 16 hr, and average light intensity of approximately 100 umol/m²/s. At 28 days post plating, root length was measured, growth stage was observed, the visual color was assessed, and a whole plate photograph was taken.

The root length at day 28 was analyzed as a quantitative response according to example 1M. The growth stage at day 7 was analyzed as a qualitative response according to example 1 L. Table 9 provides a list of recombinant DNA constructs that improve cold stress tolerance in transgenic plants.

TABLE 9

| PEP SEQ ID | Construct ID | Orientation | Root length at day 28 Delta mean | P-value | Growth stage at day28 Delta mean | P-value |
|---|---|---|---|---|---|---|
| 523 | 14810 | SENSE | 0.429 | 0.028 | 2.822 | 0.041 |
| 524 | 14835 | ANTI-SENSE | 0.307 | 0.114 | 2.658 | 0.058 |
| 525 | 15419 | ANTI-SENSE | / | / | 3.333 | 0.038 |
| 526 | 16223 | SENSE | 0.321 | 0.062 | 4.000 | 0.000 |
| 527 | 17903 | SENSE | / | / | 2.667 | 0.057 |
| 528 | 18279 | SENSE | 0.100 | 0.622 | 3.390 | 0.031 |
| 529 | 18284 | SENSE | 0.343 | 0.143 | 1.533 | 0.097 |
| 530 | 18332 | SENSE | 0.286 | 0.032 | 2.579 | 0.026 |
| 531 | 18349 | SENSE | 0.153 | 0.013 | 1.694 | 0.026 |
| 537 | 70125 | SENSE | 0.550 | 0.020 | 2.987 | 0.034 |
| 432 | 17410 | SENSE | 0.346 | 0.027 | 4.000 | 0.000 |
| 532 | 18623 | SENSE | 0.253 | 0.048 | 2.144 | 0.011 |
| 533 | 19551 | SENSE | 0.109 | 0.055 | 0.511 | 0.479 |
| 534 | 19627 | SENSE | 0.234 | 0.007 | 0.918 | 0.240 |
| 438 | 19760 | SENSE | 0.275 | 0.078 | 2.249 | 0.141 |
| 535 | 19785 | SENSE | 0.175 | 0.301 | 3.103 | 0.074 |
| 536 | 19944 | SENSE | 0.107 | 0.214 | 3.423 | 0.027 |
| 538 | 70504 | SENSE | −0.204 | 0.122 | 2.893 | 0.035 |
| 441 | 70605 | SENSE | −0.135 | 0.357 | 3.322 | 0.039 |
| 539 | 70830 | SENSE | 0.085 | 0.303 | 3.396 | 0.030 |
| 444 | 70933 | SENSE | 0.191 | 0.084 | 3.371 | 0.033 |
| 540 | 70943 | SENSE | 0.181 | 0.011 | 2.958 | 0.032 |
| 541 | 71711 | ANTI-SENSE | 0.086 | 0.492 | 3.345 | 0.036 |
| 542 | 71962 | SENSE | 0.251 | 0.096 | 3.025 | 0.090 |
| 543 | 72352 | SENSE | 0.267 | 0.200 | 3.358 | 0.035 |
| 544 | 72413 | SENSE | 0.316 | 0.087 | 4.000 | 0.000 |
| 545 | 72603 | SENSE | 0.703 | 0.015 | 3.298 | 0.011 |
| 546 | 72676 | SENSE | 0.164 | 0.097 | 2.360 | 0.012 |
| 547 | 72737 | SENSE | 0.153 | 0.127 | 2.900 | 0.035 |
| 548 | 72742 | SENSE | 0.320 | 0.038 | 2.868 | 0.127 |
| 549 | 72762 | SENSE | 0.904 | 0.015 | 2.647 | 0.087 |
| 552 | 73091 | SENSE | 0.357 | 0.027 | 2.858 | 0.038 |
| 554 | 73340 | SENSE | 0.305 | 0.015 | 1.663 | 0.346 |
| 453 | 72026 | SENSE | 0.365 | 0.027 | 3.359 | 0.035 |

TABLE 9-continued

| PEP SEQ ID | Construct ID | Orientation | Root length at day 28 Delta mean | P-value | Growth stage at day28 Delta mean | P-value |
|---|---|---|---|---|---|---|
| 557 | 73750 | SENSE | 0.353 | 0.032 | 4.000 | 0.000 |
| 558 | 73751 | SENSE | 0.668 | 0.008 | 4.000 | 0.000 |
| 551 | 73031 | SENSE | 0.265 | 0.005 | 4.000 | 0.000 |
| 555 | 73420 | SENSE | −0.007 | 0.910 | 2.116 | 0.031 |
| 556 | 73489 | SENSE | 0.266 | 0.069 | 3.297 | 0.043 |
| 567 | 74135 | SENSE | 0.092 | 0.134 | 1.544 | 0.014 |
| 550 | 72993 | SENSE | 0.305 | 0.085 | 2.926 | 0.032 |
| 562 | 73929 | SENSE | 0.260 | 0.018 | 4.000 | 0.000 |
| 568 | 74313 | SENSE | 0.157 | 0.026 | 3.280 | 0.045 |
| 569 | 74315 | SENSE | 0.158 | 0.012 | 4.000 | 0.000 |
| 790 | 74359 | SENSE | 0.341 | 0.080 | 2.062 | 0.101 |
| 570 | 74427 | SENSE | 0.132 | 0.097 | 1.952 | 0.051 |
| 573 | 74531 | SENSE | 0.242 | 0.018 | 4.000 | 0.000 |
| 574 | 74532 | SENSE | 0.288 | 0.079 | 3.361 | 0.034 |
| 575 | 74538 | SENSE | 0.250 | 0.226 | 3.737 | 0.005 |
| 576 | 74550 | SENSE | 0.245 | 0.043 | 4.000 | 0.000 |
| 577 | 74579 | SENSE | 0.255 | 0.002 | 3.346 | 0.036 |
| 578 | 74644 | SENSE | 0.105 | 0.492 | 2.711 | 0.052 |
| 584 | 74896 | SENSE | 0.381 | 0.036 | 4.000 | 0.000 |
| 585 | 74976 | SENSE | 0.134 | 0.038 | 2.342 | 0.293 |
| 586 | 74991 | SENSE | −0.132 | 0.117 | 1.739 | 0.090 |
| 488 | 75231 | SENSE | 0.042 | 0.074 | 4.000 | 0.000 |
| 587 | 75289 | SENSE | 0.173 | 0.053 | 4.000 | 0.000 |
| 553 | 73224 | SENSE | 0.245 | 0.077 | 1.439 | 0.015 |
| 785 | 73292 | SENSE | 0.169 | 0.363 | 2.790 | 0.055 |
| 559 | 73814 | SENSE | 0.305 | 0.075 | 1.976 | 0.058 |
| 560 | 73855 | SENSE | 0.637 | 0.034 | 3.222 | 0.015 |
| 561 | 73856 | SENSE | 0.650 | 0.011 | 2.895 | 0.056 |
| 471 | 73863 | SENSE | 0.132 | 0.134 | 3.385 | 0.032 |
| 572 | 74511 | SENSE | 0.265 | 0.011 | 0.667 | 0.423 |
| 563 | 74063 | SENSE | 0.244 | 0.005 | 4.000 | 0.000 |
| 564 | 74072 | SENSE | 0.245 | 0.005 | 2.536 | 0.225 |
| 565 | 74073 | SENSE | 0.352 | 0.065 | 3.019 | 0.091 |
| 566 | 74075 | SENSE | 0.240 | 0.026 | 4.000 | 0.000 |
| 478 | 74445 | SENSE | 0.223 | 0.073 | 2.618 | 0.064 |
| 571 | 74490 | SENSE | 0.143 | 0.016 | 4.000 | 0.000 |
| 579 | 74703 | SENSE | 0.468 | 0.024 | 3.125 | 0.070 |
| 580 | 74733 | SENSE | 0.487 | 0.020 | 2.504 | 0.088 |
| 581 | 74749 | SENSE | 0.501 | 0.026 | 3.406 | 0.029 |
| 582 | 74752 | SENSE | 0.276 | 0.097 | 3.389 | 0.031 |
| 484 | 74755 | SENSE | 0.136 | 0.392 | 2.821 | 0.045 |
| 583 | 74773 | SENSE | 0.376 | 0.004 | 4.000 | 0.000 |
| 795 | 75867 | SENSE | 0.401 | 0.061 | 4.000 | 0.000 |
| 793 | 75530 | SENSE | −0.032 | 0.760 | 2.385 | 0.098 |
| 588 | 76003 | SENSE | 0.239 | 0.021 | 1.611 | 0.315 |
| 589 | 76074 | SENSE | 0.269 | 0.033 | 2.696 | 0.174 |
| 590 | 76137 | SENSE | 0.316 | 0.075 | 2.624 | 0.081 |
| 591 | 76220 | SENSE | 0.074 | 0.516 | 2.585 | 0.089 |
| 796 | 75910 | SENSE | 0.225 | 0.070 | 4.000 | 0.000 |
| 592 | 76301 | SENSE | 0.110 | 0.308 | 2.683 | 0.055 |
| 593 | 76318 | SENSE | 0.052 | 0.600 | 2.692 | 0.078 |
| 594 | 76347 | SENSE | 0.088 | 0.362 | 3.254 | 0.049 |
| 596 | 76566 | SENSE | 0.144 | 0.052 | 2.408 | 0.117 |
| 595 | 76513 | SENSE | 0.316 | 0.019 | 3.347 | 0.036 |
| 597 | 76719 | SENSE | 0.099 | 0.063 | 4.000 | |
| 598 | 76757 | SENSE | 0.251 | 0.037 | 3.042 | 0.086 |
| 514 | 76917 | SENSE | 0.165 | 0.055 | 1.834 | 0.254 |
| 599 | 76891 | SENSE | 0.382 | 0.070 | 0.000 | 1.000 |
| 600 | 77208 | SENSE | 0.408 | 0.034 | 2.835 | 0.051 |

If p<0.05 and delta or risk score mean >0, the transgenic plants showed statistically significant trait improvement as compared to the reference. If p<0.2 and delta or risk score mean >0, the transgenic plants showed a trend of trait improvement as compared to the reference.

H. Shade Tolerance Screen

Plants undergo a characteristic morphological response in shade that includes the elongation of the petiole, a change in the leaf angle, and a reduction in chlorophyll content. While these changes may confer a competitive advantage to individuals, in a monoculture the shade avoidance response is thought to reduce the overall biomass of the population. Thus, genetic alterations that prevent the shade avoidance response may be associated with higher yields. Genes that favor growth under low light conditions may also promote yield, as inadequate light levels frequently limit yield. This protocol describes a screen to look for *Arabidopsis* plants that show an attenuated shade avoidance response and/or grow better than control plants under low light intensity. Of particular interest, we were looking for plants that didn't extend their petiole length, had an increase in seedling weight relative to the reference and had leaves that were more close to parallel with the plate surface.

T2 seeds were plated on glufosinate selection plates with ½ MS medium. Seeds were sown on ½× MS salts, 1% Phytagel, 10 ug/ml BASTA. Plants were grown on vertical plates at a temperature of 22° C. at day, 20° C. at night and under low light (approximately 30 uE/m²/s, far/red ratio (655/665/725/735) ~0.35 using PLAQ lights with GAM color filter #680). Twenty-three days after seedlings were sown, measurements were recorded including seedling status, number of rosette leaves, status of flower bud, petiole leaf angle, petiole length, and pooled fresh weights. A digital image of the whole plate was taken on the measurement day. Seedling weight and petiole length were analyzed as quantitative responses according to example 1M. The number of rosette leaves, flowering bud formation and leaf angel were analyzed as qualitative responses according to example 1 L.

Table 10 provides a list of recombinant DNA constructs that improve shade tolerance in plants

TABLE 10

| PEP SEQ ID NO | Construct ID | Orientation | Leaf angle at day 23 RS mean | P-value | Seedling weight at day 23 Delta mean | P-value | Petiole length at day 23 Delta mean | P-value |
|---|---|---|---|---|---|---|---|---|
| 441 | 70605 | SENSE | / | / | 0.424 | 0.061 | 0.352 | 0.038 |
| 632 | 72414 | SENSE | 0.000 | 1.000 | 0.396 | 0.067 | 0.222 | 0.047 |
| 464 | 73344 | SENSE | 2.667 | 0.057 | 0.179 | 0.444 | 0.289 | 0.058 |
| 744 | 73666 | SENSE | / | / | 0.838 | 0.008 | 0.142 | 0.445 |
| 453 | 72026 | SENSE | 0.000 | 1.000 | 0.469 | 0.042 | 0.313 | 0.073 |

TABLE 10-continued

| PEP SEQ ID NO | Construct ID | Orientation | Leaf angle at day 23 RS mean | P-value | Seedling weight at day 23 Delta mean | P-value | Petiole length at day 23 Delta mean | P-value |
|---|---|---|---|---|---|---|---|---|
| 634 | 73723 | SENSE | 1.333 | 0.423 | −0.103 | 0.677 | −0.406 | 0.089 |
| 635 | 73747 | SENSE | 2.000 | 0.225 | −0.605 | 0.002 | −0.565 | 0.050 |
| 633 | 73409 | SENSE | 2.667 | 0.057 | 0.365 | 0.052 | 0.283 | 0.010 |
| 636 | 74634 | SENSE | 0.667 | 0.423 | −0.636 | 0.109 | −0.869 | 0.017 |
| 615 | 74558 | SENSE | 1.333 | 0.184 | 0.486 | 0.018 | 0.231 | 0.108 |
| 824 | 74956 | SENSE | 1.333 | 0.423 | 0.154 | 0.076 | −0.052 | 0.289 |
| 486 | 75220 | SENSE | 0.000 | 1.000 | −0.644 | 0.230 | −0.716 | 0.099 |
| 487 | 75226 | SENSE | 0.000 | 1.000 | −0.601 | 0.067 | −1.142 | 0.086 |
| 488 | 75231 | SENSE | 0.667 | 0.423 | 0.455 | 0.039 | 0.258 | 0.072 |
| 638 | 75232 | SENSE | 1.333 | 0.423 | −1.931 | 0.077 | −1.992 | 0.038 |
| 489 | 75239 | SENSE | 0.667 | 0.423 | 0.149 | 0.075 | 0.060 | 0.444 |
| 560 | 73855 | SENSE | 3.333 | 0.038 | −0.261 | 0.121 | −0.361 | 0.215 |
| 472 | 74059 | SENSE | 0.000 | 1.000 | 0.409 | 0.066 | 0.331 | 0.062 |
| 482 | 74707 | SENSE | 3.333 | 0.038 | 0.269 | 0.071 | 0.136 | 0.016 |
| 754 | 74753 | SENSE | 0.000 | 1.000 | 0.365 | 0.079 | 0.267 | 0.057 |
| 637 | 74769 | SENSE | 1.333 | 0.184 | −0.141 | 0.346 | −0.221 | 0.029 |
| 493 | 75355 | SENSE | 1.333 | 0.423 | −0.735 | 0.069 | −0.581 | 0.058 |
| 639 | 75429 | SENSE | 2.667 | 0.057 | −0.453 | 0.151 | −1.319 | 0.032 |
| 640 | 75965 | SENSE | 0.667 | 0.423 | 0.092 | 0.086 | 0.109 | 0.122 |
| 642 | 76061 | SENSE | / | / | 0.373 | 0.075 | 0.110 | 0.330 |
| 643 | 76155 | SENSE | 0.667 | 0.423 | −0.473 | 0.021 | −0.608 | 0.004 |
| 761 | 76207 | SENSE | 2.667 | 0.057 | −0.374 | 0.060 | −0.369 | 0.088 |
| 641 | 75975 | SENSE | 2.000 | 0.225 | 0.405 | 0.056 | 0.223 | 0.044 |
| 762 | 76293 | SENSE | 2.667 | 0.184 | −0.412 | 0.052 | −0.717 | 0.018 |
| 644 | 76322 | SENSE | 0.667 | 0.423 | −0.533 | 0.044 | −0.559 | 0.045 |
| 645 | 76440 | SENSE | / | / | −0.405 | 0.141 | −0.525 | 0.045 |
| 509 | 76741 | SENSE | 0.667 | 0.423 | −0.793 | 0.027 | −0.803 | 0.018 |
| 513 | 76913 | SENSE | / | / | 0.313 | 0.073 | 0.336 | 0.129 |
| 646 | 76828 | SENSE | 0.667 | 0.423 | −0.185 | 0.141 | −1.189 | 0.001 |
| 517 | 77022 | SENSE | 0.000 | 1.000 | −0.495 | 0.282 | −0.475 | 0.079 |
| 648 | 77303 | SENSE | 2.000 | 0.225 | −0.296 | 0.117 | −0.176 | 0.038 |
| 649 | 77352 | SENSE | 1.333 | 0.423 | −0.298 | 0.127 | −0.377 | 0.036 |
| 631 | 77366 | SENSE | 0.667 | 0.423 | 0.611 | 0.015 | 0.327 | 0.044 |
| 647 | 77136 | SENSE | 1.333 | 0.423 | −0.824 | 0.076 | −0.566 | 0.089 |

For "seeding weight" and "leaf angle", if p<0.05 and delta or risk score mean >0, the transgenic plants showed statistically significant trait improvement as compared to the reference. If p<0.2 and delta or risk score mean >0, the transgenic plants showed a trend of trait improvement as compared to the reference with p<0.2.

For "petiole length", if p<0.05 and delta <0, the transgenic plants showed statistically significant trait improvement as compared to the reference. If p<0.2 and delta <0, the transgenic plants showed a trend of trait improvement as compared to the reference.

I. Early Plant Growth and Development Screen

This example sets forth a plate based phenotypic analysis platform for the rapid detection of phenotypes that are evident during the first two weeks of growth. In this screen, we were looking for genes that confer advantages in the processes of germination, seedling vigor, root growth and root morphology under non-stressed growth conditions to plants. The transgenic plants with advantages in seedling growth and development were determined by the seedling weight and root length at day 14 after seed planting.

T2 seeds were plated on glufosinate selection plates and grown under standard conditions (~100 uE/m²/s, 16 h photoperiod, 22° C. at day, 20° C. at night). Seeds were stratified for 3 days at 4° C. Seedlings were grown vertically (at a temperature of 22° C. at day 20° C. at night). Observations were taken on day 10 and day 14. Both seedling weight and root length at day 14 were analyzed as quantitative responses according to example 1M.

Table 11 provides a list recombinant DNA constructs that improve early plant growth and development.

TABLE 11

| PEP SEQ ID NO | Construct ID | Orientation | Root length at day 10 Delta mean | P-value | Root length at day 14 Delta mean | P-value | Seedling weight at day 14 Delta mean | P-value |
|---|---|---|---|---|---|---|---|---|
| 523 | 14810 | SENSE | 0.175 | 0.027 | 0.049 | 0.231 | −0.089 | 0.337 |
| 773 | 14836 | SENSE | 0.105 | 0.007 | 0.089 | 0.029 | 0.162 | 0.217 |
| 735 | 14944 | SENSE | 0.205 | 0.207 | 0.175 | 0.046 | 0.259 | 0.221 |
| 525 | 15419 | ANTI-SENSE | 0.182 | 0.019 | 0.125 | 0.048 | 0.212 | 0.155 |

TABLE 11-continued

| PEP SEQ ID NO | Construct ID | Orientation | Root length at day 10 | | Root length at day 14 | | Seedling weight at day 14 | |
|---|---|---|---|---|---|---|---|---|
| | | | Delta mean | P-value | Delta mean | P-value | Delta mean | P-value |
| 527 | 17903 | SENSE | 0.401 | 0.008 | 0.174 | 0.011 | 0.330 | 0.005 |
| 529 | 18284 | SENSE | 0.031 | 0.795 | 0.016 | 0.722 | 0.223 | 0.043 |
| 737 | 18536 | SENSE | 0.158 | 0.222 | 0.104 | 0.118 | 0.149 | 0.122 |
| 736 | 18410 | SENSE | 0.222 | 0.228 | 0.078 | 0.640 | 0.141 | 0.080 |
| 432 | 17410 | SENSE | 0.145 | 0.052 | 0.074 | 0.246 | 0.074 | 0.542 |
| 532 | 18623 | SENSE | 0.247 | 0.100 | 0.133 | 0.074 | 0.228 | 0.036 |
| 434 | 18665 | SENSE | 0.237 | 0.025 | 0.156 | 0.057 | 0.268 | 0.033 |
| 738 | 19540 | SENSE | 0.115 | 0.397 | 0.085 | 0.237 | 0.130 | 0.031 |
| 739 | 19624 | SENSE | 0.329 | 0.057 | 0.171 | 0.269 | 0.494 | 0.024 |
| 740 | 70353 | SENSE | 0.136 | 0.065 | 0.086 | 0.355 | 0.140 | 0.170 |
| 780 | 70804 | SENSE | 0.411 | 0.066 | 0.290 | 0.147 | 0.483 | 0.129 |
| 443 | 70812 | SENSE | 0.438 | 0.069 | 0.351 | 0.043 | 0.571 | 0.036 |
| 444 | 70933 | SENSE | 0.093 | 0.099 | 0.088 | 0.039 | 0.071 | 0.060 |
| 540 | 70943 | SENSE | 0.344 | 0.074 | 0.173 | 0.031 | 0.263 | 0.283 |
| 741 | 71215 | SENSE | 0.282 | 0.107 | 0.142 | 0.010 | 0.108 | 0.594 |
| 446 | 71319 | SENSE | 0.201 | 0.077 | 0.051 | 0.427 | 0.236 | 0.025 |
| 742 | 71320 | SENSE | 0.601 | 0.015 | 0.437 | 0.041 | 0.547 | 0.107 |
| 447 | 71446 | SENSE | 0.308 | 0.182 | 0.207 | 0.021 | 0.465 | 0.107 |
| 463 | 73338 | SENSE | 0.309 | 0.035 | 0.146 | 0.038 | 0.462 | 0.017 |
| 611 | 73619 | SENSE | 0.070 | 0.151 | 0.103 | 0.016 | 0.266 | 0.093 |
| 744 | 73666 | SENSE | 0.304 | 0.036 | 0.166 | 0.014 | 0.480 | 0.010 |
| 469 | 73733 | SENSE | 0.156 | 0.148 | −0.087 | 0.511 | 0.156 | 0.036 |
| 612 | 73737 | SENSE | 0.352 | 0.005 | 0.244 | 0.020 | 0.098 | 0.093 |
| 557 | 73750 | SENSE | 0.156 | 0.033 | 0.111 | 0.047 | 0.216 | 0.040 |
| 465 | 73536 | SENSE | 0.461 | 0.007 | 0.261 | 0.006 | 0.330 | 0.024 |
| 550 | 72993 | SENSE | 0.254 | 0.034 | 0.152 | 0.228 | 0.271 | 0.073 |
| 747 | 74211 | SENSE | 0.155 | 0.084 | 0.068 | 0.159 | 0.368 | 0.034 |
| 569 | 74315 | SENSE | 0.328 | 0.007 | 0.149 | 0.020 | 0.513 | 0.055 |
| 748 | 74510 | SENSE | 0.277 | 0.003 | 0.158 | 0.016 | 0.433 | 0.029 |
| 749 | 74527 | SENSE | 0.446 | 0.025 | 0.256 | 0.022 | 0.412 | 0.052 |
| 750 | 74539 | SENSE | 0.103 | 0.024 | 0.063 | 0.196 | 0.249 | 0.013 |
| 576 | 74550 | SENSE | 0.216 | 0.076 | 0.228 | 0.035 | 0.424 | 0.048 |
| 481 | 74576 | SENSE | 0.270 | 0.017 | 0.016 | 0.823 | 0.216 | 0.235 |
| 752 | 74577 | SENSE | 0.333 | 0.032 | 0.224 | 0.023 | 0.285 | 0.094 |
| 743 | 73076 | SENSE | 0.129 | 0.459 | 0.063 | 0.513 | 0.244 | 0.055 |
| 756 | 74908 | SENSE | 0.237 | 0.006 | 0.184 | 0.014 | 0.253 | 0.094 |
| 751 | 74556 | SENSE | 0.147 | 0.111 | 0.076 | 0.025 | 0.377 | 0.035 |
| 489 | 75239 | SENSE | 0.180 | 0.145 | 0.085 | 0.019 | 0.236 | 0.162 |
| 758 | 75254 | SENSE | 0.144 | 0.233 | 0.031 | 0.502 | 0.363 | 0.054 |
| 553 | 73224 | SENSE | 0.384 | 0.035 | 0.257 | 0.022 | 0.616 | 0.029 |
| 745 | 73852 | SENSE | 0.029 | 0.760 | 0.031 | 0.617 | 0.031 | 0.019 |
| 572 | 74511 | SENSE | 0.345 | 0.003 | 0.107 | 0.069 | 0.487 | 0.043 |
| 565 | 74073 | SENSE | −0.003 | 0.969 | −0.023 | 0.646 | 0.225 | 0.096 |
| 746 | 74080 | SENSE | 0.252 | 0.031 | 0.102 | 0.152 | 0.296 | 0.074 |
| 753 | 74729 | SENSE | 0.065 | 0.082 | −0.031 | 0.642 | 0.080 | 0.068 |
| 581 | 74749 | SENSE | 0.160 | 0.161 | 0.104 | 0.120 | 0.243 | 0.322 |
| 754 | 74753 | SENSE | 0.136 | 0.127 | 0.061 | 0.224 | 0.422 | 0.002 |
| 755 | 74754 | SENSE | 0.216 | 0.004 | 0.133 | 0.040 | 0.188 | 0.055 |
| 484 | 74755 | SENSE | 0.397 | 0.071 | 0.243 | 0.084 | 0.499 | 0.037 |
| 757 | 75107 | SENSE | 0.352 | 0.014 | 0.212 | 0.044 | 0.342 | 0.086 |
| 759 | 75741 | SENSE | 0.160 | 0.098 | 0.062 | 0.399 | 0.123 | 0.320 |
| 760 | 75931 | SENSE | 0.162 | 0.037 | 0.134 | 0.012 | 0.225 | 0.061 |
| 797 | 76101 | SENSE | 0.142 | 0.445 | 0.109 | 0.361 | 0.372 | 0.051 |
| 761 | 76207 | SENSE | 0.397 | 0.015 | 0.235 | 0.100 | 0.151 | 0.149 |
| 762 | 76293 | SENSE | 0.160 | 0.172 | 0.178 | 0.042 | 0.491 | 0.000 |
| 495 | 75847 | SENSE | 0.262 | 0.003 | 0.005 | 0.928 | 0.246 | 0.159 |
| 763 | 76517 | SENSE | 0.220 | 0.080 | 0.162 | 0.021 | 0.210 | 0.017 |
| 764 | 76559 | SENSE | 0.283 | 0.130 | 0.211 | 0.123 | 0.266 | 0.093 |
| 765 | 76804 | SENSE | 0.219 | 0.061 | 0.130 | 0.066 | 0.419 | 0.003 |
| 766 | 77018 | SENSE | 0.338 | 0.002 | 0.137 | 0.095 | 0.469 | 0.059 |
| 522 | 77351 | SENSE | 0.052 | 0.566 | 0.060 | 0.290 | 0.343 | 0.091 |
| 518 | 77108 | SENSE | 0.000 | 0.998 | 0.095 | 0.080 | 0.067 | 0.085 |
| 767 | 77115 | SENSE | 0.339 | 0.102 | 0.173 | 0.044 | 0.788 | 0.056 |
| 768 | 77128 | SENSE | 0.360 | 0.075 | 0.174 | 0.170 | 0.304 | 0.125 |
| 769 | 77158 | SENSE | 0.290 | 0.052 | 0.033 | 0.484 | 0.365 | 0.010 |
| 770 | 77159 | SENSE | 0.303 | 0.019 | 0.177 | 0.166 | 0.408 | 0.033 |
| 771 | 77163 | SENSE | 0.497 | 0.007 | 0.434 | 0.002 | 1.047 | 0.038 |
| 600 | 77208 | SENSE | 0.206 | 0.011 | 0.103 | 0.077 | 0.388 | 0.009 |

If p<0.05 and delta or risk score mean >0, the transgenic plants showed statistically significant trait improvement as compared to the reference. If p<0.2 and delta or risk score mean >0, the transgenic plants showed a trend of trait improvement as compared to the reference.

J. Late Plant Growth and Development Screen

This example sets forth a soil based phenotypic platform to identify genes that confer advantages in the processes of leaf development, flowering production and seed maturity to plants.

leaves were visible. Each pot was thinned to leave a single glufosinate-resistant seedling ~3 days after the selection was applied.

The rosette radius was measured at day 25. The silique length was measured at day 40. The plant parts were harvested at day 49 for dry weight measurements if flowering production was stopped. Otherwise, the dry weights of rosette and silique were carried out at day 53. The seeds were harvested at day 58. All measurements were analyzed as quantitative responses according to example 1M.

Table 12 provides a list of recombinant DNA constructs that improve late plant growth and development.

TABLE 12

| PEP SEQ ID NO | Orientation | Rosette dry weight at day 53 | | Rosette radius at day 25 | | Seed net dry weight at day 62 | | Silique dry weight at day 53 | | Silique length at day 40 | |
|---|---|---|---|---|---|---|---|---|---|---|---|
| | | Delta mean | P-value | Delta mean | P-value | Delta mean | P-value | Delta mean | P-value | Delta mean | P-value |
| 772 | ANTI-SENSE | 0.072 | 0.189 | / | / | 0.846 | 0.002 | 0.143 | 0.381 | −0.012 | 0.803 |
| 773 | SENSE | 0.094 | 0.592 | −0.238 | 0.098 | 0.665 | 0.059 | 0.247 | 0.474 | −0.029 | 0.184 |
| 775 | SENSE | 0.134 | 0.019 | / | / | 0.675 | 0.061 | 0.540 | 0.010 | 0.093 | 0.008 |
| 774 | SENSE | −0.262 | 0.112 | −0.407 | 0.032 | −0.393 | 0.120 | 0.357 | 0.081 | 0.003 | 0.922 |
| 776 | SENSE | −1.027 | 0.044 | / | / | 2.216 | 0.004 | 0.351 | 0.355 | 0.135 | 0.001 |
| 780 | SENSE | 0.310 | 0.048 | / | / | −0.245 | 0.629 | 0.149 | 0.157 | 0.149 | 0.043 |
| 781 | SENSE | 0.219 | 0.069 | / | / | 0.779 | 0.001 | −0.174 | 0.108 | −0.015 | 0.595 |
| 777 | SENSE | 0.526 | 0.045 | / | / | −0.388 | 0.478 | 0.131 | 0.281 | −0.351 | 0.036 |
| 778 | SENSE | 0.402 | 0.004 | −0.158 | 0.126 | −2.159 | 0.036 | −0.410 | 0.016 | −0.195 | 0.043 |
| 779 | SENSE | 0.454 | 0.006 | −0.124 | 0.234 | −0.112 | 0.328 | 0.228 | 0.070 | 0.065 | 0.024 |
| 782 | SENSE | 0.195 | 0.205 | −0.153 | 0.019 | 0.352 | 0.005 | 0.488 | 0.031 | −0.063 | 0.473 |
| 783 | SENSE | −0.388 | 0.381 | / | / | 1.339 | 0.002 | −1.147 | 0.126 | 0.601 | 0.000 |
| 786 | SENSE | −0.107 | 0.280 | 0.091 | 0.148 | 0.563 | 0.058 | 0.166 | 0.165 | 0.042 | 0.084 |
| 787 | SENSE | −0.290 | 0.138 | −0.752 | 0.020 | 0.501 | 0.044 | −0.114 | 0.237 | 0.048 | 0.188 |
| 788 | SENSE | −0.064 | 0.709 | −0.060 | 0.302 | 0.346 | 0.027 | 0.198 | 0.082 | 0.062 | 0.115 |
| 789 | SENSE | −0.060 | 0.585 | −0.204 | 0.076 | 0.930 | 0.004 | −0.243 | 0.109 | 0.094 | 0.016 |
| 790 | SENSE | −0.299 | 0.076 | 0.208 | 0.181 | 0.683 | 0.008 | 0.140 | 0.652 | −0.047 | 0.070 |
| 792 | SENSE | 0.470 | 0.039 | / | / | 0.113 | 0.691 | −0.118 | 0.511 | −0.003 | 0.921 |
| 791 | SENSE | −0.037 | 0.754 | / | / | 0.484 | 0.084 | −0.163 | 0.366 | 0.024 | 0.328 |
| 784 | SENSE | −0.182 | 0.070 | −0.079 | 0.243 | 0.649 | 0.075 | 0.070 | 0.659 | −0.150 | 0.112 |
| 785 | SENSE | −0.057 | 0.216 | −0.086 | 0.016 | 1.645 | 0.008 | 0.278 | 0.036 | 0.015 | 0.364 |
| 795 | SENSE | 0.620 | 0.013 | / | / | 0.698 | 0.010 | −0.102 | 0.794 | 0.040 | 0.247 |
| 793 | SENSE | 0.492 | 0.045 | −0.232 | 0.029 | −0.505 | 0.030 | 0.025 | 0.881 | | |
| 794 | SENSE | −0.051 | 0.809 | / | / | 0.809 | 0.003 | −0.054 | 0.649 | −0.020 | 0.786 |
| 797 | SENSE | 0.121 | 0.107 | / | / | 0.915 | 0.017 | −0.287 | 0.054 | 0.054 | 0.120 |
| 796 | SENSE | 0.324 | 0.017 | / | / | −0.289 | 0.468 | 0.331 | 0.012 | 0.040 | 0.476 |
| 798 | SENSE | 0.411 | 0.038 | / | / | 0.809 | 0.018 | 0.231 | 0.286 | −0.048 | 0.279 |
| 799 | SENSE | −0.014 | 0.720 | / | / | 0.337 | 0.064 | −0.112 | 0.165 | 0.018 | 0.581 |

*Arabidopsis* plants were grown on a commercial potting mixture (Metro Mix 360, Scotts Co., Marysville, Ohio) consisting of 30-40% medium grade horticultural vermiculite, 35-55% sphagnum peat moss, 10-20% processed bark ash, 1-15% pine bark and a starter nutrient charge. Soil was supplemented with Osmocote time-release fertilizer at a rate of 30 mg/ft$^3$. T2 seeds were imbibed in 1% agarose solution for 3 days at 4° C. and then sown at a density of ~5 per 2½" pot. Thirty-two pots were ordered in a 4 by 8 grid in standard greenhouse flat. Plants were grown in environmentally controlled rooms under a 16 h day length with an average light intensity of ~200 μmoles/m$^2$/s. Day and night temperature set points were 22° C. and 20° C., respectively. Humidity was maintained at 65%. Plants were watered by sub-irrigation every two days on average until mid-flowering, at which point the plants were watered daily until flowering was complete.

Application of the herbicide glufosinate was performed to select T2 individuals containing the target transgene. A single application of glufosinate was applied when the first true If p<0.05 and delta or risk score mean >0, the transgenic plants showed statistically significant trait improvement as compared to the reference. If p<0.2 and delta or risk score mean >0, the transgenic plants showed a trend of trait improvement as compared to the reference.

K. Limited Nitrogen Tolerance Screen

Under low nitrogen conditions, *Arabidopsis* seedlings become chlorotic and have less biomass. This example sets forth the limited nitrogen tolerance screen to identify *Arabidopsis* plants transformed with the gene of interest that are altered in their ability to accumulate biomass and/or retain chlorophyll under low nitrogen condition.

T2 seeds were plated on glufosinate selection plates containing 0.5× N-Free Hoagland's T 0.1 mM NH$_4$NO$_3$ T 0.1% sucrose T 1% phytagel media and grown under standard light and temperature conditions. At 12 days of growth, plants were scored for seedling status (i. e., viable or non-viable) and root length. After 21 days of growth, plants were scored for BASTA resistance, visual color, seedling weight, number of green leaves, number of rosette leaves, root length and formation of flowering buds. A photograph of each plant was also taken at this time point.

The seedling weight and root length were analyzed as quantitative responses according to example 1M. The number green leaves, the number of rosette leaves and the flowerbud formation were analyzed as qualitative responses according to example 1L. The leaf color raw data were collected on each plant as the percentages of five color elements (Green, DarkGreen, LightGreen, RedPurple, YellowChlorotic) using a computer imaging system. A statistical logistic regression model was developed to predict an overall value based on five colors for each plant.

Table 13 provides a list of recombinant DNA constructs that improve low nitrogen availability tolerance in plants.

TABLE 13

| PEP SEQ ID NO | Construct ID | Orientation | Root length Delta mean | P-value | Leaf color Risk score mean | P-value | Rosette Weight Delta mean | P-value |
|---|---|---|---|---|---|---|---|---|
| 650 | 10913 | ANTI-SENSE | −0.322 | 0.072 | 0.559 | 0.234 | −0.052 | 0.209 |
| 651 | 10925 | ANTI-SENSE | −0.407 | 0.047 | 5.828 | 0.342 | −0.064 | 0.416 |
| 652 | 11357 | SENSE | −0.436 | 0.016 | 0.996 | 0.047 | −0.093 | 0.233 |
| 653 | 11358 | SENSE | −0.521 | 0.000 | 1.297 | 0.012 | −0.003 | 0.945 |
| 654 | 11432 | ANTI-SENSE | −0.215 | 0.049 | 0.669 | 0.046 | 0.009 | 0.899 |
| 655 | 11927 | ANTI-SENSE | −0.416 | 0.028 | 0.581 | 0.021 | 0.028 | 0.293 |
| 430 | 11937 | ANTI-SENSE | −0.302 | 0.076 | 0.564 | 0.039 | −0.102 | 0.067 |
| 656 | 12050 | SENSE | −0.188 | 0.003 | 1.323 | 0.032 | −0.031 | 0.245 |
| 657 | 12358 | ANTI-SENSE | −0.179 | 0.050 | 0.278 | 0.065 | 0.024 | 0.818 |
| 658 | 13809 | SENSE | −0.126 | 0.024 | 0.796 | 0.303 | −0.099 | 0.073 |
| 603 | 14733 | SENSE | −0.161 | 0.131 | 2.267 | 0.085 | −0.055 | 0.676 |
| 525 | 15419 | ANTI-SENSE | −0.068 | 0.119 | 1.607 | 0.051 | 0.044 | 0.451 |
| 659 | 16877 | SENSE | −0.207 | 0.158 | 2.516 | 0.057 | 0.012 | 0.843 |
| 660 | 18117 | ANTI-SENSE | −0.221 | 0.004 | 0.906 | 0.004 | −0.146 | 0.067 |
| 805 | 70819 | SENSE | −0.258 | 0.057 | 2.275 | 0.088 | −0.103 | 0.231 |
| 777 | 70639 | SENSE | −0.276 | 0.071 | −1.184 | 0.099 | 0.132 | 0.052 |
| 778 | 70668 | SENSE | −0.126 | 0.010 | −0.521 | 0.156 | 0.067 | 0.520 |
| 661 | 71651 | SENSE | −0.037 | 0.599 | 0.485 | 0.042 | −0.020 | 0.682 |
| 662 | 72449 | SENSE | −0.019 | 0.645 | −0.738 | 0.043 | 0.324 | 0.024 |
| 454 | 72533 | SENSE | −0.011 | 0.866 | 1.131 | 0.017 | 0.068 | 0.237 |
| 663 | 72649 | SENSE | −0.154 | 0.309 | 0.181 | 0.093 | −0.046 | 0.350 |
| 610 | 72978 | SENSE | −0.304 | 0.184 | 0.367 | 0.125 | 0.144 | 0.008 |
| 464 | 73344 | SENSE | −0.068 | 0.002 | −0.547 | 0.400 | 0.040 | 0.612 |
| 744 | 73666 | SENSE | 0.239 | 0.137 | −2.192 | 0.089 | 0.125 | 0.064 |
| 635 | 73747 | SENSE | −0.031 | 0.568 | 0.671 | 0.010 | 0.002 | 0.974 |
| 664 | 73107 | SENSE | −0.236 | 0.039 | 0.196 | 0.057 | 0.050 | 0.554 |
| 567 | 74135 | SENSE | 0.173 | 0.081 | −2.988 | 0.061 | 0.117 | 0.090 |
| 636 | 74634 | SENSE | −1.049 | 0.019 | 0.805 | 0.083 | −0.084 | 0.034 |
| 578 | 74644 | SENSE | −0.224 | 0.027 | 0.247 | 0.353 | −0.054 | 0.256 |
| 665 | 74875 | SENSE | −0.297 | 0.201 | 1.084 | 0.089 | 0.201 | 0.106 |
| 666 | 75079 | SENSE | −0.303 | 0.277 | 0.583 | 0.071 | −0.122 | 0.329 |
| 485 | 75202 | SENSE | −0.277 | 0.093 | 0.463 | 0.049 | −0.020 | 0.570 |
| 668 | 75228 | SENSE | −0.838 | 0.036 | 1.239 | 0.033 | −0.091 | 0.503 |
| 669 | 75246 | SENSE | −1.192 | 0.009 | 1.314 | 0.039 | −0.136 | 0.205 |
| 809 | 73223 | SENSE | 0.060 | 0.764 | −0.249 | 0.442 | 0.066 | 0.084 |
| 784 | 73283 | SENSE | 0.200 | 0.242 | −2.819 | 0.046 | 0.198 | 0.051 |
| 637 | 74769 | SENSE | −0.135 | 0.090 | 0.642 | 0.024 | 0.102 | 0.064 |
| 667 | 75180 | SENSE | −0.266 | 0.031 | 0.602 | 0.021 | 0.006 | 0.281 |
| 670 | 75375 | SENSE | −0.647 | 0.012 | 1.618 | 0.001 | −0.156 | 0.043 |
| 671 | 75476 | SENSE | −0.563 | 0.011 | 1.101 | 0.003 | −0.091 | 0.162 |
| 673 | 75857 | SENSE | −0.256 | 0.067 | 2.472 | 0.006 | −0.125 | 0.041 |
| 672 | 75502 | SENSE | 0.101 | 0.209 | −0.147 | 0.482 | 0.156 | 0.066 |
| 675 | 75970 | SENSE | −0.125 | 0.191 | 0.963 | 0.036 | 0.046 | 0.391 |
| 676 | 76115 | SENSE | −0.499 | 0.113 | 0.619 | 0.092 | 0.018 | 0.752 |
| 833 | 76121 | SENSE | −0.707 | 0.012 | 1.695 | 0.007 | −0.199 | 0.049 |
| 643 | 76155 | SENSE | −0.059 | 0.454 | 0.779 | 0.022 | −0.033 | 0.742 |
| 677 | 76217 | SENSE | −0.312 | 0.120 | 0.750 | 0.001 | −0.010 | 0.864 |
| 678 | 76287 | SENSE | −0.504 | 0.035 | 1.326 | 0.003 | −0.147 | 0.018 |
| 679 | 76294 | SENSE | −0.492 | 0.002 | 1.096 | 0.006 | −0.134 | 0.013 |
| 762 | 76293 | SENSE | 0.102 | 0.330 | −2.184 | 0.008 | 0.358 | 0.049 |
| 674 | 75873 | SENSE | −0.191 | 0.071 | 3.070 | 0.093 | 0.109 | 0.197 |
| 680 | 76305 | SENSE | −0.643 | 0.001 | 2.319 | 0.000 | −0.110 | 0.018 |
| 644 | 76322 | SENSE | −0.568 | 0.019 | 1.259 | 0.091 | −0.205 | 0.019 |
| 837 | 76388 | SENSE | 0.078 | 0.155 | −0.032 | 0.862 | 0.130 | 0.017 |
| 681 | 76391 | SENSE | −0.259 | 0.114 | 1.043 | 0.046 | 0.036 | 0.806 |
| 798 | 76431 | SENSE | 0.143 | 0.134 | −0.383 | 0.554 | 0.196 | 0.034 |
| 682 | 76438 | SENSE | −0.183 | 0.029 | 0.790 | 0.057 | −0.062 | 0.291 |
| 683 | 76452 | SENSE | −0.284 | 0.112 | 0.928 | 0.017 | −0.002 | 0.969 |
| 684 | 76563 | SENSE | −0.032 | 0.100 | −0.047 | 0.203 | −0.095 | 0.153 |
| 839 | 76567 | SENSE | 0.228 | 0.057 | −0.403 | 0.418 | 0.180 | 0.024 |
| 646 | 76828 | SENSE | −0.163 | 0.051 | 0.666 | 0.018 | 0.156 | 0.078 |
| 685 | 77055 | SENSE | −0.261 | 0.180 | 0.926 | 0.079 | 0.054 | 0.516 |

TABLE 13-continued

| PEP SEQ ID NO | Construct ID | Orientation | Root length Delta mean | P-value | Leaf color Risk score mean | P-value | Rosette Weight Delta mean | P-value |
|---|---|---|---|---|---|---|---|---|
| 686 | 77059 | SENSE | −0.380 | 0.005 | 1.188 | 0.021 | −0.138 | 0.012 |
| 687 | 77062 | SENSE | −0.494 | 0.020 | 1.284 | 0.033 | 0.010 | 0.759 |
| 688 | 77063 | SENSE | −0.290 | 0.018 | 0.814 | 0.019 | −0.082 | 0.116 |
| 691 | 77314 | SENSE | −0.500 | 0.046 | 0.369 | 0.008 | −0.185 | 0.029 |
| 692 | 77344 | SENSE | −0.163 | 0.029 | 0.199 | 0.016 | 0.067 | 0.350 |
| 693 | 77348 | SENSE | −0.218 | 0.003 | 0.313 | 0.000 | 0.002 | 0.960 |
| 846 | 77112 | SENSE | −0.025 | 0.839 | −0.057 | 0.919 | 0.142 | 0.059 |
| 689 | 77218 | SENSE | −0.072 | 0.687 | 0.679 | 0.008 | 0.054 | 0.336 |
| 521 | 77219 | SENSE | 0.183 | 0.071 | 0.134 | 0.290 | 0.319 | 0.038 |
| 690 | 77256 | SENSE | −0.339 | 0.015 | 0.216 | 0.205 | −0.058 | 0.302 |

For leaf color and rosette weight, if p<0.05 and delta or risk score mean >0, the transgenic plants showed statistically significant trait improvement as compared to the reference. If p<0.2 and delta or risk score mean >0, the transgenic plants showed a trend of trait improvement as compared to the reference with p<0.2. For root length, if p<0.05, the transgenic plants showed statistically significant trait improvement as compared to the reference. If p<0.2, the transgenic plants showed a trend of trait improvement as compared to the reference.

L. Statistic Analysis for Qualitative Responses

Table 14 provides a list of responses that were analyzed as qualitative responses

TABLE 14

| response | screen | categories (success vs. failure) |
|---|---|---|
| wilting response Risk Score | Soil drought tolerance screen | non-wilted vs. wilted |
| growth stage at day 14 | heat stress tolerance screen | 50% of plants reach stage 1.03 vs. not |
| growth stage at day 14 | salt stress tolerance screen | 50% of plants reach stage 1.03 vs. not |
| growth stage at day 14 | PEG induced osmotic stress tolerance screen | 50% of plants reach stage 1.03 vs. not |
| growth stage at day 7 | cold germination tolerance screen | 50% of plants reach stage 0.5 vs. not |
| number of rosette leaves at day 23 | Shade tolerance screen | 5 leaves appeared vs. not |
| flower bud formation at day 23 | Shade tolerance screen | flower buds appear vs. not |
| leaf angle at day 23 | Shade tolerance screen | >60 degree vs. <60 degree |
| number of green leaves at day 21 | limited nitrogen tolerance screen | 6 or 7 leaves appeared vs. not |
| number of rosette leaves at day 21 | limited nitrogen tolerance screen | 6 or 7 leaves appeared vs. not |
| Flower bud formation at day 21 | limited nitrogen tolerance screen | flower buds appear vs. not |

Plants were grouped into transgenic and reference groups and were scored as success or failure according to Table 14. First, the risk (R) was calculated, which is the proportion of plants that were scored as of failure plants within the group. Then the relative risk (RR) was calculated as the ratio of R (transgenic) to R (reference). Risk score (RS) was calculated as $-\log_2 RR$. Subsequently the risk scores from multiple events for each transgene of interest were evaluated for statistical significance by t-test using SAS statistical software (SAS 9, SAS/STAT User's Guide, SAS Institute Inc, Cary, N.C., USA). RS with a value greater than 0 indicates that the transgenic plants perform better than the reference. RS with a value less than 0 indicates that the transgenic plants perform worse than the reference. The RS with a value equal to 0 indicates that the performance of the transgenic plants and the reference don't show any difference.

M. Statistic Analysis for Quantitative Responses

Table 15 provides a list of responses that were analyzed as quantitative responses.

TABLE 15

| response | screen |
|---|---|
| seed yield | Soil drought stress tolerance screen |
| seedling weight at day 14 | heat stress tolerance screen |

TABLE 15-continued

| response | screen |
|---|---|
| root length at day 14 | heat stress tolerance screen |
| seedling weight at day 14 | salt stress tolerance screen |
| root length at day 14 | salt stress tolerance screen |
| root length at day 11 | salt stress tolerance screen |
| seedling weight at day 14 | PEG induced osmotic stress tolerance screen |
| root length at day 11 | PEG induced osmotic stress tolerance screen |
| root length at day 14 | PEG induced osmotic stress tolerance screen |
| rosette area at day 8 | cold shock tolerance screen |
| rosette area at day 28 | cold shock tolerance screen |
| difference in rosette area from day 8 to day 28 | cold shock tolerance screen |

TABLE 15-continued

| response | screen |
|---|---|
| root length at day 28 | cold germination tolerance screen |
| seedling weight at day 23 | Shade tolerance screen |
| petiole length at day 23 | Shade tolerance screen |
| root length at day 14 | Early plant growth and development screen |
| Seedling weight at day 14 | Early plant growth and development screen |
| Rosette dry weight at day 53 | Late plant growth and development screen |
| rosette radius at day 25 | Late plant growth and development screen |
| seed dry weight at day 58 | Late plant growth and development screen |
| silique dry weight at day 53 | Late plant growth and development screen |
| silique length at day 40 | Late plant growth and development screen |
| Seedling weight at day 21 | Limited nitrogen tolerance screen |
| Root length at day 21 | Limited nitrogen tolerance screen |

The measurements (M) of each plant were transformed by $log_2$ calculation. The Delta was calculated as $log_2 M$(transgenic)–$log_2 M$(reference). Subsequently the mean delta from multiple events of the transgene of interest was evaluated for statistical significance by t-test using SAS statistical software (SAS 9, SAS/STAT User's Guide, SAS Institute Inc, Cary, N.C., USA). The Delta with a value greater than 0 indicates that the transgenic plants perform better than the reference. The Delta with a value less than 0 indicates that the transgenic plants perform worse than the reference. The Delta with a value equal to 0 indicates that the performance of the transgenic plants and the reference don't show any difference.

Example 2

Identification of Homologs

A BLAST searchable "All Protein Database" is constructed of known protein sequences using a proprietary sequence database and the National Center for Biotechnology Information (NCBI) non-redundant amino acid database (nr.aa). For each organism from which a DNA sequence provided herein was obtained, an "Organism Protein Database" is constructed of known protein sequences of the organism; the Organism Protein Database is a subset of the All Protein Database based on the NCBI taxonomy ID for the organism.

The All Protein Database is queried using amino acid sequence of cognate protein for gene DNA used in trait-improving recombinant DNA, i.e., sequences of SEQ ID NO: 426 through SEQ ID NO: 850 using "blastp" with E-value cutoff of 1e-8. Up to 1000 top hits were kept, and separated by organism names. For each organism other than that of the query sequence, a list is kept for hits from the query organism itself with a more significant E-value than the best hit of the organism. The list contains likely duplicated genes, and is referred to as the Core List. Another list was kept for all the hits from each organism, sorted by E-value, and referred to as the Hit List.

The Organism Protein Database is queried using amino acid sequences of SEQ ID NO: 426 through SEQ ID NO: 850 using "blastp" with E-value cutoff of 1e-4. Up to 1000 top hits are kept. A BLAST searchable database is constructed based on these hits, and is referred to as "SubDB". SubDB was queried with each sequence in the Hit List using "blastp" with E-value cutoff of 1e-8. The hit with the best E-value is compared with the Core List from the corresponding organism. The hit is deemed a likely ortholog if it belongs to the Core List, otherwise it is deemed not a likely ortholog and there is no further search of sequences in the Hit List for the same organism. Likely orthologs from a large number of distinct organisms were identified and are reported by amino acid sequences of SEQ ID NO: 851 to SEQ ID NO: 33634. These orthologs are reported in Tables 2 as homologs to the proteins cognate to genes used in trait-improving recombinant DNA.

Example 3

Consensus Sequence Build

ClustalW program is selected for multiple sequence alignments of an amino acid sequence of SEQ ID NO: 426 and its homologs, through SEQ ID NO: 850 and its homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of 1 were chosen for multiple sequence alignment. The consensus sequence of SEQ ID NO: 601 and its 13 homologs was derived according to the procedure described above and is displayed in FIG. 1.

Example 4

This example illustrates the identification of amino acid domain by Pfam analysis.

The amino acid sequence of the expressed proteins that were shown to be associated with an enhanced trait were analyzed for Pfam protein family against the current Pfam collection of multiple sequence alignments and hidden Markov models using the HMMER software in the appended computer listing. The Pfam protein families for the proteins of SEQ ID NO: 425 through 850 are shown in Table 16. The Hidden Markov model databases for the identified patent families are also in the appended computer listing allowing identification of other homologous proteins and their cognate encoding DNA to enable the full breadth of the invention for a person of ordinary skill in the art. Certain proteins are identified by a single Pfam domain and others by multiple Pfam domains. For instance, the protein with amino acids of SEQ ID NO: 488 is characterized by two Pfam domains, i.e. "NAF" and "Pyr_redox_2". See also the protein with amino acids of SEQ ID NO: 441 which is characterized by three copies of the Pfam domain "zf-CCCH". In Table 16 "score" is the gathering score for the Hidden Markov Model of the domain which exceeds the gathering cutoff reported in Table 17.

TABLE 16

| PEP SEQ ID NO | GENE ID | Pfam domain name | begin | stop | score | E-value |
|---|---|---|---|---|---|---|
| 426 | CGPG699 | Histone | 27 | 100 | 99.6 | 8.80E−27 |
| 427 | CGPG567 | MIF | 2 | 115 | 69.4 | 1.00E−17 |
| 428 | CGPG267 | WD40 | 46 | 83 | 28.3 | 2.40E−05 |
| 428 | CGPG267 | WD40 | 136 | 173 | 36.3 | 9.60E−08 |

TABLE 16-continued

| PEP SEQ ID NO | GENE ID | Pfam domain name | begin | stop | score | E-value |
|---|---|---|---|---|---|---|
| 430 | CGPG959 | NPH3 | 209 | 444 | 429.9 | 3.20E−126 |
| 431 | CGPG2158 | LSM | 14 | 92 | 75.7 | 1.30E−19 |
| 432 | CGPG2446 | NUDIX | 63 | 210 | 94.9 | 2.20E−25 |
| 433 | CGPG1862 | Bromodomain | 421 | 510 | 97.4 | 4.00E−26 |
| 435 | CGPG1674 | efhand | 303 | 331 | 23.1 | 0.00089 |
| 435 | CGPG1674 | Na_Ca_ex | 441 | 575 | 58.5 | 1.90E−14 |
| 436 | CGPG2680 | Linker_histone | 23 | 93 | 101 | 3.30E−27 |
| 437 | CGPG3577 | Glyoxalase | 13 | 132 | 45.2 | 2.00E−10 |
| 438 | CGPG4065 | LRR_2 | 150 | 174 | 17.3 | 0.051 |
| 439 | CGPG3929 | Lung_7-TM_R | 134 | 419 | 130.2 | 5.20E−36 |
| 441 | CGPG3012 | zf-CCCH | 30 | 57 | 7.7 | 0.12 |
| 441 | CGPG3012 | zf-CCCH | 61 | 85 | 7.3 | 0.13 |
| 441 | CGPG3012 | zf-CCCH | 115 | 140 | 19.3 | 0.0034 |
| 442 | CGPG3162 | SBF | 128 | 313 | 239.7 | 5.60E−69 |
| 443 | CGPG607 | PurA | 28 | 275 | 44.4 | 5.80E−12 |
| 444 | CGPG4084 | PCI | 251 | 355 | 102 | 1.60E−27 |
| 445 | CGPG3917 | Pkinase | 13 | 268 | 341.6 | 1.20E−99 |
| 445 | CGPG3917 | NAF | 307 | 367 | 124.7 | 2.30E−34 |
| 446 | CGPG4414 | p450 | 32 | 502 | 364.5 | 1.50E−106 |
| 447 | CGPG185 | Cyclin_N | 62 | 187 | 117.7 | 3.00E−32 |
| 447 | CGPG185 | Cyclin_C | 189 | 312 | 83.3 | 7.00E−22 |
| 448 | CGPG1679 | Ferric_reduct | 183 | 304 | 126.7 | 6.00E−35 |
| 448 | CGPG1679 | FAD_binding_8 | 334 | 435 | 163.6 | 4.70E−46 |
| 448 | CGPG1679 | FAD_binding_6 | 336 | 435 | −7.5 | 0.0026 |
| 448 | CGPG1679 | NAD_binding_6 | 441 | 709 | 348.5 | 9.90E−102 |
| 449 | CGPG271 | PP2C | 269 | 629 | 56 | 1.10E−13 |
| 450 | CGPG4434 | p450 | 30 | 490 | 347.1 | 2.70E−101 |
| 452 | CGPG5253 | SBP56 | 20 | 487 | 1316.4 | 0 |
| 453 | CGPG5231 | Pkinase | 85 | 343 | 344.4 | 1.70E−100 |
| 453 | CGPG5231 | efhand | 390 | 418 | 35.6 | 1.50E−07 |
| 453 | CGPG5231 | efhand | 426 | 454 | 31.4 | 3.00E−06 |
| 453 | CGPG5231 | efhand | 462 | 490 | 28.3 | 2.50E−05 |
| 453 | CGPG5231 | efhand | 496 | 524 | 39.3 | 1.20E−08 |
| 455 | CGPG4859 | PSI_PsaF | 47 | 221 | 443.9 | 2.00E−130 |
| 456 | CGPG1589 | PLAC8 | 292 | 390 | 87.4 | 4.00E−23 |
| 458 | CGPG3899 | Pkinase | 132 | 417 | 294.1 | 2.40E−85 |
| 460 | CGPG5665 | Aminotran_3 | 27 | 362 | 550.2 | 2.00E−162 |
| 460 | CGPG5665 | Aminotran_1_2 | 42 | 417 | −49.4 | 5.40E−05 |
| 461 | CGPG5697 | Aminotran_3 | 25 | 360 | 503.2 | 2.70E−148 |
| 461 | CGPG5697 | Aminotran_1_2 | 40 | 415 | −51.6 | 7.00E−05 |
| 462 | CGPG5695 | Pyr_redox | 148 | 240 | 10.4 | 0.0019 |
| 462 | CGPG5695 | Pyr_redox_2 | 148 | 450 | 71.6 | 2.20E−18 |
| 463 | CGPG4862 | Glyco_hydro_1 | 40 | 520 | 611 | 9.40E−181 |
| 465 | CGPG6541 | PGK | 88 | 479 | 732.8 | 2.10E−217 |
| 466 | CGPG1756 | NOP5NT | 2 | 67 | 119.5 | 8.70E−33 |
| 466 | CGPG1756 | NOSIC | 160 | 212 | 127.9 | 2.70E−35 |
| 466 | CGPG1756 | Nop | 252 | 400 | 332.4 | 7.00E−97 |
| 467 | CGPG4927 | WD40 | 294 | 331 | 32.9 | 1.00E−06 |
| 467 | CGPG4927 | WD40 | 336 | 373 | 24.7 | 0.0003 |
| 467 | CGPG4927 | WD40 | 378 | 428 | 22.1 | 0.0018 |
| 468 | CGPG5106 | C2 | 17 | 96 | 91.7 | 2.10E−24 |
| 469 | CGPG5167 | p450 | 43 | 501 | 265.6 | 9.30E−77 |
| 470 | CGPG1924 | F-box | 21 | 68 | 39.6 | 9.80E−09 |
| 471 | CGPG5201 | Methyltransf_11 | 116 | 231 | 86.8 | 6.20E−23 |
| 471 | CGPG5201 | Methyltransf_12 | 116 | 229 | 31.3 | 3.10E−06 |
| 472 | CGPG1884 | Pkinase_Tyr | 88 | 365 | 137.7 | 2.90E−38 |
| 472 | CGPG1884 | Pkinase | 88 | 368 | 142.5 | 1.00E−39 |
| 473 | CGPG5089 | LRR_1 | 142 | 164 | 17.7 | 0.037 |
| 473 | CGPG5089 | LRR_1 | 166 | 188 | 8 | 8.2 |
| 473 | CGPG5089 | LRR_1 | 190 | 212 | 9.3 | 4.7 |
| 473 | CGPG5089 | LRR_1 | 214 | 233 | 10.7 | 2.6 |
| 473 | CGPG5089 | LRR_1 | 238 | 257 | 9.4 | 4.5 |
| 473 | CGPG5089 | Pkinase | 402 | 658 | −21.1 | 7.60E−07 |
| 474 | CGPG5870 | Pkinase | 47 | 314 | 77.2 | 4.60E−20 |
| 474 | CGPG5870 | Pkinase_Tyr | 48 | 314 | 67.5 | 8.20E−20 |
| 475 | CGPG5888 | Pkinase | 12 | 270 | 119.6 | 7.90E−33 |
| 476 | CGPG1461 | PGAM | 79 | 265 | 151.4 | 2.10E−42 |
| 477 | CGPG6743 | PGK | 88 | 483 | 573.5 | 1.80E−169 |
| 478 | CGPG6722 | Gln-synt_C | 208 | 468 | 370.2 | 2.90E−108 |
| 479 | CGPG82 | Pkinase | 43 | 329 | 324.8 | 1.40E−94 |
| 480 | CGPG6761 | Pyr_redox | 155 | 247 | 23.4 | 0.00017 |
| 480 | CGPG6761 | Pyr_redox_2 | 155 | 468 | 91.9 | 1.80E−24 |
| 481 | CGPG6781 | Aminotran_3 | 28 | 350 | 619.8 | 2.20E−183 |
| 482 | CGPG4914 | WD40 | 281 | 318 | 31 | 3.80E−06 |
| 483 | CGPG5840 | Pkinase | 5 | 274 | 146.1 | 8.30E−41 |
| 484 | CGPG5980 | Pkinase | 9 | 278 | 134.2 | 3.20E−37 |

TABLE 16-continued

| PEP SEQ ID NO | GENE ID | Pfam domain name | begin | stop | score | E-value |
|---|---|---|---|---|---|---|
| 485 | CGPG1743 | mTERF | 88 | 391 | 536.8 | 2.00E-158 |
| 486 | CGPG5434 | MtN3_slv | 9 | 98 | 76.7 | 6.50E-20 |
| 486 | CGPG5434 | MtN3_slv | 132 | 206 | 56.5 | 8.10E-14 |
| 487 | CGPG5824 | Pkinase | 121 | 407 | 304.3 | 2.00E-88 |
| 488 | CGPG5879 | Pkinase | 74 | 328 | 349 | 7.00E-102 |
| 488 | CGPG5879 | NAF | 383 | 441 | 95.5 | 1.50E-25 |
| 489 | CGPG5949 | Pyr_redox_2 | 6 | 302 | 154.8 | 2.00E-43 |
| 489 | CGPG5949 | Pyr_redox | 164 | 259 | 97 | 5.30E-26 |
| 490 | CGPG6096 | GSHPx | 79 | 187 | 229.1 | 8.70E-66 |
| 491 | CGPG6218 | MFS_1 | 27 | 449 | 95.1 | 2.00E-25 |
| 491 | CGPG6218 | Sugar_tr | 30 | 488 | 528.1 | 8.40E-156 |
| 492 | CGPG6226 | Sugar_tr | 101 | 556 | 315.4 | 9.20E-92 |
| 492 | CGPG6226 | MFS_1 | 105 | 515 | 81.2 | 2.90E-21 |
| 494 | CGPG7654 | HABP4_PAI-RBP1 | 159 | 272 | 149.9 | 6.00E-42 |
| 495 | CGPG6875 | zf-C3HC4 | 202 | 239 | 25.3 | 0.00019 |
| 496 | CGPG8259 | TIM | 4 | 245 | 454.3 | 1.40E-133 |
| 498 | CGPG8224 | NIR_SIR_ferr | 66 | 133 | 49.7 | 8.80E-12 |
| 498 | CGPG8224 | NIR_SIR | 166 | 347 | 199.3 | 8.30E-57 |
| 498 | CGPG8224 | NIR_SIR_ferr | 362 | 434 | 69.7 | 8.70E-18 |
| 498 | CGPG8224 | NIR_SIR | 443 | 591 | 0.4 | 0.0014 |
| 499 | CGPG1927 | F-box | 38 | 85 | 38.8 | 1.70E-08 |
| 499 | CGPG1927 | Arm | 418 | 458 | 27 | 5.90E-05 |
| 499 | CGPG1927 | Arm | 459 | 499 | 34.8 | 2.70E-07 |
| 499 | CGPG1927 | Arm | 500 | 543 | 39.2 | 1.30E-08 |
| 499 | CGPG1927 | Arm | 544 | 585 | 37.4 | 4.50E-08 |
| 499 | CGPG1927 | Arm | 589 | 630 | 45.7 | 1.40E-10 |
| 499 | CGPG1927 | Arm | 631 | 674 | 28.5 | 2.20E-05 |
| 499 | CGPG1927 | Arm | 675 | 715 | 45.8 | 1.30E-10 |
| 499 | CGPG1927 | Arm | 716 | 757 | 25 | 0.00025 |
| 500 | CGPG5962 | Glyco_hydro_14 | 95 | 523 | 269.8 | 5.00E-78 |
| 501 | CGPG5375 | IMPDH | 18 | 493 | 696.2 | 2.10E-206 |
| 503 | CGPG8943 | MGS | 123 | 238 | 189.9 | 5.50E-54 |
| 503 | CGPG8943 | AICARFT_IMPCHas | 243 | 568 | 635.4 | 4.30E-188 |
| 504 | CGPG8896 | Ferric_reduct | 122 | 279 | 184.5 | 2.40E-52 |
| 505 | CGPG8960 | DnaJ | 77 | 139 | 86.9 | 5.60E-23 |
| 505 | CGPG8960 | Fer4 | 162 | 185 | 12.6 | 0.0035 |
| 506 | CGPG5891 | Pkinase | 56 | 307 | −19.6 | 6.30E-07 |
| 507 | CGPG7260 | ATP-grasp_2 | 5 | 204 | −43.8 | 5.10E-10 |
| 508 | CGPG2647 | Fibrillarin | 79 | 310 | 599.4 | 2.90E-177 |
| 509 | CGPG6995 | F-box | 23 | 71 | 30.2 | 6.70E-06 |
| 510 | CGPG9046 | Pro_isomerase | 36 | 195 | 57.4 | 4.40E-14 |
| 511 | CGPG9047 | Pec_lyase_C | 108 | 274 | 124.5 | 2.80E-34 |
| 513 | CGPG9076 | Auxin_inducible | 7 | 106 | 26.3 | 5.50E-08 |
| 515 | CGPG9109 | CS | 19 | 93 | 91.2 | 2.80E-24 |
| 516 | CGPG5933 | Nodulin-like | 16 | 263 | 497.5 | 1.40E-146 |
| 517 | CGPG6335 | Sterol_desat | 35 | 246 | 238.8 | 1.10E-68 |
| 518 | CGPG9174 | YjeF_N | 28 | 205 | 146.4 | 7.10E-41 |
| 518 | CGPG9174 | Carb_kinase | 268 | 524 | 267.5 | 2.50E-77 |
| 519 | CGPG9120 | Glyoxal_oxid_N | 114 | 355 | 530.2 | 2.10E-156 |
| 522 | CGPG8087 | DUF1677 | 43 | 159 | 228.8 | 1.10E-65 |
| 523 | CGPG385 | RRM_1 | 13 | 76 | 71.4 | 2.70E-18 |
| 523 | CGPG385 | zf-CCHC | 99 | 116 | 34.1 | 4.40E-07 |
| 523 | CGPG385 | zf-CCHC | 121 | 138 | 28 | 1.90E-05 |
| 524 | CGPG1857 | FHA | 32 | 107 | 45.8 | 1.30E-10 |
| 525 | CGPG1788 | PB1 | 100 | 192 | 88.2 | 2.30E-23 |
| 526 | CGPG1966 | PHD | 66 | 114 | 57.6 | 3.70E-14 |
| 526 | CGPG1966 | SET | 238 | 373 | 99 | 1.30E-26 |
| 527 | CGPG1908 | F-box | 12 | 59 | 31 | 3.80E-06 |
| 527 | CGPG1908 | LRR_2 | 171 | 197 | 24.5 | 0.00035 |
| 529 | CGPG3557 | DnaJ | 4 | 67 | 139.6 | 7.80E-39 |
| 529 | CGPG3557 | DnaJ_C | 214 | 336 | 53.7 | 5.70E-13 |
| 530 | CGPG3340 | Dehydrin | 21 | 186 | 188.8 | 1.20E-53 |
| 531 | CGPG3431 | DUF914 | 3 | 330 | 829.1 | 2.20E-246 |
| 532 | CGPG3530 | DUF1644 | 29 | 181 | 359.3 | 5.80E-105 |
| 533 | CGPG3119 | DUF231 | 262 | 434 | 243.6 | 3.80E-70 |
| 534 | CGPG3594 | PRA-CH | 81 | 155 | 109.1 | 1.20E-29 |
| 534 | CGPG3594 | PRA-PH | 176 | 269 | 76 | 1.10E-19 |
| 535 | CGPG4031 | Pkinase_Tyr | 73 | 355 | 134.8 | 2.20E-37 |
| 535 | CGPG4031 | Pkinase | 73 | 355 | 173.8 | 4.10E-49 |
| 536 | CGPG4036 | Aa_trans | 31 | 467 | 546.7 | 2.20E-161 |
| 537 | CGPG2384 | Epimerase | 3 | 266 | 18.3 | 1.80E-07 |
| 537 | CGPG2384 | 3Beta_HSD | 4 | 292 | −95.6 | 5.50E-06 |
| 538 | CGPG1598 | Hist_deacetyl | 149 | 461 | 399.3 | 5.10E-117 |
| 539 | CGPG560 | zf-CCCH | 43 | 69 | 33.8 | 5.50E-07 |
| 539 | CGPG560 | zf-CCCH | 88 | 114 | 42 | 1.80E-09 |
| 539 | CGPG560 | zf-CCCH | 134 | 160 | 43.1 | 8.60E-10 |

TABLE 16-continued

| PEP SEQ ID NO | GENE ID | Pfam domain name | begin | stop | score | E-value |
|---|---|---|---|---|---|---|
| 539 | CGPG560 | zf-CCCH | 244 | 270 | 44.7 | 2.90E-10 |
| 539 | CGPG560 | zf-CCCH | 290 | 316 | 46.2 | 9.80E-11 |
| 540 | CGPG4002 | Aldo_ket_red | 15 | 319 | 258.8 | 1.00E-74 |
| 541 | CGPG1422 | ADH_N | 33 | 148 | 131.6 | 1.90E-36 |
| 541 | CGPG1422 | ADH_zinc_N | 179 | 314 | 106 | 9.80E-29 |
| 542 | CGPG4429 | p450 | 42 | 510 | 443 | 3.60E-130 |
| 544 | CGPG2251 | Abhydrolase_1 | 214 | 507 | 29.8 | 8.80E-06 |
| 545 | CGPG646 | 2-Hacid_dh | 31 | 357 | 64.1 | 4.10E-16 |
| 545 | CGPG646 | 2-Hacid_dh_C | 128 | 322 | 225.6 | 1.00E-64 |
| 546 | CGPG2569 | zf-CCCH | 146 | 171 | 27.5 | 4.30E-05 |
| 546 | CGPG2569 | WD40 | 178 | 215 | 25.9 | 0.00013 |
| 546 | CGPG2569 | WD40 | 302 | 338 | 31.9 | 2.00E-06 |
| 546 | CGPG2569 | WD40 | 343 | 378 | 26.4 | 9.40E-05 |
| 547 | CGPG5507 | zf-MYND | 74 | 111 | 47.9 | 3.10E-11 |
| 547 | CGPG5507 | UCH | 539 | 844 | 192.1 | 1.20E-54 |
| 548 | CGPG5547 | Hrf1 | 66 | 313 | 533.2 | 2.60E-157 |
| 548 | CGPG5547 | Yip1 | 108 | 286 | 1.7 | 0.00014 |
| 549 | CGPG5517 | HEAT | 178 | 214 | 14.2 | 0.44 |
| 549 | CGPG5517 | HEAT | 497 | 533 | 17.8 | 0.036 |
| 550 | CGPG5792 | AA_permease | 90 | 561 | 483.8 | 1.90E-142 |
| 551 | CGPG5766 | PHD | 282 | 329 | 54.3 | 3.70E-13 |
| 552 | CGPG5775 | SEP | 237 | 311 | 150.2 | 4.90E-42 |
| 552 | CGPG5775 | UBX | 343 | 422 | 105.7 | 1.20E-28 |
| 554 | CGPG4872 | WD40 | 310 | 347 | 31.9 | 2.00E-06 |
| 555 | CGPG6420 | ADH_N | 27 | 155 | 128.4 | 1.90E-35 |
| 555 | CGPG6420 | ADH_zinc_N | 186 | 327 | 138.2 | 2.10E-38 |
| 556 | CGPG6402 | PALP | 44 | 349 | −9.2 | 2.50E-07 |
| 557 | CGPG5073 | MatE | 49 | 209 | 124.5 | 2.70E-34 |
| 557 | CGPG5073 | MatE | 270 | 433 | 104.4 | 3.20E-28 |
| 558 | CGPG5091 | Lectin_C | 69 | 189 | 15.7 | 2.10E-05 |
| 558 | CGPG5091 | Pkinase | 257 | 542 | 64.3 | 3.60E-16 |
| 558 | CGPG5091 | Pkinase_Tyr | 283 | 542 | 69.1 | 6.30E-20 |
| 559 | CGPG3570 | TMEM14 | 4 | 107 | 204.8 | 1.90E-58 |
| 560 | CGPG4342 | Mito_carr | 114 | 210 | 119.3 | 1.00E-32 |
| 560 | CGPG4342 | Mito_carr | 214 | 301 | 100.5 | 4.60E-27 |
| 560 | CGPG4342 | Mito_carr | 304 | 392 | 100.7 | 4.10E-27 |
| 563 | CGPG4351 | ADH_N | 59 | 146 | 41.2 | 3.30E-09 |
| 563 | CGPG4351 | ADH_zinc_N | 177 | 323 | 66.6 | 7.40E-17 |
| 564 | CGPG4753 | FKBP_C | 43 | 137 | 190.9 | 2.80E-54 |
| 565 | CGPG4757 | DPBB_1 | 65 | 152 | 140.4 | 4.40E-39 |
| 565 | CGPG4757 | Pollen_allerg_1 | 163 | 240 | 133.5 | 5.20E-37 |
| 567 | CGPG6624 | YGGT | 92 | 174 | 111.5 | 2.20E-30 |
| 568 | CGPG3161 | ABC_tran | 92 | 280 | 155.8 | 1.00E-43 |
| 568 | CGPG3161 | ABC2_membrane | 384 | 590 | 180.6 | 3.60E-51 |
| 569 | CGPG3770 | ARID | 21 | 129 | 36.3 | 3.70E-08 |
| 569 | CGPG3770 | ELM2 | 372 | 427 | 33 | 9.50E-07 |
| 569 | CGPG3770 | Myb_DNA-binding | 472 | 518 | 19.4 | 0.011 |
| 571 | CGPG6702 | Aldedh | 103 | 564 | 794.5 | 5.60E-236 |
| 572 | CGPG21 | MIP | 30 | 265 | 447.2 | 2.00E-131 |
| 573 | CGPG6801 | PEPCK_ATP | 18 | 492 | 1215.7 | 0 |
| 574 | CGPG154 | Aa_trans | 29 | 428 | 516.5 | 2.80E-152 |
| 575 | CGPG6762 | Aldedh | 28 | 511 | 665.1 | 5.10E-197 |
| 576 | CGPG6763 | PK | 1 | 343 | 804.6 | 5.00E-239 |
| 576 | CGPG6763 | PK_C | 355 | 470 | 176.3 | 6.80E-50 |
| 576 | CGPG6763 | PEP-utilizers | 486 | 574 | 116.7 | 6.00E-32 |
| 577 | CGPG1467 | Auxin_inducible | 23 | 112 | 153 | 6.90E-43 |
| 578 | CGPG6160 | Miro | 11 | 126 | 66.4 | 8.20E-17 |
| 578 | CGPG6160 | Ras | 12 | 173 | 318 | 1.50E-92 |
| 579 | CGPG15 | p450 | 28 | 483 | 375.3 | 8.60E-110 |
| 580 | CGPG5825 | Pkinase | 138 | 425 | 297.9 | 1.80E-86 |
| 581 | CGPG5936 | MFS_1 | 48 | 421 | 141.9 | 1.60E-39 |
| 582 | CGPG5974 | FMO-like | 10 | 457 | −195.5 | 5.40E-15 |
| 582 | CGPG5974 | DAO | 12 | 288 | −14.4 | 7.70E-05 |
| 582 | CGPG5974 | Pyr_redox_2 | 12 | 308 | −16.4 | 0.0018 |
| 583 | CGPG1366 | Pkinase | 87 | 363 | 126.5 | 6.90E-35 |
| 583 | CGPG1366 | Pkinase_Tyr | 87 | 364 | 123.2 | 6.70E-34 |
| 584 | CGPG7390 | DapB_N | 51 | 180 | 68.3 | 2.20E-17 |
| 584 | CGPG7390 | DapB_C | 183 | 315 | 100.6 | 4.40E-27 |
| 585 | CGPG7421 | Ribul_P_3_epim | 91 | 291 | 411.7 | 9.30E-121 |
| 585 | CGPG7421 | OMPdecase | 94 | 300 | −46 | 0.0036 |
| 586 | CGPG7446 | TPR_1 | 123 | 156 | 26.4 | 9.10E-05 |
| 586 | CGPG7446 | TPR_2 | 123 | 156 | 24.4 | 0.00038 |
| 586 | CGPG7446 | TPR_1 | 160 | 193 | 37.1 | 5.70E-08 |
| 586 | CGPG7446 | TPR_2 | 160 | 193 | 32.9 | 9.90E-07 |
| 586 | CGPG7446 | TPR_1 | 194 | 241 | 14.4 | 0.093 |
| 587 | CGPG6295 | Pkinase | 67 | 345 | −14.9 | 3.40E-07 |

TABLE 16-continued

| PEP SEQ ID NO | GENE ID | Pfam domain name | begin | stop | score | E-value |
|---|---|---|---|---|---|---|
| 588 | CGPG1476 | RRM_1 | 26 | 97 | 63.9 | 4.80E−16 |
| 588 | CGPG1476 | RRM_1 | 114 | 184 | 98.1 | 2.40E−26 |
| 588 | CGPG1476 | RRM_1 | 203 | 273 | 88.2 | 2.30E−23 |
| 588 | CGPG1476 | RRM_1 | 306 | 376 | 94.6 | 2.80E−25 |
| 588 | CGPG1476 | PABP | 504 | 581 | 69.4 | 1.10E−17 |
| 589 | CGPG1821 | F-box | 10 | 57 | 37.4 | 4.50E−08 |
| 589 | CGPG1821 | LRR_2 | 166 | 190 | 16.6 | 0.077 |
| 589 | CGPG1821 | LRR_2 | 376 | 401 | 6.6 | 1.9 |
| 590 | CGPG6975 | Trp_syntA | 17 | 274 | 441.7 | 9.00E−130 |
| 591 | CGPG6189 | GDPD | 43 | 321 | 186.4 | 6.40E−53 |
| 592 | CGPG8868 | Pkinase | 49 | 318 | 114.4 | 2.90E−31 |
| 593 | CGPG8909 | Brix | 29 | 346 | 270.9 | 2.30E−78 |
| 594 | CGPG8951 | Lipase_3 | 102 | 222 | 8.9 | 9.40E−05 |
| 595 | CGPG5892 | Pkinase | 50 | 288 | −29.2 | 2.20E−06 |
| 597 | CGPG6142 | FAD_binding_4 | 123 | 258 | 118.8 | 1.40E−32 |
| 599 | CGPG9034 | Nicastrin | 249 | 458 | 357.9 | 1.50E−104 |
| 600 | CGPG9270 | Pkinase | 241 | 513 | 133.9 | 4.00E−37 |
| 600 | CGPG9270 | Pkinase_Tyr | 241 | 513 | 126.7 | 5.90E−35 |
| 602 | CGPG1284 | NAPRTase | 172 | 439 | 196.4 | 6.20E−56 |
| 603 | CGPG1640 | DUF1639 | 117 | 190 | 80.8 | 3.80E−21 |
| 604 | CGPG2136 | HMA | 13 | 73 | 52 | 1.80E−12 |
| 605 | CGPG3542 | Oxidored_FMN | 11 | 346 | 315.7 | 7.60E−92 |
| 606 | CGPG1691 | Mlo | 5 | 513 | 1236.3 | 0 |
| 607 | CGPG4067 | Glyco_transf_8 | 169 | 499 | 263 | 5.50E−76 |
| 608 | CGPG5335 | U-box | 256 | 329 | 93.1 | 7.90E−25 |
| 608 | CGPG5335 | Arm | 383 | 423 | 48.9 | 1.60E−11 |
| 608 | CGPG5335 | Arm | 424 | 464 | 22.1 | 0.0018 |
| 608 | CGPG5335 | Arm | 465 | 505 | 40.9 | 3.90E−09 |
| 608 | CGPG5335 | Arm | 506 | 546 | 18.7 | 0.019 |
| 608 | CGPG5335 | Arm | 547 | 587 | 34.1 | 4.30E−07 |
| 609 | CGPG27 | Ammonium_transp | 43 | 467 | 685.5 | 3.50E−203 |
| 611 | CGPG4375 | Anti-silence | 1 | 155 | 392.9 | 4.40E−115 |
| 612 | CGPG5176 | Pkinase | 334 | 602 | 135.4 | 1.40E−37 |
| 612 | CGPG5176 | Pkinase_Tyr | 334 | 606 | 124.9 | 2.00E−34 |
| 614 | CGPG661 | Flavodoxin_1 | 87 | 230 | 173.8 | 3.80E−49 |
| 614 | CGPG661 | FAD_binding_1 | 285 | 509 | 380.4 | 2.50E−111 |
| 614 | CGPG661 | NAD_binding_1 | 545 | 657 | 112 | 1.60E−30 |
| 615 | CGPG869 | ABC_tran | 110 | 312 | 147.5 | 3.20E−41 |
| 616 | CGPG6159 | Miro | 14 | 129 | 80.2 | 5.80E−21 |
| 616 | CGPG6159 | Ras | 15 | 176 | 332.9 | 5.10E−97 |
| 618 | CGPG6282 | Pkinase_Tyr | 86 | 365 | 140.5 | 4.10E−39 |
| 618 | CGPG6282 | Pkinase | 86 | 365 | 167.8 | 2.60E−47 |
| 619 | CGPG7671 | GATase_2 | 2 | 259 | 109.8 | 7.20E−30 |
| 619 | CGPG7671 | SIS | 356 | 490 | 123 | 7.60E−34 |
| 619 | CGPG7671 | SIS | 527 | 666 | 83.5 | 6.10E−22 |
| 620 | CGPG1574 | SPX | 1 | 293 | 370.2 | 2.90E−108 |
| 620 | CGPG1574 | EXS | 550 | 718 | 320.5 | 2.80E−93 |
| 621 | CGPG9294 | Pkinase | 22 | 281 | 169.6 | 7.20E−48 |
| 622 | CGPG2435 | Abhydrolase_3 | 92 | 307 | 250 | 4.50E−72 |
| 623 | CGPG3336 | GRP | 1 | 109 | 144.7 | 2.30E−40 |
| 625 | CGPG4168 | zf-A20 | 10 | 34 | 29.1 | 1.40E−05 |
| 625 | CGPG4168 | zf-AN1 | 99 | 139 | 61 | 3.50E−15 |
| 626 | CGPG6517 | Aldedh | 19 | 478 | 827.9 | 4.90E−246 |
| 627 | CGPG993 | p450 | 30 | 500 | 86.4 | 7.90E−23 |
| 629 | CGPG5393 | PALP | 20 | 309 | 439.2 | 5.10E−129 |
| 630 | CGPG1313 | Di19 | 10 | 218 | 482.6 | 4.40E−142 |
| 631 | CGPG8150 | DnaJ | 93 | 162 | 23.9 | 1.90E−05 |
| 631 | CGPG8150 | HSCB_C | 176 | 250 | 102.1 | 1.50E−27 |
| 632 | CGPG1661 | FAE_3-kCoA_syn1 | 14 | 340 | 776.2 | 1.80E−230 |
| 633 | CGPG6427 | ADH_N | 27 | 155 | 129.8 | 6.70E−36 |
| 633 | CGPG6427 | ADH_zinc_N | 186 | 332 | 129.4 | 9.40E−36 |
| 634 | CGPG4906 | WD40 | 46 | 83 | 39.2 | 1.30E−08 |
| 635 | CGPG5092 | Lectin_legB | 25 | 262 | 393.3 | 3.30E−115 |
| 635 | CGPG5092 | Pkinase | 353 | 611 | 45.8 | 1.30E−10 |
| 635 | CGPG5092 | Pkinase_Tyr | 353 | 611 | 65.9 | 1.10E−19 |
| 636 | CGPG6146 | DUF241 | 37 | 272 | 374.9 | 1.20E−109 |
| 637 | CGPG6022 | RRM_1 | 46 | 113 | 28.5 | 2.20E−05 |
| 637 | CGPG6022 | RRM_1 | 163 | 233 | 44.6 | 3.10E−10 |
| 638 | CGPG5883 | Pkinase | 129 | 411 | 125.5 | 1.40E−34 |
| 638 | CGPG5883 | Pkinase_Tyr | 129 | 411 | 86.8 | 6.00E−23 |
| 640 | CGPG8248 | NAD_binding_2 | 1 | 163 | 203 | 6.40E−58 |
| 640 | CGPG8248 | 6PGD | 167 | 301 | −145.6 | 3.60E−09 |
| 641 | CGPG8233 | Sedlin_N | 3 | 77 | 177.8 | 2.50E−50 |
| 645 | CGPG6337 | Sterol_desat | 38 | 246 | 218.1 | 1.80E−62 |
| 646 | CGPG9005 | CH | 14 | 115 | 54.8 | 2.60E−13 |
| 646 | CGPG9005 | EB1 | 200 | 247 | 76.6 | 7.30E−20 |

TABLE 16-continued

| PEP SEQ ID NO | GENE ID | Pfam domain name | begin | stop | score | E-value |
|---|---|---|---|---|---|---|
| 647 | CGPG9208 | CoA_trans | 5 | 242 | 104.7 | 2.50E−28 |
| 648 | CGPG4348 | Xan_ur_permease | 94 | 532 | −11.6 | 1.00E−07 |
| 650 | CGPG618 | ADK | 38 | 224 | 317.8 | 1.80E−92 |
| 650 | CGPG618 | ADK_lid | 160 | 195 | 83.4 | 6.40E−22 |
| 651 | CGPG251 | p450 | 37 | 459 | 223.1 | 5.80E−64 |
| 652 | CGPG636 | Ion_trans_2 | 81 | 163 | 75.3 | 1.80E−19 |
| 652 | CGPG636 | Ion_trans_2 | 202 | 277 | 59.5 | 9.80E−15 |
| 654 | CGPG287 | B56 | 71 | 484 | 1074.3 | 0 |
| 655 | CGPG893 | DUF231 | 210 | 368 | 324.8 | 1.30E−94 |
| 657 | CGPG657 | PI-PLC-X | 106 | 248 | 73.4 | 6.70E−19 |
| 657 | CGPG657 | C2 | 405 | 496 | 85.1 | 1.90E−22 |
| 658 | CGPG1489 | Enolase_N | 3 | 139 | 232.7 | 7.20E−67 |
| 658 | CGPG1489 | Enolase_C | 147 | 441 | 719.3 | 2.40E−213 |
| 660 | CGPG1683 | DUF568 | 89 | 227 | 302 | 9.90E−88 |
| 661 | CGPG4685 | MFS_1 | 40 | 446 | 143.1 | 6.60E−40 |
| 662 | CGPG4729 | Auxin_inducible | 37 | 146 | 217.2 | 3.40E−62 |
| 663 | CGPG4880 | Trehalose_PPase | 108 | 346 | 314.1 | 2.30E−91 |
| 664 | CGPG5680 | Aminotran_1_2 | 30 | 384 | 204.7 | 1.90E−58 |
| 665 | CGPG7317 | ADH_N | 27 | 155 | 123 | 7.60E−34 |
| 665 | CGPG7317 | ADH_zinc_N | 186 | 328 | 146.5 | 6.30E−41 |
| 666 | CGPG4902 | DUF260 | 15 | 116 | 240.1 | 4.30E−69 |
| 667 | CGPG6720 | Aldedh | 116 | 581 | 794.9 | 4.30E−236 |
| 668 | CGPG5850 | Pkinase | 75 | 349 | 170.9 | 2.80E−48 |
| 668 | CGPG5850 | Pkinase_Tyr | 75 | 349 | 128.3 | 2.00E−35 |
| 669 | CGPG6010 | RRM_1 | 130 | 200 | 60 | 7.30E−15 |
| 669 | CGPG6010 | RRM_1 | 229 | 299 | 62.6 | 1.20E−15 |
| 670 | CGPG7488 | OPT | 28 | 651 | 682.3 | 3.40E−202 |
| 672 | CGPG7672 | PTPA | 86 | 387 | 526.8 | 2.10E−155 |
| 674 | CGPG6988 | Sulfotransfer_1 | 79 | 340 | 296.6 | 4.10E−86 |
| 675 | CGPG1357 | DUF26 | 77 | 131 | 85.6 | 1.40E−22 |
| 675 | CGPG1357 | DUF26 | 190 | 241 | 81.6 | 2.20E−21 |
| 675 | CGPG1357 | Pkinase_Tyr | 326 | 598 | 144.7 | 2.30E−40 |
| 675 | CGPG1357 | Pkinase | 326 | 598 | 158.3 | 1.80E−44 |
| 676 | CGPG5918 | ADH_N | 35 | 150 | 102.7 | 1.00E−27 |
| 676 | CGPG5918 | ADH_zinc_N | 181 | 315 | 81.3 | 2.80E−21 |
| 677 | CGPG6020 | La | 107 | 166 | 135.1 | 1.70E−37 |
| 677 | CGPG6020 | RRM_1 | 195 | 278 | 39.7 | 9.50E−09 |
| 678 | CGPG7032 | Pkinase | 18 | 302 | 169.8 | 6.20E−48 |
| 678 | CGPG7032 | Pkinase_Tyr | 18 | 302 | 174.3 | 2.80E−49 |
| 679 | CGPG7069 | Na_Ca_ex | 115 | 249 | 118.5 | 1.80E−32 |
| 679 | CGPG7069 | Na_Ca_ex | 415 | 558 | 118.9 | 1.30E−32 |
| 680 | CGPG8900 | K_trans | 1 | 302 | 64.8 | 2.30E−23 |
| 681 | CGPG8923 | Pkinase | 134 | 418 | 303.1 | 4.80E−88 |
| 682 | CGPG6296 | Pkinase | 113 | 376 | 169.5 | 7.50E−48 |
| 682 | CGPG6296 | Pkinase_Tyr | 113 | 376 | 150.7 | 3.50E−42 |
| 685 | CGPG6951 | RNA_pol_Rpb8 | 9 | 145 | 314.2 | 2.10E−91 |
| 686 | CGPG6994 | Ion_trans_2 | 155 | 237 | 56.5 | 8.00E−14 |
| 686 | CGPG6994 | Ion_trans_2 | 279 | 354 | 44 | 4.80E−10 |
| 687 | CGPG7019 | Aldo_ket_red | 10 | 325 | −73.8 | 5.00E−05 |
| 689 | CGPG9255 | Pkinase | 97 | 417 | 246.9 | 3.90E−71 |
| 690 | CGPG9274 | CS | 73 | 150 | 66.2 | 9.80E−17 |
| 690 | CGPG9274 | SGS | 154 | 212 | 58.1 | 2.70E−14 |
| 691 | CGPG6130 | Miro | 107 | 222 | 145.6 | 1.20E−40 |
| 691 | CGPG6130 | Ras | 108 | 274 | −24.6 | 1.80E−07 |
| 692 | CGPG8074 | PMEI | 32 | 193 | 190.9 | 2.70E−54 |
| 694 | CGPG172 | WD40 | 187 | 222 | 23.4 | 0.00074 |
| 696 | CGPG3222 | zf-C3HC4 | 110 | 151 | 30.9 | 4.10E−06 |
| 697 | CGPG3259 | Asp | 86 | 507 | 507.1 | 1.90E−149 |
| 697 | CGPG3259 | SapB_2 | 319 | 353 | 56.5 | 8.10E−14 |
| 697 | CGPG3259 | SapB_1 | 379 | 417 | 57 | 5.70E−14 |
| 698 | CGPG1900 | F-box | 1 | 48 | 39.5 | 1.00E−08 |
| 700 | CGPG20 | MIP | 30 | 259 | 448.1 | 1.10E−131 |
| 701 | CGPG201 | PI-PLC-X | 113 | 257 | 137 | 4.80E−38 |
| 701 | CGPG201 | PI-PLC-Y | 299 | 417 | 97.2 | 4.40E−26 |
| 701 | CGPG201 | C2 | 439 | 531 | 80.2 | 5.70E−21 |
| 702 | CGPG3420 | WD40 | 573 | 612 | 26.9 | 6.50E−05 |
| 703 | CGPG4308 | NPH3 | 30 | 309 | 254 | 2.90E−73 |
| 704 | CGPG5244 | FH2 | 589 | 985 | 601.3 | 8.30E−178 |
| 705 | CGPG5538 | aPHC | 13 | 313 | 625.3 | 4.60E−185 |
| 706 | CGPG3738 | Glycolytic | 55 | 399 | 842.5 | 1.90E−250 |
| 707 | CGPG6454 | PGM_PMM_I | 103 | 249 | 157.3 | 3.70E−44 |
| 707 | CGPG6454 | PGM_PMM_II | 280 | 394 | 163.5 | 4.90E−46 |
| 707 | CGPG6454 | PGM_PMM_III | 396 | 518 | 150.6 | 3.70E−42 |
| 707 | CGPG6454 | PGM_PMM_IV | 539 | 647 | 96.5 | 7.50E−26 |
| 708 | CGPG6530 | Glutaminase | 121 | 412 | 609.3 | 3.10E−180 |
| 709 | CGPG5175 | p450 | 36 | 467 | 55.8 | 1.30E−13 |

TABLE 16-continued

| PEP SEQ ID NO | GENE ID | Pfam domain name | begin | stop | score | E-value |
|---|---|---|---|---|---|---|
| 710 | CGPG5756 | Pkinase | 504 | 838 | 165.3 | 1.40E−46 |
| 711 | CGPG5361 | U-box | 32 | 106 | 87.5 | 3.80E−23 |
| 712 | CGPG6709 | Aldedh | 103 | 562 | 699.5 | 2.10E−207 |
| 713 | CGPG6755 | Aminotran_3 | 123 | 449 | 313.4 | 3.80E−91 |
| 714 | CGPG6765 | Alpha-amylase | 16 | 418 | 541.6 | 7.40E−160 |
| 715 | CGPG6039 | LEA_2 | 2 | 151 | 358.6 | 8.90E−105 |
| 716 | CGPG6158 | Miro | 9 | 124 | 78.5 | 1.90E−20 |
| 716 | CGPG6158 | Ras | 10 | 171 | 357.2 | 2.40E−104 |
| 718 | CGPG7528 | Agenet | 3 | 68 | 34 | 4.80E−07 |
| 718 | CGPG7528 | Agenet | 141 | 206 | 93.6 | 5.50E−25 |
| 719 | CGPG7756 | BRAP2 | 51 | 161 | 137.8 | 2.70E−38 |
| 719 | CGPG7756 | zf-C3HC4 | 168 | 207 | 40.1 | 7.20E−09 |
| 719 | CGPG7756 | zf-UBP | 219 | 290 | 119.4 | 9.30E−33 |
| 721 | CGPG8249 | PfkB | 3 | 313 | 214 | 3.20E−61 |
| 722 | CGPG2232 | PCI | 293 | 397 | 103.9 | 4.20E−28 |
| 723 | CGPG5494 | FAE1_CUT1_RppA | 22 | 313 | 586 | 3.30E−173 |
| 723 | CGPG5494 | Chal_sti_synt_C | 287 | 426 | 0 | 0.0016 |
| 723 | CGPG5494 | ACP_syn_III_C | 333 | 424 | 31.3 | 7.50E−09 |
| 724 | CGPG5947 | Glyco_hydro_14 | 109 | 534 | 645.4 | 4.40E−191 |
| 726 | CGPG6262 | Pkinase | 68 | 304 | −46.3 | 2.00E−05 |
| 727 | CGPG6909 | 2OG-FeII_Oxy | 205 | 302 | 109.4 | 9.80E−30 |
| 729 | CGPG8965 | DnaJ | 6 | 68 | 116.2 | 8.30E−32 |
| 730 | CGPG5861 | Pkinase | 68 | 337 | 98.7 | 1.60E−26 |
| 730 | CGPG5861 | Pkinase_Tyr | 68 | 337 | 78.1 | 1.40E−20 |
| 732 | CGPG7246 | MIP | 75 | 285 | 170.5 | 3.80E−48 |
| 733 | CGPG5378 | WWE | 77 | 148 | 88.4 | 2.00E−23 |
| 734 | CGPG9168 | NTP_transferase | 5 | 286 | 481.1 | 1.20E−141 |
| 734 | CGPG9168 | MannoseP_isomer | 297 | 462 | 449.5 | 4.10E−132 |
| 734 | CGPG9168 | Cupin_2 | 377 | 447 | 52 | 1.80E−12 |
| 735 | CGPG1505 | PGI | 52 | 548 | 1050.2 | 0 |
| 737 | CGPG3220 | Methyltransf_6 | 2 | 159 | 181.8 | 1.60E−51 |
| 738 | CGPG3062 | Sugar_tr | 26 | 489 | 672.8 | 2.30E−199 |
| 738 | CGPG3062 | MFS_1 | 32 | 450 | 89.6 | 8.70E−24 |
| 739 | CGPG3580 | DUF588 | 27 | 169 | 202.1 | 1.20E−57 |
| 740 | CGPG3725 | DUF1325 | 8 | 269 | 487.8 | 1.20E−143 |
| 741 | CGPG592 | Spermine_synth | 50 | 295 | 493.4 | 2.40E−145 |
| 742 | CGPG4417 | p450 | 34 | 510 | 291.7 | 1.30E−84 |
| 743 | CGPG2276 | IF2_N | 419 | 470 | 46.9 | 6.20E−11 |
| 743 | CGPG2276 | GTP_EFTU | 499 | 670 | 157 | 4.40E−44 |
| 743 | CGPG2276 | Ras | 513 | 668 | −68.7 | 0.00036 |
| 743 | CGPG2276 | GTP_EFTU_D2 | 693 | 756 | 59 | 1.40E−14 |
| 744 | CGPG4975 | CK_II_beta | 96 | 270 | 447.9 | 1.20E−131 |
| 745 | CGPG2790 | Asp | 82 | 476 | −116.5 | 9.10E−07 |
| 746 | CGPG4972 | PP2C | 88 | 349 | 281 | 2.00E−81 |
| 747 | CGPG5140 | p450 | 27 | 502 | 87.5 | 3.70E−23 |
| 748 | CGPG19 | MIP | 11 | 232 | 391.4 | 1.20E−114 |
| 749 | CGPG6769 | iPGM_N | 12 | 367 | 828.1 | 4.30E−246 |
| 749 | CGPG6769 | Metalloenzyme | 377 | 493 | 184.1 | 3.00E−52 |
| 750 | CGPG6770 | Molybdop_Fe4S4 | 53 | 114 | 70.4 | 5.30E−18 |
| 750 | CGPG6770 | Molybdopterin | 117 | 670 | 82.9 | 8.90E−22 |
| 750 | CGPG6770 | Molydop_binding | 902 | 1021 | 63.2 | 7.60E−16 |
| 752 | CGPG6789 | Isoamylase_N | 12 | 98 | 134.2 | 3.20E−37 |
| 752 | CGPG6789 | Alpha-amylase | 138 | 574 | 49.2 | 1.10E−12 |
| 753 | CGPG5374 | CBS | 54 | 268 | 34 | 4.80E−07 |
| 753 | CGPG5374 | CBS | 291 | 426 | 80.3 | 5.60E−21 |
| 754 | CGPG5978 | Pkinase_Tyr | 74 | 349 | 229.9 | 5.00E−66 |
| 754 | CGPG5978 | Pkinase | 74 | 349 | 185.3 | 1.30E−52 |
| 755 | CGPG5979 | Pkinase | 108 | 369 | 219.6 | 6.40E−63 |
| 757 | CGPG948 | NPH3 | 165 | 407 | 469.9 | 2.90E−138 |
| 758 | CGPG6052 | DUF1723 | 61 | 110 | 92.8 | 9.50E−25 |
| 759 | CGPG7661 | HMA | 91 | 154 | 50.4 | 5.40E−12 |
| 759 | CGPG7661 | DAO | 188 | 525 | −20.6 | 0.0002 |
| 759 | CGPG7661 | Pyr_redox_2 | 188 | 497 | 237.8 | 2.10E−68 |
| 759 | CGPG7661 | Pyr_redox | 360 | 450 | 89 | 1.30E−23 |
| 759 | CGPG7661 | Pyr_redox_dim | 525 | 634 | 160.9 | 3.00E−45 |
| 760 | CGPG8261 | Aminotran_3 | 27 | 350 | 484.5 | 1.20E−142 |
| 761 | CGPG5447 | Cys_Met_Meta_PP | 176 | 561 | 752.1 | 3.20E−223 |
| 761 | CGPG5447 | Beta_elim_lyase | 215 | 461 | −106.2 | 0.0013 |
| 762 | CGPG7068 | DUF1005 | 249 | 432 | 467.9 | 1.10E−137 |
| 763 | CGPG5938 | MFS_1 | 45 | 420 | 78.2 | 2.30E−20 |
| 764 | CGPG7100 | BCNT | 149 | 228 | 153.6 | 4.90E−43 |
| 765 | CGPG9003 | SNARE | 37 | 99 | 66.1 | 1.00E−16 |
| 766 | CGPG6299 | Pkinase_Tyr | 73 | 349 | 136 | 9.50E−38 |
| 766 | CGPG6299 | Pkinase | 73 | 349 | 139.1 | 1.10E−38 |
| 767 | CGPG9135 | Acyl-CoA_dh_N | 51 | 162 | 83.6 | 5.80E−22 |
| 767 | CGPG9135 | Acyl-CoA_dh_M | 166 | 218 | 85.2 | 1.80E−22 |

TABLE 16-continued

| PEP SEQ ID NO | GENE ID | Pfam domain name | begin | stop | score | E-value |
|---|---|---|---|---|---|---|
| 767 | CGPG9135 | Acyl-CoA_dh_1 | 272 | 418 | 95.2 | 1.80E−25 |
| 767 | CGPG9135 | Acyl-CoA_dh_2 | 284 | 407 | −9.9 | 0.0016 |
| 771 | CGPG9139 | TB2_DP1_HVA22 | 2 | 98 | 38.6 | 6.60E−09 |
| 772 | CGPG414 | Pkinase | 80 | 338 | 353.1 | 4.00E−103 |
| 774 | CGPG1986 | Sulfotransfer_1 | 71 | 332 | 273.5 | 3.80E−79 |
| 775 | CGPG2916 | PC4 | 68 | 158 | 190.2 | 4.70E−54 |
| 776 | CGPG111 | PBP | 20 | 165 | 256.9 | 3.80E−74 |
| 777 | CGPG4317 | zf-AN1 | 102 | 142 | 70.1 | 6.60E−18 |
| 778 | CGPG4387 | zf-A20 | 31 | 55 | 40.6 | 4.90E−09 |
| 778 | CGPG4387 | zf-AN1 | 124 | 164 | 64.7 | 2.80E−16 |
| 779 | CGPG4492 | Oleosin | 27 | 145 | 87.2 | 4.70E−23 |
| 780 | CGPG597 | Glyco_hydro_28 | 98 | 437 | 482.9 | 3.60E−142 |
| 781 | CGPG345 | TPR_2 | 491 | 524 | 25 | 0.00024 |
| 781 | CGPG345 | TPR_1 | 491 | 524 | 18.8 | 0.018 |
| 781 | CGPG345 | TPR_2 | 590 | 623 | 25.4 | 0.00018 |
| 781 | CGPG345 | TPR_1 | 590 | 623 | 32.3 | 1.60E−06 |
| 781 | CGPG345 | TPR_1 | 624 | 657 | 24 | 0.00048 |
| 781 | CGPG345 | TPR_2 | 658 | 691 | 32.6 | 1.30E−06 |
| 781 | CGPG345 | TPR_1 | 658 | 691 | 36.6 | 8.00E−08 |
| 783 | CGPG4998 | LRRNT_2 | 27 | 67 | 57.2 | 5.00E−14 |
| 783 | CGPG4998 | LRR_1 | 71 | 93 | 9.9 | 3.6 |
| 783 | CGPG4998 | LRR_1 | 95 | 117 | 17.8 | 0.035 |
| 783 | CGPG4998 | LRR_1 | 119 | 141 | 17.2 | 0.056 |
| 783 | CGPG4998 | LRR_1 | 143 | 165 | 12.8 | 1 |
| 785 | CGPG5104 | C2 | 8 | 87 | 94.8 | 2.30E−25 |
| 786 | CGPG6502 | Pribosyltran | 95 | 241 | 137.3 | 3.90E−38 |
| 787 | CGPG6630 | Lactamase_B | 113 | 278 | 42.4 | 1.40E−09 |
| 788 | CGPG5484 | PP2C | 100 | 340 | 253.9 | 3.10E−73 |
| 789 | CGPG5394 | PDT | 101 | 278 | 281.4 | 1.60E−81 |
| 789 | CGPG5394 | ACT | 288 | 371 | 26.6 | 8.30E−05 |
| 791 | CGPG2090 | DUF786 | 5 | 107 | 220.1 | 4.60E−63 |
| 792 | CGPG6664 | FeThRed_A | 91 | 157 | 166.5 | 6.10E−47 |
| 793 | CGPG7706 | Acetyltransf_1 | 58 | 149 | 71.2 | 3.10E−18 |
| 794 | CGPG7884 | Aldedh | 72 | 516 | 216.4 | 5.70E−62 |
| 795 | CGPG6965 | COX5C | 2 | 63 | 162.4 | 1.10E−45 |
| 797 | CGPG2297 | TCTP | 1 | 165 | 320.9 | 2.00E−93 |
| 798 | CGPG6246 | Pkinase | 24 | 278 | 334.9 | 1.30E−97 |
| 798 | CGPG6246 | NAF | 311 | 373 | 119.5 | 8.90E−33 |
| 799 | CGPG9037 | Ribophorin_I | 40 | 472 | 658 | 6.90E−195 |
| 800 | CGPG1941 | TBC | 271 | 503 | −52.5 | 0.00069 |
| 801 | CGPG2055 | Terpene_synth | 1 | 105 | −37 | 7.70E−05 |
| 803 | CGPG386 | Ank | 57 | 89 | 46.8 | 6.50E−11 |
| 803 | CGPG386 | Ank | 91 | 123 | 22.6 | 0.0013 |
| 803 | CGPG386 | RCC1 | 259 | 307 | 29 | 1.50E−05 |
| 803 | CGPG386 | RCC1 | 311 | 361 | 25.7 | 0.00015 |
| 804 | CGPG393 | CDI | 155 | 208 | 92.1 | 1.50E−24 |
| 805 | CGPG609 | Smr | 428 | 502 | 81.8 | 2.00E−21 |
| 806 | CGPG4022 | Aa_trans | 41 | 435 | 323.9 | 2.60E−94 |
| 807 | CGPG942 | AMP-binding | 32 | 441 | 405 | 9.70E−119 |
| 808 | CGPG1800 | PHD | 605 | 653 | 48.3 | 2.30E−11 |
| 810 | CGPG3257 | LRRNT_2 | 26 | 63 | 39.9 | 7.80E−09 |
| 810 | CGPG3257 | LRR_1 | 91 | 113 | 18.9 | 0.016 |
| 810 | CGPG3257 | LRR_1 | 115 | 137 | 12.2 | 1.4 |
| 810 | CGPG3257 | LRR_1 | 163 | 183 | 9.6 | 4.1 |
| 810 | CGPG3257 | Pkinase_Tyr | 344 | 612 | 68.3 | 7.20E−20 |
| 810 | CGPG3257 | Pkinase | 345 | 612 | 63.9 | 4.90E−16 |
| 811 | CGPG1696 | MtN3_slv | 6 | 93 | 133.5 | 5.40E−37 |
| 811 | CGPG1696 | MtN3_slv | 128 | 214 | 96.2 | 8.80E−26 |
| 813 | CGPG3780 | Response_reg | 78 | 194 | 79.9 | 7.10E−21 |
| 813 | CGPG3780 | CCT | 675 | 713 | 71.5 | 2.40E−18 |
| 814 | CGPG6602 | RuBisCO_large_N | 104 | 229 | 293.3 | 4.30E−85 |
| 814 | CGPG6602 | RuBisCO_large | 237 | 545 | 816.5 | 1.30E−242 |
| 815 | CGPG6621 | GIDA | 128 | 453 | −213 | 0.0004 |
| 815 | CGPG6621 | Pyr_redox_2 | 128 | 437 | 209.4 | 7.80E−60 |
| 815 | CGPG6621 | Pyr_redox | 296 | 391 | 126.7 | 6.00E−35 |
| 815 | CGPG6621 | Pyr_redox_dim | 470 | 579 | 158.4 | 1.70E−44 |
| 816 | CGPG5493 | FAE1_CUT1_RppA | 113 | 402 | 727.7 | 7.00E−216 |
| 816 | CGPG5493 | Chal_sti_synt_C | 384 | 528 | −2.9 | 0.0028 |
| 816 | CGPG5493 | ACP_syn_III_C | 442 | 526 | 23.2 | 5.20E−08 |
| 817 | CGPG5811 | Pkinase | 107 | 381 | 198.8 | 1.20E−56 |
| 817 | CGPG5811 | Pkinase_Tyr | 107 | 381 | 253.2 | 4.80E−73 |
| 818 | CGPG5902 | ADH_N | 27 | 108 | 66.2 | 9.80E−17 |
| 818 | CGPG5902 | ADH_zinc_N | 139 | 281 | 165.3 | 1.50E−46 |
| 819 | CGPG6791 | PGI | 25 | 480 | 184.8 | 2.00E−52 |
| 820 | CGPG6778 | Alpha-amylase | 13 | 420 | 442.8 | 4.00E−130 |
| 821 | CGPG6166 | Miro | 7 | 121 | 52.9 | 1.00E−12 |

TABLE 16-continued

| PEP SEQ ID NO | GENE ID | Pfam domain name | begin | stop | score | E-value |
|---|---|---|---|---|---|---|
| 821 | CGPG6166 | Ras | 8 | 177 | 266.5 | 4.90E−77 |
| 822 | CGPG3735 | LisH | 47 | 73 | 43.8 | 5.40E−10 |
| 823 | CGPG5854 | Pkinase | 2 | 275 | 97.2 | 4.60E−26 |
| 825 | CGPG5024 | adh_short | 30 | 212 | 15.2 | 3.60E−07 |
| 826 | CGPG6054 | Miro | 6 | 120 | 63.4 | 6.90E−16 |
| 826 | CGPG6054 | Ras | 7 | 178 | 255.3 | 1.20E−73 |
| 827 | CGPG6207 | Sugar_tr | 34 | 479 | 468.3 | 8.90E−138 |
| 827 | CGPG6207 | MFS_1 | 38 | 438 | 121.3 | 2.50E−33 |
| 828 | CGPG7620 | Arginase | 69 | 349 | 375.5 | 7.30E−110 |
| 831 | CGPG73 | Dicty_CAR | 10 | 314 | −6.3 | 2.80E−06 |
| 832 | CGPG2100 | PLAC8 | 17 | 116 | 142.7 | 9.00E−40 |
| 833 | CGPG6026 | RRM_1 | 8 | 62 | 43.4 | 7.20E−10 |
| 834 | CGPG7269 | Tim17 | 18 | 146 | 146.8 | 5.20E−41 |
| 836 | CGPG6993 | Peptidase_C12 | 12 | 219 | 381.6 | 1.10E−111 |
| 838 | CGPG6926 | Yip1 | 93 | 240 | 161.1 | 2.70E−45 |
| 839 | CGPG7172 | Pkinase | 3 | 269 | 192.5 | 9.30E−55 |
| 840 | CGPG7129 | DUF1070 | 9 | 63 | 115.5 | 1.40E−31 |
| 842 | CGPG9031 | MFAP1_C | 141 | 423 | 511 | 1.20E−150 |
| 843 | CGPG9105 | ARD | 14 | 168 | 329.7 | 4.50E−96 |
| 843 | CGPG9105 | Cupin_2 | 88 | 162 | 28.3 | 2.50E−05 |
| 844 | CGPG9082 | DUF662 | 7 | 169 | 236.3 | 6.00E−68 |
| 845 | CGPG6212 | Sugar_tr | 20 | 490 | 52.4 | 1.40E−12 |
| 845 | CGPG6212 | MFS_1 | 29 | 451 | 98.9 | 1.40E−26 |
| 846 | CGPG9206 | Carboxyl_trans | 34 | 535 | 1022.5 | 1.30E−304 |
| 847 | CGPG9151 | Aminotran_3 | 82 | 421 | 269 | 8.90E−78 |
| 848 | CGPG9129 | HATPase_c | 228 | 356 | 83.7 | 5.20E−22 |
| 850 | CGPG9358 | TPR_1 | 551 | 584 | 10.5 | 0.28 |
| 850 | CGPG9358 | TPR_1 | 585 | 618 | 15.5 | 0.068 |
| 850 | CGPG9358 | TPR_1 | 655 | 688 | 16.1 | 0.059 |

TABLE 17

| Pfam domain name | accession number | gathering cutoff | domain description |
|---|---|---|---|
| zf-MYND | PF01753.8 | 11 | MYND finger |
| UCH | PF00443.18 | −8.6 | Ubiquitin carboxyl-terminal hydrolase |
| MIF | PF01187.7 | −17.6 | Macrophage migration inhibitory factor (MIF) |
| PurA | PF04845.3 | 25 | PurA ssDNA and RNA-binding protein |
| Gln-synt_C | PF00120.14 | −124 | Glutamine synthetase, catalytic domain |
| WD40 | PF00400.20 | 21.5 | WD domain, G-beta repeat |
| Pkinase | PF00069.14 | −70.8 | Protein kinase domain |
| Pkinase | PF00069.14 | −70.8 | Protein kinase domain |
| NAF | PF03822.4 | 4.5 | NAF domain |
| Sterol_desat | PF01598.7 | −13 | Sterol desaturase |
| Pkinase | PF00069.14 | −70.8 | Protein kinase domain |
| Asp | PF00026.13 | −186.1 | Eukaryotic aspartyl protease |
| Glyco_hydro_1 | PF00232.9 | −301.8 | Glycosyl hydrolase family 1 |
| Oleosin | PF01277.7 | −27 | Oleosin |
| Sugar_tr | PF00083.13 | −85 | Sugar (and other) transporter |
| MFS_1 | PF07690.5 | 23.5 | Major Facilitator Superfamily |
| ATP-grasp_2 | PF08442.1 | −118.8 | ATP-grasp domain |
| PLAC8 | PF04749.6 | −1.1 | PLAC8 family |
| Ferric_reduct | PF01794.8 | −7 | Ferric reductase like transmembrane component |
| FAD_binding_8 | PF08022.1 | −10.4 | FAD-binding domain |
| FAD_binding_6 | PF00970.13 | −11.4 | Oxidoreductase FAD-binding domain |
| NAD_binding_6 | PF08030.1 | −23.6 | Ferric reductase NAD binding domain |
| LSM | PF01423.12 | 13.7 | LSM domain |
| Fibrillarin | PF01269.7 | −86.6 | Fibrillarin |
| WD40 | PF00400.20 | 21.5 | WD domain, G-beta repeat |
| WD40 | PF00400.20 | 21.5 | WD domain, G-beta repeat |
| Linker_histone | PF00538.8 | −8 | linker histone H1 and H5 family |
| PP2C | PF00481.11 | −44 | Protein phosphatase 2C |
| Sugar_tr | PF00083.13 | −85 | Sugar (and other) transporter |
| MFS_1 | PF07690.5 | 23.5 | Major Facilitator Superfamily |
| SBF | PF01758.6 | −27.8 | Sodium Bile acid symporter family |
| Glyoxalase | PF00903.14 | 12.1 | Glyoxalase/Bleomycin resistance protein/Dioxygenase superfamily |
| Pkinase | PF00069.14 | −70.8 | Protein kinase domain |
| NAF | PF03822.4 | 4.5 | NAF domain |
| LRR_2 | PF07723.2 | 6 | Leucine Rich Repeat |
| p450 | PF00067.11 | −105 | Cytochrome P450 |

TABLE 17-continued

| Pfam domain name | accession number | gathering cutoff | domain description |
|---|---|---|---|
| WD40 | PF00400.20 | 21.5 | WD domain, G-beta repeat |
| WD40 | PF00400.20 | 21.5 | WD domain, G-beta repeat |
| WD40 | PF00400.20 | 21.5 | WD domain, G-beta repeat |
| LRR_1 | PF00560.21 | 7.7 | Leucine Rich Repeat |
| LRR_1 | PF00560.21 | 7.7 | Leucine Rich Repeat |
| LRR_1 | PF00560.21 | 7.7 | Leucine Rich Repeat |
| LRR_1 | PF00560.21 | 7.7 | Leucine Rich Repeat |
| LRR_1 | PF00560.21 | 7.7 | Leucine Rich Repeat |
| Pkinase | PF00069.14 | −70.8 | Protein kinase domain |
| C2 | PF00168.18 | 3.7 | C2 domain |
| SBP56 | PF05694.1 | 25 | 56 kDa selenium binding protein (SBP56) |
| IMPDH | PF00478.13 | −190.6 | IMP dehydrogenase/GMP reductase domain |
| MtN3_slv | PF03083.5 | −0.8 | MtN3/saliva family |
| MtN3_slv | PF03083.5 | −0.8 | MtN3/saliva family |
| Aminotran_3 | PF00202.10 | −207.6 | Aminotransferase class-III |
| Aminotran_1_2 | PF00155.10 | −57.5 | Aminotransferase class I and II |
| Aminotran_3 | PF00202.10 | −207.6 | Aminotransferase class-III |
| Aminotran_1_2 | PF00155.10 | −57.5 | Aminotransferase class I and II |
| Pkinase | PF00069.14 | −70.8 | Protein kinase domain |
| Pkinase | PF00069.14 | −70.8 | Protein kinase domain |
| Pkinase | PF00069.14 | −70.8 | Protein kinase domain |
| Pkinase_Tyr | PF07714.5 | 65 | Protein tyrosine kinase |
| Pkinase | PF00069.14 | −70.8 | Protein kinase domain |
| NAF | PF03822.4 | 4.5 | NAF domain |
| Pkinase | PF00069.14 | −70.8 | Protein kinase domain |
| Pkinase | PF00069.14 | −70.8 | Protein kinase domain |
| Nodulin-like | PF06813.3 | −57.8 | Nodulin-like |
| Glyco_hydro_14 | PF01373.7 | −231.4 | Glycosyl hydrolase family 14 |
| GSHPx | PF00255.10 | −16 | Glutathione peroxidase |
| MFS_1 | PF07690.5 | 23.5 | Major Facilitator Superfamily |
| Sugar_tr | PF00083.13 | −85 | Sugar (and other) transporter |
| PGK | PF00162.9 | −39.9 | Phosphoglycerate kinase |
| PGK | PF00162.9 | −39.9 | Phosphoglycerate kinase |
| Pyr_redox | PF00070.17 | 5 | Pyridine nucleotide-disulphide oxidoreductase |
| Pyr_redox_2 | PF07992.3 | −20 | Pyridine nucleotide-disulphide oxidoreductase |
| zf-C3HC4 | PF00097.13 | 16.9 | Zinc finger, C3HC4 type (RING finger) |
| MIP | PF00230.9 | −62 | Major intrinsic protein |
| Tim17 | PF02466.8 | 2.7 | Tim17/Tim22/Tim23 family |
| HABP4_PAI-RBP1 | PF04774.4 | 17.1 | Hyaluronan/mRNA binding family |
| DUF1677 | PF07911.4 | 25 | Protein of unknown function (DUF1677) |
| NIR_SIR_ferr | PF03460.6 | 2.4 | Nitrite/Sulfite reductase ferredoxin-like half domain |
| NIR_SIR | PF01077.11 | −25 | Nitrite and sulphite reductase 4Fe—4S domain |
| NIR_SIR_ferr | PF03460.6 | 2.4 | Nitrite/Sulfite reductase ferredoxin-like half domain |
| NIR_SIR | PF01077.11 | −25 | Nitrite and sulphite reductase 4Fe—4S domain |
| TIM | PF00121.8 | −97 | Triosephosphate isomerase |
| DnaJ | PF00226.19 | −8 | DnaJ domain |
| Fer4 | PF00037.15 | 9.3 | 4Fe—4S binding domain |
| Pro_isomerase | PF00160.10 | −37 | Cyclophilin type peptidyl-prolyl cis-trans isomerase/CLD |
| Pec_lyase_C | PF00544.8 | −45 | Pectate lyase |
| CS | PF04969.5 | 8.6 | CS domain |
| Glyoxal_oxid_N | PF07250.1 | 25 | Glyoxal oxidase N-terminus |
| YjeF_N | PF03853.4 | 25 | YjeF-related protein N-terminus |
| Carb_kinase | PF01256.7 | −66.3 | Carbohydrate kinase |
| TPR_1 | PF00515.16 | 7.7 | Tetratricopeptide repeat |
| TPR_1 | PF00515.16 | 7.7 | Tetratricopeptide repeat |
| TPR_1 | PF00515.16 | 7.7 | Tetratricopeptide repeat |
| DUF1644 | PF07800.2 | 25 | Protein of unknown function (DUF1644) |
| TMEM14 | PF03647.3 | −1 | Transmembrane proteins 14C |
| Aldo_ket_red | PF00248.10 | −97 | Aldo/keto reductase family |
| Pkinase | PF00069.14 | −70.8 | Protein kinase domain |
| BCNT | PF07572.2 | 25 | Bucentaur or craniofacial development |
| Mito_carr | PF00153.15 | 0 | Mitochondrial carrier protein |
| Mito_carr | PF00153.15 | 0 | Mitochondrial carrier protein |
| Mito_carr | PF00153.15 | 0 | Mitochondrial carrier protein |
| NUDIX | PF00293.17 | 0 | NUDIX domain |
| PRA-CH | PF01502.9 | 25 | Phosphoribosyl-AMP cyclohydrolase |
| PRA-PH | PF01503.8 | 6 | Phosphoribosyl-ATP pyrophosphohydrolase |
| Pkinase | PF00069.14 | −70.8 | Protein kinase domain |
| Pkinase_Tyr | PF07714.5 | 65 | Protein tyrosine kinase |
| zf-CCCH | PF00642.14 | 0 | Zinc finger C-x8-C-x5-C-x3-H type (and similar) |
| WD40 | PF00400.20 | 21.5 | WD domain, G-beta repeat |
| WD40 | PF00400.20 | 21.5 | WD domain, G-beta repeat |
| WD40 | PF00400.20 | 21.5 | WD domain, G-beta repeat |

TABLE 17-continued

| Pfam domain name | accession number | gathering cutoff | domain description |
|---|---|---|---|
| CK_II_beta | PF01214.9 | −106 | Casein kinase II regulatory subunit |
| MFS_1 | PF07690.5 | 23.5 | Major Facilitator Superfamily |
| Yip1 | PF04893.6 | −6.4 | Yip1 domain |
| ARID | PF01388.11 | −8 | ARID/BRIGHT DNA binding domain |
| ELM2 | PF01448.12 | 12 | ELM2 domain |
| Myb_DNA-binding | PF00249.19 | 2.8 | Myb-like DNA-binding domain |
| PP2C | PF00481.11 | −44 | Protein phosphatase 2C |
| MatE | PF01554.8 | 59.6 | MatE |
| MatE | PF01554.8 | 59.6 | MatE |
| Methyltransf_11 | PF08241.1 | 17.1 | Methyltransferase domain |
| Methyltransf_12 | PF08242.1 | 21.4 | Methyltransferase domain |
| FMO-like | PF00743.9 | −381.6 | Flavin-binding monooxygenase-like |
| DAO | PF01266.12 | −35.9 | FAD dependent oxidoreductase |
| Pyr_redox_2 | PF07992.3 | −20 | Pyridine nucleotide-disulphide oxidoreductase |
| Auxin_inducible | PF02519.4 | −15 | Auxin responsive protein |
| Response_reg | PF00072.12 | 4 | Response regulator receiver domain |
| CCT | PF06203.4 | 25 | CCT motif |
| Pkinase | PF00069.14 | −70.8 | Protein kinase domain |
| Pkinase | PF00069.14 | −70.8 | Protein kinase domain |
| Pkinase_Tyr | PF07714.5 | 65 | Protein tyrosine kinase |
| RRM_1 | PF00076.11 | 20.7 | RNA recognition motif. (a.k.a. RRM, RBD, or RNP domain) |
| RRM_1 | PF00076.11 | 20.7 | RNA recognition motif. (a.k.a. RRM, RBD, or RNP domain) |
| RRM_1 | PF00076.11 | 20.7 | RNA recognition motif. (a.k.a. RRM, RBD, or RNP domain) |
| RRM_1 | PF00076.11 | 20.7 | RNA recognition motif. (a.k.a. RRM, RBD, or RNP domain) |
| PABP | PF00658.8 | 25 | Poly-adenylate binding protein, unique domain |
| p450 | PF00067.11 | −105 | Cytochrome P450 |
| Aa_trans | PF01490.7 | −128.4 | Transmembrane amino acid transporter protein |
| F-box | PF00646.21 | 13.6 | F-box domain |
| LRR_2 | PF07723.2 | 6 | Leucine Rich Repeat |
| LRR_2 | PF07723.2 | 6 | Leucine Rich Repeat |
| FHA | PF00498.14 | 25 | FHA domain |
| Bromodomain | PF00439.14 | 8.9 | Bromodomain |
| PHD | PF00628.17 | 25.9 | PHD-finger |
| SET | PF00856.17 | 23.5 | SET domain |
| Abhydrolase_1 | PF00561.10 | 10.3 | alpha/beta hydrolase fold |
| Epimerase | PF01370.11 | −46.3 | NAD dependent epimerase/dehydratase family |
| 3Beta_HSD | PF01073.8 | −135.9 | 3-beta hydroxysteroid dehydrogenase/isomerase family |
| DUF231 | PF03005.5 | −58 | *Arabidopsis* proteins of unknown function |
| ABC_tran | PF00005.15 | 9.5 | ABC transporter |
| ABC2_membrane | PF01061.12 | −17.9 | ABC-2 type transporter |
| Dehydrin | PF00257.9 | −4.4 | Dehydrin |
| DnaJ | PF00226.19 | −8 | DnaJ domain |
| DnaJ_C | PF01556.9 | −24 | DnaJ C terminal region |
| Ank | PF00023.18 | 0 | Ankyrin repeat |
| Ank | PF00023.18 | 0 | Ankyrin repeat |
| RCC1 | PF00415.8 | 19 | Regulator of chromosome condensation (RCC1) |
| RCC1 | PF00415.8 | 19 | Regulator of chromosome condensation (RCC1) |
| Pkinase | PF00069.14 | −70.8 | Protein kinase domain |
| Lung_7-TM_R | PF06814.3 | 25 | Lung seven transmembrane receptor |
| Pkinase_Tyr | PF07714.5 | 65 | Protein tyrosine kinase |
| Pkinase | PF00069.14 | −70.8 | Protein kinase domain |
| Aa_trans | PF01490.7 | −128.4 | Transmembrane amino acid transporter protein |
| PCI | PF01399.15 | 25 | PCI domain |
| ADH_N | PF08240.2 | −14.5 | Alcohol dehydrogenase GroES-like domain |
| ADH_zinc_N | PF00107.16 | 23.8 | Zinc-binding dehydrogenase |
| p450 | PF00067.11 | −105 | Cytochrome P450 |
| FKBP_C | PF00254.17 | −7.6 | FKBP-type peptidyl-prolyl cis-trans isomerase |
| WD40 | PF00400.20 | 21.5 | WD domain, G-beta repeat |
| Lectin_C | PF00059.10 | −10.4 | Lectin C-type domain |
| Pkinase | PF00069.14 | −70.8 | Protein kinase domain |
| Pkinase_Tyr | PF07714.5 | 65 | Protein tyrosine kinase |
| HEAT | PF02985.10 | 9.9 | HEAT repeat |
| HEAT | PF02985.10 | 9.9 | HEAT repeat |
| zf-CCCH | PF00642.14 | 0 | Zinc finger C-x8-C-x5-C-x3-H type (and similar) |

TABLE 17-continued

| Pfam domain name | accession number | gathering cutoff | domain description |
|---|---|---|---|
| zf-CCCH | PF00642.14 | 0 | Zinc finger C-x8-C-x5-C-x3-H type (and similar) |
| zf-CCCH | PF00642.14 | 0 | Zinc finger C-x8-C-x5-C-x3-H type (and similar) |
| zf-CCCH | PF00642.14 | 0 | Zinc finger C-x8-C-x5-C-x3-H type (and similar) |
| PHD | PF00628.17 | 25.9 | PHD-finger |
| SEP | PF08059.2 | 25 | SEP domain |
| UBX | PF00789.10 | 10 | UBX domain |
| AA_permease | PF00324.10 | −120.8 | Amino acid permease |
| Pkinase_Tyr | PF07714.5 | 65 | Protein tyrosine kinase |
| Pkinase | PF00069.14 | −70.8 | Protein kinase domain |
| FAD_binding_4 | PF01565.12 | −8.1 | FAD binding domain |
| PALP | PF00291.14 | −70 | Pyridoxal-phosphate dependent enzyme |
| GIDA | PF01134.11 | −226.7 | Glucose inhibited division protein A |
| Pyr_redox_2 | PF07992.3 | −20 | Pyridine nucleotide-disulphide oxidoreductase |
| Pyr_redox | PF00070.17 | 5 | Pyridine nucleotide-disulphide oxidoreductase |
| Pyr_redox_dim | PF02852.12 | −13 | Pyridine nucleotide-disulphide oxidoreductase, dimerisation domain |
| YGGT | PF02325.7 | 0 | YGGT family |
| Aldedh | PF00171.11 | −209.3 | Aldehyde dehydrogenase family |
| PEPCK_ATP | PF01293.10 | −327 | Phosphoenolpyruvate carboxykinase |
| Trp_syntA | PF00290.11 | −149.8 | Tryptophan synthase alpha chain |
| DapB_N | PF01113.10 | −20.7 | Dihydrodipicolinate reductase, N-terminus |
| DapB_C | PF05173.3 | 0.5 | Dihydrodipicolinate reductase, C-terminus |
| Ribul_P_3_epim | PF00834.8 | −97.3 | Ribulose-phosphate 3 epimerase family |
| OMPdecase | PF00215.13 | −47.3 | Orotidine 5'-phosphate decarboxylase/HUMPS family |
| Arginase | PF00491.11 | −120 | Arginase family |
| Pkinase | PF00069.14 | −70.8 | Protein kinase domain |
| Ferric_reduct | PF01794.8 | −7 | Ferric reductase like transmembrane component |
| Lipase_3 | PF01764.14 | −8 | Lipase (class 3) |
| Auxin_inducible | PF02519.4 | −15 | Auxin responsive protein |
| TPR_2 | PF07719.5 | 20.1 | Tetratricopeptide repeat |
| TPR_1 | PF00515.16 | 7.7 | Tetratricopeptide repeat |
| TPR_2 | PF07719.5 | 20.1 | Tetratricopeptide repeat |
| TPR_1 | PF00515.16 | 7.7 | Tetratricopeptide repeat |
| TPR_1 | PF00515.16 | 7.7 | Tetratricopeptide repeat |
| TPR_2 | PF07719.5 | 20.1 | Tetratricopeptide repeat |
| TPR_1 | PF00515.16 | 7.7 | Tetratricopeptide repeat |
| Anti-silence | PF04729.4 | 25 | Anti-silencing protein, ASF1-like |
| p450 | PF00067.11 | −105 | Cytochrome P450 |
| Pkinase | PF00069.14 | −70.8 | Protein kinase domain |
| Pkinase_Tyr | PF07714.5 | 65 | Protein tyrosine kinase |
| TCTP | PF00838.7 | −70.7 | Translationally controlled tumour protein |
| NAPRTase | PF04095.5 | −88.5 | Nicotinate phosphoribosyltransferase (NAPRTase) family |
| SPX | PF03105.9 | −20 | SPX domain |
| EXS | PF03124.4 | 20 | EXS family |
| DUF1639 | PF07797.3 | 25 | Protein of unknown function (DUF1639) |
| Mlo | PF03094.5 | −263 | Mlo family |
| Sulfotransfer_1 | PF00685.16 | −53.1 | Sulfotransferase domain |
| PI-PLC-X | PF00388.8 | 18.8 | Phosphatidylinositol-specific phospholipase C, X domain |
| PI-PLC-Y | PF00387.8 | −11 | Phosphatidylinositol-specific phospholipase C, Y domain |
| C2 | PF00168.18 | 3.7 | C2 domain |
| HMA | PF00403.14 | 17.4 | Heavy-metal-associated domain |
| Ammonium_transp | PF00909.10 | −144 | Ammonium Transporter Family |
| Asp | PF00026.13 | −186.1 | Eukaryotic aspartyl protease |
| SapB_2 | PF03489.6 | 10.7 | Saposin-like type B, region 2 |
| SapB_1 | PF05184.4 | 3 | Saposin-like type B, region 1 |
| Oxidored_FMN | PF00724.9 | −147.7 | NADH: flavin oxidoreductase/NADH oxidase family |
| Pyr_redox | PF00070.17 | 5 | Pyridine nucleotide-disulphide oxidoreductase |
| Pyr_redox_2 | PF07992.3 | −20 | Pyridine nucleotide-disulphide oxidoreductase |
| Pkinase | PF00069.14 | −70.8 | Protein kinase domain |
| Miro | PF08477.1 | 28 | Miro-like protein |
| Ras | PF00071.11 | −69.9 | Ras family |
| Miro | PF08477.1 | 28 | Miro-like protein |
| Ras | PF00071.11 | −69.9 | Ras family |
| Pkinase_Tyr | PF07714.5 | 65 | Protein tyrosine kinase |
| Pkinase | PF00069.14 | −70.8 | Protein kinase domain |
| Sterol_desat | PF01598.7 | −13 | Sterol desaturase |

TABLE 17-continued

| Pfam domain name | accession number | gathering cutoff | domain description |
|---|---|---|---|
| ADH_N | PF08240.2 | −14.5 | Alcohol dehydrogenase GroES-like domain |
| ADH_zinc_N | PF00107.16 | 23.8 | Zinc-binding dehydrogenase |
| Sulfotransfer_1 | PF00685.16 | −53.1 | Sulfotransferase domain |
| TPR_1 | PF00515.16 | 7.7 | Tetratricopeptide repeat |
| TPR_2 | PF07719.5 | 20.1 | Tetratricopeptide repeat |
| TPR_1 | PF00515.16 | 7.7 | Tetratricopeptide repeat |
| TPR_2 | PF07719.5 | 20.1 | Tetratricopeptide repeat |
| TPR_1 | PF00515.16 | 7.7 | Tetratricopeptide repeat |
| GATase_2 | PF00310.10 | −106.2 | Glutamine amidotransferases class-II |
| SIS | PF01380.11 | 0 | SIS domain |
| SIS | PF01380.11 | 0 | SIS domain |
| Acetyltransf_1 | PF00583.13 | 18.6 | Acetyltransferase (GNAT) family |
| DUF1005 | PF06219.2 | 25 | Protein of unknown function (DUF1005) |
| DUF231 | PF03005.5 | −58 | *Arabidopsis* proteins of unknown function |
| TB2_DP1_HVA22 | PF03134.9 | −25.1 | TB2/DP1, HVA22 family |
| Di19 | PF05605.2 | 25 | Drought induced 19 protein (Di19) |
| MtN3_slv | PF03083.5 | −0.8 | MtN3/saliva family |
| MtN3_slv | PF03083.5 | −0.8 | MtN3/saliva family |
| Pkinase | PF00069.14 | −70.8 | Protein kinase domain |
| p450 | PF00067.11 | −105 | Cytochrome P450 |
| PGI | PF00342.8 | −168.9 | Phosphoglucose isomerase |
| Glyco_hydro_28 | PF00295.7 | −97 | Glycosyl hydrolases family 28 |
| Pkinase | PF00069.14 | −70.8 | Protein kinase domain |
| Isoamylase_N | PF02922.7 | −6.5 | Isoamylase N-terminal domain |
| Alpha-amylase | PF00128.12 | −93 | Alpha amylase, catalytic domain |
| PBP | PF01161.9 | −20.6 | Phosphatidylethanolamine-binding protein |
| zf-CCCH | PF00642.14 | 0 | Zinc finger C-x8-C-x5-C-x3-H type (and similar) |
| zf-CCCH | PF00642.14 | 0 | Zinc finger C-x8-C-x5-C-x3-H type (and similar) |
| zf-CCCH | PF00642.14 | 0 | Zinc finger C-x8-C-x5-C-x3-H type (and similar) |
| Aa_trans | PF01490.7 | −128.4 | Transmembrane amino acid transporter protein |
| Smr | PF01713.11 | 10 | Smr domain |
| 2-Hacid_dh | PF00389.19 | 11.2 | D-isomer specific 2-hydroxyacid dehydrogenase, catalytic domain |
| 2-Hacid_dh_C | PF02826.7 | −82.2 | D-isomer specific 2-hydroxyacid dehydrogenase, NAD binding domain |
| DUF1070 | PF06376.2 | 25 | Protein of unknown function (DUF1070) |
| AMP-binding | PF00501.16 | 0 | AMP-binding enzyme |
| Enolase_N | PF03952.6 | −3.3 | Enolase, N-terminal domain |
| Enolase_C | PF00113.12 | −34 | Enolase, C-terminal TIM barrel domain |
| FAE_3-kCoA_syn1 | PF07168.2 | 25 | Fatty acid elongase 3-ketoacyl-CoA synthase 1 |
| efhand | PF00036.20 | 17.5 | EF hand |
| Na_Ca_ex | PF01699.12 | 25 | Sodium/calcium exchanger protein |
| NOP5NT | PF08156.2 | 25 | NOP5NT (NUC127) domain |
| NOSIC | PF08060.2 | 25 | NOSIC (NUC001) domain |
| Nop | PF01798.6 | 25 | Putative snoRNA binding domain |
| Terpene_synth | PF01397.10 | −86 | Terpene synthase, N-terminal domain |
| PCI | PF01399.15 | 25 | PCI domain |
| Abhydrolase_3 | PF07859.2 | 25.8 | alpha/beta hydrolase fold |
| GRP | PF07172.1 | 16.8 | Glycine rich protein family |
| DUF914 | PF06027.2 | −193 | Eukaryotic protein of unknown function (DUF914) |
| DUF1325 | PF07039.1 | 25 | Protein of unknown function (DUF1325) |
| zf-A20 | PF01754.6 | 25 | A20-like zinc finger |
| zf-AN1 | PF01428.6 | 0 | AN1-like Zinc finger |
| PALP | PF00291.14 | −70 | Pyridoxal-phosphate dependent enzyme |
| MFS_1 | PF07690.5 | 23.5 | Major Facilitator Superfamily |
| DUF1723 | PF08330.1 | 17 | Protein of unknown function (DUF1723) |
| GDPD | PF03009.7 | −18 | Glycerophosphoryl diester phosphodiesterase family |
| Pkinase | PF00069.14 | −70.8 | Protein kinase domain |
| Pkinase_Tyr | PF07714.5 | 65 | Protein tyrosine kinase |
| Pkinase | PF00069.14 | −70.8 | Protein kinase domain |
| ADH_N | PF08240.2 | −14.5 | Alcohol dehydrogenase GroES-like domain |
| ADH_zinc_N | PF00107.16 | 23.8 | Zinc-binding dehydrogenase |
| Pribosyltran | PF00156.15 | 2 | Phosphoribosyl transferase domain |
| Aldedh | PF00171.11 | −209.3 | Aldehyde dehydrogenase family |
| BRAP2 | PF07576.1 | 25 | BRCA1-associated protein 2 |
| zf-C3HC4 | PF00097.13 | 16.9 | Zinc finger, C3HC4 type (RING finger) |
| zf-UBP | PF02148.8 | 25 | Zn-finger in ubiquitin-hydrolases and other protein |
| DnaJ | PF00226.19 | −8 | DnaJ domain |
| HSCB_C | PF07743.4 | −7 | HSCB C-terminal oligomerisation domain |
| ABC_tran | PF00005.15 | 9.5 | ABC transporter |

TABLE 17-continued

| Pfam domain name | accession number | gathering cutoff | domain description |
|---|---|---|---|
| Acyl-CoA_dh_N | PF02771.7 | 10.9 | Acyl-CoA dehydrogenase, N-terminal domain |
| Acyl-CoA_dh_M | PF02770.9 | 25 | Acyl-CoA dehydrogenase, middle domain |
| Acyl-CoA_dh_1 | PF00441.13 | −15.6 | Acyl-CoA dehydrogenase, C-terminal domain |
| Acyl-CoA_dh_2 | PF08028.1 | −16.9 | Acyl-CoA dehydrogenase, C-terminal domain |
| NTP_transferase | PF00483.12 | −90.5 | Nucleotidyl transferase |
| MannoseP_isomer | PF01050.8 | −70 | Mannose-6-phosphate isomerase |
| Cupin_2 | PF07883.1 | 16.6 | Cupin domain |
| Lectin_legB | PF00139.10 | −110.1 | Legume lectin domain |
| Pkinase | PF00069.14 | −70.8 | Protein kinase domain |
| Pkinase_Tyr | PF07714.5 | 65 | Protein tyrosine kinase |
| Pkinase_Tyr | PF07714.5 | 65 | Protein tyrosine kinase |
| Pkinase | PF00069.14 | −70.8 | Protein kinase domain |
| PGAM | PF00300.12 | −3 | Phosphoglycerate mutase family |
| WD40 | PF00400.20 | 21.5 | WD domain, G-beta repeat |
| Alpha-amylase | PF00128.12 | −93 | Alpha amylase, catalytic domain |
| PTPA | PF03095.4 | −106 | Phosphotyrosyl phosphate activator (PTPA) protein |
| Sedlin_N | PF04628.2 | 25 | Sedlin, N-terminal conserved region |
| NAD_binding_2 | PF03446.4 | −63.5 | NAD binding domain of 6-phosphogluconate dehydrogenase |
| 6PGD | PF00393.8 | −232.3 | 6-phosphogluconate dehydrogenase, C-terminal domain |
| ADK | PF00406.11 | 24.2 | Adenylate kinase |
| ADK_lid | PF05191.3 | 25 | Adenylate kinase, active site lid |
| DUF26 | PF01657.7 | 0 | Domain of unknown function DUF26 |
| DUF26 | PF01657.7 | 0 | Domain of unknown function DUF26 |
| Pkinase_Tyr | PF07714.5 | 65 | Protein tyrosine kinase |
| Pkinase | PF00069.14 | −70.8 | Protein kinase domain |
| mTERF | PF02536.4 | −60 | mTERF |
| B56 | PF01603.9 | −210 | Protein phosphatase 2A regulatory B subunit (B56 family) |
| zf-AN1 | PF01428.6 | 0 | AN1-like Zinc finger |
| Xan_ur_permease | PF00860.10 | −151.2 | Permease family |
| MFS_1 | PF07690.5 | 23.5 | Major Facilitator Superfamily |
| Auxin_inducible | PF02519.4 | −15 | Auxin responsive protein |
| Trehalose_PPase | PF02358.6 | −49.4 | Trehalose-phosphatase |
| DUF260 | PF03195.4 | 0.8 | Protein of unknown function DUF260 |
| Aminotran_1_2 | PF00155.10 | −57.5 | Aminotransferase class I and II |
| Pkinase | PF00069.14 | −70.8 | Protein kinase domain |
| Pkinase_Tyr | PF07714.5 | 65 | Protein tyrosine kinase |
| Pkinase | PF00069.14 | −70.8 | Protein kinase domain |
| Pkinase_Tyr | PF07714.5 | 65 | Protein tyrosine kinase |
| ADH_N | PF08240.2 | −14.5 | Alcohol dehydrogenase GroES-like domain |
| ADH_zinc_N | PF00107.16 | 23.8 | Zinc-binding dehydrogenase |
| RRM_1 | PF00076.11 | 20.7 | RNA recognition motif. (a.k.a. RRM, RBD, or RNP domain) |
| RRM_1 | PF00076.11 | 20.7 | RNA recognition motif. (a.k.a. RRM, RBD, or RNP domain) |
| La | PF05383.5 | 25 | La domain |
| RRM_1 | PF00076.11 | 20.7 | RNA recognition motif. (a.k.a. RRM, RBD, or RNP domain) |
| RRM_1 | PF00076.11 | 20.7 | RNA recognition motif. (a.k.a. RRM, RBD, or RNP domain) |
| RRM_1 | PF00076.11 | 20.7 | RNA recognition motif. (a.k.a. RRM, RBD, or RNP domain) |
| RRM_1 | PF00076.11 | 20.7 | RNA recognition motif. (a.k.a. RRM, RBD, or RNP domain) |
| LEA_2 | PF03168.3 | 25 | Late embryogenesis abundant protein |
| Miro | PF08477.1 | 28 | Miro-like protein |
| Ras | PF00071.11 | −69.9 | Ras family |
| DUF241 | PF03087.4 | −53.6 | Arabidopsis protein of unknown function |
| Sugar_tr | PF00083.13 | −85 | Sugar (and other) transporter |
| MFS_1 | PF07690.5 | 23.5 | Major Facilitator Superfamily |
| Ion_trans_2 | PF07885.4 | 24.9 | Ion channel |
| Ion_trans_2 | PF07885.4 | 24.9 | Ion channel |
| PI-PLC-X | PF00388.8 | 18.8 | Phosphatidylinositol-specific phospholipase C, X domain |
| C2 | PF00168.18 | 3.7 | C2 domain |
| Aldedh | PF00171.11 | −209.3 | Aldehyde dehydrogenase family |
| RNA_pol_Rpb8 | PF03870.5 | −31.2 | RNA polymerase Rpb8 |
| COX5C | PF05799.1 | 25 | Cytochrome c oxidase subunit Vc (COX5C) |
| Ion_trans_2 | PF07885.4 | 24.9 | Ion channel |
| Ion_trans_2 | PF07885.4 | 24.9 | Ion channel |
| Aldo_ket_red | PF00248.10 | −97 | Aldo/keto reductase family |
| Pkinase | PF00069.14 | −70.8 | Protein kinase domain |
| Pkinase_Tyr | PF07714.5 | 65 | Protein tyrosine kinase |
| Na_Ca_ex | PF01699.12 | 25 | Sodium/calcium exchanger protein |

TABLE 17-continued

| Pfam domain name | accession number | gathering cutoff | domain description |
|---|---|---|---|
| Na_Ca_ex | PF01699.12 | 25 | Sodium/calcium exchanger protein |
| Pkinase | PF00069.14 | −70.8 | Protein kinase domain |
| ADH_N | PF08240.2 | −14.5 | Alcohol dehydrogenase GroES-like domain |
| ADH_zinc_N | PF00107.16 | 23.8 | Zinc-binding dehydrogenase |
| OPT | PF03169.6 | −238.6 | OPT oligopeptide transporter protein |
| PMEI | PF04043.5 | 25 | Plant invertase/pectin methylesterase inhibitor |
| K_trans | PF02705.6 | −482 | K+ potassium transporter |
| Pkinase | PF00069.14 | −70.8 | Protein kinase domain |
| CH | PF00307.19 | 22.5 | Calponin homology (CH) domain |
| EB1 | PF03271.6 | 25 | EB1-like C-terminal motif |
| Carboxyl_trans | PF01039.11 | −262.3 | Carboxyl transferase domain |
| CoA_trans | PF01144.12 | 25 | Coenzyme A transferase |
| Pkinase | PF00069.14 | −70.8 | Protein kinase domain |
| CS | PF04969.5 | 8.6 | CS domain |
| SGS | PF05002.5 | 5.2 | SGS domain |
| NPH3 | PF03000.4 | 25 | NPH3 family |
| WD40 | PF00400.20 | 21.5 | WD domain, G-beta repeat |
| Spermine_synth | PF01564.6 | −93.8 | Spermine/spermidine synthase |
| FeThRed_A | PF02941.5 | 25 | Ferredoxin thioredoxin reductase variable alpha chain |
| Alpha-amylase | PF00128.12 | −93 | Alpha amylase, catalytic domain |
| Cyclin_N | PF00134.13 | −14.7 | Cyclin, N-terminal domain |
| Cyclin_C | PF02984.8 | −13 | Cyclin, C-terminal domain |
| F-box | PF00646.21 | 13.6 | F-box domain |
| F-box | PF00646.21 | 13.6 | F-box domain |
| Arm | PF00514.11 | 17 | Armadillo/beta-catenin-like repeat |
| Arm | PF00514.11 | 17 | Armadillo/beta-catenin-like repeat |
| Arm | PF00514.11 | 17 | Armadillo/beta-catenin-like repeat |
| Arm | PF00514.11 | 17 | Armadillo/beta-catenin-like repeat |
| Arm | PF00514.11 | 17 | Armadillo/beta-catenin-like repeat |
| Arm | PF00514.11 | 17 | Armadillo/beta-catenin-like repeat |
| Arm | PF00514.11 | 17 | Armadillo/beta-catenin-like repeat |
| Arm | PF00514.11 | 17 | Armadillo/beta-catenin-like repeat |
| MIP | PF00230.9 | −62 | Major intrinsic protein |
| LRRNT_2 | PF08263.2 | 18.6 | Leucine rich repeat N-terminal domain |
| LRR_1 | PF00560.21 | 7.7 | Leucine Rich Repeat |
| LRR_1 | PF00560.21 | 7.7 | Leucine Rich Repeat |
| LRR_1 | PF00560.21 | 7.7 | Leucine Rich Repeat |
| Pkinase_Tyr | PF07714.5 | 65 | Protein tyrosine kinase |
| Pkinase | PF00069.14 | −70.8 | Protein kinase domain |
| WD40 | PF00400.20 | 21.5 | WD domain, G-beta repeat |
| Glycolytic | PF00274.9 | −174.5 | Fructose-bisphosphate aldolase class-I |
| PSI_PsaF | PF02507.5 | 25 | Photosystem I reaction centre subunit III |
| LRRNT_2 | PF08263.2 | 18.6 | Leucine rich repeat N-terminal domain |
| LRR_1 | PF00560.21 | 7.7 | Leucine Rich Repeat |
| LRR_1 | PF00560.21 | 7.7 | Leucine Rich Repeat |
| LRR_1 | PF00560.21 | 7.7 | Leucine Rich Repeat |
| LRR_1 | PF00560.21 | 7.7 | Leucine Rich Repeat |
| C2 | PF00168.18 | 3.7 | C2 domain |
| p450 | PF00067.11 | −105 | Cytochrome P450 |
| FH2 | PF02181.13 | −98.3 | Formin Homology 2 Domain |
| U-box | PF04564.5 | 10.5 | U-box domain |
| FAE1_CUT1_RppA | PF08392.1 | −192.7 | FAE1/Type III polyketide synthase-like protein |
| Chal_sti_synt_C | PF02797.5 | −6.1 | Chalcone and stilbene synthases, C-terminal domain |
| ACP_syn_III_C | PF08541.1 | −24.4 | 3-Oxoacyl-[acyl-carrier-protein (ACP)] synthase III C terminal |
| aPHC | PF05875.2 | 25 | Alkaline phytoceramidase (aPHC) |
| Pkinase | PF00069.14 | −70.8 | Protein kinase domain |
| Pkinase | PF00069.14 | −70.8 | Protein kinase domain |
| Pkinase_Tyr | PF07714.5 | 65 | Protein tyrosine kinase |
| Glyco_hydro_14 | PF01373.7 | −231.4 | Glycosyl hydrolase family 14 |
| Miro | PF08477.1 | 28 | Miro-like protein |
| Ras | PF00071.11 | −69.9 | Ras family |
| PGM_PMM_I | PF02878.5 | −37.5 | Phosphoglucomutase/phosphomannomutase, alpha/beta/alpha domain I |
| PGM_PMM_II | PF02879.5 | −20 | Phosphoglucomutase/phosphomannomutase, alpha/beta/alpha domain II |
| PGM_PMM_III | PF02880.5 | −7.8 | Phosphoglucomutase/phosphomannomutase, alpha/beta/alpha domain III |
| PGM_PMM_IV | PF00408.9 | −6 | Phosphoglucomutase/phosphomannomutase, C-terminal domain |
| Glutaminase | PF04960.5 | −143.6 | Glutaminase |
| Aldedh | PF00171.11 | −209.3 | Aldehyde dehydrogenase family |
| Aminotran_3 | PF00202.10 | −207.6 | Aminotransferase class-III |
| 2OG-FeII_Oxy | PF03171.9 | 11.5 | 2OG-Fe(II) oxygenase superfamily |

TABLE 17-continued

| Pfam domain name | accession number | gathering cutoff | domain description |
|---|---|---|---|
| Histone | PF00125.13 | 17.4 | Core histone H2A/H2B/H3/H4 |
| F-box | PF00646.21 | 13.6 | F-box domain |
| Agenet | PF05641.2 | 6.6 | Agenet domain |
| Agenet | PF05641.2 | 6.6 | Agenet domain |
| DnaJ | PF00226.19 | −8 | DnaJ domain |
| SNARE | PF05739.8 | 20.8 | SNARE domain |
| adh_short | PF00106.14 | −17 | short chain dehydrogenase |
| Pyr_redox_2 | PF07992.3 | −20 | Pyridine nucleotide-disulphide oxidoreductase |
| Pyr_redox | PF00070.17 | 5 | Pyridine nucleotide-disulphide oxidoreductase |
| NPH3 | PF03000.4 | 25 | NPH3 family |
| PB1 | PF00564.13 | 12.3 | PB1 domain |
| MIP | PF00230.9 | −62 | Major intrinsic protein |
| F-box | PF00646.21 | 13.6 | F-box domain |
| LRR_2 | PF07723.2 | 6 | Leucine Rich Repeat |
| F-box | PF00646.21 | 13.6 | F-box domain |
| MIP | PF00230.9 | −62 | Major intrinsic protein |
| Methyltransf_6 | PF03737.5 | 25 | Demethylmenaquinone methyltransferase |
| zf-C3HC4 | PF00097.13 | 16.9 | Zinc finger, C3HC4 type (RING finger) |
| RRM_1 | PF00076.11 | 20.7 | RNA recognition motif. (a.k.a. RRM, RBD, or RNP domain) |
| zf-CCHC | PF00098.12 | 17.9 | Zinc knuckle |
| zf-CCHC | PF00098.12 | 17.9 | Zinc knuckle |
| NPH3 | PF03000.4 | 25 | NPH3 family |
| p450 | PF00067.11 | −105 | Cytochrome P450 |
| p450 | PF00067.11 | −105 | Cytochrome P450 |
| DPBB_1 | PF03330.7 | 5.3 | Rare lipoprotein A (RlpA)-like double-psi beta-barrel |
| Pollen_allerg_1 | PF01357.10 | 17.2 | Pollen allergen |
| p450 | PF00067.11 | −105 | Cytochrome P450 |
| p450 | PF00067.11 | −105 | Cytochrome P450 |
| CBS | PF00571.16 | 17.5 | CBS domain pair |
| CBS | PF00571.16 | 17.5 | CBS domain pair |
| Cys_Met_Meta_PP | PF01053.9 | −278.4 | Cys/Met metabolism PLP-dependent enzyme |
| Beta_elim_lyase | PF01212.10 | −114.4 | Beta-eliminating lyase |
| Aldedh | PF00171.11 | −209.3 | Aldehyde dehydrogenase family |
| PK | PF00224.10 | −244 | Pyruvate kinase, barrel domain |
| PK_C | PF02887.5 | −44 | Pyruvate kinase, alpha/beta domain |
| PEP-utilizers | PF00391.12 | 10 | PEP-utilising enzyme, mobile domain |
| iPGM_N | PF06415.3 | −263.4 | BPG-independent PGAM N-terminus (iPGM_N) |
| Metalloenzyme | PF01676.7 | −14.4 | Metalloenzyme superfamily |
| Molybdop_Fe4S4 | PF04879.5 | 13.6 | Molybdopterin oxidoreductase Fe4S4 domain |
| Molybdopterin | PF00384.11 | −50 | Molybdopterin oxidoreductase |
| Molydop_binding | PF01568.10 | 1.1 | Molydopterin dinucleotide binding domain |
| Aminotran_3 | PF00202.10 | −207.6 | Aminotransferase class-III |
| HMA | PF00403.14 | 17.4 | Heavy-metal-associated domain |
| DAO | PF01266.12 | −35.9 | FAD dependent oxidoreductase |
| Pyr_redox_2 | PF07992.3 | −20 | Pyridine nucleotide-disulphide oxidoreductase |
| Pyr_redox | PF00070.17 | 5 | Pyridine nucleotide-disulphide oxidoreductase |
| Pyr_redox_dim | PF02852.12 | −13 | Pyridine nucleotide-disulphide oxidoreductase, dimerisation domain |
| Aminotran_3 | PF00202.10 | −207.6 | Aminotransferase class-III |
| ADH_N | PF08240.2 | −14.5 | Alcohol dehydrogenase GroES-like domain |
| ADH_zinc_N | PF00107.16 | 23.8 | Zinc-binding dehydrogenase |
| Hist_deacetyl | PF00850.9 | −71 | Histone deacetylase domain |
| zf-A20 | PF01754.6 | 25 | A20-like zinc finger |
| zf-AN1 | PF01428.6 | 0 | AN1-like Zinc finger |
| U-box | PF04564.5 | 10.5 | U-box domain |
| Arm | PF00514.11 | 17 | Armadillo/beta-catenin-like repeat |
| Arm | PF00514.11 | 17 | Armadillo/beta-catenin-like repeat |
| Arm | PF00514.11 | 17 | Armadillo/beta-catenin-like repeat |
| Arm | PF00514.11 | 17 | Armadillo/beta-catenin-like repeat |
| Arm | PF00514.11 | 17 | Armadillo/beta-catenin-like repeat |
| PDT | PF00800.8 | 25 | Prephenate dehydratase |
| ACT | PF01842.13 | 0 | ACT domain |
| PP2C | PF00481.11 | −44 | Protein phosphatase 2C |
| Aminotran_3 | PF00202.10 | −207.6 | Aminotransferase class-III |
| DUF568 | PF04526.3 | 25 | Protein of unknown function (DUF568) |
| PHD | PF00628.17 | 25.9 | PHD-finger |
| TBC | PF00566.8 | −58 | TBC domain |

TABLE 17-continued

| Pfam domain name | accession number | gathering cutoff | domain description |
|---|---|---|---|
| DUF786 | PF05646.3 | −31.3 | Protein of unknown function (DUF786) |
| PLAC8 | PF04749.6 | −1.1 | PLAC8 family |
| IF2_N | PF04760.6 | 25 | Translation initiation factor IF-2, N-terminal region |
| GTP_EFTU | PF00009.15 | 8 | Elongation factor Tu GTP binding domain |
| Ras | PF00071.11 | −69.9 | Ras family |
| GTP_EFTU_D2 | PF03144.14 | 25 | Elongation factor Tu domain 2 |
| PC4 | PF02229.5 | 4 | Transcriptional Coactivator p15 (PC4) |
| DUF588 | PF04535.2 | 25 | Domain of unknown function (DUF588) |
| LisH | PF08513.1 | 20.7 | LisH |
| CDI | PF02234.8 | 17 | Cyclin-dependent kinase inhibitor |
| Glyco_transf_8 | PF01501.9 | −43.2 | Glycosyl transferase family 8 |
| Pkinase | PF00069.14 | −70.8 | Protein kinase domain |
| efhand | PF00036.20 | 17.5 | EF hand |
| efhand | PF00036.20 | 17.5 | EF hand |
| efhand | PF00036.20 | 17.5 | EF hand |
| efhand | PF00036.20 | 17.5 | EF hand |
| WWE | PF02825.9 | 25 | WWE domain |
| FAE1_CUT1_RppA | PF08392.1 | −192.7 | FAE1/Type III polyketide synthase-like protein |
| Chal_sti_synt_C | PF02797.5 | −6.1 | Chalcone and stilbene synthases, C-terminal domain |
| ACP_syn_III_C | PF08541.1 | −24.4 | 3-Oxoacyl-[acyl-carrier-protein (ACP)] synthase III C terminal |
| Hrf1 | PF03878.5 | −81.2 | Hrf1 family |
| Yip1 | PF04893.6 | −6.4 | Yip1 domain |
| Pkinase | PF00069.14 | −70.8 | Protein kinase domain |
| Pkinase_Tyr | PF07714.5 | 65 | Protein tyrosine kinase |
| Pkinase | PF00069.14 | −70.8 | Protein kinase domain |
| ADH_N | PF08240.2 | −14.5 | Alcohol dehydrogenase GroES-like domain |
| ADH_zinc_N | PF00107.16 | 23.8 | Zinc-binding dehydrogenase |
| Miro | PF08477.1 | 28 | Miro-like protein |
| Ras | PF00071.11 | −69.9 | Ras family |
| Miro | PF08477.1 | 28 | Miro-like protein |
| Ras | PF00071.11 | −69.9 | Ras family |
| Sugar_tr | PF00083.13 | −85 | Sugar (and other) transporter |
| MFS_1 | PF07690.5 | 23.5 | Major Facilitator Superfamily |
| RuBisCO_large_N | PF02788.5 | 25 | Ribulose bisphosphate carboxylase large chain, N-terminal domain |
| RuBisCO_large | PF00016.9 | −76 | Ribulose bisphosphate carboxylase large chain, catalytic domain |
| Flavodoxin_1 | PF00258.14 | 6.3 | Flavodoxin |
| FAD_binding_1 | PF00667.9 | −79 | FAD binding domain |
| NAD_binding_1 | PF00175.10 | −3.9 | Oxidoreductase NAD-binding domain |
| Lactamase_B | PF00753.16 | 24.6 | Metallo-beta-lactamase superfamily |
| PGI | PF00342.8 | −168.9 | Phosphoglucose isomerase |
| Peptidase_C12 | PF01088.10 | −91.4 | Ubiquitin carboxyl-terminal hydrolase, family 1 |
| Dicty_CAR | PF05462.2 | −39.7 | Slime mold cyclic AMP receptor |
| Aldedh | PF00171.11 | −209.3 | Aldehyde dehydrogenase family |
| PfkB | PF00294.13 | −67.8 | pfkB family carbohydrate kinase |
| Brix | PF04427.7 | 11.4 | Brix domain |
| MGS | PF02142.11 | 3 | MGS-like domain |
| AICARFT_IMPCHas | PF01808.8 | −98 | AICARFT/IMPCHase bienzyme |
| MFAP1_C | PF06991.1 | 25 | Micro-fibrillar-associated protein 1 C-terminus |
| Nicastrin | PF05450.4 | −85.8 | Nicastrin |
| Ribophorin_I | PF04597.4 | −217 | Ribophorin I |
| DUF662 | PF04949.2 | 25 | Family of unknown function (DUF662) |
| ARD | PF03079.4 | 25 | ARD/ARD' family |
| Cupin_2 | PF07883.1 | 16.6 | Cupin domain |
| HATPase_c | PF02518.14 | 22.4 | Histidine kinase-, DNA gyrase B-, and HSP90-like ATPase |
| Pkinase | PF00069.14 | −70.8 | Protein kinase domain |
| Pkinase_Tyr | PF07714.5 | 65 | Protein tyrosine kinase |
| Pkinase | PF00069.14 | −70.8 | Protein kinase domain |

Example 5 A

This example illustrates the construction of plasmids for transferring recombinant DNA into the nucleus of a plant cell which can be regenerated into a transgenic crop plant of this invention. Primers for PCR amplification of protein coding nucleotides of recombinant DNA are designed at or near the start and stop codons of the coding sequence, in order to eliminate most of the 5' and 3' untranslated regions. DNA of interest, i.e. each DNA identified in Table 1 and the DNA for the identified homologous genes, are cloned and amplified by PCR prior to insertion into the insertion site the base vector.

Elements of an exemplary common expression vector, pMON82060 are illustrated in Table 18. The exemplary base vector which is especially useful for corn transformation is illustrated in FIG. 2 and assembled using technology known in the art. The DNA of interest are inserted in a expression vector at the insertion site between the intron 1 of rice act 1 gene and the termination sequence of PinII gene.

TABLE 18 pMON82060

| function | name | annotation | Coordinates of SEQ ID NO: 33636 |
|---|---|---|---|
| Agro transformation | B-AGRtu.right border | Agro right border sequence, essential for transfer of T-DNA. | 5235-5591 |
| Gene of interest plant expression cassette | P-Os.Act1 | Promoter from the rice actin gene act1. | 5609-7009 |
| | L-Os.Act1 | Leader (first exon) from the rice actin 1 gene. | |
| | I-Os.Act1 | First intron and flanking UTR exon sequences from the rice actin 1 gene | |
| | insertion site | | |
| | T-St.Pis4 | The 3' non-translated region of the potato proteinase inhibitor II gene which functions to direct polyadenylation of the mRNA | 7084-8026 |
| Plant selectable marker expression cassette | P-CaMV.35S | CaMV 35S promoter | 8075-8398 |
| | L-CaMV.35S | 5' UTR from the 35S RNA of CaMV | |
| | CR-Ec.nptII-Tn5 | nptII selectable marker that confers resistance to neomycin and kanamycin | 8432-9226 |
| | T-AGRtu.nos | A 3' non-translated region of the nopaline synthase gene of Agrobacterium tumefaciens Ti plasmid which functions to direct polyadenylation of the mRNA.. | 9255-9507 |
| Agro transformation | B-AGRtu.left border | Agro left border sequence, essential for transfer of T-DNA. | 39-480 |
| Maintenance in E. coli | OR-Ec.oriV-RK2 | The vegetative origin of replication from plasmid RK2. | 567-963 |
| | CR-Ec.rop | Coding region for repressor of primer from the ColE1 plasmid. Expression of this gene product interferes with primer binding at the origin of replication, keeping plasmid copy number low. | 2472-2663 |
| | OR-Ec.ori-ColE1 | The minimal origin of replication from the E. coli plasmid ColE1. | 3091-3679 |
| | P-Ec.aadA-SPC/STR | promoter for Tn7 adenylyltransferase (AAD(3")) | 4210-4251 |
| | CR-Ec.aadA-SPC/STR | Coding region for Tn7 adenylyltransferase (AAD(3")) conferring spectinomycin and streptomycin resistance. | 4252-5040 |
| | T-Ec.aadA-SPC/STR | 3' UTR from the Tn7 adenylyltransferase (AAD(3")) gene of E. coli. | 5041-5098 |

Figure 3:
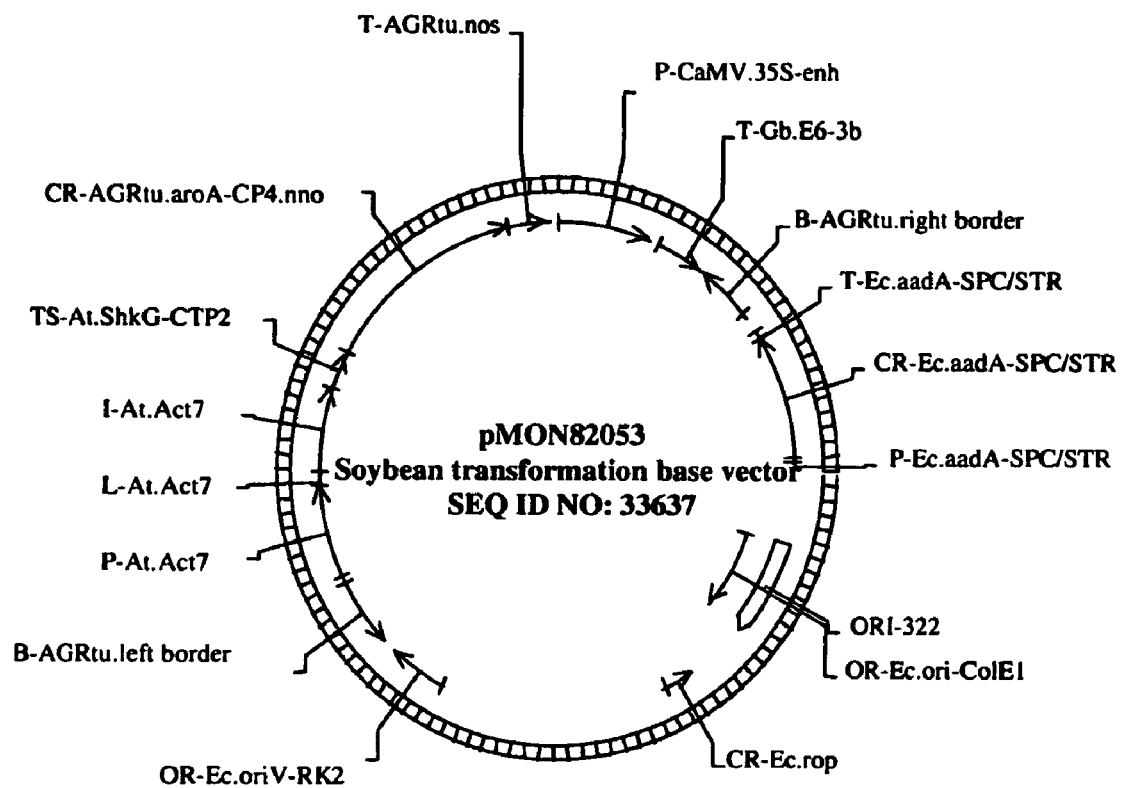

Plasmids for use in transformation of soybean are also prepared. Elements of an exemplary common expression vector plasmid pMON82053 are shown in Table 19 below. This exemplary soybean transformation base vector illustrated in FIG. 3 was assembled using the technology known in the art. DNA of interest, i.e. each DNA identified in Table 1 and the DNA for the identified homologous genes, are cloned and amplified by PCR prior to insertion into the insertion site the base vector at the insertion site between the enhanced 35S CaMV promoter and the termination sequence of cotton E6 gene.

TABLE 19 pMON82053

| function | name | annotation | Coordinates of SEQ ID NO: 33637 |
|---|---|---|---|
| Agro transforamtion | B-AGRtu.left border | Agro left border sequence, essential for transfer of T-DNA. | 6144-6585 |
| Plant selectable marker expression cassette | P-At.Act7 | Promoter from the arabidopsis actin 7 gene | 6624-7861 |
| | L-At.Act7 | 5'UTR of Arabidopsis Act7 gene | |
| | I-At.Act7 | Intron from the Arabidopsis actin7 gene | |
| | TS-At.ShkG-CTP2 | Transit peptide region of Arabidopsis EPSPS | 7864-8091 |
| | CR-AGRtu.aroA-CP4.nno__At | Synthetic CP4 coding region with dicot preferred codon usage. | 8092-9459 |

TABLE 19-continued pMON82053

| function | name | annotation | Coordinates of SEQ ID NO: 33637 |
|---|---|---|---|
| | T-AGRtu.nos | A 3' non-translated region of the nopaline synthase gene of *Agrobacterium tumefaciens* Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-613 |
| | insertion site T-Gb.E6-3b | 3' untranslated region from the fiber protein E6 gene of sea-island cotton; | 688-1002 |
| Agro transformation | B-AGRtu.right border | Agro right border sequence, essential for transfer of T-DNA. | 1033-1389 |
| Maintenance in *E. coli* | OR-Ec.oriV-RK2 | The vegetative origin of replication from plasmid RK2. | 5661-6057 |
| | CR-Ec.rop | Coding region for repressor of primer from the ColE1 plasmid. Expression of this gene product interferes with primer binding at the origin of replication, keeping plasmid copy number low. | 3961-4152 |
| | OR-Ec.ori-ColE1 | The minimal origin of replication from the *E. coli* plasmid ColE1. | 2945-3533 |
| | P-Ec.aadA-SPC/STR | romoter for Tn7 adenylyltransferase (AAD(3")) | 2373-2414 |
| | CR-Ec.aadA-SPC/STR | Coding region for Tn7 adenylyltransferase (AAD(3")) conferring spectinomycin and streptomycin resistance. | 1584-2372 |
| | T-Ec.aadA-SPC/STR | 3' UTR from the Tn7 adenylyltransferase (AAD(3")) gene of *E. coli*. | 1526-1583 |

Example 5 B

This example illustrates monocot plant transformation to produce nuclei of this invention in cells of a transgenic plant by transformation of corn callus. Corn plants of a readily transformable line are grown in the greenhouse and ears harvested when the embryos are 1.5 to 2.0 mm in length. Ears are surface sterilized by spraying or soaking the ears in 80% ethanol, followed by air drying. Immature embryos are isolated from individual kernels on surface sterilized ears. Prior to inoculation of maize cells, *Agrobacterium* cells are grown overnight at room temperature. Immature maize embryos are inoculated with *Agrobacterium* shortly after excision, and incubated at room temperature with *Agrobacterium* for 5-20 minutes. Immature embryos are then co-cultured with *Agrobacterium* for 1 to 3 days at 23° C. in the dark. Co-cultured embryos are transferred to selection media and cultured for approximately two weeks to allow embryogenic callus to develop. Embryogenic callus is transferred to culture medium containing 100 mg/L paromomycin and subcultured at about two week intervals. Transformants are recovered 6 to 8 weeks after initiation of selection.

Plasmid vectors are prepared essentially as described in Example 5 for transforming into corn callus each of DNA identified in Table 1 and the corresponding DNA for the identified homologous genes identified in Table 2, by *Agrobacterium*-mediated transformation.

For *Agrobacterium*-mediated transformation of corn callus, immature embryos are cultured for approximately 8-21 days after excision to allow callus to develop. Callus is then incubated for about 30 minutes at room temperature with the *Agrobacterium* suspension, followed by removal of the liquid by aspiration. The callus and *Agrobacterium* are co-cultured without selection for 3-6 days followed by selection on paromomycin for approximately 6 weeks, with biweekly transfers to fresh media, and paromomycin resistant callus identified as containing the recombinant DNA in an expression cassette.

Transgenic corn plants are regenerated from transgenic callus resulting from transformation on media to initiate shoot development in plantlets which are transferred to potting soil for initial growth in a growth chamber at 26 degrees C. followed by a mist bench before transplanting to 5 inch pots where plants are grown to maturity. The plants are self fertilized and seed is harvested for screening as seed, seedlings or progeny R2 plants or hybrids, e.g. for yield trials in the screens indicated above. Populations of transgenic plants and seeds produced form transgenic plant cells from each transgenic event are screened as described in Example 7 below to identify the members of the population having the enhanced trait.

Example 6

This example illustrates dicot plant transformation to produce nuclei of this transgenic in cells of transgenic plants by transformation of soybean tissue. For *Agrobacterium*-mediated transformation, soybean seeds are germinated overnight and the meristem explants excised. The meristems and the explants are placed in a wounding vessel. Soybean explants and induced *Agrobacterium* cells from a strain containing plasmid DNA with the gene of interest cassette and a plant selectable marker cassette are mixed no later than 14 hours from the time of initiation of seed germination and wounded using sonication. Following wounding, explants are placed in co-culture for 2-5 days at which point they are transferred to selection media for 6-8 weeks to allow selection and growth of transgenic shoots. Trait positive shoots are harvested approximately 6-8 weeks post bombardment and placed into selective rooting media for 2-3 weeks. Shoots producing roots are transferred to the greenhouse and potted in soil. Shoots that remain healthy on selection, but do not produce roots are transferred to non-selective rooting media for an additional two weeks. Roots from any shoots that produce roots off selection are tested for expression of the plant selectable marker before they are transferred to the greenhouse and potted in soil. Populations of transgenic plants and seeds produced form transgenic plant cells from each transgenic event are screened as described in Example 7 below to identify the members of the population having the enhanced trait.

Example 7

This example illustrates identification of nuclei of the invention by screening derived plants and seeds for an enhanced trait identified below.

Many transgenic events which survive to fertile transgenic plants that produce seeds and progeny plants will not exhibit an enhanced agronomic trait. Populations of transgenic seed and plants prepared in Examples 5 and 6 are screened to identify those transgenic events providing transgenic plant cells with a nucleus having recombinant DNA imparting an enhanced trait. Each population is screened for enhanced nitrogen use efficiency, increased yield, enhanced water use efficiency, enhanced tolerance to cold and heat, increased level of oil and protein in seed using assays described below. Plant cell nuclei having recombinant DNA with each of the genes identified in Table 1 and the identified homologs are identified in plants and seeds with at least one of the enhanced traits.

Selection for Enhanced Nitrogen Use Efficiency

Transgenic corn plants with nuclei of the invention are planted in fields with three levels of nitrogen (N) fertilizer being applied, i.e. low level (0 pounds per acre N), medium level (80 pounds per acre N) and high level (180 pounds per acre N). Liquid 28% or 32% UAN (Urea, Ammonium Nitrogen) are used as the N source and apply by broadcast boom and incorporate with a field cultivator with rear rolling basket in the same direction as intended crop rows. Although there is no N applied in the low level treatment, the soil should still be disturbed in the same fashion as the treated area. Transgenic plants and control plants can be grouped by genotype and construct with controls arranged randomly within genotype blocks. For improved statistical analysis each type of transgenic plant can be tested by 3 replications and across 4 locations. Nitrogen levels in the fields are analyzed before planting by collecting sample soil cores from 0-24" and 24 to 48" soil layer. Soil samples are analyzed for nitrate-nitrogen, phosphorus (P), potassium (K), organic matter and pH to provide baseline values. P, K and micronutrients are applied based upon soil test recommendations.

Transgenic corn plants prepared in Example 5 and which exhibit a 2 to 5% yield increase as compared to control plants when grown in the high nitrogen field are selected as having nuclei of the invention. Transgenic corn plants which have at least the same or higher yield as compared to control plants when grown in the medium nitrogen field are selected as having nuclei of the invention. Transgenic corn plants having a nucleus with DNA identified in Table 3 as imparting nitrogen use efficiency (LN) and homologous DNA are selected from a nitrogen use efficiency screen as having a nucleus of this invention.

Selection for Increased Yield

Many transgenic plants of this invention exhibit improved yield as compared to a control plant. Improved yield can result from enhanced seed sink potential, i.e. the number and size of endosperm cells or kernels and/or enhanced sink strength, i.e. the rate of starch biosynthesis. Sink potential can be established very early during kernel development, as endosperm cell number and size are determined within the first few days after pollination.

Much of the increase in corn yield of the past several decades has resulted from an increase in planting density. During that period, corn yield has been increasing at a rate of 2.1 bushels/acre/year, but the planting density has increased at a rate of 250 plants/acre/year. A characteristic of modern hybrid corn is the ability of these varieties to be planted at high density. Many studies have shown that a higher than current planting density should result in more biomass production, but current germplasm does not perform. well at these higher densities. One approach to increasing yield is to increase harvest index (HI), the proportion of biomass that is allocated to the kernel compared to total biomass, in high density plantings.

Effective yield selection of enhanced yielding transgenic corn events uses hybrid progeny of the transgenic event over multiple locations with plants grown under optimal production management practices, and maximum pest control. A useful target for improved yield is a 5% to 10% increase in yield as compared to yield produced by plants grown from seed for a control plant. Selection methods may be applied in multiple and diverse geographic locations, for example up to 16 or more locations, over one or more planting seasons, for example at least two planting seasons to statistically distinguish yield improvement from natural environmental effects. It is to plant multiple transgenic plants, positive and negative control plants, and pollinator plants in standard plots, for example 2 row plots, 20 feet long by 5 feet wide with 30 inches distance between rows and a 3 foot alley between ranges. Transgenic events can be grouped by recombinant DNA constructs with groups randomly placed in the field. A pollinator plot of a high quality corn line is planted for every two plots to allow open pollination when using male sterile transgenic events. A useful planting density is about 30,000 plants/acre. High planting density is greater than 30,000 plants/acre, preferably about 40,000 plants/acre, more preferably about 42,000 plants/acre, most preferably about 45,000 plants/acre.

Each of the transgenic corn plants and soybean plants with a nucleus of the invention prepared in Examples 5 and 6 are screened for yield enhancement. At least one event from each of the corn and soybean plants is selected as having at least between 3 and 5% increase in yield as compared to a control plant as having a nucleus of this invention.

Selection for Enhanced Water Use Efficiency (WUE)

The following is a high-throughput method for screening for water use efficiency in a greenhouse to identify the transgenic corn plants with a nucleus of this invention. This selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment. The hydration status of the shoot tissues following the drought is also measured. The plant height are measured at three time points. The first is taken just prior to the onset drought when the plant is 11 days old, which is the shoot initial height (SIH). The plant height is also measured halfway throughout the drought/re-water regimen, on day 18 after planting, to give rise to the shoot mid-drought height (SMH). Upon the completion of the final drought cycle on day 26 after planting, the shoot portion of the plant is harvested and measured for a final height, which is the shoot wilt height (SWH) and also measured for shoot wilted biomass (SWM). The shoot is placed in water at 40 degree Celsius in the dark. Three days later, the shoot is weighted to give rise to the shoot turgid weight (STM). After drying in an oven for four days, the shoots are weighted for shoot dry biomass (SDM). The shoot average height (SAH) is the mean plant height across the 3 height measurements. The procedure described above may be adjusted for +/− ~one day for each step given the situation.

To correct for slight differences between plants, a size corrected growth value is derived from SIH and SWH. This is the Relative Growth Rate (RGR). Relative Growth Rate (RGR) is calculated for each shoot using the formula [RGR %=(SWH−SIH)/((SWH+SIH)/2)×100]. Relative water content (RWC) is a measurement of how much (%) of the plant was water at harvest. Water Content (RWC) is calculated for each shoot using the formula [RWC %=(SWM−SDM)/(STM−SDM)×100]. Fully watered corn plants of this age run around 98% RWC.

Transgenic corn plants and soybean plants prepared in Examples 5 and 6 are screened for water use efficiency. Transgenic plants having at least a 1% increase in GRG and RWC as compared to control plants are identified as having enhanced water used efficiency and are selected as having a nucleus of this invention. Transgenic corn and soybean plants having in their nucleus DNA identified in Table 3 as imparting drought tolerance improvement (DS) and homologous DNA are identified as showing increased water use efficiency as compared to control plants and are selected as having a nucleus of this invention.

Selection for Growth Under Cold Stress

Cold germination assay—Three sets of seeds are used for the assay. The first set consists of positive transgenic events (F1 hybrid) where the genes of the present invention are expressed in the seed. The second seed set is nontransgenic, wild-type negative control made from the same genotype as the transgenic events. The third set consisted of two cold tolerant and one cold sensitive commercial check lines of corn. All seeds are treated with a fungicide "Captan" (MAESTRO® 80DF Fungicide, Arvesta Corporation, San Francisco, Calif., USA). 0.43 mL Captan is applied per 45 g of corn seeds by mixing it well and drying the fungicide prior to the experiment.

Corn kernels are placed embryo side down on blotter paper within an individual cell (8.9×8.9 cm) of a germination tray (54×36 cm). Ten seeds from an event are placed into one cell of the germination tray. Each tray can hold 21 transgenic events and 3 replicates of wildtype (LH244SDms+LH59), which is randomized in a complete block design. For every event there are five replications (five trays). The trays are placed at 9.7 C. for 24 days (no light) in a Convrion® growth chamber (Conviron Model PGV36, Controlled Environments, Winnipeg, Canada). Two hundred and fifty millilters of deionized water are added to each germination tray. Germination counts are taken 10th, 11th, 12th, 13th, 14th, 17th, 19th, 21st, and 24th day after start date of the experiment. Seeds are considered germinated if the emerged radicle size is 1 cm. From the germination counts germination index is calculated.

The germination index is calculated as per:

$$\text{Germination index} = (\Sigma([T+1-n_i]*[P_i-P_{i-1}]))/T$$

where T is the total number of days for which the germination assay is performed. The number of days after planting is defined by n. "i" indicated the number of times the germination had been counted, including the current day. P is the percentage of seeds germinated during any given rating. Statistical differences are calculated between transgenic events and wild type control. After statistical analysis, the events that show a statistical significance at the p level of less than 0.1 relative to wild-type controls will advance to a secondary cold selection. The secondary cold screen is conducted in the same manner of the primary selection only increasing the number of repetitions to ten. Statistical analysis of the data from the secondary selection is conducted to identify the events that show a statistical significance at the p level of less than 0.05 relative to wild-type controls.

Transgenic corn plants and soybean plants prepared in Examples 5 and 6 are screened for water use efficiency. Transgenic plants having at least a 5% increase in germination index as compared to control plants are identified as having enhanced cold stress tolerance and are selected as having a nucleus of this invention. Transgenic corn and soybean plants having in their nucleus DNA identified in Table 3 as imparting cold tolerance improvement (CK or CS) and homologous DNA are identified as showing increased cold stress tolerance as compared to control plants and are selected as having a nucleus of this invention.

Screens for Transgenic Plant Seeds with Increased Protein and/or Oil Levels

The following is a high-throughput selection method for identifying plant seeds with improvement in seed composition using the Infratec® 1200 series Grain Analyzer, which is a near-infrared transmittance spectrometer used to determine the composition of a bulk seed sample. Near infrared analysis is a non-destructive, high-throughput method that can analyze multiple traits in a single sample scan. An NIR calibration for the analytes of interest is used to predict the values of an unknown sample. The NIR spectrum is obtained for the sample and compared to the calibration using a complex chemometric software package that provides a predicted values as well as information on how well the sample fits in the calibration.

Infratec® Model 1221, 1225, or 1227 analyzer with transport module by Foss North America is used with cuvette, item #1000-4033, Foss North America or for small samples with small cell cuvette, Foss standard cuvette modified by Leon Girard Co. Corn and soy check samples of varying composition maintained in check cell cuvettes are supplied by Leon Girard Co. NIT collection software is provided by Maximum Consulting Inc. Calculations are performed automatically by the software. Seed samples are received in packets or containers with barcode labels from the customer. The seed is poured into the cuvettes and analyzed as received.

TABLE 21

| | |
|---|---|
| Typical sample(s): | Whole grain corn and soybean seeds |
| Analytical time to run method: | Less than 0.75 min per sample |
| Total elapsed time per run: | 1.5 minute per sample |
| Typical and minimum sample size: | Corn typical: 50 cc; minimum 30 cc<br>Soybean typical: 50 cc; minimum 5 cc |
| Typical analytical range: | Determined in part by the specific calibration.<br>Corn - moisture 5-15%, oil 5-20%, protein 5-30%, starch 50-75%, and density 1.0-1.3%.<br>Soybean - moisture 5-15%, oil 15-25%, and protein 35-50%. |

Transgenic corn plants and soybean plants prepared in Examples 5 and 6 are screened for increased protein and oil in seed. Transgenic inbred corn and soybean plants having an increase of at least 1 percentage point in the total percent seed protein or at least 0.3 percentage point in total seed oil and transgenic hybrid corn plants having an increase of at least 0.4 percentage point in the total percent seed protein as compared to control plants are identified as having enhanced seed protein or enhanced seed oil and are selected as having a nucleus of this invention.

Example 8

This example illustrates monocot and dicot plant transformation to produce nuclei of this invention in cells of a transgenic plant by transformation where the recombinant DNA suppresses the expression of an endogenous protein identified by Pfam, Histone, WD40, NPH3, FHA, PB1, ADH_zinc_N, NAPRTase, ADK_lid, p450, B56, DUF231, C2, DUF568, WD40, F-box, Pkinase, or Terpene_synth. Corn callus and soybean tissue are transformed as describe in Examples 5 and 6 using recombinant DNA in the nucleus with DNA that transcribes to RNA that forms double-stranded RNA targeted to an endogenous gene with DNA encoding the protein. The genes for which the double-stranded RNAs are targeted are the native gene in corn and soybean that are homolog of the genes encoding the protein with an amino acid sequence of SEQ ID NO: 426, 428, 429, 430, 524, 525, 541, 601, 602, 650, 651, 654, 655, 657, 660, 694, 698, 772, 801.

Populations of transgenic corn plants and soybean plants prepared in Examples 5 and 6 with DNA for suppressing a gene identified in Table 3 as providing an enhanced trait by gene suppression are screened to identify an event from those plants with a nucleus of the invention by selecting the trait identified in this specification.

TABLE 2

| SEQ ID NO: | homolog SEQ ID NOs | | | | | | | | | | |
|---|---|---|---|---|---|---|---|---|---|---|---|
| 426: | 31549 | 26664 | 26645 | 25553 | 29273 | 18258 | 31741 | 1551 | 3388 | 3387 | 3064 | 3017 |
| | 3389 | 3999 | 3063 | 3998 | 3335 | 1921 | 2854 | 2472 | 3997 | 2355 | 2445 | 2444 |
| | 2706 | 2471 | 3248 | 2807 | 32559 | 10182 | 33093 | 29066 | 22058 | 29063 | 20705 | 31709 |
| | 6002 | 5864 | 6338 | 5023 | 4626 | 5024 | 6337 | 6427 | 5000 | 5459 | 5995 | 4979 |
| | 6428 | 6010 | 6045 | 4493 | 6336 | 4977 | 5797 | 4981 | 4976 | 5620 | 4492 | 5022 |
| | 4247 | 5044 | 5006 | 6046 | 6339 | 5629 | 6208 | 6044 | 5458 | 5578 | 5460 | 5730 |
| | 5025 | 6335 | 5127 | 4630 | 5836 | 6207 | 6334 | 4540 | 5837 | 6383 | 5119 | 5031 |
| | 10181 | 4764 | 5504 | 6014 | 5211 | 4500 | 5835 | 6384 | 6104 | 4571 | 4765 | 5788 |
| | 4499 | 5778 | 6364 | 6357 | 6233 | 4501 | 6361 | 5777 | 4665 | 6231 | 4309 | 6356 |
| | 6234 | 4842 | 4115 | 4268 | 5392 | 6239 | 6012 | 4135 | 6232 | 5765 | 4198 | 5796 |
| | 4898 | 4896 | 4495 | 4174 | 4126 | 6230 | 5013 | 4498 | 10574 | 6382 | 6237 | 6362 |
| | 6238 | 5795 | 4766 | 6236 | 5040 | 4897 | 4494 | 5012 | 6089 | 6360 | 5038 | 8703 |
| | 9296 | 7544 | 7284 | 9368 | 7945 | 9335 | 8704 | 7048 | 9329 | 7543 | 9353 | 8306 |
| | 7545 | 7944 | 8345 | 8735 | 27146 | 8792 | 7422 | 7390 | 7777 | 7719 | 9354 | 7311 |
| | 7776 | 7943 | 7718 | 9391 | 8921 | 7556 | 8687 | 8137 | 7282 | 8775 | 9334 | 10206 |
| | 33181 | 25349 | 28507 | 29674 | 12747 | 13519 | 17862 | 18456 | 33494 | 19906 | 26998 | 26997 |
| | 20607 | 20608 | | | | | | | | | | |
| 427: | 25164 | 21072 | 28215 | 30323 | 31072 | 1539 | 2857 | 2023 | 3862 | 3765 | 30194 | 4603 |
| | 4849 | 4874 | 6309 | 4873 | 5370 | 7588 | 8285 | 6789 | 7438 | 8158 | 16525 | 21509 |
| | 31609 | | | | | | | | | | | |
| 428: | 23535 | 26657 | 26659 | 25656 | 22696 | 1550 | 1502 | 1035 | 3630 | 3084 | 2821 | 2820 |
| | 3631 | 3491 | 3281 | 28996 | 5526 | 5544 | 5212 | 5600 | 6215 | 4590 | 5721 | 5483 |
| | 7411 | 7413 | 7087 | 6763 | 7285 | 8215 | 7831 | 8475 | 7336 | 7665 | 7830 | 9360 |
| | 8005 | 6817 | 19924 | 23111 | 13730 | 29173 | 20696 | 18769 | 16648 | 24623 | | |
| 429: | 1297 | 1585 | | | | | | | | | | |
| 430: | 1005 | 893 | 1155 | 1664 | 1798 | 1351 | 1677 | 2081 | 22028 | 28867 | 7193 | 8619 |
| | 7005 | 8839 | 32857 | | | | | | | | | |
| 431: | 25541 | 1508 | 1509 | 1553 | 3042 | 3874 | 2425 | 3380 | 2438 | 2089 | 2165 | 31105 |
| | 22015 | 4633 | 5715 | 6165 | 5109 | 5104 | 6018 | 4457 | 5002 | 5709 | 8234 | 8233 |
| | 8887 | 6593 | 9390 | 20693 | | | | | | | | |
| 432: | 17645 | 32929 | 16109 | 16115 | 29937 | 17418 | 12553 | 24238 | 11719 | 13895 | 18572 | 17067 |
| | 15142 | 14984 | 12937 | 32611 | 17020 | 28098 | 21188 | 16710 | 27572 | 11897 | 20037 | 20035 |
| | 20036 | 20034 | 17111 | 18055 | 28529 | 19049 | 18104 | 18105 | 13984 | 19500 | 25953 | 20452 |
| | 20014 | 20969 | 20555 | 30341 | 22310 | 33377 | 21605 | 21382 | 21278 | 24058 | 25799 | 24665 |
| | 25099 | 30029 | 27722 | 25477 | 10712 | 25303 | 26450 | 26343 | 12378 | 16213 | 16083 | 12602 |
| | 12023 | 18632 | 28013 | 27361 | 28132 | 20347 | 13710 | 30404 | 29726 | 1027 | 1629 | 11636 |
| | 1950 | 2653 | 2550 | 2419 | 3624 | 2523 | 2999 | 3403 | 14341 | 11278 | 29058 | 5150 |
| | 6157 | 6259 | 5151 | 5083 | 6272 | 7653 | 6935 | 8821 | 8308 | 7111 | 8992 | 6561 |
| | 8750 | 6934 | 8702 | 8822 | 6613 | 32327 | 33273 | 28685 | 10183 | 22836 | 30888 | 15219 |
| | 29975 | 30401 | 30402 | 30403 | 16604 | 12184 | 33248 | | | | | |
| 433: | 22629 | 1018 | 1684 | 928 | 1084 | 10512 | 3923 | 3013 | 3941 | 2520 | 4022 | 3940 |
| | 3543 | 2522 | 3352 | 2521 | 21983 | 29335 | 29050 | 29049 | 14413 | 4107 | 7164 | 8885 |
| | 6641 | 6682 | 8193 | 7548 | 13731 | | | | | | | |

TABLE 2-continued

| SEQ ID NO: | | | | homolog SEQ ID NOs | | | | | | | |
|---|---|---|---|---|---|---|---|---|---|---|---|
| 434: | 1467 | 2508 | 3970 | 7052 | | | | | | | |
| 435: | 1255 | 1124 | 958 | 1253 | 1254 | 1501 | 1549 | 1072 | 2612 | 3537 | 2443 | 3701 |
| | 4062 | 2663 | 3374 | 1932 | 2828 | 1951 | 6185 | 5932 | 4263 | 4723 | 6434 | 5884 |
| | 5933 | 4604 | 4593 | 4374 | 5240 | 5639 | 5221 | 9062 | 7723 | 6978 | 6874 | 9185 |
| | 7700 | 7668 | 6650 | 7929 | 6857 | 6992 | 8404 | 7791 | 6931 | 6564 | 6728 | 13457 |
| 436: | 11330 | 11798 | 11797 | 11803 | 11800 | 11802 | 11796 | 11807 | 11799 | 11801 | 11806 | 11805 |
| | 11804 | 11808 | 24821 | 1221 | 22575 | 3994 | 2950 | 2357 | 3993 | 13245 | 17749 | 32992 |
| | 33068 | 18403 | 16916 | 31336 | 7187 | 17867 | 27005 | 20112 | | | | |
| 437: | 1606 | 3877 | 3448 | 3876 | 2580 | 3552 | 2836 | 3074 | 2181 | 3433 | 3509 | 2498 |
| | 29402 | 22027 | 5283 | 5447 | 8053 | 7217 | 9237 | 8787 | 9236 | | | |
| 438: | 11753 | 17885 | 1367 | 22014 | 19360 | 5817 | 6826 | 8128 | | | | |
| 439: | 14793 | 15421 | 1784 | 886 | 1769 | 1620 | 1147 | 1676 | 1349 | 1130 | 1555 | 880 |
| | 29150 | 21099 | 5008 | 6469 | 9122 | 7083 | | | | | | |
| 440: | 1793 | 1191 | 2507 | 3786 | 3326 | 2547 | 2895 | 3788 | 3787 | 5050 | 4592 | 4302 |
| | 5051 | 5049 | 8723 | 7236 | 8412 | 8882 | 7135 | | | | | |
| 441: | 1017 | 1131 | 1696 | 3498 | 2936 | 2897 | 2288 | 3478 | 1846 | 28866 | 28999 | 5982 |
| | 4505 | 6279 | 4635 | 6217 | 5182 | 4846 | 8930 | 6829 | 8264 | 8123 | 6872 | 8586 |
| | 8585 | | | | | | | | | | | |
| 442: | 33099 | 13572 | 30102 | 25061 | 13115 | 32911 | 32896 | 11209 | 17364 | 25755 | 13934 | 14599 |
| | 14606 | 17072 | 15091 | 17542 | 23794 | 23810 | 15791 | 16272 | 27533 | 16826 | 20491 | 20504 |
| | 11964 | 11932 | 17180 | 17150 | 16340 | 24750 | 18956 | 12797 | 12083 | 13988 | 25948 | 25961 |
| | 30124 | 30339 | 22859 | 21343 | 28274 | 30165 | 24966 | 25262 | 31065 | 31064 | 27926 | 27216 |
| | 9467 | 30676 | 26106 | 28365 | 28321 | 28633 | 3237 | 3011 | 3098 | 29342 | 29229 | 4100 |
| | 8573 | 8809 | 8808 | 8810 | 28776 | 31168 | 31178 | 21744 | 31417 | 13203 | 32848 | 24632 |
| 443: | 1495 | 1430 | 1106 | 1631 | 3776 | 3775 | 3049 | 2841 | 3001 | 2344 | 2981 | 3315 |
| | 2494 | 3330 | 3249 | 21974 | 31098 | 5684 | 5069 | 5661 | 4632 | 5068 | 7489 | 6894 |
| | 7840 | 7889 | 7490 | 7628 | 8528 | 8518 | 6686 | 14775 | | | | |
| 444: | 23594 | 24432 | 26726 | 25623 | 22755 | 19732 | 16724 | 32850 | 1685 | 1129 | 964 | 1159 |
| | 9579 | 29036 | 27426 | 5582 | 5224 | 5225 | 4867 | 4314 | 4266 | 5226 | 4265 | 4866 |
| | 5714 | 5354 | 8768 | 9203 | 7166 | 8133 | 7519 | 7521 | 7619 | 7855 | 7691 | 8960 |
| | 7520 | 6579 | 7658 | 7051 | 8900 | 7370 | 9823 | 33308 | 29175 | 20627 | 2220 | 3390 |
| | 3971 | 3972 | | | | | | | | | | |
| 445: | 21160 | 23464 | 24408 | 24537 | 24340 | 26791 | 26667 | 26756 | 25617 | 25632 | 25636 | 25653 |
| | 22643 | 22765 | 22766 | 22900 | 9795 | 23354 | 32042 | 32047 | 28015 | 28340 | 16640 | 24622 |
| | 19287 | 1789 | 31335 | 32423 | 32422 | 19273 | 20734 | 29107 | 32424 | 19902 | 10176 | 32983 |
| | 20086 | 15242 | 15371 | 23679 | 11429 | 23746 | 17863 | 17864 | 5776 | 4405 | 6425 | 7555 |
| | 7260 | 6966 | 7614 | 9227 | 7115 | 8828 | 9226 | 7613 | 31959 | 33318 | 11328 | 10868 |
| | 13606 | 33018 | 13605 | 22972 | 20711 | 14417 | 16765 | | | | | |
| 446: | 28240 | 10652 | 26605 | 29336 | 29337 | 24953 | 26604 | 31901 | 15972 | 22181 | 26907 | 14237 |
| | 21168 | 21170 | 21169 | 13227 | 22097 | 27430 | 32943 | 30651 | 30652 | 31646 | 33594 | 31648 |
| | 31649 | 32094 | 32935 | 31922 | 20728 | 20079 | 972 | 31696 | 32640 | 32638 | 10064 | 32643 |
| | 32644 | 15930 | 15931 | 22550 | 28927 | 28945 | 28946 | 28916 | 21098 | 26524 | 18630 | 31654 |
| | 18631 | 32536 | 31281 | 11270 | 14312 | 11269 | 18402 | 31645 | 31644 | 23663 | 10224 | 18437 |
| | 13974 | 17977 | 4647 | 5686 | 6222 | 5118 | 5188 | 9061 | 6568 | 8101 | 8170 | 13782 |
| | 13781 | 13783 | 10797 | 10798 | 13286 | 26992 | 16652 | 31911 | 14189 | 22105 | 13447 | 9969 |
| | 14573 | 15981 | 25196 | 10932 | 10931 | 10933 | 10930 | 10934 | 31802 | 15396 | 33325 | 24598 |
| | 32967 | 14771 | 14228 | 33323 | 33324 | 20365 | 33262 | 20136 | 18760 | 33322 | | |
| 447: | 22160 | 15597 | 15598 | 1245 | 1163 | 1632 | 1600 | 1614 | 1324 | 1302 | 21532 | 24130 |
| | 3649 | 25355 | 9913 | 25356 | 22119 | 32161 | 31123 | 25399 | 24030 | 32165 | 32164 | 14822 |
| | 17694 | 6514 | 18246 | 19892 | | | | | | | | |
| 448: | 1732 | 1295 | 2927 | 3709 | 2305 | 2182 | 3421 | 3295 | 3599 | 2051 | 1866 | 3686 |
| | 3562 | 3569 | 3320 | 2284 | 5823 | 6340 | 5801 | 6290 | 6483 | 5770 | 8608 | 8490 |
| | 7061 | 25361 | 32572 | | | | | | | | | |
| 449: | 1069 | 1107 | 3644 | 2886 | 3353 | 2506 | 3160 | 3459 | 31109 | 26533 | 4645 | 6316 |
| | 5915 | 4363 | 7014 | 7015 | 6973 | 6916 | 9089 | 8537 | 7510 | 6974 | 7085 | 6862 |
| | 15738 | | | | | | | | | | | |
| 450: | 10652 | 26605 | 29336 | 29337 | 26608 | 24953 | 26604 | 31901 | 15972 | 22181 | 14237 | 21170 |
| | 21168 | 21169 | 13227 | 22097 | 27430 | 32943 | 17894 | 30651 | 15348 | 31646 | 33594 | 31648 |
| | 31649 | 32094 | 32935 | 31922 | 20728 | 20079 | 32638 | 10064 | 32643 | 32644 | 15931 | 15930 |
| | 22550 | 28916 | 21942 | 20838 | 28957 | 29060 | 28927 | 29027 | 28946 | 29261 | 28945 | 29260 |
| | 29035 | 21098 | 26524 | 18630 | 31654 | 18631 | 32536 | 31281 | 14312 | 11269 | 11270 | 18402 |
| | 31645 | 31644 | 10224 | 18437 | 13974 | 17977 | 31348 | 5686 | 4647 | 9061 | 6568 | 13782 |
| | 13781 | 13783 | 10797 | 10798 | 16652 | 28907 | 31643 | 31911 | 14189 | 9969 | 22117 | 15981 |
| | 25196 | 31905 | 10932 | 10933 | 10931 | 10934 | 10930 | 31802 | 11779 | 11780 | 11781 | |
| 451: | 26991 | 1104 | 1986 | 1889 | 1914 | 1919 | 1984 | 3561 | 2173 | 3162 | 2335 | 3177 |
| | 22016 | 29109 | 4192 | 6515 | 5223 | 4622 | 7947 | 6820 | 6886 | 8294 | 9189 | 8914 |
| | 9365 | 7350 | 9045 | 8470 | 7041 | 7257 | 6587 | | | | | |
| 452: | 30274 | 14219 | 18232 | 30314 | 25837 | 25227 | 27755 | 26409 | 26264 | 30622 | 12638 | 12219 |
| | 11870 | 1268 | 1818 | 2368 | 4016 | 2409 | 3482 | 11872 | 2408 | 1960 | 2906 | 2407 |
| | 2406 | 2003 | 2097 | 2504 | 2765 | 11871 | 15576 | 20252 | 10864 | 5804 | 6401 | 6161 |
| | 4817 | 4275 | 5914 | 5790 | 6189 | 4137 | 4788 | 4233 | 5596 | 4838 | 6011 | 8106 |
| | 9293 | 8426 | 9292 | 21100 | 6906 | 8667 | 7271 | 6891 | 7170 | 6779 | 6773 | 7076 |
| | 9411 | 14808 | 15740 | 16626 | 33027 | 29457 | 15879 | 11869 | | | | |

TABLE 2-continued

| SEQ ID NO: | homolog SEQ ID NOs | | | | | | | | | | |
|---|---|---|---|---|---|---|---|---|---|---|---|
| 453: | 33449 | 24954 | 11331 | 28872 | 23556 | 23581 | 24330 | 24535 | 26667 | 25640 | 25657 | 22676 |
|  | 22631 | 21212 | 19284 | 19729 | 31579 | 31580 | 28503 | 13283 | 11257 | 11256 | 11255 | 11254 |
|  | 944 | 977 | 966 | 854 | 1235 | 1526 | 1733 | 31339 | 31340 | 29635 | 31234 | 3928 |
|  | 2110 | 3030 | 2336 | 24866 | 10954 | 31341 | 31342 | 22018 | 31233 | 18873 | 31344 | 31343 |
|  | 31345 | 10338 | 11549 | 5361 | 5670 | 4117 | 4124 | 6959 | 7410 | 6960 | 7022 | 8403 |
|  | 32961 | 9046 | 8045 | 10890 | 9109 | 9057 | 8552 | 20959 | 32715 | 22099 | 22831 | 18876 |
|  | 20708 | 13253 | 17897 | 10970 | 10058 | 31776 |  |  |  |  |  |  |
| 454: | 1365 | 3329 | 3974 | 2036 | 3892 | 2206 | 20308 | 5950 | 4701 | 5390 | 5270 | 6017 |
|  | 8016 | 6635 | 9169 | 7950 |  |  |  |  |  |  |  |  |
| 455: | 14727 | 27390 | 33297 | 25773 | 21054 | 9775 | 22266 | 31040 | 9863 | 32233 | 10423 | 20072 |
|  | 9987 | 14229 | 15243 | 1761 | 1505 | 1588 | 971 | 1706 | 1037 | 1128 | 2673 | 2100 |
|  | 2603 | 2860 | 3986 | 2168 | 2941 | 2198 | 3037 | 2989 | 3385 | 1852 | 2686 | 2991 |
|  | 4092 | 3094 | 3058 | 1936 | 3069 | 3035 | 2007 | 3004 | 2148 | 23007 | 21946 | 19900 |
|  | 19773 | 32394 | 4127 | 4409 | 5411 | 5407 | 5269 | 5405 | 5410 | 5409 | 4677 | 5393 |
|  | 5408 | 4316 | 5387 | 5412 | 5133 | 5400 | 5406 | 6184 | 5610 | 4293 | 4470 | 5733 |
|  | 4836 | 4294 | 8539 | 8924 | 7846 | 8246 | 6630 | 7102 | 7847 | 8434 | 8245 | 7716 |
|  | 6625 | 9007 | 8615 | 6785 | 8516 | 7845 | 8628 | 8545 | 6603 | 8501 | 6602 | 7988 |
|  | 6758 | 7100 | 22114 | 17748 | 31591 | 21491 | 11867 |  |  |  |  |  |
| 456: | 2302 | 3412 | 3861 | 2660 | 3197 | 3019 | 2037 | 3043 | 4010 | 3150 | 3127 | 2301 |
|  | 2883 | 3327 | 29014 | 29126 | 30207 | 5813 | 4420 | 6188 | 4488 | 5339 | 5973 | 4242 |
|  | 5520 | 5986 | 5697 | 5675 | 4845 | 6772 | 9145 | 7475 | 8414 | 7242 | 8694 | 7427 |
|  | 8713 | 8901 | 7895 | 6937 | 6795 | 7262 | 8318 | 8317 | 7345 | 7346 | 7896 | 6559 |
|  | 7380 | 8949 | 15891 | 32860 | 15739 | 33026 |  |  |  |  |  |  |
| 457: | 1560 | 1290 | 3228 | 3733 | 22906 | 29032 | 32023 | 6024 | 8630 | 8579 | 9012 | 9554 |
|  | 14431 |  |  |  |  |  |  |  |  |  |  |  |
| 458: | 11386 | 27460 | 13968 | 23583 | 24335 | 24456 | 26772 | 26698 | 25546 | 22719 | 11788 | 24040 |
|  | 33254 | 1790 | 998 | 1312 | 1218 | 1353 | 1074 | 13967 | 23062 | 2973 | 3872 | 22118 |
|  | 14252 | 24829 | 15068 | 15758 | 9998 | 24867 | 24937 | 15578 | 24936 | 15579 | 11143 | 15580 |
|  | 10544 | 13615 | 18405 | 16029 | 11162 | 13465 | 12271 | 14766 | 22947 | 20701 | 20961 | 10965 |
|  | 30762 | 20606 | 14634 |  |  |  |  |  |  |  |  |  |
| 459: | 3549 | 2711 | 3511 | 3606 | 2038 | 2330 | 5747 | 4812 | 5688 | 5465 | 8968 | 9378 |
|  | 7525 |  |  |  |  |  |  |  |  |  |  |  |
| 460: | 21674 | 17217 | 29209 | 32673 | 17228 | 33139 | 33337 | 11123 | 33462 | 24991 | 17634 | 13525 |
|  | 20532 | 13549 | 12213 | 27645 | 27634 | 30261 | 30217 | 760 | 30222 | 30264 | 30233 | 31539 |
|  | 25803 | 30097 | 10349 | 13101 | 11157 | 13129 | 31505 | 32924 | 32906 | 17681 | 18668 | 11154 |
|  | 10345 | 21672 | 33598 | 21671 | 14953 | 23707 | 19274 | 14517 | 18628 | 17993 | 27015 | 19997 |
|  | 23020 | 17608 | 15594 | 10339 | 26609 | 10495 | 24134 | 14733 | 10298 | 10267 | 10310 | 10275 |
|  | 10306 | 16104 | 16096 | 16128 | 16112 | 27874 | 27867 | 11214 | 11175 | 11202 | 14422 | 29947 |
|  | 25898 | 24094 | 31742 | 17294 | 17381 | 17393 | 17384 | 17355 | 12568 | 12582 | 24838 | 24243 |
|  | 24227 | 30005 | 25764 | 21075 | 21055 | 26552 | 13409 | 13407 | 19742 | 18359 | 18317 | 18331 |
|  | 18339 | 12857 | 13851 | 13228 | 14202 | 14212 | 14191 | 18556 | 18567 | 14366 | 14369 | 14355 |
|  | 14374 | 27120 | 15686 | 15717 | 15698 | 15677 | 17740 | 17725 | 14609 | 14577 | 14582 | 23896 |
|  | 17059 | 17071 | 32887 | 14684 | 14670 | 15196 | 15035 | 32292 | 31377 | 32601 | 15089 | 15109 |
|  | 15114 | 15531 | 15564 | 20106 | 14142 | 17529 | 17545 | 22492 | 22425 | 15084 | 23796 | 32417 |
|  | 15794 | 17016 | 16998 | 17028 | 30978 | 19928 | 15523 | 17817 | 17836 | 17795 | 17828 | 17764 |
|  | 28058 | 16294 | 16291 | 29821 | 28078 | 28226 | 18792 | 16789 | 16791 | 16798 | 26001 | 16668 |
|  | 16863 | 16857 | 32374 | 32363 | 27547 | 27538 | 27558 | 16823 | 29850 | 16899 | 20518 | 29891 |
|  | 29906 | 11892 | 11913 | 11950 | 19245 | 19266 | 19225 | 19248 | 17182 | 17107 | 17088 | 17108 |
|  | 18599 | 12732 | 18067 | 18044 | 18080 | 28557 | 28564 | 28603 | 28549 | 28559 | 28617 | 18847 |
|  | 11158 | 18711 | 18682 | 16346 | 16369 | 16322 | 16342 | 24690 | 24766 | 18884 | 18882 | 18915 |
|  | 18919 | 18912 | 18930 | 19074 | 19106 | 19115 | 19073 | 12772 | 33618 | 481 | 12047 | 9873 |
|  | 9903 | 9895 | 18120 | 14033 | 14029 | 14021 | 19336 | 19792 | 19814 | 23590 | 23504 |  |
|  | 19508 | 19584 | 19688 | 19616 | 19580 | 19676 | 19568 | 19596 | 19665 | 29925 | 20483 | 20466 |
|  | 29913 | 20464 | 20017 | 21927 | 15746 | 24996 | 24390 | 24490 | 24498 | 24361 | 24463 | 9678 |
|  | 20976 | 20983 | 20563 | 20562 | 26653 | 26741 | 25544 | 25607 | 30137 | 25038 | 25891 | 25878 |
|  | 30116 | 22728 | 20779 | 21720 | 20787 | 20783 | 12468 | 32195 | 32209 | 23179 | 12350 | 12342 |
|  | 30342 | 30362 | 22344 | 22303 | 22355 | 22338 | 22371 | 22305 | 22361 | 12315 | 33409 | 33430 |
|  | 21663 | 21613 | 21806 | 22290 | 22227 | 22258 | 22219 | 22856 | 21429 | 21434 | 21480 | 21347 |
|  | 21342 | 21351 | 21330 | 21397 | 21263 | 21258 | 21280 | 21222 | 24029 | 29479 | 29489 | 25914 |
|  | 24070 | 24065 | 28261 | 23924 | 23933 | 23958 | 25170 | 25739 | 25729 | 26055 | 26057 | 26078 |
|  | 26059 | 24653 | 25867 | 27490 | 27510 | 30085 | 26601 | 24291 | 28289 | 28285 | 28272 | 30026 |
|  | 25131 | 26960 | 26958 | 25667 | 30153 | 25691 | 25681 | 27796 | 25437 | 11680 | 13046 | 10742 |
|  | 10744 | 10685 | 24973 | 24960 | 27102 | 13771 | 25277 | 25278 | 25261 | 31047 | 31518 | 26489 |
|  | 26499 | 26423 | 26394 | 26356 | 26260 | 26185 | 27930 | 27945 | 27935 | 27973 | 27974 | 27296 |
|  | 27272 | 11362 | 11368 | 11375 | 9474 | 9512 | 9538 | 9470 | 9504 | 11497 | 11468 | 11508 |
|  | 11463 | 16454 | 29780 | 30632 | 30630 | 30602 | 12384 | 13330 | 13328 | 13334 | 26095 | 16217 |
|  | 12504 | 12518 | 10370 | 10372 | 30505 | 30525 | 30513 | 30515 | 30510 | 16054 | 26032 | 16042 |
|  | 16061 | 16070 | 12640 | 12636 | 12238 | 14942 | 14938 | 10816 | 32463 | 24104 | 27984 | 27382 |
|  | 27320 | 18003 | 28352 | 28408 | 28385 | 28140 | 28496 | 28455 | 28428 | 28477 | 28325 | 28313 |
|  | 17574 | 17432 | 30767 | 32130 | 32128 | 33561 | 13649 | 17626 | 20531 | 12488 | 18504 | 24025 |
|  | 18461 | 14447 | 16439 | 29704 | 16449 | 17586 | 32129 | 15398 | 11548 | 15412 | 18015 | 33475 |
|  | 31347 | 17579 | 32864 | 28644 | 32280 | 15941 | 1060 | 1416 | 1019 | 32038 | 17665 | 14880 |
|  | 11623 | 11574 | 10628 | 3546 | 2891 | 10165 | 3678 | 3899 | 3165 | 3913 | 3083 | 3612 |
|  | 2837 | 3912 | 2225 | 1835 | 3920 | 2738 | 1871 | 1870 | 2733 | 2767 | 18393 | 29285 |
|  | 29399 | 30025 | 14567 | 14566 | 10463 | 4770 | 5738 | 4145 | 5515 | 4913 | 4637 | 5189 |
|  | 5635 | 6138 | 9044 | 9206 | 9408 | 9197 | 8857 | 9242 | 7800 | 8859 | 8858 | 8856 |
|  | 6684 | 9239 | 6575 | 9811 | 11814 | 32980 | 32670 | 22102 | 33033 | 32112 | 31913 | 20617 |
|  | 33336 | 23708 | 21004 | 10207 | 30746 | 31908 | 31906 | 31907 | 14409 | 33276 | 9965 | 21553 |

TABLE 2-continued

| SEQ ID NO: | homolog SEQ ID NOs | | | | | | | | | | |
|---|---|---|---|---|---|---|---|---|---|---|---|
| | 21551 | 461 | 713 | 28769 | 28707 | 28710 | 28708 | 28720 | 23742 | 28632 | 16521 | 16568 |
| | 16577 | 12864 | 12460 | 31203 | 31152 | 31196 | 31193 | 31137 | 20526 | 32050 | 27143 | 31329 |
| | 31313 | 31299 | 20859 | 20866 | 20879 | 20877 | 20882 | 21496 | 21523 | 30933 | 22109 | 12135 |
| | 12118 | 31534 | 12988 | 12965 | 28251 | 10617 | 21755 | 21749 | 21512 | 21515 | 16591 | 12168 |
| | 26863 | 26874 | 31444 | 31423 | 31433 | 31438 | 27532 | 29374 | 13193 | 13164 | 13191 | |
| 461: | 21674 | 17217 | 32673 | 24991 | 33462 | 29209 | 33139 | 17228 | 21008 | 11123 | 17634 | 13525 |
| | 12213 | 27634 | 27645 | 27613 | 30261 | 30217 | 760 | 30222 | 31539 | 25803 | 13101 | 31505 |
| | 32924 | 17681 | 18668 | 10345 | 21672 | 33598 | 14953 | 23707 | 19274 | 14517 | 18628 | 17993 |
| | 27015 | 19997 | 23020 | 32981 | 26609 | 10495 | 10267 | 10298 | 10275 | 10310 | 10306 | 16104 |
| | 16128 | 27874 | 11214 | 11175 | 14422 | 25898 | 29947 | 17294 | 17381 | 17384 | 17393 | 17355 |
| | 17391 | 17298 | 12568 | 24838 | 24227 | 24243 | 30005 | 21075 | 26552 | 13409 | 19742 | 19744 |
| | 18359 | 18317 | 18331 | 13851 | 12855 | 13948 | 12857 | 13936 | 13228 | 14202 | 14212 | 18556 |
| | 14366 | 14355 | 14369 | 14374 | 27120 | 15686 | 15717 | 15698 | 17740 | 14609 | 14577 | 23896 |
| | 32887 | 14684 | 15196 | 15035 | 12875 | 12909 | 32292 | 31377 | 32601 | 15089 | 15109 | 15531 |
| | 17529 | 17545 | 22492 | 15084 | 23796 | 15285 | 32417 | 15794 | 16998 | 17016 | 17028 | 30978 |
| | 19928 | 15523 | 17817 | 17795 | 17836 | 17828 | 27894 | 27896 | 27897 | 28058 | 16294 | 29821 |
| | 28078 | 28226 | 18792 | 16789 | 16798 | 26001 | 16668 | 16863 | 32374 | 32363 | 27547 | 27538 |
| | 27558 | 16823 | 29850 | 16899 | 20518 | 29891 | 29906 | 11892 | 11950 | 11913 | 19245 | 19225 |
| | 19266 | 19248 | 21877 | 17182 | 17107 | 17088 | 18599 | 12732 | 18067 | 28557 | 28564 | 28603 |
| | 28549 | 28617 | 28559 | 18847 | 11158 | 18711 | 18682 | 16346 | 16369 | 16342 | 16322 | 24690 |
| | 24766 | 18884 | 18882 | 18915 | 18919 | 18930 | 18912 | 19074 | 19106 | 12772 | 12047 | 9873 |
| | 9903 | 18120 | 18149 | 18154 | 18182 | 14033 | 14021 | 14029 | 19336 | 19792 | 19872 | 19814 |
| | 23590 | 23504 | 23621 | 19508 | 19584 | 19688 | 19580 | 19676 | 19683 | 19563 | 19616 | 19596 |
| | 19568 | 19665 | 29925 | 20483 | 29913 | 20017 | 21927 | 15746 | 24996 | 24490 | 24498 | 24390 |
| | 24361 | 9678 | 20976 | 20983 | 20425 | 20563 | 26653 | 26741 | 25544 | 25607 | 30137 | 25891 |
| | 25038 | 25878 | 22779 | 22728 | 21720 | 20783 | 20787 | 12468 | 32195 | 32209 | 12473 | 23179 |
| | 12350 | 30342 | 30362 | 22344 | 22303 | 22355 | 22338 | 22371 | 22361 | 22305 | 12315 | 33409 |
| | 33430 | 21663 | 21613 | 21806 | 22290 | 22258 | 22227 | 22856 | 21429 | 21434 | 21456 | 21480 |
| | 21342 | 21347 | 21351 | 21304 | 21329 | 21397 | 21258 | 21263 | 21280 | 21225 | 21261 | 21222 |
| | 29479 | 29489 | 24070 | 28261 | 23924 | 23933 | 23958 | 23983 | 25739 | 25170 | 26055 | 26057 |
| | 26078 | 24653 | 25867 | 24506 | 27510 | 30085 | 24291 | 28289 | 28285 | 30026 | 26960 | 25687 |
| | 30153 | 25691 | 25681 | 25678 | 27796 | 25437 | 11680 | 13046 | 13038 | 10742 | 10744 | 10659 |
| | 10685 | 24973 | 27110 | 27055 | 13771 | 25277 | 31047 | 26489 | 26423 | 26394 | 26356 | 26260 |
| | 27930 | 27945 | 27935 | 27973 | 27296 | 27272 | 11362 | 11368 | 9474 | 9512 | 9504 | 9538 |
| | 9470 | 11497 | 11468 | 11508 | 16454 | 30632 | 30602 | 12384 | 13330 | 16217 | 26095 | 12504 |
| | 12518 | 10370 | 30505 | 30525 | 30513 | 30515 | 30510 | 16054 | 26032 | 16061 | 16070 | 16042 |
| | 12640 | 12636 | 12635 | 12238 | 12228 | 12244 | 14942 | 14938 | 10816 | 32463 | 24104 | 27984 |
| | 27382 | 27377 | 27320 | 18003 | 28352 | 28408 | 28385 | 28140 | 28496 | 28455 | 28428 | 28325 |
| | 17574 | 17432 | 30767 | 32130 | 32128 | 33561 | 460 | 13649 | 13651 | 17626 | 30766 | 20531 |
| | 12488 | 18461 | 14447 | 16439 | 16449 | 29704 | 10205 | 33475 | 15398 | 32129 | 11548 | 31347 |
| | 17579 | 18015 | 15412 | 32864 | 1060 | 911 | 1565 | 32038 | 17665 | 14880 | 11574 | 11623 |
| | 10628 | 3678 | 3165 | 3736 | 3612 | 2891 | 2837 | 3546 | 3913 | 3083 | 3912 | 1835 |
| | 2225 | 3899 | 3920 | 2738 | 2767 | 18393 | 22157 | 29285 | 30025 | 29399 | 28932 | 29096 |
| | 10463 | 4913 | 5738 | 4637 | 5189 | 4770 | 5635 | 4145 | 5515 | 6138 | 5576 | 5577 |
| | 9044 | 9206 | 9408 | 6684 | 9239 | 6575 | 9242 | 9197 | 8857 | 8858 | 7800 | 8856 |
| | 8859 | 7931 | 9811 | 11814 | 22102 | 32670 | 32980 | 32331 | 33033 | 9978 | 32112 | 31913 |
| | 20617 | 33336 | 23708 | 21004 | 30746 | 31908 | 31906 | 31907 | 14409 | 33276 | 9965 | 21553 |
| | 28769 | 28707 | 28710 | 28708 | 28720 | 23742 | 28632 | 16521 | 16568 | 12864 | 12449 | 31203 |
| | 31196 | 31137 | 31193 | 31152 | 20526 | 32050 | 27143 | 31313 | 31329 | 31299 | 20859 | 20866 |
| | 20879 | 20877 | 20882 | 21496 | 30933 | 11041 | 12135 | 12118 | 12148 | 31534 | 12965 | 12988 |
| | 28251 | 10617 | 21749 | 21755 | 21512 | 26863 | 31444 | 31433 | 31423 | 27532 | 13164 | 13193 |
| | 13191 | | | | | | | | | | | |
| 462: | 11312 | 31372 | 20362 | 14449 | 33006 | 27650 | 33631 | 13095 | 10631 | 31804 | 10308 | 10286 |
| | 30295 | 29564 | 11184 | 24096 | 17416 | 17377 | 12588 | 29597 | 19912 | 13414 | 24934 | 18366 |
| | 13916 | 14223 | 16655 | 18581 | 14381 | 14368 | 14378 | 15666 | 14619 | 14486 | 15133 | 14972 |
| | 12941 | 9943 | 32598 | 15098 | 15535 | 15533 | 14138 | 14158 | 14160 | 17498 | 17553 | 17562 |
| | 17555 | 22449 | 22422 | 23771 | 23826 | 23823 | 17025 | 17009 | 19930 | 17832 | 17806 | 17820 |
| | 27916 | 28065 | 16295 | 16683 | 26004 | 16672 | 27602 | 16818 | 16811 | 29855 | 29841 | 16894 |
| | 29888 | 12003 | 11901 | 19215 | 17169 | 17110 | 17097 | 18617 | 18600 | 18059 | 18058 | 18041 |
| | 28517 | 28560 | 16391 | 18980 | 19045 | 19046 | 19119 | 12795 | 12080 | 18230 | 14020 | 14009 |
| | 19409 | 19410 | 19296 | 23520 | 19657 | 19659 | 24347 | 9688 | 20433 | 26760 | 26765 | 25614 |
| | 22792 | 21727 | 20775 | 32184 | 23227 | 30334 | 22368 | 12312 | 24300 | 33402 | 33401 | 21665 |
| | 22875 | 21477 | 21393 | 21283 | 23245 | 25909 | 25928 | 23908 | 25182 | 30053 | 28273 | 26965 |
| | 25228 | 27728 | 25466 | 25491 | 10702 | 10688 | 27084 | 27049 | 26419 | 26434 | 26208 | 26271 |
| | 11364 | 9485 | 11502 | 11480 | 29746 | 16456 | 16464 | 29114 | 16493 | 12393 | 13335 | 16202 |
| | 26137 | 26143 | 16209 | 16210 | 12493 | 30518 | 30532 | 30507 | 26011 | 16069 | 14900 | 14904 |
| | 14930 | 10844 | 28027 | 27317 | 10130 | 28439 | 11817 | 24814 | 13956 | 23306 | 13716 | 29717 |
| | 31989 | 33279 | 20134 | 14836 | 1687 | 14293 | 11629 | 11616 | 2247 | 3943 | 2415 | 3410 |
| | 3515 | 2946 | 3944 | 3942 | 3128 | 3100 | 3568 | 9717 | 31948 | 31947 | 22036 | 14306 |
| | 23287 | 4684 | 5897 | 8671 | 7334 | 9228 | 7857 | 6556 | 8247 | 7227 | 8435 | 6876 |
| | 10914 | 11235 | 10951 | 31622 | 19275 | 33194 | 31664 | 14086 | 28767 | 31187 | 31219 | 31321 |
| | 31315 | 31328 | 31303 | 31316 | 20884 | 20867 | 30898 | 12160 | 12985 | 12972 | 12982 | 14732 |
| | 21762 | 480 | 31540 | 13192 | 26864 | 26853 | 31426 | 15228 | 13180 | | | |
| 463: | 9801 | 33260 | 17216 | 9587 | 32516 | 32172 | 30219 | 32674 | 9944 | 33355 | 27012 | 27830 |
| | 27842 | 11819 | 11445 | 16961 | 16963 | 24833 | 16010 | 10337 | 14738 | 32809 | 32034 | 28337 |
| | 20212 | 12492 | 15932 | 23352 | 31680 | 21089 | 9774 | 10302 | 10300 | 13624 | 11178 | 20930 |
| | 32561 | 29586 | 16132 | 32986 | 32001 | 16136 | 32987 | 29583 | 16150 | 16142 | 10909 | 10897 |
| | 10888 | 10902 | 18667 | 18666 | 30406 | 10938 | 15346 | 13452 | 13438 | 13366 | 13380 | 13372 |

TABLE 2-continued

| SEQ ID NO: | homolog SEQ ID NOs | | | | | | | | | | |
|---|---|---|---|---|---|---|---|---|---|---|---|
| | 13369 | 13370 | 13365 | 13439 | 13384 | 13359 | 13393 | 12664 | 12643 | 12649 | 12680 | 12646 |
| | 12653 | 12704 | 12687 | 12691 | 12716 | 12689 | 12694 | 18262 | 18345 | 11723 | 13931 | 14549 |
| | 14536 | 14526 | 14540 | 14352 | 14365 | 15708 | 33019 | 33023 | 12905 | 29640 | 23087 | 31516 |
| | 17984 | 19035 | 19022 | 19034 | 19018 | 14154 | 22419 | 30976 | 19937 | 17822 | 17790 | 17842 |
| | 27923 | 27910 | 16234 | 16250 | 16233 | 28115 | 17697 | 17698 | 15907 | 19262 | 19246 | 17203 |
| | 17204 | 17195 | 17193 | 17473 | 17463 | 17469 | 17250 | 18038 | 28544 | 28619 | 28620 | 28555 |
| | 28520 | 28562 | 28524 | 28618 | 28593 | 18733 | 18732 | 18681 | 18749 | 18756 | 18735 | 18748 |
| | 18750 | 18696 | 18705 | 18741 | 16382 | 16331 | 19114 | 12771 | 12775 | 28911 | 18184 | 18124 |
| | 19390 | 19381 | 19398 | 19373 | 19370 | 19371 | 19411 | 18521 | 19862 | 23557 | 19567 | 19632 |
| | 19639 | 31909 | 16958 | 24546 | 24519 | 9708 | 19715 | 11443 | 15870 | 30350 | 22342 | 22309 |
| | 24314 | 33388 | 21609 | 24190 | 24176 | 24178 | 24177 | 24211 | 24188 | 23143 | 25186 | 26172 |
| | 27508 | 28824 | 28846 | 28834 | 28838 | 28823 | 28825 | 28845 | 28826 | 28839 | 26987 | 26926 |
| | 26938 | 26929 | 26932 | 26930 | 26925 | 26988 | 26919 | 26948 | 30148 | 27798 | 27083 | 27091 |
| | 27093 | 27101 | 27094 | 27095 | 27079 | 27075 | 27074 | 27034 | 27033 | 27030 | 27047 | 27050 |
| | 27044 | 27273 | 18257 | 9490 | 9536 | 9459 | 11470 | 11488 | 11521 | 11479 | 11495 | 11455 |
| | 11496 | 12365 | 12375 | 12386 | 12396 | 12401 | 12395 | 13358 | 13293 | 13306 | 13295 | 13298 |
| | 13296 | 13292 | 13288 | 13315 | 26115 | 26093 | 24589 | 17915 | 17914 | 26017 | 12239 | 14898 |
| | 14897 | 10832 | 17696 | 28155 | 28169 | 28198 | 28193 | 28166 | 28028 | 28358 | 28485 | 28432 |
| | 28319 | 28296 | 15648 | 9573 | 11428 | 20346 | 14407 | 1006 | 946 | 13627 | 11056 | 32272 |
| | 32273 | 32271 | 31941 | 11631 | 11737 | 14825 | 17232 | 23396 | 27413 | 33032 | 17939 | 33250 |
| | 20614 | 20379 | 24159 | 30482 | 24158 | 21207 | 30542 | 24931 | 27522 | 9850 | 33284 | 19183 |
| | 33277 | 11241 | 14956 | 31156 | 31149 | 31221 | 15237 | 31325 | 20862 | 9870 | 28343 | 27001 |
| | 20586 | 12983 | 12992 | 12980 | 10619 | 13786 | 24927 | 31415 | 31449 | 13198 | 13188 | |
| 464: | 23571 | 24368 | 25650 | 22753 | 1136 | 1052 | 1804 | 1763 | 2801 | 3585 | 2871 | 2872 |
| | 2802 | 2835 | 3937 | 3184 | 1990 | 2351 | 2803 | 3185 | 3737 | 30214 | 28958 | 6385 |
| | 4234 | 6139 | 4725 | 6280 | 4858 | 6342 | 6273 | 5285 | 5628 | 5513 | 7104 | 9124 |
| | 9225 | 9125 | 8920 | 7747 | 7746 | 9425 | 7916 | 8789 | 8788 | 7744 | 6943 | 7455 |
| | 8260 | 6754 | 8500 | 6972 | 6952 | 8261 | 6669 | 8964 | 7745 | 7202 | 6963 | 9224 |
| | 6824 | 9386 | 32180 | 33469 | 9855 | 9974 | 24801 | 24800 | 33298 | 16651 | | |
| 465: | 24861 | 15227 | 23325 | 20850 | 15069 | 33492 | 12210 | 30227 | 15339 | 18531 | 25064 | 17433 |
| | 13125 | 32898 | 31135 | 14843 | 14415 | 17283 | 10515 | 11261 | 31677 | 15226 | 10303 | 30292 |
| | 16121 | 26917 | 17752 | 29959 | 16160 | 31025 | 17411 | 12557 | 31590 | 33215 | 24240 | 25162 |
| | 21045 | 13431 | 12650 | 12692 | 18311 | 11727 | 13913 | 18375 | 14201 | 21035 | 18578 | 14548 |
| | 17734 | 14615 | 14607 | 17054 | 14687 | 14496 | 15194 | 15033 | 12935 | 32626 | 15095 | 19007 |
| | 15567 | 17532 | 22486 | 23800 | 15814 | 23030 | 15520 | 17823 | 28071 | 16249 | 28103 | 18781 |
| | 21187 | 16707 | 26006 | 16870 | 32379 | 27569 | 16812 | 20386 | 29853 | 15918 | 11904 | 23406 |
| | 21863 | 21862 | 20829 | 17167 | 17483 | 17095 | 18590 | 21179 | 26829 | 18073 | 28599 | 18843 |
| | 18689 | 16375 | 24778 | 18886 | 19098 | 12052 | 9894 | 17962 | 18130 | 13987 | 18495 | 19406 |
| | 19310 | 19506 | 19661 | 19746 | 29921 | 25964 | 24467 | 9702 | 20335 | 20981 | 21005 | 33175 |
| | 20547 | 20528 | 26634 | 25638 | 30133 | 21725 | 20806 | 22206 | 12344 | 30336 | 22319 | 10089 |
| | 24312 | 21014 | 33367 | 21590 | 22260 | 22861 | 21422 | 21309 | 21238 | 24195 | 23241 | 23135 |
| | 29483 | 29960 | 23928 | 25721 | 26056 | 29990 | 29998 | 23166 | 27513 | 25088 | 26586 | 24262 |
| | 28278 | 30027 | 28844 | 26981 | 25207 | 27661 | 27656 | 25326 | 10707 | 24983 | 27114 | 27059 |
| | 25288 | 27159 | 31044 | 27256 | 11360 | 27969 | 27796 | 26197 | 9527 | 12045 | 27045 | 11474 |
| | 16482 | 30624 | 12367 | 13350 | 16220 | 26156 | 12506 | 24585 | 17923 | 13275 | 10408 | 30519 |
| | 26015 | 12252 | 14921 | 10827 | 10595 | 21006 | 18247 | 18248 | 28162 | 27345 | 27349 | 28379 |
| | 28146 | 28449 | 31588 | 32873 | 32872 | 33180 | 28669 | 28668 | 17680 | 29309 | 17437 | 17224 |
| | 18373 | 30013 | 30015 | 29291 | 29290 | 13659 | 31636 | 29453 | 19733 | 11816 | 29695 | 13265 |
| | 13264 | 31578 | 18649 | 15923 | 14277 | 10539 | 19995 | 22210 | 22211 | 22212 | 19194 | 15382 |
| | 20148 | 13494 | 9575 | 10347 | 31803 | 9574 | 1727 | 856 | 1607 | 1531 | 1535 | 857 |
| | 1608 | 1328 | 1756 | 31586 | 31587 | 33052 | 10540 | 23323 | 477 | 11626 | 23063 | 4018 |
| | 3300 | 4017 | 1838 | 3286 | 3323 | 3285 | 2834 | 2570 | 4000 | 3322 | 2748 | 2267 |
| | 9733 | 32132 | 23108 | 20083 | 18469 | 33313 | 19522 | 28857 | 32011 | 32013 | 32012 | 16981 |
| | 29345 | 28933 | 29069 | 29396 | 27122 | 11656 | 20325 | 23293 | 13487 | 23019 | 14473 | 9948 |
| | 9947 | 21092 | 18523 | 20075 | 20076 | 33453 | 33451 | 33450 | 33452 | 33456 | 33454 | 33455 |
| | 32395 | 23029 | 31809 | 23027 | 23028 | 19519 | 19520 | 32550 | 19516 | 32551 | 19518 | 32549 |
| | 14435 | 19517 | 23317 | 29211 | 10537 | 21855 | 15338 | 5781 | 4835 | 6269 | 6061 | 5760 |
| | 5342 | 4734 | 4843 | 4672 | 18530 | 18529 | 5167 | 5827 | 4832 | 6433 | 5168 | 5181 |
| | 4179 | 5759 | 4270 | 4831 | 5757 | 5896 | 4833 | 4149 | 23324 | 23318 | 23320 | 23319 |
| | 9352 | 7450 | 7055 | 8444 | 7739 | 7740 | 9282 | 9280 | 8284 | 6706 | 18532 | 15340 |
| | 8752 | 7883 | 9281 | 7844 | 7306 | 8061 | 6827 | 9585 | 15926 | 16721 | 9749 | 20440 |
| | 17225 | 20253 | 13150 | 16304 | 10963 | 13626 | 30452 | 19745 | 20679 | 26828 | 32546 | 23004 |
| | 31283 | 19524 | 31589 | 15337 | 15336 | 15335 | 28740 | 16571 | 12446 | 17866 | 17865 | 17714 |
| | 17713 | 18410 | 18409 | 18408 | 18412 | 18411 | 18407 | 31584 | 31585 | 19996 | 31208 | 31312 |
| | 17936 | 20874 | 30890 | 32237 | 32179 | 13841 | 12113 | 32134 | 22556 | 32131 | 23107 | 32321 |
| | 32322 | 23109 | 32133 | 32323 | 32136 | 21517 | 21760 | 21326 | 16607 | 12187 | 22867 | 12832 |
| 466: | 14225 | 14345 | 17736 | 14579 | 14674 | 15112 | 18518 | 19714 | 9909 | 33135 | 24034 | 24483 |
| | 9706 | 22641 | 12348 | 25934 | 27486 | 24964 | 27944 | 11378 | 30606 | 30502 | 12250 | 12847 |
| | 11244 | 10822 | 32104 | 1579 | 866 | 1122 | 1098 | 1475 | 22961 | 3938 | 2107 | 3174 |
| | 3939 | 3175 | 29106 | 24677 | 20932 | 5532 | 5531 | 4892 | 4139 | 6513 | 9230 | 7235 |
| | 7859 | 32584 | 18819 | 33342 | 20715 | 19150 | 20687 | 20660 | 19147 | 10331 | 10968 | 12444 |
| | 31294 | 20856 | 28043 | 33608 | | | | | | | | |
| 467: | 24433 | 1415 | 1742 | 3346 | 2062 | 3726 | 2609 | 3727 | 3528 | 2887 | 3180 | 3154 |
| | 2082 | 2519 | 2888 | 3357 | 3394 | 3181 | 2083 | 4088 | 1886 | 1925 | 3215 | 2178 |
| | 5704 | 6142 | 4397 | 5510 | 5978 | 4238 | 4870 | 5514 | 4237 | 9087 | 6856 | 9176 |
| | 8991 | 7692 | 8829 | 6855 | 9174 | 8301 | 7679 | 8105 | 7147 | 8547 | 9175 | 7018 |
| | 8268 | | | | | | | | | | | |

TABLE 2-continued

| SEQ ID NO: | homolog SEQ ID NOs | | | | | | | | | | |
|---|---|---|---|---|---|---|---|---|---|---|---|
| 468: | 5812 | 4119 | 5257 | 7249 | 8502 | 8664 | 8836 | 8835 | 8880 | 6942 | 9129 | 14103 |
| 469: | 29336 | 29337 | 32646 | 32645 | 26606 | 26604 | 31901 | 28914 | 14237 | 21168 | 21169 | 21170 |
| | 22097 | 27430 | 30651 | 12428 | 30652 | 28341 | 15348 | 33594 | 31649 | 31648 | 32093 | 32935 |
| | 31922 | 20728 | 1702 | 1703 | 1717 | 1173 | 1359 | 3663 | 32641 | 32640 | 32642 | 32637 |
| | 32638 | 32636 | 17754 | 32644 | 32643 | 32639 | 22550 | 29022 | 23031 | 26524 | 32536 | 31644 |
| | 31645 | 23663 | 18437 | 31551 | 31348 | 28642 | 6913 | 8332 | 13286 | 26547 | 11223 | 31643 |
| | 31911 | 14189 | 13447 | 22105 | 9969 | 31552 | 22117 | 15981 | 25196 | 10930 | 10933 | 10934 |
| | 10932 | 10931 | 29458 | 32966 | 15735 | 15403 | 33320 | 9561 | 19738 | 23006 | 33489 | 24629 |
| | 27206 | 17875 | 24612 | 20121 | 17882 | 24597 | 33321 | 29329 | | | | |
| 470: | 2261 | 3392 | 2758 | 2900 | 3131 | 32029 | 5941 | 5680 | 4583 | 6986 | 7395 | 26901 |
| 471: | 30247 | 24003 | 1330 | 1528 | 912 | 3247 | 3015 | 1942 | 4086 | 2456 | 3345 | 2994 |
| | 3014 | 2457 | 1880 | 3099 | 8963 | | | | | | | |
| 472: | 22414 | 29412 | 1730 | 24942 | 3910 | 1922 | 2632 | 2555 | 3613 | 2556 | 2899 | 29016 |
| | 29104 | 29000 | 29200 | 20294 | 29252 | 29134 | 26906 | 11275 | 30394 | 20078 | 20254 | 15374 |
| | 5990 | 5907 | 5803 | 7128 | 8911 | 9397 | 6994 | 29207 | 10480 | 10481 | 18862 | 10875 |
| | 24600 | 9804 | 9541 | 11776 | 31976 | 583 | 15233 | | | | | |
| 473: | 23303 | 31003 | 11553 | 11554 | 11555 | 31546 | 22414 | 14396 | 20378 | 1420 | 3488 | 2382 |
| | 3244 | 3833 | 2429 | 2255 | 1958 | 2842 | 2428 | 2151 | 3480 | 4099 | 2856 | 3227 |
| | 2056 | 22825 | 22826 | 22823 | 22493 | 21906 | 21905 | 20582 | 21904 | 20583 | 20581 |
| | 10877 | 33242 | 33240 | 33241 | 13085 | 11556 | 11557 | 6036 | 5691 | 5587 | 4779 | 8393 |
| | 8110 | 7180 | 7150 | 6910 | 7151 | 8648 | 8112 | 7133 | 11551 | 27168 | 27167 | |
| 474: | 22618 | 23303 | 11553 | 11554 | 11555 | 31546 | 29205 | 14396 | 20378 | 14949 | 11107 | 11106 |
| | 11105 | 11103 | 11104 | 11109 | 11108 | 22826 | 20580 | 21905 | 20582 | 21906 | 21904 | 20583 |
| | 20581 | 33246 | 33244 | 11275 | 33245 | 14105 | 33247 | 33243 | 33240 | 33242 | 33241 | 33239 |
| | 30394 | 13085 | 11556 | 11557 | 5222 | 4322 | 11551 | 11552 | 10481 | 10483 | 10480 | 10482 |
| | 21094 | 27167 | 27168 | 27169 | 21913 | 21914 | 21911 | 21909 | 21912 | 21908 | 21907 | 21910 |
| | 24594 | | | | | | | | | | | |
| 475: | 33449 | 17641 | 22413 | 13717 | 1206 | 28799 | 22039 | 22040 | 17684 | 9785 | 16937 | 24638 |
| | 29235 | 6275 | 32114 | 14316 | 17263 | 33329 | 31635 | 33036 | 16027 | 17892 | 17893 | |
| 476: | 12205 | 32928 | 30726 | 27835 | 12542 | 17994 | 16100 | 11182 | 16155 | 29585 | 10900 | 12578 |
| | 13423 | 12676 | 28852 | 18351 | 18370 | 30692 | 21038 | 18558 | 15710 | 14603 | 14498 | 15186 |
| | 15026 | 12910 | 15126 | 19020 | 15532 | 17506 | 23779 | 30961 | 15515 | 17779 | 16246 | 16267 |
| | 16298 | 28092 | 18793 | 21190 | 16674 | 29863 | 16842 | 16883 | 19236 | 21883 | 17179 | 17462 |
| | 28540 | 18742 | 18685 | 24734 | 24758 | 17972 | 18110 | 14027 | 18490 | 19365 | 19309 | 19303 |
| | 19842 | 19609 | 19762 | 25972 | 20994 | 26797 | 26665 | 25649 | 21707 | 23204 | 22328 | 24311 |
| | 21011 | 22246 | 22250 | 22841 | 21292 | 21227 | 24175 | 24181 | 29965 | 24000 | 24654 | 25864 |
| | 25860 | 26584 | 24280 | 26974 | 27689 | 27792 | 27752 | 25325 | 10722 | 27109 | 26441 | 26326 |
| | 27301 | 12046 | 11514 | 12370 | 13343 | 12534 | 10399 | 14941 | 28159 | 28178 | 27365 | 28388 |
| | 28126 | 28492 | 15363 | 17996 | 13656 | 17995 | 20260 | 1826 | 1572 | 11566 | 3559 | 3470 |
| | 2359 | 4034 | 4077 | 3232 | 2505 | 2582 | 4096 | 2123 | 2360 | 3439 | 2275 | 2229 |
| | 28984 | 29253 | 5243 | 6220 | 5735 | 6623 | 8229 | 7152 | 8004 | 8023 | 10575 | 30684 |
| | 16305 | 11234 | 11161 | 14754 | 30889 | 31248 | 26873 | 31420 | 13163 | 15394 | 15475 | 24596 |
| 477: | 24861 | 15227 | 23325 | 23313 | 20850 | 33492 | 15069 | 12210 | 30227 | 18531 | 15339 | 9952 |
| | 23316 | 25064 | 33627 | 787 | 628 | 33621 | 567 | 824 | 756 | 613 | 792 | 586 |
| | 720 | 33628 | 570 | 17433 | 13125 | 794 | 32898 | 31135 | 14843 | 14415 | 17283 | 10515 |
| | 31677 | 15226 | 10303 | 30292 | 16121 | 26917 | 17752 | 29959 | 16160 | 31025 | 17411 | 12557 |
| | 31590 | 33215 | 24240 | 25162 | 21045 | 13431 | 12650 | 12692 | 18311 | 11727 | 13913 | 18375 |
| | 14201 | 21035 | 18578 | 14548 | 17734 | 14615 | 14607 | 17054 | 14687 | 14496 | 15194 | 15033 |
| | 12935 | 32626 | 15095 | 19007 | 15567 | 17532 | 22486 | 23800 | 15814 | 23030 | 15520 | 17823 |
| | 28071 | 16249 | 28103 | 18781 | 21187 | 16707 | 26006 | 16870 | 32379 | 27569 | 16812 | 20386 |
| | 29853 | 15918 | 11904 | 23405 | 23406 | 21862 | 21863 | 20829 | 17167 | 17483 | 17095 | 18590 |
| | 21179 | 26829 | 18073 | 28599 | 18843 | 18689 | 16375 | 24778 | 18886 | 19098 | 465 | 12832 |
| | 12052 | 9894 | 17962 | 18130 | 13987 | 18495 | 19406 | 19310 | 19506 | 19661 | 19746 | 29921 |
| | 25964 | 24467 | 9702 | 20335 | 20981 | 21005 | 33175 | 20547 | 20528 | 26634 | 25638 | 30133 |
| | 21725 | 20806 | 32206 | 12344 | 30336 | 22319 | 10089 | 24312 | 21014 | 33367 | 21590 | 22260 |
| | 22861 | 21422 | 21309 | 21238 | 24195 | 23241 | 23135 | 29483 | 29960 | 23928 | 25721 | 26056 |
| | 29990 | 29998 | 23166 | 27513 | 25088 | 26586 | 24262 | 28278 | 30027 | 28844 | 26981 | 25207 |
| | 27661 | 27656 | 25326 | 10707 | 24983 | 27114 | 27059 | 25288 | 27159 | 31044 | 26420 | 26323 |
| | 26197 | 27969 | 27256 | 11360 | 9527 | 12045 | 11474 | 16482 | 30624 | 12367 | 13350 | 16220 |
| | 26156 | 12506 | 24585 | 17923 | 13275 | 10408 | 30519 | 26015 | 12252 | 14921 | 10827 | 10595 |
| | 21006 | 18247 | 18248 | 28162 | 27345 | 27349 | 28379 | 28146 | 28449 | 31588 | 32872 | 32873 |
| | 33180 | 28669 | 28668 | 17680 | 29309 | 17437 | 17224 | 18373 | 30013 | 30015 | 29291 | 29290 |
| | 13659 | 31636 | 29453 | 19733 | 11816 | 29695 | 13265 | 13264 | 31578 | 18649 | 17603 | 10474 |
| | 33620 | 15923 | 14277 | 10539 | 19995 | 22212 | 22211 | 22210 | 19194 | 15382 | 13494 | 20148 |
| | 10347 | 9575 | 31803 | 9574 | 16625 | 9971 | 24627 | 19515 | 13000 | 13001 | 14795 | 31974 |
| | 1727 | 856 | 1607 | 1531 | 1535 | 1608 | 857 | 1328 | 871 | 907 | 906 | 905 |
| | 1403 | 908 | 872 | 1825 | 1398 | 1402 | 1126 | 1545 | 1401 | 1153 | 1456 | 1251 |
| | 1544 | 1376 | 1414 | 1527 | 1326 | 1756 | 1382 | 1354 | 1494 | 1399 | 1370 | 1361 |
| | 1341 | 1476 | 1587 | 1532 | 1504 | 1817 | 1623 | 1264 | 1417 | 1653 | 1543 |
| | 31586 | 31587 | 33052 | 10540 | 23323 | 23063 | 4018 | 1838 | 3300 | 3286 | 3323 | 4017 |
| | 3285 | 2570 | 2834 | 2748 | 3322 | 4000 | 2267 | 2641 | 3109 | 3386 | 3273 | 2964 |
| | 9770 | 2014 | 2319 | 2635 | 3299 | 2144 | 2961 | 2963 | 2013 | 2015 | 2898 | 10538 |
| | 2993 | 1853 | 2061 | 2105 | 9769 | 3272 | 2485 | 2214 | 2135 | 2962 | 4097 |
| | 2142 | 2617 | 2139 | 2676 | 2490 | 2257 | 2965 | 2543 | 2966 | 2289 | 2277 | 3328 |
| | 4001 | 2134 | 2143 | 1928 | 2724 | 1939 | 2130 | 2491 | 2967 | 1965 | 2140 | 2308 |
| | 2313 | 2310 | 2128 | 2193 | 1998 | 4089 | 1850 | 2480 | 2131 | 1912 | 2192 | 1851 |
| | 2592 | 2241 | 2212 | 4052 | 1849 | 2316 | 2245 | 1996 | 4048 | 2997 | 2968 | 2118 |
| | 3086 | 2133 | 1839 | 2129 | 2297 | 2486 | 2176 | 4047 | 1894 | 2479 | 2172 | 2076 |

TABLE 2-continued

| SEQ ID NO: | homolog SEQ ID NOs | | | | | | | | | | |
|---|---|---|---|---|---|---|---|---|---|---|---|
| | 2727 | 1947 | 4046 | 2208 | 4050 | 3066 | 2141 | 1892 | 1843 | 1913 | 2242 | 2179 |
| | 1833 | 1937 | 2655 | 4070 | 2251 | 2290 | 9733 | 32132 | 23108 | 20083 | 18469 | 33313 |
| | 14945 | 10076 | 19522 | 28857 | 32011 | 32013 | 32012 | 16981 | 28933 | 29345 | 29069 | 29396 |
| | 20107 | 27122 | 11656 | 20325 | 23293 | 13487 | 23019 | 14473 | 9947 | 9948 | 19901 | 13486 |
| | 21092 | 15423 | 18523 | 20075 | 20076 | 33453 | 33451 | 33450 | 33452 | 33456 | 33454 | 33455 |
| | 32395 | 23029 | 31809 | 23027 | 23028 | 19519 | 19520 | 32550 | 19516 | 32551 | 19518 | 32549 |
| | 14435 | 19517 | 23322 | 23317 | 29211 | 10537 | 21855 | 10535 | 15338 | 23677 | 23329 | 23676 |
| | 23315 | 5781 | 4835 | 6269 | 6061 | 5760 | 5342 | 4734 | 4843 | 4672 | 18530 | 18529 |
| | 5167 | 5827 | 6433 | 5168 | 4832 | 5757 | 5759 | 5896 | 5181 | 6270 | 4179 | 4270 |
| | 4831 | 4149 | 4391 | 6332 | 4833 | 4733 | 6449 | 6418 | 4300 | 4834 | 5975 | 4480 |
| | 5116 | 4324 | 4328 | 4354 | 5153 | 6314 | 6490 | 4301 | 4783 | 6465 | 4472 | 4342 |
| | 4859 | 10003 | 4218 | 4726 | 4863 | 4216 | 4230 | 4448 | 4741 | 4325 | 4337 | 4219 |
| | 4573 | 4329 | 4411 | 4473 | 4330 | 4338 | 4213 | 4720 | 4513 | 4511 | 5389 | 5388 |
| | 5165 | 4341 | 4351 | 4214 | 4514 | 5244 | 4232 | 5219 | 4451 | 4347 | 5218 | 5217 |
| | 5216 | 4542 | 4231 | 4215 | 4343 | 4607 | 4340 | 5265 | 5148 | 4487 | 4217 | 4705 |
| | 4221 | 5146 | 5145 | 4452 | 5138 | 4353 | 5523 | 4483 | 4446 | 4574 | 5251 | 5252 |
| | 5250 | 5247 | 5516 | 4786 | 4334 | 4333 | 4785 | 6464 | 6475 | 5135 | 10005 | 4449 |
| | 4947 | 6498 | 4925 | 4469 | 4413 | 4281 | 4949 | 5997 | 4946 | 4944 | 4941 | 4939 |
| | 4929 | 4930 | 4928 | 4194 | 4919 | 4918 | 4466 | 5144 | 32548 | 10534 | 23327 | 6476 |
| | 4936 | 4934 | 4932 | 5478 | 4327 | 5143 | 4223 | 4943 | 4923 | 4484 | 23328 | 4727 |
| | 4572 | 4150 | 5573 | 4942 | 4922 | 4339 | 4886 | 4455 | 4453 | 5248 | 4323 | 6392 |
| | 4512 | 4445 | 5595 | 4945 | 4938 | 4415 | 4924 | 4352 | 4901 | 6093 | 23314 | 33053 |
| | 33203 | 4822 | 5829 | 5553 | 6480 | 5481 | 4395 | 10536 | 4427 | 5537 | 4608 | 4447 |
| | 10002 | 31946 | 23324 | 23318 | 23320 | 23319 | 23312 | 23311 | 23310 | 9352 | 7450 | 7055 |
| | 7739 | 8444 | 7740 | 9282 | 9280 | 8284 | 6706 | 18532 | 7883 | 15340 | 8752 | 9281 |
| | 7844 | 7306 | 8061 | 8162 | 8699 | 8482 | 8879 | 8875 | 8872 | 8877 | 8873 | 8971 |
| | 8874 | 8161 | 8605 | 8876 | 8878 | 8917 | 8958 | 8970 | 6683 | 7480 | 7795 | 6827 |
| | 8753 | 6836 | 8102 | 7305 | 7461 | 7374 | 7888 | 7447 | 8208 | 7210 | 8349 | 8842 |
| | 7415 | 8445 | 7414 | 8159 | 7417 | 8841 | 8511 | 7979 | 7101 | 8867 | 8157 | 6596 |
| | 7386 | 6673 | 15926 | 9585 | 16721 | 9749 | 20440 | 17225 | 20253 | 13150 | 16304 | 10963 |
| | 707 | 13608 | 13609 | 13626 | 30452 | 19745 | 20679 | 26828 | 32546 | 23004 | 31283 | 19524 |
| | 31589 | 15337 | 15336 | 15335 | 33630 | 713 | 28740 | 16571 | 12446 | 17866 | 17865 | 17714 |
| | 17713 | 18410 | 18409 | 18408 | 18412 | 18411 | 18407 | 31585 | 31584 | 19996 | 31208 | 31312 |
| | 17936 | 20874 | 30890 | 32237 | 32179 | 13841 | 12113 | 786 | 32134 | 22556 | 32131 | 23107 |
| | 32321 | 32322 | 23109 | 32133 | 32137 | 32323 | 32136 | 32135 | 21760 | 21517 | 23326 | 16607 |
| | 12187 | 26867 | 11626 | | | | | | | | | |
| 478: | 22104 | 32506 | 33096 | 10175 | 23009 | 23325 | 23313 | 33209 | 27632 | 32344 | 32342 | 30238 |
| | 30245 | 30251 | 9952 | 23316 | 25813 | 25812 | 17901 | 787 | 792 | 720 | 628 | 824 |
| | 33619 | 32410 | 15867 | 32934 | 31135 | 30477 | 14171 | 17283 | 10269 | 30304 | 29574 | 26917 |
| | 11194 | 25907 | 29956 | 12593 | 16147 | 17420 | 17423 | 17396 | 17343 | 12576 | 24244 | 25159 |
| | 21069 | 11273 | 13399 | 12651 | 10579 | 28874 | 18324 | 13847 | 11705 | 12486 | 15747 | 14226 |
| | 14214 | 31881 | 18560 | 9961 | 30484 | 14354 | 19431 | 15712 | 17742 | 14625 | 14614 | 14672 |
| | 15178 | 15019 | 12928 | 32566 | 10358 | 32613 | 15105 | 15130 | 10957 | 19008 | 17540 | 17539 |
| | 23809 | 23808 | 15801 | 23030 | 28086 | 19926 | 16290 | 18779 | 21201 | 16787 | 16695 |
| | 16658 | 16845 | 16833 | 16825 | 16872 | 15917 | 29902 | 29881 | 29900 | 11938 | 11895 | 12019 |
| | 11927 | 19736 | 9625 | 9619 | 9651 | 9644 | 9633 | 9632 | 9626 | 9620 | 9617 | 9608 |
| | 9612 | 9605 | 9645 | 9636 | 9624 | 9610 | 9606 | 9602 | 9649 | 9648 | 9643 | 9638 |
| | 9631 | 9618 | 9616 | 9640 | 9637 | 9629 | 9628 | 9621 | 9615 | 9607 | 9627 | 9604 |
| | 9601 | 9650 | 9642 | 9613 | 9639 | 9630 | 9614 | 9609 | 9635 | 9603 | 9623 | 9622 |
| | 9652 | 9641 | 9634 | 9611 | 9600 | 9646 | 9647 | 17168 | 17482 | 17105 | 18063 | 28510 |
| | 18845 | 24863 | 18708 | 16351 | 24756 | 18987 | 19077 | 33623 | 33624 | 12051 | 9887 | 24822 |
| | 18118 | 18133 | 18193 | 18191 | 14035 | 14036 | 19407 | 19299 | 23428 | 19674 | 19651 | 19653 |
| | 29926 | 29917 | 10125 | 19707 | 24563 | 9714 | 20977 | 20413 | 20553 | 25651 | 30111 | 22639 |
| | 32187 | 23206 | 12355 | 30348 | 22300 | 12299 | 33414 | 21624 | 21612 | 22263 | 22236 | 22868 |
| | 22867 | 21362 | 24206 | 23140 | 23136 | 29490 | 29971 | 27196 | 23974 | 23953 | 23952 | 23944 |
| | 25171 | 26070 | 25800 | 24664 | 27482 | 30072 | 24248 | 28284 | 28288 | 30032 | 30042 | 30048 |
| | 25121 | 25204 | 27749 | 25435 | 10734 | 10773 | 24976 | 13755 | 25291 | 31076 | 31079 | 26462 |
| | 26294 | 26177 | 26194 | 27978 | 27288 | 11376 | 9502 | 9535 | 29754 | 30634 | 12418 | 13321 |
| | 16166 | 12520 | 12511 | 10388 | 30528 | 26026 | 16051 | 12631 | 12616 | 12227 | 12254 | 12234 |
| | 11253 | 10854 | 28157 | 11067 | 28036 | 27385 | 27381 | 32334 | 28462 | 33180 | 28669 | 28668 |
| | 17246 | 13073 | 13070 | 13056 | 13071 | 13057 | 13058 | 13054 | 13060 | 13075 | 13069 |
| | 13068 | 13066 | 13074 | 13076 | 13072 | 13064 | 13059 | 13062 | 13063 | 13061 | 13077 | 13067 |
| | 13078 | 13065 | 17680 | 29309 | 17708 | 11168 | 32339 | 30013 | 30015 | 14278 | 11657 | 13680 |
| | 17669 | 32563 | 15661 | 21531 | 17210 | 15496 | 31652 | 11816 | 16437 | 13265 | 13264 | 31578 |
| | 17603 | 10474 | 33620 | 14277 | 10539 | 32345 | 17588 | 16625 | 9971 | 24627 | 19515 | 13000 |
| | 13001 | 14795 | 14746 | 871 | 907 | 906 | 905 | 1403 | 908 | 872 | 1825 | 1398 |
| | 1402 | 1126 | 1545 | 1401 | 1153 | 1456 | 1251 | 1544 | 1376 | 1414 | 1527 | 1326 |
| | 1382 | 1354 | 1494 | 1399 | 1370 | 1361 | 1341 | 1476 | 1587 | 1504 | 1817 | 1623 |
| | 1264 | 1639 | 1417 | 1653 | 1543 | 32347 | 10540 | 23323 | 32343 | 32335 | 11620 |
| | 23063 | 26031 | 2641 | 3109 | 3386 | 2371 | 3273 | 2964 | 9770 | 2014 | 2319 | 2635 |
| | 3299 | 2144 | 2961 | 2963 | 2013 | 2015 | 2898 | 10538 | 2993 | 1853 | 2061 | 2105 |
| | 9769 | 3272 | 2485 | 2214 | 2718 | 2135 | 2962 | 2142 | 2617 | 2139 | 2676 | 2490 |
| | 2257 | 2965 | 2543 | 2966 | 2289 | 2277 | 3328 | 2134 | 2143 | 1928 | 2724 | 1939 |
| | 2130 | 2491 | 2967 | 1965 | 2140 | 2308 | 2313 | 2310 | 2128 | 2193 | 1998 | 1850 |
| | 2480 | 2131 | 1912 | 2192 | 1851 | 2592 | 2241 | 2212 | 4052 | 1849 | 2316 | 2245 |
| | 1996 | 4048 | 2997 | 2968 | 2118 | 3086 | 2133 | 1839 | 2129 | 2297 | 2486 | 2176 |
| | 4047 | 1894 | 2479 | 2172 | 2076 | 2727 | 1947 | 4046 | 2208 | 4050 | 3066 | 2141 |
| | 1892 | 1843 | 1913 | 2242 | 2179 | 1937 | 2655 | 2251 | 2290 | 2749 | 2132 | 3023 |

US 8,343,764 B2

TABLE 2-continued

| SEQ ID NO: | homolog SEQ ID NOs | | | | | | | | | | |
|---|---|---|---|---|---|---|---|---|---|---|---|
| | 4032 | 2373 | 9733 | 32338 | 32132 | 23108 | 20083 | 32386 | 18469 | 14945 | 10076 | 19522 |
| | 20926 | 32337 | 32340 | 32341 | 32348 | 32013 | 32012 | 32348 | 32346 | 16981 | 20107 | 20325 |
| | 23293 | 13487 | 23019 | 14473 | 19901 | 13486 | 15423 | 18523 | 20075 | 20076 | 33453 | 33451 |
| | 33450 | 33452 | 33456 | 33454 | 33455 | 32395 | 23029 | 31809 | 32336 | 33520 | 23027 | 23028 |
| | 19519 | 19520 | 32550 | 19516 | 32551 | 19518 | 32549 | 14435 | 19517 | 23322 | 23317 | 10537 |
| | 21855 | 10535 | 23677 | 23329 | 23676 | 23315 | 6270 | 5300 | 6332 | 6418 | 5296 | 5336 |
| | 4324 | 4328 | 4354 | 5153 | 6314 | 6490 | 4301 | 4783 | 6465 | 4472 | 4342 | 4859 |
| | 10003 | 4218 | 4726 | 4863 | 4216 | 4230 | 4448 | 4741 | 4325 | 4337 | 4219 | 4573 |
| | 4329 | 4411 | 4473 | 4330 | 4338 | 4213 | 4720 | 4513 | 4511 | 5389 | 5388 | 5165 |
| | 4341 | 4351 | 4214 | 4514 | 5244 | 4232 | 5219 | 4451 | 4347 | 5218 | 5217 | 5216 |
| | 4542 | 4231 | 4215 | 4343 | 4607 | 4340 | 5265 | 5148 | 4487 | 4217 | 4221 | 5146 |
| | 5145 | 4452 | 5138 | 4353 | 5523 | 4483 | 4446 | 4574 | 5251 | 5252 | 5250 | 5247 |
| | 5516 | 4786 | 4334 | 4333 | 4785 | 6464 | 6475 | 4705 | 5135 | 10005 | 4449 | 4947 |
| | 6498 | 4925 | 4469 | 4413 | 4949 | 5997 | 4946 | 4944 | 4941 | 4939 | 4929 | 4930 |
| | 4928 | 4194 | 4919 | 4918 | 4466 | 5144 | 32548 | 10534 | 23327 | 6476 | 4936 | 4934 |
| | 4932 | 5478 | 4327 | 5143 | 4223 | 4943 | 4923 | 4484 | 23328 | 4727 | 4572 | 4150 |
| | 5573 | 4942 | 4922 | 4339 | 4886 | 4455 | 4453 | 5248 | 4323 | 6392 | 4512 | 4445 |
| | 5595 | 4945 | 4938 | 4415 | 4924 | 4352 | 4901 | 6093 | 23314 | 33053 | 33203 | 4822 |
| | 5553 | 6480 | 5481 | 4395 | 10536 | 4427 | 5537 | 4608 | 4447 | 10002 | 5524 | 5482 |
| | 5783 | 5156 | 5162 | 5155 | 5139 | 4900 | 5246 | 4920 | 4716 | 31946 | 23324 | 23318 |
| | 23320 | 23319 | 23312 | 23311 | 23310 | 23309 | 6905 | 15926 | 9585 | 13820 | 31854 | 13819 |
| | 13821 | 13806 | 13815 | 11550 | 18419 | 18416 | 18415 | 18420 | 18417 | 18418 | 13816 | 13814 |
| | 13813 | 13810 | 13811 | 13812 | 13809 | 13808 | 13818 | 707 | 30753 | 22944 | 32546 |
| | 16936 | 13646 | 30866 | 31543 | 15593 | 33316 | 11855 | 33519 | 31917 | 22623 | 33630 | 713 |
| | 28751 | 28749 | 16509 | 16545 | 12455 | 17866 | 17865 | 17714 | 17713 | 18410 | 18409 | 18408 |
| | 18412 | 18411 | 18407 | 31239 | 32567 | 16719 | 31189 | 31228 | 17287 | 31324 | 17709 | 17936 |
| | 13785 | 21701 | 20861 | 30910 | 31996 | 19913 | 30462 | 12139 | 12128 | 12127 | 12124 | 28246 |
| | 31533 | 22993 | 32134 | 22556 | 32131 | 23107 | 32321 | 32322 | 23109 | 32133 | 32137 | 32323 |
| | 32136 | 32135 | 21771 | 23326 | 16593 | 12170 | 33622 | 708 | 26880 | 33616 | 32568 | 31401 |
| | 21694 | 29375 | | | | | | | | | | |
| 479: | 30405 | 18507 | 23000 | 30390 | 19528 | 19530 | 19529 | 18016 | 24798 | 17266 | 32182 | 27460 |
| | 33120 | 25346 | 33448 | 33292 | 10429 | 21526 | 20949 | 25350 | 23460 | 23480 | 23531 | 24488 |
| | 24392 | 24525 | 26714 | 26796 | 26720 | 26757 | 26702 | 25605 | 25580 | 25535 | 30765 | 22740 |
| | 31950 | 31556 | 32003 | 29286 | 10065 | 16929 | 20044 | 28912 | 27441 | 9817 | 29270 | 29274 |
| | 29322 | 11685 | 10242 | 14397 | 20050 | 20727 | 17707 | 21111 | 1680 | 24121 | 32241 | 3853 |
| | 3747 | 3852 | 3851 | 2613 | 10081 | 10359 | 29118 | 20311 | 15934 | 14850 | 19167 | 17565 |
| | 9737 | 18471 | 15615 | 15058 | 28673 | 31498 | 17695 | 25492 | 4782 | 5518 | 4156 | 22805 |
| | 7368 | 9066 | 7261 | 25338 | 18800 | 24108 | 16954 | 13260 | 33201 | 10869 | 10330 | 29392 |
| | 29394 | 29391 | 29393 | 24132 | 19533 | 19721 | 32490 | 31954 | 16939 | 27007 | 25025 | 31561 |
| | 14469 | 24786 | 11560 | 17230 | 20891 | 18541 | 10876 | 10635 | 11643 | 20704 | 20668 | 18458 |
| | 22911 | 21548 | 20961 | 32676 | 10354 | 31376 | 24640 | 13972 | 33050 | 12997 | 31930 | 10052 |
| | 10051 | 23404 | 14298 | 25022 | 33525 | 14963 | 15492 | 22085 | 22562 | 30763 | 15637 | 22959 |
| | 22957 | 22958 | 15427 | 20251 | 31454 | 16767 | 15622 | 17598 | | | | |
| 480: | 31372 | 11312 | 20362 | 33006 | 14449 | 27650 | 33631 | 13095 | 10631 | 31804 | 10308 |
| | 10286 | 30295 | 29564 | 11184 | 24096 | 17416 | 17377 | 12588 | 29597 | 19912 | 13414 | 24934 |
| | 18366 | 13916 | 14223 | 16655 | 18581 | 14381 | 14368 | 14378 | 15666 | 14619 | 14486 | 15133 |
| | 14972 | 12941 | 9943 | 32598 | 15098 | 15533 | 15535 | 14138 | 14158 | 17498 | 17553 | 17555 |
| | 22449 | 22422 | 23771 | 23823 | 23826 | 17025 | 17009 | 19930 | 17832 | 17820 | 17806 | 27916 |
| | 28065 | 16295 | 16683 | 26004 | 16672 | 27602 | 16818 | 16811 | 29855 | 29841 | 16894 | 29888 |
| | 12003 | 11901 | 19215 | 17169 | 17110 | 17097 | 18617 | 18600 | 18058 | 18059 | 18041 | 28517 |
| | 28560 | 16391 | 18980 | 19046 | 19045 | 19119 | 12795 | 12080 | 18230 | 14020 | 14009 | 19409 |
| | 19410 | 19296 | 23520 | 19657 | 19659 | 19557 | 24347 | 9688 | 20433 | 26760 | 26765 | 26697 |
| | 25614 | 22792 | 21727 | 20775 | 32184 | 32188 | 23227 | 30334 | 22368 | 12312 | 24300 | 33401 |
| | 33402 | 21665 | 22875 | 21477 | 21393 | 21283 | 23245 | 25909 | 25928 | 23908 | 25182 | 30053 |
| | 28273 | 26965 | 25228 | 27728 | 25466 | 25491 | 10702 | 10688 | 27084 | 27049 | 26419 | 26434 |
| | 26208 | 26271 | 11364 | 9485 | 11502 | 11480 | 16464 | 16556 | 16493 | 29746 | 29772 | 12393 |
| | 13335 | 16209 | 26143 | 16202 | 26137 | 16210 | 12493 | 30518 | 30532 | 26011 | 16069 | 12597 |
| | 14900 | 14904 | 10844 | 28027 | 27317 | 10130 | 28439 | 11817 | 24814 | 13956 | 23306 | 13716 |
| | 19728 | 29717 | 33279 | 20134 | 31989 | 14836 | 18534 | 1687 | 14293 | 11629 | 11616 | 2415 |
| | 3943 | 3410 | 3515 | 2946 | 3944 | 3942 | 2247 | 3128 | 2388 | 3510 | 3100 | 3568 |
| | 1971 | 3142 | 9717 | 31947 | 31948 | 22036 | 28798 | 14306 | 23287 | 4684 | 5897 | 5886 |
| | 4683 | 5734 | 6410 | 7334 | 9228 | 8671 | 7857 | 6556 | 8247 | 7227 | 8435 | 7898 |
| | 6876 | 7914 | 7226 | 6702 | 7121 | 8291 | 8058 | 9014 | 10914 | 13732 | 11235 | 10951 |
| | 31622 | 19275 | 33194 | 31664 | 14086 | 462 | 28767 | 31187 | 31219 | 31315 | 31321 | 31328 |
| | 31303 | 20884 | 20884 | 30898 | 24143 | 12160 | 12985 | 12982 | 12972 | 14732 | 21762 | 26864 |
| | 26853 | 15228 | 31426 | 13192 | 13180 | | | | | | | |
| 481: | 33462 | 12213 | 27634 | 27613 | 30217 | 760 | 30222 | 31539 | 25803 | 10349 | 13101 | 31505 |
| | 32924 | 18668 | 10345 | 21672 | 33598 | 14953 | 12537 | 23707 | 19274 | 14517 | 18628 | 19997 |
| | 15594 | 10241 | 10339 | 10340 | 26609 | 10495 | 10310 | 10275 | 10306 | 16104 | 16128 | 11175 |
| | 14422 | 29947 | 25898 | 12568 | 24838 | 24243 | 24227 | 30005 | 21075 | 13409 | 18317 | 26882 |
| | 13228 | 14212 | 21039 | 18556 | 14374 | 27120 | 15717 | 15698 | 14577 | 23896 | 17059 | 32887 |
| | 30191 | 14504 | 15196 | 15035 | 12909 | 12875 | 31377 | 32601 | 15531 | 20106 | 17529 | 22492 |
| | 15084 | 32417 | 15794 | 17028 | 30978 | 19928 | 15523 | 17795 | 17836 | 17828 | 27894 | 16294 |
| | 29821 | 16291 | 28078 | 28226 | 18792 | 16789 | 16791 | 16790 | 16679 | 16798 | 16799 | 16779 |
| | 26001 | 16863 | 16823 | 16899 | 19266 | 19248 | 19225 | 21889 | 17182 | 17088 | 18067 | 28603 |
| | 28549 | 18847 | 16369 | 24766 | 19106 | 18149 | 14033 | 14029 | 14021 | 19336 | 19814 | 23590 |
| | 19489 | 19596 | 19683 | 20483 | 29925 | 29913 | 20017 | 21927 | 15746 | 24996 | 24498 | 24390 |
| | 9678 | 20983 | 20425 | 20563 | 26653 | 25607 | 25878 | 22779 | 21720 | 20787 | 32195 | 22355 |

TABLE 2-continued

| SEQ ID NO: | homolog SEQ ID NOs | | | | | | | | | | |
|---|---|---|---|---|---|---|---|---|---|---|---|
| | 22303 | 21806 | 22856 | 21304 | 21225 | 23260 | 23257 | 24070 | 28261 | 27417 | 27190 | 23958 |
| | 25170 | 26057 | 26078 | 24653 | 25867 | 27510 | 25097 | 30026 | 26960 | 27673 | 10744 | 27110 |
| | 27055 | 13759 | 13771 | 25277 | 31047 | 26185 | 27272 | 9538 | 30632 | 30602 | 12384 | 13330 |
| | 30510 | 16070 | 12228 | 10816 | 24104 | 27984 | 27377 | 28385 | 28140 | 28455 | 28428 | 28325 |
| | 17248 | 17574 | 30767 | 32130 | 17432 | 32128 | 10529 | 33495 | 33561 | 13651 | 17626 | 30766 |
| | 20948 | 12488 | 18504 | 24025 | 14447 | 10205 | 17580 | 33475 | 911 | 1469 | 32038 | 27443 |
| | 14883 | 14880 | 14877 | 3678 | 3165 | 18393 | 30025 | 31623 | 5189 | 6406 | 6266 | 9239 |
| | 6684 | 6575 | 7452 | 7931 | 9811 | 11814 | 32670 | 32980 | 32112 | 31913 | 20617 | 21004 |
| | 9567 | 10207 | 30746 | 33276 | 9965 | 14409 | 21553 | 30485 | 28708 | 28710 | 23742 | 28632 |
| | 16568 | 12864 | 12449 | 31137 | 32050 | 27143 | 20882 | 21496 | 22109 | 11041 | 12988 | 28251 |
| | 12965 | 10617 | 21749 | 21755 | 21512 | 16599 | 12180 | 26863 | 31433 | 31423 | 27532 | 29374 |
| | 13193 | 13191 | 13164 | | | | | | | | | |
| 482: | 18506 | 982 | 1096 | 3007 | 2421 | 2343 | 28924 | 31337 | 6030 | 5727 | 4202 | 6148 |
| | 5872 | 5543 | 5287 | 5667 | 6097 | 5534 | 6287 | 5822 | 4210 | 6096 | 9128 | 8776 |
| | 9134 | 8498 | 8292 | 6954 | 9295 | 7832 | 8491 | 9205 | 7725 | 9394 | 8418 | 32517 |
| | 33035 | 15402 | 17572 | | | | | | | | | |
| 483: | 20536 | 32302 | 17639 | 17641 | 23467 | 23484 | 24336 | 24377 | 24495 | 26738 | 26699 | 26696 |
| | 26742 | 25554 | 25577 | 25528 | 22658 | 22674 | 22689 | 22413 | 1059 | 22040 | 22041 | 22039 |
| | 16937 | 17684 | 9785 | 24638 | 23347 | 23348 | 15995 | 9991 | 6275 | 5889 | 8037 | 9105 |
| | 16944 | 14868 | 11792 | 10329 | 13458 | 18533 | 20706 | 14316 | 33036 | 16027 | 14326 | 11785 |
| | 33626 | 33491 | 14328 | 14327 | 25363 | 21143 | 11787 | | | | | |
| 484: | 23483 | 23534 | 24445 | 26644 | 26722 | 26689 | 25531 | 25532 | 22645 | 18865 | 1810 | 1038 |
| | 1357 | 1042 | 1056 | 1234 | 1719 | 1389 | 948 | 1108 | 1690 | 1185 | 855 | 32398 |
| | 32397 | 3826 | 2554 | 33054 | 12749 | 11172 | 18836 | 22831 | 20644 | 19272 | 32881 | 24845 |
| | 30839 | 10000 | | | | | | | | | | |
| 485: | 1603 | 1197 | 1362 | 1707 | 1371 | 1446 | 1408 | 1063 | 1390 | 1214 | 1648 | 1507 |
| | 1225 | 1455 | 29095 | 28921 | 28922 | 29256 | 29257 | 29255 | 29183 | 28983 | 29254 | 32017 |
| | 32016 | 6098 | 6370 | 6732 | 8015 | 7962 | 9427 | 8544 | 9363 | 17877 | 11755 | 20149 |
| | 24626 | 19156 | 11756 | 30391 | 19165 | 15345 | 18868 | 15460 | 9543 | 11762 | | |
| 486: | 28661 | 1029 | 3443 | 22048 | 22047 | 29080 | 22162 | 5506 | 8147 | 8534 | 7623 | 8937 |
| | 24795 | | | | | | | | | | | |
| 487: | 18507 | 15657 | 11386 | 18016 | 27460 | 33120 | 22123 | 17997 | 21535 | 25350 | 23446 | 24478 |
| | 24523 | 26695 | 26764 | 25631 | 30765 | 22780 | 22794 | 23694 | 32003 | 28912 | 27441 | 33137 |
| | 24040 | 18528 | 29269 | 29274 | 33254 | 14397 | 12423 | 13789 | 11856 | 1461 | 1067 | 17998 |
| | 24121 | 22118 | 14252 | 24829 | 15068 | 10359 | 21992 | 29133 | 15758 | 9998 | 33531 | 33234 |
| | 10955 | 10956 | 15615 | 28673 | 10542 | 31655 | 10543 | 13615 | 17695 | 30446 | 18405 | 25338 |
| | 16029 | 17647 | 17646 | 10572 | 19925 | 31657 | 19523 | 32118 | 24132 | 19721 | 31561 | 14469 |
| | 18541 | 20678 | 19146 | 20961 | 24640 | 29454 | 14298 | 25022 | 10967 | 10332 | 22562 | 30763 |
| | 15427 | | | | | | | | | | | |
| 488: | 21160 | 23464 | 24408 | 24537 | 24340 | 26791 | 26667 | 25617 | 25632 | 25653 | 25636 | 22643 |
| | 22766 | 9795 | 25402 | 33524 | 28015 | 13717 | 1819 | 31335 | 3578 | 3450 | 4072 | 30560 |
| | 32423 | 32422 | 29228 | 30833 | 21982 | 32424 | 19902 | 10176 | 32983 | 20086 | 15242 | 15371 |
| | 23679 | 11429 | 23746 | 20853 | 4155 | 5208 | 6435 | 4771 | 4154 | 9143 | 9359 | 33095 |
| | 32108 | 30498 | 28893 | 33318 | 11328 | 24320 | 26822 | 18377 | 13242 | 20711 | 22972 | 20707 |
| | 10970 | 10964 | 14417 | 32181 | 21142 | | | | | | | |
| 489: | 33529 | 32539 | 32242 | 20358 | 32540 | 22984 | 29178 | 29222 | 29223 | 33071 | 29676 | 22217 |
| | 12269 | 10566 | 10601 | 24839 | 31900 | 23045 | 23044 | 33605 | 33604 | 33603 | 33602 | 14439 |
| | 15361 | 27827 | 15395 | 21542 | 17630 | 24135 | 18404 | 11159 | 11293 | 10295 | 11110 | 11068 |
| | 15937 | 23042 | 23041 | 23040 | 16133 | 17363 | 17424 | 17427 | 10895 | 9989 | 15610 | 15652 |
| | 12670 | 12709 | 18360 | 13861 | 13233 | 20105 | 10952 | 21527 | 11866 | 14533 | 23644 | 14372 |
| | 31232 | 14364 | 17741 | 14628 | 14678 | 14507 | 12938 | 15108 | 19027 | 15562 | 14148 | 30682 |
| | 17509 | 22458 | 22421 | 23124 | 23822 | 23784 | 27881 | 27892 | 16257 | 16284 | 28076 | 16786 |
| | 25995 | 27545 | 27575 | 16832 | 19163 | 15898 | 12013 | 21876 | 17196 | 17466 | 17450 | 18619 |
| | 18047 | 18040 | 28577 | 28528 | 31782 | 18753 | 18726 | 18717 | 16394 | 16334 | 20437 | 24712 |
| | 18923 | 18991 | 12067 | 9888 | 9878 | 9904 | 17973 | 18148 | 18153 | 18146 | 14037 | 19388 |
| | 19397 | 19818 | 23607 | 19704 | 19643 | 19682 | 19654 | 19561 | 19537 | 19575 | 20016 | 24412 |
| | 9695 | 20339 | 15584 | 30540 | 32200 | 23195 | 23187 | 23208 | 23188 | 12346 | 30325 | 22339 |
| | 12283 | 12292 | 12281 | 24298 | 21019 | 21419 | 21400 | 21455 | 21425 | 21291 | 21357 | 21337 |
| | 21226 | 21250 | 23247 | 23158 | 29964 | 27416 | 24005 | 23942 | 23172 | 25851 | 25107 | 25833 |
| | 25076 | 25841 | 28849 | 28827 | 25707 | 25665 | 25698 | 27703 | 27732 | 27780 | 27724 | 27739 |
| | 11674 | 10743 | 10790 | 10729 | 24977 | 13766 | 26503 | 26287 | 26242 | 26324 | 26365 | 26295 |
| | 27940 | 27971 | 27287 | 9531 | 10473 | 29787 | 16471 | 30644 | 12414 | 12374 | 14291 | 16188 |
| | 16218 | 26103 | 16219 | 26101 | 24578 | 24592 | 24591 | 17904 | 30512 | 16050 | 12629 | 12225 |
| | 14926 | 14944 | 10834 | 28197 | 28174 | 28168 | 28021 | 27334 | 28391 | 30724 | 32979 | 20329 |
| | 10244 | 25233 | 19511 | 33302 | 23734 | 23056 | 32535 | 25533 | 10343 | 18627 | 30698 | |
| | 11277 | 9997 | 16410 | 27433 | 956 | 997 | 1570 | 25521 | 31936 | 31999 | 11577 | 11621 |
| | 31541 | 11622 | 3647 | 21669 | 29292 | 29403 | 22139 | 22144 | 31616 | 28975 | 28974 | 30691 |
| | 30690 | 33212 | 4392 | 4965 | 9191 | 23762 | 13449 | 27520 | 27521 | 27518 | 27519 | 27517 |
| | 21926 | 10514 | 22922 | 11148 | 32542 | 15373 | 24784 | 20633 | 23049 | 23047 | 23046 | 23048 |
| | 14872 | 32571 | 27144 | 33213 | 14826 | 31800 | 28724 | 28695 | 28701 | 12452 | 31223 | 31173 |
| | 31182 | 31300 | 31307 | 31318 | 31314 | 20868 | 20880 | 11858 | 30942 | 30931 | 30900 | 30937 |
| | 20725 | 18099 | 29213 | 15929 | 11017 | 12123 | 12100 | 12979 | 23052 | 23051 | 23050 | 23053 |
| | 23043 | 23055 | 10556 | 14167 | 18470 | | | | | | | |
| 490: | 33084 | 31504 | 27620 | 30254 | 30272 | 25065 | 13122 | 13113 | 11310 | 21670 | 17692 | 32585 |
| | 30311 | 10274 | 16101 | 16129 | 24081 | 29939 | 17338 | 17307 | 17332 | 10889 | 12577 | 12570 |
| | 25157 | 21073 | 13394 | 12647 | 12690 | 31284 | 18323 | 18362 | 18559 | 18563 | 21779 | 14527 |
| | 17070 | 17050 | 14482 | 15160 | 15211 | 15163 | 15004 | 15052 | 15008 | 12894 | 32300 | 19033 |
| | 14131 | 14133 | 17550 | 23816 | 16999 | 17794 | 27903 | 29825 | 28091 | 32376 | 27539 | 27551 |

TABLE 2-continued

| SEQ ID NO: | homolog SEQ ID NOs | | | | | | | | | | |
|---|---|---|---|---|---|---|---|---|---|---|---|
| | 20500 | 25976 | 29894 | 11910 | 11955 | 11919 | 21866 | 17113 | 17134 | 28553 | 18676 | 16326 |
| | 16315 | 24725 | 18910 | 18896 | 18908 | 19135 | 12802 | 18217 | 18177 | 19346 | 19833 | 23547 |
| | 19601 | 20013 | 26682 | 26681 | 26683 | 26672 | 26676 | 25559 | 22734 | 20595 | 30368 | 24313 |
| | 21649 | 21655 | 21604 | 22291 | 22871 | 21452 | 21361 | 21246 | 30180 | 25177 | 30095 | 25087 |
| | 24252 | 24272 | 24250 | 26949 | 26532 | 27089 | 25307 | 25295 | 31041 | 26411 | 26222 | 26304 |
| | 27246 | 9511 | 11500 | 11501 | 11499 | 16477 | 19905 | 10417 | 13316 | 16205 | 17919 | 16059 |
| | 10596 | 28029 | 27335 | 27350 | 28420 | 28461 | 28498 | 13708 | 13654 | 22062 | 16612 | 15624 |
| | 14085 | 32511 | 16411 | 16434 | 14097 | 32977 | 18259 | 1034 | 23332 | 31805 | 3756 | 2285 |
| | 32076 | 17861 | 14070 | 30712 | 9735 | 17651 | 16632 | 10884 | 5614 | 6144 | 8612 | 7474 |
| | 8613 | 7476 | 8614 | 30718 | 29742 | 27524 | 22942 | 14871 | 28744 | 28680 | 16547 | 31170 |
| | 19735 | 30948 | 20588 | 20613 | 31446 | 28049 | 9674 | | | | | |
| 491: | 33464 | 27846 | 31629 | 19719 | 15168 | 15012 | 27922 | 28083 | 32355 | 19198 | 33211 | 16383 |
| | 18900 | 18111 | 19300 | 19349 | 19293 | 19334 | 23505 | 23496 | 23564 | 23614 | 23491 | 23591 |
| | 23470 | 23455 | 23495 | 23488 | 23560 | 23620 | 23636 | 23517 | 23523 | 19587 | 24337 | 24513 |
| | 24452 | 24528 | 24334 | 24454 | 24375 | 9684 | 9693 | 9710 | 20426 | 26774 | 26643 | 26704 |
| | 26786 | 26773 | 26813 | 26639 | 26652 | 25557 | 22705 | 22681 | 22767 | 22758 | 22700 | 22723 |
| | 22738 | 22763 | 22652 | 20804 | 23984 | 23994 | 27504 | 26485 | 26247 | 26288 | 12267 | 12240 |
| | 11251 | 10850 | 11245 | 10825 | 28012 | 13702 | 13711 | 29729 | 29680 | 29735 | 19469 | 1135 |
| | 1523 | 1137 | 999 | 1561 | 1460 | 1458 | 1609 | 1292 | 11607 | 3534 | 3931 | 28800 |
| | 11651 | 31367 | 31366 | 14633 | 6242 | 4527 | 8712 | 9016 | 9278 | 7792 | 7690 | 9055 |
| | 9820 | 9819 | 9919 | 31703 | 20651 | 20664 | 28812 | 33551 | 33278 | 28762 | 16506 | 29159 |
| | 29162 | 29160 | 29158 | 29161 | 18296 | 11042 | 12149 | 13215 | 13187 | 13207 | 13208 | 13154 |
| 492: | 33464 | 10059 | 27846 | 14423 | 16009 | 18431 | 14332 | 10246 | 17324 | 31629 | 19719 | |
| | 15694 | 15168 | 15012 | 23770 | 23761 | 30977 | 30975 | 17038 | 16988 | 17825 | 17758 | 17819 |
| | 27922 | 16280 | 16259 | 16258 | 16260 | 28083 | 28077 | 16781 | 32355 | 19198 | 33211 | 18752 |
| | 18755 | 18754 | 16383 | 24726 | 18900 | 18194 | 18111 | 14043 | 19349 | 19300 | 19334 | 19293 |
| | 23505 | 23491 | 23564 | 23614 | 23496 | 23620 | 19476 | 19587 | 24337 | 9684 | 9693 | 9710 |
| | 20426 | 26704 | 26774 | 26652 | 26773 | 26813 | 26786 | 26643 | 26639 | 26718 | 25557 | 22767 |
| | 22681 | 22738 | 22705 | 22758 | 22723 | 20804 | 23984 | 23994 | 27708 | 25664 | 26485 | 27292 |
| | 11492 | 11491 | 12397 | 16163 | 12267 | 12240 | 12224 | 12237 | 12236 | 11251 | 10850 | 11245 |
| | 10825 | 28192 | 28188 | 28012 | 11435 | 21206 | 9866 | 13702 | 15924 | 29729 | 29735 | 29680 |
| | 1775 | 969 | 1774 | 19710 | 29281 | 26915 | 19709 | 11607 | 2562 | 3475 | 3212 | 26884 |
| | 14633 | 8503 | 8655 | 6678 | 10465 | 9820 | 9919 | 31703 | 29741 | 29170 | 10549 | 10498 |
| | 18525 | 20664 | 20651 | 13152 | 21165 | 28812 | 33551 | 18000 | 33278 | 16506 | 29162 | 29161 |
| | 29159 | 29158 | 29160 | 11042 | 12149 | 12984 | 12947 | 13215 | 28040 | 13187 | 13207 | 13208 |
| | 13154 | | | | | | | | | | | |
| 493: | 23425 | 24501 | 22741 | 29293 | 1266 | 21966 | 4541 | 5609 | 4807 | 5873 | 5086 | 5234 |
| | 4408 | 20667 | | | | | | | | | | |
| 494: | 23095 | 23096 | 25334 | 25601 | 32260 | 32261 | 32262 | 1178 | 1616 | 1177 | 1143 | 1058 |
| | 1822 | 1657 | 1786 | 1649 | 1571 | 1321 | 1515 | 3945 | 2910 | 3363 | 4003 | 1985 |
| | 3539 | 14961 | 22031 | 29075 | 32259 | 4224 | 5291 | 4140 | 5763 | 6072 | 5346 | 5015 |
| | 5692 | 5290 | 8109 | 8688 | 7494 | 8907 | 9321 | 6909 | 6777 | 8309 | 8116 | 8449 |
| | 8310 | | | | | | | | | | | |
| 495: | 875 | 4082 | 3603 | 18851 | | | | | | | | |
| 496: | 24860 | 32169 | 14729 | 12206 | 27621 | 27630 | 30252 | 25805 | 13128 | 12217 | 31794 | 31795 |
| | 24032 | 32905 | 15745 | 32724 | 32720 | 32725 | 32723 | 32722 | 32718 | 32717 | 32719 | 30447 |
| | 32721 | 30448 | 22511 | 22510 | 22509 | 22507 | 22508 | 13252 | 27829 | 31793 | 12543 | 10516 |
| | 29419 | 29420 | 14741 | 24830 | 11237 | 30312 | 29361 | 29358 | 29357 | 24684 | 24683 | 24682 |
| | 24681 | 24680 | 24679 | 14728 | 29354 | 29363 | 29362 | 29359 | 29356 | 29364 | 29360 | 29355 |
| | 29365 | 16106 | 16127 | 27859 | 17753 | 29943 | 16159 | 31026 | 17402 | 12551 | 24223 | 25138 |
| | 21066 | 13430 | 13371 | 12673 | 12711 | 9805 | 18312 | 13874 | 21040 | 18549 | 14528 | 17053 |
| | 14688 | 14514 | 15180 | 15021 | 12898 | 32287 | 32625 | 19032 | 15548 | 17531 | 23799 | 15787 |
| | 30543 | 15516 | 28070 | 29822 | 28085 | 28105 | 28213 | 18782 | 21200 | 16865 | 32377 | 27588 |
| | 16813 | 29843 | 11994 | 19252 | 21880 | 31769 | 17184 | 17461 | 17102 | 18591 | 10796 | 18069 |
| | 28614 | 28525 | 18842 | 18690 | 16374 | 24777 | 18966 | 19041 | 12831 | 12056 | 17963 | 18190 |
| | 13993 | 14032 | 18491 | 19405 | 19342 | 23418 | 19499 | 19662 | 19750 | 20479 | 20453 | 20019 |
| | 24524 | 20342 | 20978 | 20569 | 26777 | 25604 | 25597 | 30139 | 22628 | 22650 | 21710 | 20785 |
| | 32205 | 12466 | 30371 | 22381 | 10092 | 24306 | 21013 | 33412 | 21599 | 22235 | 22860 | 21375 |
| | 24196 | 23150 | 25916 | 23929 | 25720 | 26060 | 25791 | 23165 | 14322 | 31792 | 25857 | 26596 |
| | 24263 | 28279 | 25785 | 28842 | 26931 | 30140 | 27652 | 27693 | 27758 | 25487 | 10672 | 10774 |
| | 27113 | 27100 | 25289 | 27156 | 31039 | 26417 | 26213 | 26180 | 27970 | 27255 | 9526 | 12037 |
| | 11475 | 29784 | 12390 | 13349 | 13297 | 26108 | 12507 | 24588 | 17908 | 13272 | 10392 | 10404 |
| | 26022 | 14920 | 10590 | 31785 | 15071 | 28161 | 30741 | 28003 | 27369 | 18007 | 19474 | 13451 |
| | 28129 | 28450 | 29455 | 31373 | 29422 | 29421 | 12595 | 21102 | 14323 | 14325 | 14324 | 30744 |
| | 30743 | 30483 | 22554 | 13698 | 30742 | 30730 | 16448 | 16447 | 20194 | 20264 | 15450 | |
| | 32668 | 9815 | 932 | 1477 | 934 | 933 | 863 | 1605 | 1513 | 33100 | 11586 | 11609 |
| | 2032 | 3850 | 2690 | 4019 | 27716 | 3748 | 2600 | 3000 | 2599 | 2896 | 2093 | 2417 |
| | 3540 | 3541 | 2813 | 2394 | 2156 | 2671 | 22138 | 28902 | 22013 | 31768 | 22804 | 17644 |
| | 19512 | 19513 | 13822 | 31853 | 23638 | 5107 | 5682 | 4249 | 4772 | 5037 | 6060 | 9788 |
| | 4277 | 6059 | 5489 | 6325 | 6341 | 6105 | 5683 | 4424 | 5295 | 6546 | 5441 | 4758 |
| | 6058 | 5108 | 5618 | 4899 | 4425 | 6056 | 6103 | 6057 | 5106 | 4750 | 5111 | 8337 |
| | 8593 | 9251 | 7254 | 9418 | 8922 | 7897 | 6722 | 7002 | 8786 | 9252 | 7848 | 7669 |
| | 9422 | 8178 | 7388 | 8446 | 8733 | 9337 | 8638 | 9431 | 9336 | 8072 | 8171 | 7938 |
| | 6897 | 6583 | 7577 | 7280 | 8340 | 9021 | 6873 | 7850 | 6769 | 8071 | 8070 | 8338 |
| | 8739 | 7129 | 9020 | 8069 | 8339 | 6815 | 32714 | 32558 | 13629 | 14730 | 21929 | 16300 |
| | 11420 | 18665 | 18664 | 22076 | 10204 | 29456 | 20673 | 20629 | 23668 | 32866 | 24808 | 31353 |
| | 24794 | 31391 | 20524 | 20525 | 23125 | 28682 | 29818 | 29424 | 11307 | 31207 | 15218 | 30927 |
| | 31597 | 12484 | 12114 | 21752 | 16589 | 12166 | 29423 | 26856 | 13623 | 31791 | | |

TABLE 2-continued

| SEQ ID NO: | homolog SEQ ID NOs | | | | | | | | | | |
|---|---|---|---|---|---|---|---|---|---|---|---|
| 497: | 32841 | 1705 | 3429 | 29042 | 6297 | 6112 | 7154 | 8092 | | | |
| 498: | 17069 | 9876 | 23516 | 24402 | 25600 | 22691 | 23221 | 16175 | 26153 | 26134 | 20887 | 16650 |
| | 983 | 867 | 1023 | 1660 | 1739 | 3963 | 2879 | 2059 | 22163 | 5786 | 4621 | 5952 |
| | 4582 | 5775 | 5193 | 4396 | 5399 | 9199 | 9257 | 7806 | 7454 | 7572 | 7462 | 31131 |
| | 31132 | 31130 | 31129 | 16646 | 9447 | 20640 | 14395 | 19271 | 33183 | 21588 | | |
| 499: | 901 | 1088 | 3746 | 2769 | 2420 | 1962 | 2934 | 4264 | 5943 | 5940 | 5129 | 5898 |
| | 4226 | 4888 | 4227 | 4889 | 8323 | 6741 | 7466 | 8322 | 7967 | 6765 | 9058 | 8629 |
| | 8303 | 8003 | | | | | | | | | | |
| 500: | 14296 | 22529 | 33340 | 30796 | 30810 | 20033 | 20031 | 30802 | 31638 | 9847 | 30791 | 30811 |
| | 20028 | 30823 | 20025 | 20029 | 28808 | 1714 | 1140 | 30783 | 30789 | 30792 | 30793 | 30784 |
| | 30803 | 30818 | 30815 | 30816 | 30817 | 30804 | 33111 | 17643 | 19353 | 19896 | 29100 | 13480 |
| | 13481 | 21988 | 22023 | 30788 | 30787 | 15607 | 24041 | 9438 | 15608 | 30775 | 30779 | 30785 |
| | 30780 | 30777 | 30778 | 30776 | 30795 | 30800 | 30799 | 30798 | 30797 | 30812 | 30813 | 15073 |
| | 30814 | 6041 | 6124 | 30822 | 7364 | 30805 | 30820 | 30786 | 30781 | 30819 | 30808 | 30807 |
| | 30809 | 30806 | 10067 | 14821 | 11217 | 30794 | 30801 | 30821 | 30782 | 30790 | 20030 | 20032 |
| | 11546 | | | | | | | | | | | |
| 501: | 32883 | 32753 | 32884 | 13575 | 12200 | 27622 | 17628 | 30250 | 17075 | 13114 | 32921 | 33048 |
| | 27840 | 32495 | 9808 | 16098 | 16116 | 29951 | 16144 | 29587 | 17313 | 10894 | 12586 | 24222 |
| | 30003 | 21070 | 32494 | 13362 | 12684 | 12666 | 12707 | 18369 | 18326 | 11708 | 13854 | 21028 |
| | 18569 | 14532 | 14349 | 15673 | 17724 | 14683 | 14510 | 15174 | 15016 | 12891 | 32288 | 32620 |
| | 19038 | 19026 | 15546 | 14152 | 17511 | 22452 | 22435 | 22968 | 23786 | 23820 | 15813 | 30974 |
| | 16989 | 15511 | 17814 | 17759 | 27885 | 27912 | 27884 | 28061 | 16282 | 28104 | 18778 | 21197 |
| | 16774 | 25999 | 16675 | 29864 | 27560 | 16837 | 16900 | 11976 | 15906 | 19206 | 19200 | 21873 |
| | 17209 | 17486 | 17468 | 17133 | 18616 | 12734 | 18052 | 18029 | 28580 | 28597 | 18838 | 18744 |
| | 16308 | 16347 | 24782 | 18902 | 19052 | 19133 | 12827 | 12079 | 18172 | 14050 | 18486 | 19420 |
| | 19408 | 19341 | 19781 | 19891 | 19497 | 19624 | 19678 | 19625 | 19758 | 25952 | 29916 | 9682 |
| | 20992 | 20559 | 26635 | 26636 | 25591 | 29934 | 25055 | 21709 | 32219 | 23209 | 12362 | 30315 |
| | 22350 | 32035 | 12306 | 24319 | 33380 | 33419 | 21610 | 21639 | 22247 | 22846 | 21313 | 24171 |
| | 24184 | 23162 | 24050 | 23939 | 25711 | 25744 | 26046 | 24648 | 24658 | 27480 | 30067 | 24273 |
| | 24270 | 28265 | 25789 | 28835 | 28828 | 26922 | 25211 | 25446 | 10784 | 24959 | 27078 | 25283 |
| | 31085 | 26406 | 26220 | 26193 | 11369 | 11512 | 11536 | 30605 | 30675 | 12366 | 12391 | 13357 |
| | 13289 | 16230 | 26124 | 12528 | 24573 | 17907 | 30529 | 26043 | 14901 | 10852 | 28158 | 28167 |
| | 27313 | 18006 | 28350 | 28404 | 28137 | 28436 | 28464 | 28307 | 13686 | 16431 | 17589 | 1138 |
| | 1499 | 1205 | 20450 | 11576 | 1873 | 1874 | 24859 | 3173 | 2688 | 2557 | 2766 | 1972 |
| | 3337 | 2055 | 18766 | 11155 | 21947 | 22625 | 4700 | 5838 | 4239 | 5505 | 6224 | 6346 |
| | 4699 | 5857 | 5701 | 6853 | 8334 | 8335 | 8336 | 9208 | 7591 | 7308 | 9210 | 7593 |
| | 7592 | 8622 | 7309 | 7594 | 7357 | 9209 | 8188 | 23001 | 10413 | 16720 | 33310 | 25255 |
| | 19186 | 32414 | 11387 | 14088 | 28773 | 16561 | 31136 | 31211 | 31295 | 21522 | 33125 | 30952 |
| | 31596 | 12121 | 17438 | 21768 | 16595 | 16596 | 12176 | 12177 | 21705 | 32655 | 26846 | 15468 |
| | 11750 | | | | | | | | | | | |
| 502: | 13535 | 25809 | 25143 | 21061 | 12654 | 32290 | 15771 | 29820 | 28212 | 17162 | 17449 | 18622 |
| | 12763 | 19364 | 19785 | 25053 | 25717 | 28270 | 14936 | 28176 | 28443 | 14261 | 21678 | 15379 |
| | 11765 | 891 | 1289 | 892 | 1904 | 30590 | 32009 | 4246 | 4698 | 5784 | 16542 | 31146 |
| | 21498 | 21487 | 8627 | | | | | | | | | |
| 503: | 20534 | 30289 | 20537 | 20535 | 27455 | 31523 | 31529 | 31524 | 27454 | 31531 | 31530 | 31527 |
| | 31522 | 31525 | 31520 | 31526 | 31528 | 31521 | 29416 | 20533 | 27876 | 11193 | 31092 | 24231 |
| | 15352 | 13416 | 18319 | 17060 | 14503 | 32619 | 15080 | 29849 | 29837 | 21881 | 18609 | 18730 |
| | 16330 | 24688 | 14873 | 12077 | 9902 | 19400 | 19338 | 19790 | 9677 | 20995 | 32404 | 20551 |
| | 30131 | 21722 | 12304 | 22228 | 25723 | 26058 | 27488 | 24285 | 26967 | 25688 | 25276 | 26179 |
| | 27299 | 9462 | 11494 | 29782 | 16485 | 13336 | 26119 | 26118 | 26154 | 14903 | 10815 | 28171 |
| | 28384 | 28457 | 21104 | 30736 | 1294 | 3722 | 3153 | 3721 | 3136 | 5288 | 5272 | 5273 |
| | 6117 | 5493 | 5271 | 5274 | 5656 | 4521 | 29815 | 29418 | 26826 | 31164 | 31595 | 20839 |
| | 32952 | 21765 | 29417 | 26877 | 26875 | 31434 | 9017 | 9056 | | | | |
| 504: | 21132 | 21133 | 3744 | 3208 | 2664 | 3595 | 3921 | 3753 | 1956 | 3225 | 2915 | 3444 |
| | 2264 | 2984 | 3664 | 2236 | 2665 | 3130 | 2248 | 2746 | 2183 | 2747 | 1924 | 1878 |
| | 2204 | 29132 | 29202 | 5547 | 4951 | 4952 | 5324 | 5325 | 6195 | 4164 | 4165 | 6417 |
| | 5630 | 6436 | 4676 | 6345 | 4802 | 5564 | 4673 | 4416 | 4356 | 8948 | 7597 | 7080 |
| | 8771 | 7219 | 7081 | 7218 | 6733 | 7013 | 6663 | 6996 | 8266 | 7078 | 6915 | 8244 |
| | 8140 | 7079 | 8468 | 7465 | 8560 | 7765 | 7077 | 9069 | 6670 | 8141 | 8683 | 8715 |
| | 6756 | 8013 | 6845 | 7421 | 7004 | 6927 | 6842 | 6993 | 6858 | | | |
| 505: | 13574 | 13142 | 25144 | 21081 | 15811 | 25054 | 22274 | 31088 | 25408 | 15407 | 17624 | 1392 |
| | 962 | 991 | 3907 | 3219 | 31465 | 22033 | 6444 | 4601 | 6213 | 4160 | 6196 | 4576 |
| | 4956 | 21555 | 16582 | 21502 | 21510 | | | | | | | |
| 506: | 896 | 903 | 1310 | 24942 | 2345 | 3873 | 29057 | 21948 | 11275 | 30992 | 20078 | 5120 |
| | 29206 | 18862 | 10875 | 33255 | 14794 | 32831 | | | | | | |
| 507: | 10228 | 27862 | 21849 | 15541 | 23847 | 23866 | 23884 | 23875 | 23871 | 23874 | 23855 | 23846 |
| | 23843 | 23863 | 23861 | 23868 | 23872 | 23845 | 23869 | 23842 | 23856 | 23857 | 23864 | 23849 |
| | 23880 | 23844 | 23851 | 23852 | 23878 | 23876 | 23860 | 23865 | 23854 | 23839 | 23867 | 23850 |
| | 23840 | 23858 | 23870 | 23883 | 23859 | 23873 | 23862 | 23885 | 23841 | 23853 | 23848 | 23886 |
| | 23838 | 23877 | 23882 | 23879 | 23881 | 23569 | 24482 | 25548 | 22757 | 21848 | 21813 | 21810 |
| | 21818 | 21814 | 21812 | 21811 | 21820 | 21827 | 21825 | 21819 | 21817 | 21832 | 21828 | 21841 |
| | 21829 | 21826 | 21847 | 21809 | 21846 | 21821 | 21845 | 21842 | 21835 | 21824 | 21815 | 21837 |
| | 21831 | 21816 | 21844 | 21834 | 21830 | 21833 | 21840 | 21823 | 21822 | 21836 | 21838 | 21839 |
| | 21843 | 21804 | 21805 | 27964 | 1626 | 1044 | 1636 | 1621 | 974 | 1691 | 1103 | 1710 |
| | 976 | 1781 | 3825 | 12721 | 31951 | 32015 | 32031 | 5099 | 5752 | 4407 | 5611 | 5028 |
| | 5082 | 5093 | 5021 | 5098 | 5097 | 5398 | 5096 | 5245 | 4818 | 8227 | 9284 | 9248 |
| | 8782 | 9283 | 7534 | 7711 | 7860 | 17042 | 32707 | 14254 | 20663 | 32711 | 20609 | |

TABLE 2-continued

| SEQ ID NO: | homolog SEQ ID NOs | | | | | | | | | | |
|---|---|---|---|---|---|---|---|---|---|---|---|
| 508: | 27616 | 14831 | 14224 | 14344 | 17737 | 14580 | 14675 | 15113 | 33132 | 18501 | 9908 | 27131 |
| | 19796 | 23526 | 33136 | 24033 | 24332 | 9699 | 20430 | 26712 | 25613 | 22761 | 20807 | 20764 |
| | 12349 | 24072 | 27500 | 10720 | 30164 | 24965 | 26325 | 11377 | 30607 | 30501 | 12251 | 10842 |
| | 24137 | 24136 | 15307 | 19730 | 14763 | 1437 | 1186 | 1304 | 1369 | 1788 | 1166 | 11406 |
| | 11606 | 14964 | 3929 | 3930 | 2536 | 3147 | 2537 | 1918 | 3117 | 2535 | 33258 | 28998 |
| | 29400 | 14250 | 9950 | 14855 | 6038 | 4819 | 4768 | 4431 | 6001 | 4298 | 6152 | 4299 |
| | 4381 | 4443 | 4462 | 4794 | 7056 | 8772 | 8926 | 9274 | 9273 | 6792 | 6589 | 8773 |
| | 7518 | 8297 | 6570 | 6614 | 8860 | 8861 | 32252 | 14388 | 24908 | 13461 | 10966 | 12445 |
| | 31293 | 20855 | 31276 | 11547 | 15940 | 31697 | | | | | | |
| 509: | 1231 | 1576 | 1293 | 1314 | 1176 | 2106 | 3881 | 2920 | 3882 | 3029 | 2954 | 2053 |
| | 29074 | 22026 | 29067 | 30660 | 22020 | 5693 | 5560 | 4331 | 4830 | 4383 | 6371 | 4504 |
| | 6201 | 6166 | 6523 | 5396 | 4517 | 4960 | 4860 | 8910 | 6557 | 6571 | 7176 | 8200 |
| | 7513 | 9202 | 7339 | 8199 | 7448 | 7205 | 8089 | 6802 | 8783 | 8784 | 7764 | 7477 |
| | 7026 | 7027 | 7221 | 9361 | 6744 | 8350 | 7829 | 9426 | 6870 | 8678 | 6879 | 7934 |
| | 7204 | 7608 | 7935 | 6746 | 6705 | 7997 | 6971 | 16639 | | | | |
| 510: | 29944 | 21068 | 13879 | 22476 | 17029 | 16995 | 17776 | 16702 | 16850 | 20490 | 11962 | 19238 |
| | 17205 | 18084 | 18958 | 19063 | 20469 | 25965 | 20987 | 22710 | 32185 | 32221 | 33392 | 24049 |
| | 25873 | 10673 | 10384 | 28152 | 33216 | 9721 | 13676 | 13677 | 15411 | 24639 | 11593 | 11592 |
| | 3759 | 3760 | 2755 | 2333 | 30862 | 4823 | 4398 | 4297 | 18436 | 31389 | 25499 | 21499 |
| | 30923 | 30924 | 12958 | 16610 | 12189 | 26833 | 13194 | 8363 | 9387 | | | |
| 511: | 11124 | 32402 | 17602 | 25406 | 25407 | 32527 | 15149 | 15148 | 15037 | 12933 | 27889 | 23503 |
| | 23524 | 19663 | 20357 | 24520 | 24464 | 24508 | 24554 | 24459 | 22695 | 20772 | 20771 | 12286 |
| | 9533 | 31992 | 33049 | 11650 | 32004 | 29168 | 14072 | 9996 | 31991 | 9999 | 17260 | 20127 |
| | 32660 | 32426 | 24630 | 1014 | 1277 | 11300 | 11299 | 17077 | 2859 | 2858 | 2024 | 3141 |
| | 2659 | 2661 | 22055 | 22012 | 30836 | 14752 | 14631 | 16011 | 16012 | 6291 | 6076 | 5085 |
| | 32381 | 10328 | 32382 | 18872 | 10527 | 9750 | 20656 | 13232 | 19899 | 33528 | 33564 | 24128 |
| | 23899 | 24129 | 15592 | 15639 | 31142 | 31639 | 31640 | 30495 | 30494 | 8057 | 8056 | 9400 |
| 512: | 18586 | 1522 | 3105 | 3676 | 3677 | 2312 | 3106 | 2065 | 30213 | 5484 | 5495 | 4606 |
| | 5485 | | | | | | | | | | | |
| 513: | 15400 | 14267 | 18660 | 15431 | 11745 | 14266 | 15453 | 14269 | 22966 | 11786 | 18661 | 15466 |
| | 14829 | 10222 | 11746 | 10221 | 11744 | 10220 | 14268 | 15414 | 11768 | 1366 | 2510 | 14750 |
| | 5856 | 4310 | | | | | | | | | | |
| 514: | 922 | 1154 | 1500 | 1079 | 1040 | 1435 | 6351 | 9137 | 7003 | 9136 | | |
| 515: | 15344 | 1227 | 3201 | 3711 | 3202 | 3054 | 2455 | 3712 | 22035 | 8933 | 8493 | 7917 |
| 516: | 23413 | 16467 | 879 | 2072 | 3796 | 3206 | 3579 | 3795 | 31473 | 29124 | 6252 | 5585 |
| | 6221 | 5878 | 9071 | 7272 | 9383 | 6828 | 8972 | 7464 | 9068 | 7132 | 7033 | 7358 |
| | 7825 | 6768 | 7206 | 8793 | 8396 | 7793 | 7239 | 8686 | 7082 | 7993 | 7794 | 7509 |
| | 8209 | 7335 | 6745 | 20109 | 11813 | | | | | | | |
| 517: | 30096 | 15805 | 23421 | 23458 | 24328 | 24481 | 26660 | 25608 | 22627 | 24268 | 31051 | 1659 |
| | 1658 | 1355 | 3684 | 2034 | 2481 | 2524 | 30704 | 21939 | 23900 | 24841 | 22075 | 15649 |
| | 5328 | 4260 | 5569 | 6366 | 5327 | 4417 | 8327 | 6989 | 8263 | 8765 | 8296 | 8766 |
| | 8696 | 9272 | 7849 | 8095 | 8328 | 18801 | 23744 | 32250 | 16904 | 20655 | 23680 | 28806 |
| | 32590 | 15457 | 9675 | | | | | | | | | |
| 518: | 21774 | 33090 | 27625 | 30277 | 25066 | 32920 | 13450 | 33597 | 27834 | 16628 | 16108 | 16118 |
| | 24086 | 29582 | 17409 | 12556 | 30007 | 13410 | 12698 | 18298 | 13881 | 11716 | 26883 | 14213 |
| | 18579 | 14347 | 15671 | 14590 | 14676 | 15176 | 15154 | 15017 | 14999 | 12899 | 32600 | 15119 |
| | 14123 | 22436 | 15075 | 15818 | 27886 | 16247 | 16236 | 28114 | 16696 | 27587 | 15900 | 29872 |
| | 12000 | 17178 | 17458 | 17087 | 18618 | 18030 | 18703 | 16328 | 18974 | 19134 | 12840 | 12073 |
| | 9885 | 18192 | 19401 | 19347 | 23417 | 19492 | 19623 | 24545 | 9712 | 20427 | 20576 | 26666 |
| | 25594 | 25654 | 22640 | 21706 | 20792 | 20795 | 32212 | 12360 | 30360 | 12298 | 24308 | 33417 |
| | 21643 | 22259 | 22882 | 21474 | 21462 | 21389 | 21324 | 21276 | 21271 | 24185 | 23243 | 24026 |
| | 24067 | 24008 | 30179 | 26071 | 27484 | 26581 | 24254 | 30045 | 26961 | 25690 | 25329 | 10664 |
| | 27117 | 31037 | 26404 | 26184 | 27942 | 11381 | 11471 | 30610 | 12368 | 13331 | 26109 | 26136 |
| | 12501 | 30533 | 26021 | 12628 | 12260 | 14933 | 11242 | 10818 | 28185 | 27380 | 28425 | 29708 |
| | 14946 | 11595 | 7424 | 8919 | 15869 | 23079 | 20683 | 24923 | 28743 | 12447 | 31148 | 31327 |
| | 20886 | 30929 | 21164 | 12152 | 21756 | 16608 | 12188 | | | | | |
| 519: | 24385 | 22726 | 22770 | 1237 | 1656 | 1671 | 1665 | 926 | 1410 | 5512 | 4616 | 22943 |
| | 16537 | 7023 | 7143 | 8484 | | | | | | | | |
| 520: | 27434 | 4035 | 1963 | 4421 | 5094 | 4168 | 7955 | 7763 | 8647 | | | |
| 521: | 13522 | 33039 | 1189 | 2561 | 29090 | 5130 | 5793 | 26995 | 7195 | | | |
| 522: | 1193 | 2230 | 2231 | 3391 | 30199 | 21981 | 4656 | 7167 | 15422 | | | |
| 523: | 24343 | 1346 | 1099 | 1693 | 1117 | 1540 | 1772 | 1375 | 1203 | 1204 | 925 | 2905 |
| | 3903 | 3904 | 2875 | 3905 | 2874 | 3681 | 2953 | 2314 | 2315 | 3259 | 30705 | 29018 |
| | 21940 | 29072 | 6529 | 4112 | 5899 | 6528 | 4441 | 5992 | 4884 | 4439 | 5994 | 6179 |
| | 5429 | 4883 | 5900 | 4440 | 6210 | 4177 | 6087 | 4998 | 4882 | 6495 | 4609 | 6527 |
| | 9327 | 8600 | 8346 | 7366 | 8347 | 8131 | 8115 | 7636 | 9428 | 8505 | 7854 | 7392 |
| | 7852 | 7400 | 7694 | 7401 | 9342 | 7638 | 8473 | 7640 | 6644 | 8126 | 9285 | 8348 |
| | 7211 | 7635 | 9325 | 9286 | 7252 | 9328 | 6968 | 7853 | 7273 | 7639 | 9326 | 6997 |
| | 8062 | 8899 | 6709 | 11735 | 9844 | 16985 | 29332 | 33511 | | | | |
| 524: | 26690 | 26691 | 1547 | 1593 | 3843 | 2878 | 3842 | 3089 | 29321 | 29142 | 12426 | 4953 |
| | 4959 | 6094 | 6022 | 7821 | 9163 | 7822 | 7393 | 7803 | 7286 | 6734 | 8081 | 32407 |
| | 17884 | | | | | | | | | | | |
| 525: | 1709 | 2952 | 3507 | 2619 | 14632 | 28865 | 5260 | 6277 | 5263 | 5264 | 8326 | 6917 |
| | 8680 | 6701 | 8299 | 7706 | 7905 | 6700 | 7355 | 8681 | | | | |
| 526: | 3347 | 2865 | 21994 | 6467 | 4629 | 6289 | 5677 | 6457 | 6808 | 7318 | 33104 | 15355 |
| 527: | 936 | 1164 | 1219 | 1340 | 1100 | 1496 | 1262 | 1689 | 28972 | 20281 | 28795 | 7292 |
| | 9047 | 9037 | 6553 | 17621 | 17886 | 16962 | 11772 | 31981 | 33080 | 11782 | 24613 | 33143 |
| | 24606 | 33044 | 33142 | 15734 | 19698 | 19699 | 15728 | 33145 | 33043 | 33074 | 14777 | 24634 |

TABLE 2-continued

| SEQ ID NO: | homolog SEQ ID NOs | | | | | | | | | | |
|---|---|---|---|---|---|---|---|---|---|---|---|
| | 33144 | 17889 | 32853 | 16621 | 24608 | 32845 | 33075 | 28671 | 33486 | 15880 | 33146 | 24607 |
| | 20066 | 16307 | 11740 | 17620 | 31990 | 32503 | 24930 | 11741 | 11749 | 19157 | 33077 | 29327 |
| | 22964 | 15878 | 15857 | 18239 | 17613 | 20117 | 33147 | 33076 | 33487 | 32893 | 33081 | 31916 |
| | 11790 | 33473 | 14790 | 11791 | 33082 | 32894 | 32554 | 15856 | 589 | 20110 | 32520 | 18238 |
| | 20118 | 25309 | 9563 | 33078 | 19700 | 16637 | 10223 | 11757 | 9552 | 33073 | 32829 | 11751 |
| | 26823 | 14273 | 15391 | 26918 | 11747 | 24603 | 33102 | 33083 | 24617 | 32275 | 24609 | 32851 |
| | 32836 | 15860 | 32276 | 17612 | 32834 | 11748 | 9540 | 32651 | 9542 | 9556 | 14280 | 10046 |
| | 11752 | 33483 | | | | | | | | | | |
| 528: | 1413 | 20299 | 29830 | 27422 | 27421 | 27435 | 15469 | 28786 | 21854 | | | |
| 529: | 33141 | 31510 | 33527 | 32507 | 13564 | 13577 | 13548 | 20224 | 12198 | 27614 | 27623 | 30281 |
| | 30270 | 13138 | 24124 | 9793 | 13735 | 9666 | 33447 | 27832 | 11323 | 20190 | 12422 | 32069 |
| | 32067 | 15294 | 27875 | 25903 | 24083 | 16141 | 22135 | 17403 | 17408 | 32079 | 24221 | 25156 |
| | 29152 | 13403 | 12652 | 12693 | 18332 | 32070 | 21023 | 14546 | 17739 | 14593 | 14484 | 15006 |
| | 14998 | 12920 | 19009 | 17541 | 9792 | 19772 | 21693 | 30957 | 19923 | 15619 | 15509 | 17757 |
| | 27891 | 16241 | 18795 | 21182 | 16671 | 16657 | 16856 | 16810 | 16814 | 15895 | 11995 | 19196 |
| | 32066 | 21868 | 32064 | 17158 | 32068 | 17444 | 17100 | 18612 | 15085 | 28598 | 18848 | 18719 |
| | 31545 | 16361 | 32065 | 18967 | 18973 | 19055 | 9790 | 17971 | 18109 | 18142 | 14007 | 18485 |
| | 14232 | 19391 | 19875 | 23563 | 19496 | 19493 | 19693 | 19638 | 19614 | 19751 | 20480 | 25973 |
| | 24475 | 9703 | 20334 | 20336 | 20970 | 20574 | 26658 | 25624 | 30134 | 25035 | 25883 | 24126 |
| | 22796 | 20802 | 23178 | 30344 | 30340 | 22308 | 10083 | 12295 | 22277 | 22878 | 21467 | 21377 |
| | 21310 | 21268 | 21239 | 24204 | 23254 | 23270 | 25927 | 27199 | 25174 | 25175 | 26074 | 29983 |
| | 25871 | 10800 | 28837 | 26955 | 30141 | 25260 | 27802 | 13021 | 10724 | 10776 | 30156 | 27160 |
| | 31087 | 26433 | 26345 | 26198 | 27929 | 27968 | 27290 | 12039 | 29767 | 30642 | 12420 | 13325 |
| | 12508 | 13269 | 10380 | 26010 | 12600 | 12022 | 14908 | 10826 | 10598 | 11285 | 14886 | 28186 |
| | 28470 | 31801 | 30849 | 15258 | 29714 | 32072 | 1791 | 11567 | 16726 | 16943 | 11126 | 24122 |
| | 29283 | 29314 | 21990 | 9990 | 31924 | 20592 | 11141 | 5326 | 5732 | 4847 | 8981 | 9246 |
| | 7324 | 7796 | 7675 | 8643 | 7418 | 31374 | 10892 | 33553 | 22207 | 24323 | 28231 | 10361 |
| | 32073 | 32071 | 17573 | 20223 | 14438 | 30683 | 17256 | 16530 | 29813 | 16556 | 16570 | 12435 |
| | 32997 | 31179 | 27431 | 31956 | 9959 | 30925 | 30899 | 23395 | 21022 | 29973 | 23286 | 20610 |
| | 12133 | 21754 | 21494 | 16606 | 12186 | 11441 | 26878 | 26858 | 21209 | 31436 | | |
| 530: | 27129 | 19701 | 14100 | 23726 | 31747 | 13792 | 31746 | 23725 | 27866 | 29279 | 20965 | 27582 |
| | 24694 | 19796 | 24441 | 24383 | 24437 | 20430 | 20428 | 20429 | 20406 | 20393 | 20408 | 20407 |
| | 20421 | 20411 | 20389 | 20418 | 20412 | 20416 | 20419 | 22659 | 22693 | 32186 | 28254 | 27174 |
| | 30060 | 27670 | 10669 | 10720 | 30161 | 27252 | 28405 | 22901 | 13657 | 15307 | 17078 | 10530 |
| | 32998 | 1111 | 1686 | 11147 | 31371 | 24816 | 33205 | 11603 | 11606 | 23016 | 19527 | 14870 |
| | 14425 | 14869 | 14424 | 29267 | 17943 | 17890 | 19521 | 32025 | 32019 | 32026 | 32027 | 31380 |
| | 22560 | 25504 | 17978 | 11262 | 15240 | 13280 | 18392 | 17751 | 22124 | 10098 | 10097 | 10095 |
| | 23394 | 10099 | 10096 | 18379 | 10101 | 10100 | 23393 | 10102 | 9662 | 9663 | 18386 | 18390 |
| | 18389 | 11094 | 30865 | 11439 | 32999 | 6407 | 5689 | 5853 | 5852 | 6478 | 6258 | 5353 |
| | 4280 | 6416 | 13976 | 5665 | 4136 | 5215 | 9976 | 9975 | 9110 | 8890 | 8098 | 9349 |
| | 7514 | 7300 | 9348 | 7299 | 16959 | 8368 | 9347 | 19713 | 17756 | 31555 | 18457 | 32891 |
| | 22952 | 11329 | 18381 | 18380 | 18382 | 18383 | 18387 | 18384 | 18388 | 18385 | 14094 | 14093 |
| | 18391 | 22894 | 18864 | 31733 | 31728 | 31726 | 31725 | 31724 | 31731 | 31732 | 31727 | 31729 |
| | 31723 | 31722 | 31721 | 31720 | 31730 | 21558 | 31687 | 31693 | 31690 | 31684 | 31686 | 31717 |
| | 31689 | 31688 | 31716 | 31719 | 31718 | 31715 | 11024 | 11045 | 11043 | 11046 | 11047 | 11015 |
| | 11044 | 11036 | 11026 | 11034 | 11048 | 11027 | 11035 | 31259 | 31275 | 31274 | 31276 | 31272 |
| | 31254 | 31245 | 31277 | 31250 | 31273 | 31278 | 31263 | 31244 | 31260 | 31262 | 31258 | 31270 |
| | 31266 | 20051 | 32677 | 13256 | | | | | | | | |
| 531: | 23522 | 24386 | 22651 | 2518 | 3485 | 4067 | 3159 | 2126 | 3103 | 2283 | 2681 | 3590 |
| | 29145 | 28897 | 29064 | 29065 | 6226 | 4666 | 5892 | 6214 | 6377 | 6066 | 4102 | 5114 |
| | 5498 | 7539 | 7720 | 8541 | 6558 | 19894 | 20642 | 33148 | 24631 | 14272 | 13973 | 33149 |
| | 20920 | 15864 | | | | | | | | | | |
| 532: | 1041 | 3868 | 2943 | 2763 | 2045 | 2757 | 3325 | 2377 | 3256 | 3097 | 2937 | 2591 |
| | 29251 | 30202 | 30201 | 5626 | 4646 | 5307 | 5802 | 5306 | 4258 | 4205 | 5027 | 8564 |
| | 7122 | 8083 | 8146 | 6825 | 6677 | 8734 | 7379 | 8781 | 32856 | | | |
| 533: | 929 | 1820 | 3461 | 2005 | 2699 | 2827 | 4066 | 29009 | 21952 | 30589 | 5674 | 5901 |
| | 5858 | 5805 | 6548 | 6657 | 32882 | | | | | | | |
| 534: | 30756 | 15300 | 12196 | 15223 | 13148 | 15342 | 32908 | 30300 | 29567 | 27857 | 11216 | 29941 |
| | 17412 | 12580 | 25759 | 25155 | 21059 | 13378 | 31920 | 18306 | 11715 | 13880 | 25013 | 14196 |
| | 18565 | 14373 | 17726 | 14584 | 17047 | 14682 | 15170 | 15014 | 12874 | 15117 | 15534 | 17538 |
| | 22463 | 23806 | 15768 | 15507 | 17803 | 16238 | 21193 | 16700 | 16879 | 20521 | 12004 | 19220 |
| | 17200 | 17120 | 25014 | 18093 | 28568 | 24865 | 18728 | 16324 | 29339 | 18981 | 19062 | 12835 |
| | 12078 | 9906 | 18198 | 18483 | 28809 | 15299 | 19307 | 19821 | 19655 | 29929 | 20008 | 20550 |
| | 30115 | 25030 | 20813 | 32193 | 23202 | 12359 | 30322 | 22331 | 12303 | 33384 | 21597 | 22241 |
| | 22978 | 22866 | 21395 | 21285 | 25920 | 25923 | 25176 | 26072 | 29997 | 27505 | 30051 | 25780 |
| | 26937 | 25703 | 27665 | 25431 | 10676 | 30166 | 24962 | 25299 | 31083 | 26457 | 26199 | 27238 |
| | 11485 | 29773 | 30626 | 12392 | 13304 | 26116 | 12513 | 10389 | 16085 | 14932 | 28000 | 27340 |
| | 28141 | 28499 | 24567 | 22887 | 16945 | 13714 | 29716 | 23026 | 1287 | 1207 | 1256 | 27466 |
| | 11585 | 3471 | 2992 | 3381 | 2775 | 3382 | 2674 | 2177 | 31095 | 21978 | 5980 | 6284 |
| | 4518 | 5036 | 4148 | 7890 | 7372 | 19922 | 31679 | 24922 | 24061 | 17677 | 23025 | 22616 |
| | 28683 | 16578 | 12459 | 31209 | 31297 | 30892 | 31261 | 14770 | 21742 | 21511 | 15301 | 19161 |
| | 26832 | 23304 | 13178 | | | | | | | | | |
| 535: | 31546 | 33056 | 33057 | 15420 | 14772 | 24619 | 33267 | 14804 | 979 | 24942 | 22493 | |
| | 29151 | 21949 | 21996 | 31470 | 15331 | 33240 | 11556 | 20078 | 6494 | 5241 | 5563 | 4388 |
| | 7431 | 7199 | 29207 | 11551 | 27445 | 27436 | 10480 | 10481 | 18862 | 24600 | 9804 | |
| 536: | 30017 | 30018 | 27415 | 33272 | 17896 | 22088 | 20319 | 20318 | 30478 | 23894 | 32311 | 32312 |
| | 14285 | 14284 | 29088 | 29089 | 30197 | 18250 | 14394 | 17079 | 33002 | 24803 | 6303 | 7673 |
| | 3946 | 3161 | 2935 | | | | | | | | | |

TABLE 2-continued

| SEQ ID NO: | homolog SEQ ID NOs | | | | | | | | | |
|---|---|---|---|---|---|---|---|---|---|---|
| 537: | 31349 | 13556 | 17607 | 15996 | 23291 | 33293 | 9716 | 33522 | 30216 | 14454 | 14453 | 19917 |
| | 28814 | 10805 | 31573 | 11180 | 25154 | 13404 | 22065 | 15971 | 22499 | 15077 | 17171 | 18739 |
| | 18736 | 19142 | 18998 | 18202 | 20001 | 23416 | 23600 | 23476 | 19535 | 24366 | 24511 | 24398 |
| | 24439 | 24461 | 24509 | 18855 | 18854 | 26768 | 26792 | 26621 | 26818 | 26647 | 26622 | 26784 |
| | 26749 | 25662 | 25615 | 25575 | 25661 | 25880 | 22745 | 22788 | 26956 | 10693 | 27081 | 27053 |
| | 23837 | 11538 | 12399 | 28434 | 28298 | 20361 | 14757 | 20832 | 31681 | 20833 | 28645 | 30389 |
| | 13970 | 28817 | 28815 | 28818 | 28816 | 28820 | 28819 | 28821 | 30554 | 30553 | 9718 | 16925 |
| | 16924 | 16926 | 32758 | 18284 | 19531 | 33607 | 11783 | 20131 | 11739 | 15456 | 21919 | 10151 |
| | 20126 | 21920 | 10079 | 20138 | 30773 | 19177 | 10243 | 15438 | 21922 | 32487 | 11754 | 21921 |
| | 19737 | 15432 | 13254 | 31982 | 20113 | 9551 | 29328 | 32315 | 16620 | 11767 | 20196 | 980 |
| | 996 | 1118 | 1379 | 1380 | 986 | 1814 | 1286 | 1285 | 1442 | 1202 | 1323 | 1391 |
| | 1368 | 1746 | 31914 | 19425 | 18861 | 20270 | 29297 | 17710 | 29298 | 26534 | 19724 | 31693 |
| | 18853 | 18852 | 14955 | 22204 | 3961 | 3550 | 3699 | 2402 | 3732 | 2588 | 3954 | 3024 |
| | 2534 | 3526 | 3725 | 31574 | 2398 | 2232 | 3458 | 2882 | 3813 | 3754 | 3312 | 3627 |
| | 3755 | 3719 | 3239 | 3582 | 3045 | 3782 | 4015 | 2090 | 3262 | 4036 | 3973 | 3081 |
| | 32400 | 3240 | 22986 | 18508 | 22985 | 20831 | 32970 | 9854 | 14859 | 14860 | 22052 | 30837 |
| | 20584 | 29131 | 28903 | 28904 | 28989 | 29140 | 29123 | 28990 | 29319 | 28991 | 28992 | 28926 |
| | 32418 | 29010 | 22011 | 29192 | 21971 | 21972 | 29242 | 30656 | 21997 | 28935 | 21938 | 15596 |
| | 15595 | 20840 | 29193 | 25520 | 29052 | 30838 | 29051 | 31659 | 32285 | 32286 | 23722 |
| | 31771 | 31770 | 14853 | 28882 | 32892 | 17577 | 21533 | 15497 | 21534 | 17578 | 23240 | 23017 |
| | 15892 | 23748 | 24133 | 17702 | 23749 | 32971 | 14385 | 23750 | 32086 | 28641 | 22513 | 31704 |
| | 28917 | 28349 | 17576 | 16015 | 9434 | 33568 | 13969 | 29296 | 13726 | 21161 | 32958 | 32959 |
| | 6095 | 6135 | 5828 | 4763 | 5612 | 6006 | 6132 | 5317 | 6246 | 4674 | 6007 | 5316 |
| | 4877 | 4675 | 6125 | 4162 | 5391 | 5984 | 5194 | 5681 | 5722 | 5718 | 5930 | 5425 |
| | 5574 | 4907 | 5905 | 4344 | 4130 | 6062 | 4146 | 6253 | 4225 | 7247 | 7053 | 7752 |
| | 7054 | 20721 | 8587 | 15871 | 8813 | 9082 | 8962 | 9413 | 9240 | 9144 | 8588 | 7467 |
| | 6617 | 7265 | 7631 | 7913 | 6864 | 7009 | 8362 | 7632 | 7021 | 18803 | 7378 | 6714 |
| | 8321 | 18804 | 8457 | 8906 | 8589 | 8256 | 9277 | 8763 | 8905 | 6628 | 8018 | 6800 |
| | 7062 | 7458 | 6799 | 8311 | 6889 | 8556 | 9042 | 7952 | 7159 | 9276 | 7406 | 8145 |
| | 6675 | 9229 | 20927 | 8253 | 8316 | 8590 | 7276 | 8846 | 8555 | 6655 | 8966 | 6964 |
| | 14823 | 6748 | 9043 | 8549 | 9279 | 7827 | 6577 | 8690 | 8097 | 8422 | 7828 | 28504 |
| | 19141 | 19192 | 33252 | 30771 | 20255 | 14442 | 31850 | 22925 | 32420 | 32313 | 30998 | 31937 |
| | 27427 | 24022 | 30824 | 20623 | 15478 | 19151 | 20665 | 20645 | 28908 | 22955 | 13467 | 13003 |
| | 22161 | 21554 | 28692 | 10199 | 20928 | 24792 | 31451 | 32090 | 32092 | 32091 | 9589 | 29171 |
| | 10550 | 29174 | | | | | | | | | | |
| 538: | 29208 | 13531 | 30230 | 30280 | 25810 | 13091 | 32907 | 27872 | 29955 | 17425 | 30010 | 13856 |
| | 14221 | 14359 | 17735 | 14679 | 15151 | 14992 | 12903 | 15776 | 27576 | 29834 | 9875 | 18143 |
| | 19620 | 24036 | 24350 | 25885 | 22216 | 12341 | 21653 | 22242 | 21464 | 21415 | 21399 | 21431 |
| | 21366 | 21290 | 21346 | 21236 | 21275 | 21264 | 23244 | 30092 | 25828 | 28293 | 25125 | 25710 |
| | 27763 | 27788 | 10777 | 31081 | 26476 | 26521 | 26397 | 26328 | 26360 | 11384 | 29180 | 11366 |
| | 9519 | 16457 | 26160 | 26151 | 30522 | 26029 | 26018 | 26037 | 12262 | 14910 | 28311 | 11259 |
| | 13671 | 33301 | 25495 | 1085 | 10360 | 9845 | 6071 | 6099 | 8522 | 8697 | 15724 | 7126 |
| | 8524 | 8523 | 8698 | 15725 | 14073 | 11150 | 10971 | 31879 | 31878 | 16580 | 12433 | 31289 |
| | 20875 | 30885 | 26861 | 31437 | | | | | | | | |
| 539: | 865 | 1050 | 3620 | 3849 | 2046 | 2972 | 30829 | 31476 | 22006 | 31477 | 5961 | 5654 |
| | 6965 | 8716 | 7197 | 8027 | 8028 | 9235 | 7034 | 7900 | 7443 | 8974 | 8305 | 8730 |
| | 7036 | 8428 | 7208 | 7035 | 7290 | 8653 | 33490 | 15383 | 17881 | 28332 | 32521 | |
| 540: | 14846 | 32317 | 24858 | 17213 | 27635 | 27644 | 27615 | 30253 | 10565 | 28915 | 27132 | 33465 |
| | 27133 | 28813 | 31678 | 10276 | 29563 | 11187 | 11197 | 11189 | 29588 | 17366 | 10225 | 13360 |
| | 13421 | 13381 | 18309 | 18328 | 11706 | 13848 | 15628 | 18574 | 14383 | 15682 | 15693 | 15493 |
| | 14601 | 25493 | 27458 | 15204 | 15185 | 15043 | 12923 | 33314 | 15116 | 15129 | 11644 | 15079 |
| | 15788 | 30967 | 17766 | 17796 | 27893 | 27917 | 27921 | 16276 | 29827 | 16292 | 32362 | 27557 |
| | 15916 | 20487 | 20506 | 11952 | 11934 | 11916 | 19199 | 17170 | 17481 | 17094 | 18056 | 28522 |
| | 18673 | 18734 | 16318 | 24721 | 24763 | 24722 | 18937 | 19048 | 12768 | 12785 | 10462 | 18183 |
| | 18199 | 19378 | 19304 | 19829 | 19869 | 19846 | 19830 | 23578 | 23465 | 19608 | 19647 | 19538 |
| | 19641 | 19588 | 29914 | 24380 | 24449 | 24353 | 20572 | 26662 | 26638 | 25596 | 25606 | 25560 |
| | 22682 | 22701 | 22772 | 32226 | 32220 | 23229 | 23199 | 12300 | 21607 | 22233 | 22271 | 22220 |
| | 22248 | 22265 | 24216 | 23151 | 24055 | 27183 | 23950 | 23967 | 23930 | 30175 | 25749 | 30176 |
| | 30187 | 30076 | 28831 | 26920 | 26972 | 26939 | 25225 | 25221 | 27795 | 27794 | 25318 | 25317 |
| | 13027 | 11673 | 10731 | 10691 | 26531 | 27076 | 27099 | 27088 | 27045 | 26502 | 26379 | 26307 |
| | 27934 | 27243 | 27269 | 27244 | 11374 | 11371 | 9537 | 11535 | 16487 | 30636 | 12410 | 11341 |
| | 13307 | 16228 | 26094 | 12503 | 17920 | 30500 | 12639 | 12226 | 12265 | 28182 | 28184 | 28196 |
| | 28415 | 28416 | 28446 | 28467 | 28448 | 28308 | 28304 | 13653 | 9722 | 29718 | 16443 | 16444 |
| | 29719 | 16445 | 9773 | 9667 | 1674 | 1187 | 1396 | 11569 | 22152 | 20300 | 30463 | 14554 |
| | 26542 | 26540 | 17716 | 20956 | 4631 | 5551 | 4547 | 5725 | 4183 | 4815 | 9050 |
| | 7453 | 7289 | 7140 | 9254 | 9146 | 7946 | 7360 | 17044 | 9848 | 24031 | 32537 | 23003 |
| | 26603 | 26543 | 26539 | 33471 | 26538 | 26536 | 15980 | 25017 | 25018 | 24789 | 20697 | 20713 |
| | 20671 | 20677 | 14165 | 24825 | 14570 | 18657 | 16517 | 29796 | 16562 | 31308 | 20854 | 30847 |
| | 26999 | 12132 | 12966 | 10620 | 10610 | 16603 | 31399 | 31405 | 31430 | 3667 | 2362 | 2932 |
| | 2017 | 2294 | 4002 | 3245 | 2390 | 2923 | | | | | | |
| 541: | 14847 | 33198 | 13532 | 20846 | 27626 | 30225 | 15868 | 13147 | 33574 | 14643 | 14650 | 14649 |
| | 14648 | 14647 | 14646 | 14661 | 14659 | 14660 | 14642 | 14664 | 19428 | 11417 | 21673 | 18297 |
| | 14838 | 10252 | 10325 | 30299 | 30305 | 16125 | 29569 | 11188 | 17345 | 17375 | 10881 | 12584 |
| | 12575 | 12574 | 12562 | 33214 | 9868 | 21180 | 13437 | 13377 | 18310 | 11712 | 13868 | 13885 |
| | 11717 | 13855 | 12854 | 13947 | 10646 | 14220 | 15463 | 18568 | 18550 | 14520 | 25199 | 14581 |
| | 33022 | 15132 | 14971 | 12924 | 21583 | 17242 | 32629 | 19000 | 15545 | 17497 | 17504 | 17494 |
| | 22423 | 23777 | 23773 | 23825 | 30986 | 15612 | 17769 | 17857 | 28056 | 28113 | 16699 | 32367 |
| | 32364 | 27567 | 15894 | 29908 | 20514 | 11948 | 12016 | 18440 | 18442 | 23412 | 17441 | 17153 |

TABLE 2-continued

| SEQ ID NO: | homolog SEQ ID NOs | | | | | | | | | | |
|---|---|---|---|---|---|---|---|---|---|---|---|
| | 18042 | 28600 | 28579 | 18751 | 16332 | 24727 | 18934 | 18920 | 19137 | 12813 | 18200 | 18175 |
| | 18164 | 18145 | 18208 | 14011 | 19402 | 19835 | 23714 | 23525 | 23554 | 23548 | 23479 | 23419 |
| | 23573 | 23461 | 19593 | 19556 | 20010 | 21915 | 16627 | 24345 | 24521 | 24544 | 24339 | 24420 |
| | 24372 | 24484 | 24426 | 24534 | 24388 | 24536 | 24460 | 24548 | 24382 | 24564 | 17988 | 20565 |
| | 22981 | 26767 | 26808 | 26805 | 26750 | 25564 | 25598 | 25562 | 25625 | 25589 | 25626 | 25886 |
| | 22661 | 22660 | 22784 | 22685 | 22697 | 20810 | 32215 | 23228 | 23183 | 30352 | 30365 | 33431 |
| | 21618 | 22568 | 23010 | 22275 | 22293 | 22270 | 22876 | 21270 | 23656 | 23977 | 23945 | 23941 |
| | 25872 | 27502 | 27489 | 25079 | 25831 | 26594 | 24260 | 30030 | 30152 | 27711 | 27730 | 27778 |
| | 27815 | 25458 | 13032 | 10680 | 27082 | 27067 | 13763 | 13748 | 26513 | 26399 | 26466 | 26446 |
| | 26472 | 26204 | 26354 | 27226 | 11379 | 9457 | 29764 | 30677 | 13356 | 13303 | 12522 | 12526 |
| | 17921 | 22546 | 22547 | 22545 | 16079 | 12632 | 27127 | 27423 | 27995 | 27330 | 28392 | 28447 |
| | 23088 | 18519 | 18515 | 13662 | 13719 | 13689 | 13652 | 33182 | 13488 | 30749 | 14639 | 14644 |
| | 14645 | 14667 | 15259 | 14446 | 19771 | 24813 | 16407 | 29727 | 16398 | 16420 | 13620 | 23021 |
| | 23022 | 11818 | 29265 | 18992 | 24125 | 1520 | 989 | 1795 | 10352 | 10351 | 32429 | 10350 |
| | 32428 | 23696 | 10795 | 27464 | 11625 | 3679 | 2095 | 3544 | 33459 | 28797 | 20302 | 32176 |
| | 32178 | 32177 | 32175 | 29061 | 29048 | 21970 | 32174 | 9595 | 14851 | 9957 | 33300 | 20925 |
| | 21580 | 32968 | 33184 | 17668 | 22415 | 14556 | 14555 | 21162 | 6459 | 4810 | 5850 | 4743 |
| | 6101 | 6359 | 6203 | 5186 | 4808 | 5737 | 4534 | 6028 | 4610 | 4132 | 5987 | 9090 |
| | 7707 | 7230 | 9085 | 8108 | 8360 | 9214 | 6848 | 8288 | 7283 | 7502 | 9314 | 9313 |
| | 7158 | 7684 | 7685 | 11864 | 11863 | 11865 | 11862 | 22395 | 11276 | 33358 | 15343 | 16301 |
| | 15054 | 29427 | 22540 | 22538 | 22539 | 22537 | 33516 | 14401 | 29737 | 15820 | 32811 | 22543 |
| | 22542 | 22544 | 22541 | 31500 | 31501 | 31912 | 31865 | 14295 | 20619 | 20689 | 20634 | 20714 |
| | 33140 | 22945 | 22536 | 22534 | 22535 | 31563 | 22956 | 31453 | 24989 | 24988 | 24990 | 13240 |
| | 32880 | 11405 | 25195 | 9719 | 28778 | 28766 | 29792 | 14638 | 14652 | 14651 | 14653 | 14654 |
| | 31140 | 20890 | 14663 | 25194 | 25193 | 25192 | 11030 | 12122 | 24326 | 12953 | 22999 | 16600 |
| | 12181 | 12191 | 24926 | 14641 | 14640 | 14662 | 14655 | 14656 | 14658 | 14657 | 14666 | 14665 |
| | 9586 | 13210 | 11811 | | | | | | | | | |
| 542: | 26605 | 31901 | 26907 | 21170 | 22097 | 27430 | 23034 | 15348 | 15347 | 31649 | 31648 | 31922 |
| | 32935 | 20728 | 23033 | 10203 | 23032 | 1168 | 1075 | 11170 | 2957 | 18233 | 4059 | 2286 |
| | 32640 | 32641 | 17754 | 32644 | 32643 | 32639 | 29275 | 20310 | 28794 | 10191 | 21098 | 23086 |
| | 30840 | 18437 | 17977 | 5255 | 8654 | 24907 | 31643 | 28907 | 31911 | 9969 | 10200 | 22117 |
| | 25196 | 31905 | 10935 | 15458 | 18761 | 32942 | | | | | | |
| 543: | 25362 | 13552 | 27610 | 30226 | 25806 | 13124 | 32569 | 32913 | 9594 | 27844 | 10326 | 16099 |
| | 16119 | 25902 | 16151 | 17399 | 10886 | 12567 | 24233 | 10517 | 22064 | 21044 | 13364 | 12685 |
| | 18307 | 13862 | 21024 | 18555 | 17064 | 14485 | 15155 | 15000 | 12892 | 32622 | 19004 | 15543 |
| | 14156 | 17551 | 22477 | 23818 | 15789 | 30987 | 17858 | 27901 | 16283 | 28097 | 16686 | 25992 |
| | 16855 | 27541 | 16841 | 29848 | 11990 | 21861 | 10184 | 17165 | 17445 | 17103 | 18623 | 18082 |
| | 28519 | 18686 | 16312 | 18969 | 19087 | 12762 | 12062 | 18174 | 14006 | 19363 | 19320 | 19784 |
| | 19498 | 19619 | 19752 | 20468 | 25974 | 20988 | 20554 | 25041 | 21708 | 32202 | 23180 | 30357 |
| | 22307 | 12275 | 24316 | 21021 | 33399 | 21640 | 22262 | 22872 | 21458 | 21328 | 21244 | 24182 |
| | 23152 | 25918 | 23916 | 25718 | 26048 | 29986 | 24670 | 30069 | 26587 | 24279 | 30031 | 26924 |
| | 25666 | 27808 | 25430 | 10781 | 25272 | 31032 | 26410 | 26223 | 26192 | 27949 | 12035 | 11528 |
| | 29756 | 29765 | 12412 | 13291 | 16206 | 26122 | 26142 | 10367 | 16046 | 12605 | 12025 | 18641 |
| | 14937 | 28177 | 28004 | 27315 | 18005 | 28389 | 28139 | 28442 | 28301 | 14333 | 13684 | 16435 |
| | 1492 | 11581 | 2631 | 2919 | 2379 | 2041 | 3152 | 3157 | 2459 | 3436 | 3379 | 2215 |
| | 3384 | 2125 | 5924 | 4393 | 7463 | 7367 | 6914 | 33003 | 28757 | 16543 | 31145 | 20200 |
| | 22572 | 31663 | 30950 | 31607 | 31606 | 29977 | 12153 | 10624 | 11156 | 21741 | 16590 | 12167 |
| | 13725 | 26852 | 31427 | 13211 | 24616 | 33488 | | | | | | |
| 544: | 19645 | 1824 | 1039 | 1498 | 3196 | 3275 | 3691 | 2127 | 3209 | 2645 | 5761 | 5876 |
| | 6712 | 9035 | 7293 | 9158 | 9034 | 7493 | 9157 | | | | | |
| 545: | 19162 | 31134 | 32246 | 13618 | 27640 | 30273 | 33558 | 13145 | 13116 | 30844 | 15375 | 32930 |
| | 32900 | 30759 | 28919 | 17590 | 10418 | 10419 | 10420 | 11128 | 30685 | 32166 | 18240 |
| | 11127 | 30546 | 16091 | 16126 | 16957 | 15358 | 15357 | 30396 | 11208 | 30444 | 24074 | 29589 |
| | 17320 | 10896 | 12579 | 29596 | 25760 | 12218 | 18315 | 24856 | 12745 | 11430 | 18564 | 15721 |
| | 17056 | 14671 | 14494 | 14492 | 14502 | 15182 | 15023 | 12946 | 32605 | 29219 | 14118 | 22472 |
| | 22488 | 22485 | 22475 | 26573 | 22439 | 15083 | 15082 | 23766 | 15781 | 16251 | 16231 | 16278 |
| | 16274 | 16263 | 16279 | 16270 | 29823 | 28117 | 28108 | 16662 | 16673 | 29861 | 27590 | 16834 |
| | 16802 | 16876 | 16901 | 15901 | 15914 | 21871 | 21891 | 21875 | 17206 | 17096 | 17142 | 17093 |
| | 17132 | 12731 | 18087 | 18688 | 24714 | 24775 | 19112 | 19102 | 19097 | 19084 | 12064 | 19417 |
| | 19822 | 19883 | 23528 | 23602 | 23487 | 19503 | 20471 | 25950 | 29912 | 20462 | 25011 | 20394 |
| | 20544 | 25616 | 25056 | 22703 | 20778 | 23205 | 30356 | 22337 | 22362 | 22357 | 24309 | 21010 |
| | 33418 | 33406 | 33405 | 33421 | 33397 | 21656 | 22287 | 24172 | 23331 | 25910 | 25933 | 25743 |
| | 26053 | 29981 | 29989 | 29985 | 25874 | 29996 | 24671 | 30089 | 30036 | 30039 | 25694 | 27659 |
| | 13043 | 24969 | 13758 | 25286 | 31700 | 31036 | 26333 | 26358 | 27239 | 27249 | 11373 | 9521 |
| | 11462 | 11461 | 11520 | 29781 | 30620 | 30615 | 30625 | 12379 | 17905 | 10405 | 10374 | 26039 |
| | 12620 | 12248 | 14928 | 10845 | 11249 | 10837 | 28164 | 27346 | 28412 | 28153 | 28144 |
| | 28130 | 28453 | 28488 | 28305 | 16949 | 13673 | 31116 | 30731 | 20228 | 23299 | 33601 | 16401 |
| | 26574 | 1180 | 1386 | 11617 | 3962 | 19286 | 2909 | 2497 | 2340 | 2187 | 22148 | 22137 |
| | 28930 | 11007 | 6508 | 4189 | 4875 | 5470 | 4659 | 4190 | 4365 | 4658 | 4657 | 6319 |
| | 4460 | 9084 | 7730 | 7731 | 7563 | 7092 | 20354 | 22621 | 9809 | 32662 | 32663 | 26577 |
| | 15723 | 33038 | 33589 | 26161 | 31780 | 15087 | 27138 | 20680 | 16035 | 10924 | 20577 | 27124 |
| | 33017 | 28713 | 16558 | 12432 | 26576 | 26575 | 19170 | 30955 | 22609 | 12101 | 16586 | 12163 |
| | 31431 | 31442 | 14854 | | | | | | | | | |
| 546: | 1481 | 1343 | 22000 | 29011 | 5535 | 5562 | 4869 | 8423 | 9421 | 9389 | 8884 | 7001 |
| | 8300 | 9324 | 7533 | 8525 | 8441 | 6649 | 6892 | 6781 | 10146 | 9550 | | |
| 547: | 23459 | 24532 | 25530 | 955 | 910 | 3854 | 3654 | 3529 | 6108 | 7343 | 9102 | 8038 |
| | 8402 | 8834 | 6801 | 9101 | 22101 | 33510 | 32633 | 33283 | 10045 | | | |

TABLE 2-continued

| SEQ ID NO: | homolog SEQ ID NOs | | | | | | | | | | |
|---|---|---|---|---|---|---|---|---|---|---|---|
| 548: | 23427 | 24436 | 26641 | 25620 | 20132 | 32653 | 21210 | 15232 | 33472 | 2058 | 3632 | 2411 |
| | 2033 | 29189 | 29059 | 5070 | 4287 | 6518 | 6413 | 4915 | 5047 | 6183 | 5071 | 7703 |
| | 9123 | 9097 | 8040 | 8957 | 6662 | 8041 | 7460 | 8546 | 7940 | 8938 | 14960 | 20643 |
| | 9653 | | | | | | | | | | | |
| 549: | 25570 | 15753 | 17623 | 14774 | 31107 | 14575 | 6600 | | | | | |
| 550: | 30664 | 25358 | 32575 | 32576 | 11458 | 22100 | 9442 | 22916 | 22915 | 27850 | 27841 | 33457 |
| | 15059 | 10287 | 10259 | 10247 | 10299 | 10270 | 11195 | 11185 | 12724 | 29591 | 16148 | 16137 |
| | 29590 | 16146 | 16145 | 17372 | 17304 | 17314 | 17311 | 17413 | 17407 | 17380 | 17394 | 17297 |
| | 17390 | 17357 | 17405 | 17349 | 17318 | 17301 | 10906 | 10880 | 9818 | 13386 | 13385 | 13382 |
| | 12699 | 18334 | 18325 | 18348 | 18357 | 18335 | 18352 | 18358 | 13917 | 13886 | 24114 | 15353 |
| | 15354 | 14519 | 15719 | 15679 | 15704 | 15674 | 15701 | 15709 | 17728 | 14578 | 14600 | 14493 |
| | 15159 | 15202 | 15188 | 15171 | 15003 | 14986 | 15028 | 15015 | 32293 | 32303 | 32306 | 15110 |
| | 19014 | 14136 | 14124 | 14119 | 17524 | 17522 | 17528 | 23781 | 23793 | 17010 | 30960 | 16990 |
| | 17033 | 30958 | 17017 | 17039 | 30963 | 17036 | 19936 | 19934 | 15616 | 17777 | 17760 | 17843 |
| | 17771 | 17818 | 17856 | 16268 | 16293 | 16253 | 16296 | 16269 | 16288 | 28109 | 28220 | 16768 |
| | 16670 | 25994 | 16664 | 32380 | 27561 | 27553 | 27562 | 27566 | 16804 | 16817 | 16805 | 16829 |
| | 16839 | 15910 | 15913 | 29438 | 29437 | 29441 | 29440 | 25977 | 20499 | 29873 | 20501 | 29904 |
| | 29875 | 29883 | 25982 | 29903 | 20496 | 11991 | 11909 | 11958 | 12001 | 12005 | 11912 | 11940 |
| | 11886 | 11970 | 11939 | 12018 | 11981 | 19201 | 19214 | 19241 | 19211 | 21870 | 17791 | 17202 |
| | 17474 | 17479 | 18601 | 12742 | 12736 | 12739 | 12729 | 28570 | 28572 | 28531 | 28566 | 28609 |
| | 28596 | 28573 | 28616 | 18698 | 18702 | 18713 | 18723 | 18745 | 18672 | 18694 | 18712 | 16393 |
| | 16387 | 24739 | 24700 | 24695 | 24705 | 24703 | 24748 | 24757 | 18986 | 18911 | 18988 | 12778 |
| | 12764 | 12765 | 12822 | 12834 | 12774 | 12781 | 12770 | 14019 | 19385 | 19380 | 19850 | |
| | 19801 | 19806 | 19804 | 19857 | 19848 | 19861 | 23570 | 23589 | 23475 | 23497 | 23434 | 23443 |
| | 19488 | 19628 | 19564 | 19636 | 19552 | 19635 | 19555 | 19577 | 24562 | 9696 | 20417 | 26785 |
| | 26800 | 26633 | 26801 | 26680 | 26674 | 26673 | 22684 | 30316 | 22352 | 22311 | 22351 | 22358 |
| | 22333 | 22377 | 22354 | 24301 | 21636 | 21668 | 21606 | 22261 | 22855 | 22854 | 24213 | 24174 |
| | 24214 | 24209 | 24212 | 24215 | 29478 | 25930 | 28258 | 28260 | 28257 | 27418 | 24001 | 23981 |
| | 25722 | 30177 | 25191 | 25188 | 30189 | 25715 | 25714 | 27511 | 27512 | 27478 | 25853 | 25835 |
| | 25104 | 30087 | 25077 | 26598 | 26942 | 26941 | 26940 | 25223 | 25673 | 25684 | 27706 | 27682 |
| | 27766 | 27748 | 10756 | 27108 | 27119 | 27063 | 27056 | 27037 | 26479 | 26474 | 26449 | 26408 |
| | 26437 | 26456 | 26447 | 26248 | 26366 | 26234 | 26318 | 26339 | 26317 | 26251 | 26296 | 26389 |
| | 26266 | 26218 | 26355 | 26252 | 27279 | 27266 | 27253 | 27283 | 27281 | 27214 | 27277 | 27289 |
| | 9495 | 11533 | 11527 | 11478 | 11498 | 11515 | 16458 | 29747 | 30599 | 30672 | 12417 | 12373 |
| | 12371 | 12372 | 12385 | 12407 | 12364 | 13310 | 13309 | 13351 | 13308 | 26133 | 12516 | 12517 |
| | 18824 | 12266 | 14943 | 14907 | 28207 | 28163 | 28201 | 28203 | 28014 | 28398 | 28354 | 28400 |
| | 28372 | 28353 | 28369 | 28472 | 28463 | 28489 | 28473 | 28494 | 28466 | 28320 | 28302 | 21101 |
| | 31699 | 17872 | 13694 | 13693 | 30653 | 4336 | 6172 | 6134 | 6328 | 5874 | 5228 | 4636 |
| | 7426 | 8149 | 7442 | 7573 | 7006 | 9115 | 9114 | 8988 | 9207 | 10917 | 11272 | 18809 |
| | 18832 | 18833 | 18831 | 23657 | 21175 | 20638 | 18455 | 26881 | 23350 | 13805 | 14246 | 14283 |
| | 33001 | 20435 | 29515 | 29504 | 29517 | 29449 | 29448 | 29516 | 29447 | 29503 | 29518 | 29450 |
| | 29520 | 29514 | 29522 | 29519 | 29451 | 23038 | 13645 | 11854 | 24123 | 29506 | 29556 | 29512 |
| | 29529 | 29429 | 29511 | 29432 | 29558 | 29434 | 29430 | 29433 | 29553 | 29552 | 29550 | 29431 |
| | 29551 | 29527 | 29436 | 29435 | 29446 | 29439 | 29442 | 29509 | 29557 | 29444 | 29443 | 29559 |
| | 29555 | 29554 | 29445 | 29513 | 29539 | 29534 | 29535 | 29536 | 29538 | 29537 | 29531 | 29532 |
| | 29540 | 29533 | 29530 | 29521 | 29507 | 29541 | 29545 | 29523 | 29549 | 29543 | 29546 | 29547 |
| | 29526 | 29524 | 29505 | 29542 | 29525 | 29528 | 29548 | 29544 | 29510 | 29561 | 29562 | 29560 |
| | 29508 | 28689 | 28705 | 28761 | 28704 | 28714 | 28770 | 28679 | 28756 | 23743 | 12865 | 31167 |
| | 31160 | 11859 | 11032 | 31267 | 31247 | 31249 | 12146 | 28244 | 12948 | 28252 | 12955 | 31532 |
| | 28245 | 10615 | 10618 | 10609 | 12169 | 13218 | 31408 | 31402 | 31416 | 31409 | 31404 | 31429 |
| | 13158 | 13155 | 13206 | 13182 | | | | | | | | |
| 551: | 23506 | 26685 | 26687 | 26795 | 25611 | 15467 | 18759 | 24624 | 25365 | 15408 | 19357 | 7559 |
| | 8416 | 8728 | 9168 | 8844 | 7884 | 22209 | 17983 | | | | | |
| 552: | 24486 | 26748 | 26746 | 26747 | 25599 | 22722 | 25379 | 21677 | 20227 | 11810 | 32830 | 882 |
| | 3869 | 2399 | 3770 | 2658 | 3855 | 2517 | 10503 | 10504 | 29250 | 29034 | 20841 | 5089 |
| | 5366 | 5608 | 5965 | 4442 | 6479 | 4634 | 5397 | 4708 | 9116 | 8691 | 7536 | 9138 |
| | 7496 | 8790 | 8791 | 7743 | 31240 | 14257 | 27004 | 24947 | | | | |
| 553: | 20817 | 1766 | 3123 | 3139 | 2621 | 3250 | 3324 | 2719 | 29128 | 5063 | 6035 | 5668 |
| | 5637 | 5064 | 8413 | 7871 | 8711 | 7674 | 6810 | | | | | |
| 554: | 18506 | 982 | 1096 | 1281 | 1226 | 3919 | 3918 | 3032 | 3925 | 3178 | 28977 | 29139 |
| | 30711 | 31337 | 5727 | 6148 | 6097 | 6030 | 4202 | 5872 | 9295 | 7832 | 8292 | 8491 |
| | 9128 | 8776 | 7864 | 6954 | 6585 | 9205 | 7725 | 9394 | 7434 | 6549 | 32517 | 33035 |
| | 33327 | 33265 | | | | | | | | | | |
| 555: | 30490 | 9787 | 24992 | 13546 | 31872 | 32703 | 32702 | 32704 | 31904 | 27618 | 32743 | 32693 |
| | 32741 | 32738 | 32689 | 32745 | 32695 | 32747 | 32697 | 11055 | 14342 | 14340 | 30991 | 29462 |
| | 29474 | 29473 | 29471 | 29469 | 29464 | 29463 | 29461 | 29472 | 29468 | 29467 | 29465 | 29470 |
| | 29466 | 21565 | 21561 | 21566 | 21564 | 21562 | 21563 | 21567 | 17222 | 633 | 13102 | 15761 |
| | 31493 | 15947 | 16973 | 19951 | 11292 | 10253 | 33349 | 17330 | 31287 | 13877 | 13929 | 12852 |
| | 13945 | 22533 | 23036 | 20213 | 19777 | 19775 | 19778 | 13005 | 15706 | 15198 | 15201 | 14990 |
| | 14987 | 12919 | 12924 | 12914 | 14798 | 17503 | 22453 | 23776 | 17770 | 19950 | 19943 | 19941 |
| | 19949 | 19948 | 19945 | 19942 | 19946 | 19944 | 19947 | 27918 | 16777 | 33613 | 25983 | 11972 |
| | 17159 | 31491 | 31492 | 17119 | 17155 | 19971 | 19973 | 19962 | 19970 | 19969 | 19964 | 19967 |
| | 19966 | 19965 | 19961 | 19968 | 19974 | 19963 | 19972 | 19956 | 19955 | 19953 | 19954 | |
| | 12726 | 18051 | 28569 | 16384 | 18906 | 19111 | 18213 | 18231 | 14013 | 14047 | 23714 | 23502 |
| | 19779 | 19604 | 19649 | 19681 | 19670 | 29928 | 20011 | 20009 | 22976 | 17869 | 17868 | 26770 |
| | 25660 | 25049 | 22729 | 22373 | 21598 | 22296 | 21392 | 23160 | 29477 | 23917 | 23987 | 23992 |
| | 23955 | 24642 | 29994 | 25815 | 25109 | 25839 | 24259 | 30155 | 27697 | 27767 | 25473 | 11663 |
| | 13042 | 10675 | 13738 | 31059 | 26427 | 26263 | 9493 | 12523 | 16075 | 12259 | 28187 | 28032 |

TABLE 2-continued

| SEQ ID NO: | homolog SEQ ID NOs | | | | | | | | | | |
|---|---|---|---|---|---|---|---|---|---|---|---|
| | 15366 | 15362 | 15364 | 32729 | 22522 | 22515 | 22516 | 22517 | 32736 | 32734 | 31683 | 32877 |
| | 17946 | 28331 | 33498 | 33502 | 14271 | 32827 | 14071 | 33530 | 32828 | 13661 | 32393 | 26162 |
| | 10161 | 10162 | 10155 | 10156 | 10157 | 10159 | 10160 | 10158 | 10163 | 10154 | 31751 | 31750 |
| | 32876 | 20185 | 28330 | 17954 | 17950 | 17951 | 17956 | 17953 | 17949 | 20158 | 13015 | 31753 |
| | 31752 | 31748 | 31749 | 31755 | 31754 | 31756 | 31766 | 31765 | 31763 | 31764 | 31757 | 31758 |
| | 31762 | 31761 | 31760 | 31759 | 29268 | 31494 | 32513 | 31490 | 16427 | 21001 | 17234 | 17239 |
| | 15949 | 17948 | 17955 | 22090 | 11832 | 11831 | 10477 | 32957 | 32956 | 32875 | 32874 | 17952 |
| | 17947 | 33503 | 33504 | 22098 | 23911 | 23907 | 23905 | 23906 | 23913 | 33500 | 33499 | 23904 |
| | 23902 | 23901 | 23903 | 11833 | 11835 | 11834 | 11841 | 11839 | 11842 | 11845 | 11846 | 11848 |
| | 11847 | 11840 | 11836 | 11851 | 11843 | 11838 | 11844 | 11849 | 11850 | 11837 | 32878 | 17945 |
| | 33501 | 20159 | 33497 | 16931 | 21576 | 21574 | 21575 | 21211 | 11449 | 9853 | 10441 | 18651 |
| | 17659 | 14445 | 32460 | 14443 | 10440 | 15451 | 14444 | 14805 | 15406 | 9441 | 24636 | 24595 |
| | 13736 | 15731 | 14270 | 29333 | 28860 | 15474 | 14281 | 15434 | 15730 | 32844 | 32502 | 1787 |
| | 1767 | 874 | 32438 | 23074 | 14292 | 33281 | 11584 | 9797 | 11630 | 32871 | 3988 | 3280 |
| | 3989 | 2729 | 2918 | 2324 | 1938 | 2716 | 3284 | 1905 | 15927 | 3643 | 3885 | 3447 |
| | 23334 | 24853 | 3670 | 2623 | 2295 | 2222 | 3111 | 2189 | 2239 | 3821 | 3625 | 4075 |
| | 2237 | 2044 | 3502 | 3884 | 3446 | 3950 | 2426 | 2540 | 3344 | 4026 | 2939 | 2071 |
| | 3504 | 2590 | 2571 | 2019 | 3990 | 3194 | 2980 | 3680 | 3454 | 2602 | 3805 | 17237 |
| | 17240 | 31489 | 20222 | 15630 | 31889 | 31888 | 22143 | 14769 | 28995 | 28963 | 22004 |
| | 28964 | 21968 | 21969 | 32680 | 20282 | 29110 | 21902 | 32728 | 32682 | 17629 | 31871 | 32701 |
| | 16965 | 16966 | 15945 | 11070 | 11080 | 16964 | 16968 | 16967 | 15950 | 17609 | 11081 | 11082 |
| | 11073 | 11084 | 11071 | 11072 | 11085 | 11086 | 11083 | 15948 | 16974 | 33115 | 9730 | 33116 |
| | 31877 | 27442 | 19467 | 19468 | 9731 | 9840 | 9591 | 31885 | 21569 | 21572 | 21570 | 21573 |
| | 21571 | 21568 | 14824 | 14339 | 23073 | 21900 | 21901 | 21899 | 21898 | 32726 | 32681 | 32635 |
| | 13479 | 21903 | 32737 | 32686 | 32744 | 32694 | 32735 | 22526 | 22520 | 22525 | 22519 | 32685 |
| | 32732 | 22521 | 32683 | 32727 | 32730 | 10979 | 10978 | 29628 | 29629 | 29633 | 29632 | 29630 |
| | 29631 | 32244 | 21680 | 5729 | 5819 | 6067 | 6431 | 5918 | 4797 | 5555 | 5421 | 5921 |
| | 4799 | 4798 | 30397 | 5920 | 5203 | 4796 | 5422 | 5424 | 5919 | 5917 | 4208 | 6175 |
| | 4244 | 4795 | 6288 | 5058 | 5554 | 5647 | 5904 | 5906 | 5849 | 5971 | 6176 | 5423 |
| | 5556 | 5443 | 5014 | 5053 | 6177 | 5818 | 4581 | 6194 | 5206 | 33348 | 10194 | 6707 |
| | 7909 | 6719 | 8574 | 9266 | 9267 | 7704 | 9265 | 9330 | 6721 | 7875 | 13446 |
| | 23005 | 6639 | 9332 | 30192 | 8526 | 7708 | 7153 | 9333 | 8942 | 9011 | 7604 | 9133 |
| | 32533 | 7812 | 8217 | 8216 | 7216 | 30662 | 8604 | 30661 | 6626 | 7754 | 7602 | 7603 |
| | 9232 | 7606 | 7600 | 7601 | 8724 | 8129 | 7373 | 7607 | 8527 | 7179 | 8941 | 7834 |
| | 7067 | 8218 | 7887 | 7605 | 7817 | 9139 | 7266 | 7645 | 8985 | 7259 | 8324 | 8538 |
| | 7099 | 11658 | 11115 | 10195 | 10198 | 10197 | 10196 | 17241 | 31014 | 13008 | 13009 | 19362 |
| | 13014 | 20171 | 31387 | 33496 | 32580 | 13017 | 20165 | 20166 | 20164 | 20160 | 20161 | 20162 |
| | 13016 | 20163 | 20170 | 20168 | 20169 | 16654 | 20172 | 20173 | 20175 | 20174 | 20176 | 20180 |
| | 20177 | 20178 | 20179 | 20181 | 20184 | 20182 | 20183 | 13778 | 13779 | 21537 | 22749 | 30727 |
| | 13733 | 13238 | 31890 | 31887 | 31886 | 32434 | 22431 | 32432 | 32433 | 32462 | 32435 |
| | 14244 | 22523 | 22524 | 22518 | 22918 | 16645 | 33282 | 10976 | 17235 | 17236 | 15212 | 23069 |
| | 23064 | 32457 | 32456 | 32594 | 22919 | 22909 | 16970 | 15946 | 17610 | 16972 | 16971 | 15951 |
| | 15952 | 16969 | 28738 | 32731 | 17658 | 17655 | 17656 | 17652 | 17654 | 17653 | 17657 | 32443 |
| | 23065 | 23067 | 29800 | 32733 | 32684 | 32705 | 11077 | 31873 | 11079 | 11074 | 11076 | 11078 |
| | 11075 | 32706 | 31870 | 31869 | 32698 | 31868 | 32699 | 32700 | 18294 | 18290 | 18274 | 18276 |
| | 18275 | 18273 | 18278 | 18272 | 18277 | 18271 | 18293 | 18291 | 18289 | 18295 | 18286 | 18282 |
| | 18283 | 18285 | 18281 | 18280 | 18279 | 18269 | 18270 | 18268 | 23061 | 23059 | 18266 | 18264 |
| | 18267 | 18288 | 18292 | 18287 | 18265 | 32440 | 32441 | 19976 | 19983 | 19975 | 19988 |
| | 19985 | 19981 | 19982 | 19979 | 19980 | 19987 | 19990 | 19984 | 19977 | 19989 | 19986 | 23070 |
| | 32444 | 20167 | 30939 | 30904 | 18647 | 18648 | 18646 | 10023 | 10019 | 10020 | 10021 | 10017 |
| | 10018 | 10022 | 18479 | 18478 | 18482 | 18480 | 18475 | 18474 | 18481 | 18477 | 10012 | 10013 |
| | 10014 | 10011 | 10010 | 10016 | 10015 | 10009 | 20370 | 20371 | 20374 | 20373 | 20375 | 20372 |
| | 20369 | 20368 | 18476 | 31691 | 32746 | 32696 | 32740 | 32739 | 32690 | 23071 | 23066 | 32447 |
| | 32449 | 32448 | 23068 | 23072 | 32446 | 32453 | 32597 | 32596 | 32595 | 32437 | 32436 | 32442 |
| | 32450 | 32451 | 32452 | 32454 | 32455 | 32459 | 32458 | 32461 | 32430 | 32439 | 32445 | 32742 |
| | 32692 | 32687 | 32688 | 32691 | 11018 | 31251 | 12143 | 31246 | 12130 | 12954 | 19958 | 19957 |
| | 19959 | 19960 | 665 | 13171 |
| 556: | 13561 | 10281 | 14343 | 15702 | 12901 | 30681 | 17007 | 17800 | 28075 | 27548 | 16888 | 19222 |
| | 28547 | 24742 | 18982 | 18950 | 18953 | 18103 | 17571 | 19853 | 23568 | 23437 | 19559 | 19591 |
| | 25004 | 24391 | 25887 | 22644 | 12278 | 21387 | 24045 | 25090 | 10749 | 13751 | 26522 | 26380 |
| | 26216 | 27209 | 16164 | 30503 | 27397 | 27400 | 27316 | 28382 | 27401 | 11264 | 30772 | 27394 |
| | 27403 | 30703 | 27392 | 27393 | 17700 | 10794 | 31957 | 20128 | 14796 | 33270 | 1190 | 1443 |
| | 14881 | 13018 | 27396 | 3916 | 2692 | 2137 | 28986 | 4848 | 6251 | 4159 | 6347 | 8577 |
| | 8811 | 7926 | 32328 | 31862 | 10152 | 20351 | 20350 | 27395 | 32664 | 19149 | 20632 | 33233 |
| | 27402 | 23728 | 23729 | 31642 | 18805 | 28691 | 29793 | 20857 | 16592 | 18806 | 10613 | 10612 |
| | 27399 | 27398 | 27391 | 26870 | 27019 | 13176 |
| 557: | 27607 | 13135 | 32914 | 16095 | 29579 | 17421 | 12587 | 13419 | 12663 | 12703 | 12717 | 13887 |
| | 20527 | 18580 | 14508 | 15205 | 15044 | 32297 | 14130 | 22470 | 22430 | 19929 | 17792 | 16684 |
| | 16854 | 27574 | 29838 | 15909 | 29896 | 20522 | 11922 | 12009 | 19227 | 21858 | 17157 | 17160 |
| | 17472 | 17442 | 17122 | 18595 | 18089 | 18022 | 28556 | 15979 | 18808 | 16390 | 31960 | 24719 |
| | 24717 | 18878 | 18927 | 19068 | 19066 | 12798 | 12801 | 12793 | 17969 | 18114 | 19337 | 19313 |
| | 19298 | 19820 | 19825 | 19827 | 19816 | 23432 | 19485 | 25937 | 25967 | 24491 | 24355 | 24430 |
| | 24429 | 20985 | 26771 | 22635 | 21719 | 20594 | 22348 | 22360 | 12294 | 24303 | 33387 | 33389 |
| | 21615 | 21441 | 21457 | 21316 | 21245 | 29485 | 27192 | 25726 | 29987 | 24669 | 25083 | 24276 |
| | 26970 | 27762 | 25454 | 10728 | 27060 | 25302 | 31089 | 26359 | 27237 | 27235 | 27224 | 9469 |
| | 11534 | 13339 | 13287 | 26128 | 10377 | 30508 | 16086 | 14896 | 14924 | 28026 | 28390 | 28411 |
| | 28128 | 13678 | 16405 | 1554 | 1771 | 1393 | 1134 | 1150 | 1046 | 1783 | 1602 | 1748 |
| | 1782 | 1363 | 1597 | 1599 | 1755 | 1584 | 1809 | 1451 | 1156 | 1757 | 1068 | 931 |

TABLE 2-continued

| SEQ ID NO: | homolog SEQ ID NOs | | | | | | | | | | |
|---|---|---|---|---|---|---|---|---|---|---|---|
| | 1806 | 11591 | 3282 | 3071 | 3148 | 29098 | 6037 | 4111 | 5323 | 7696 | 7093 | 31692 |
| | 9782 | 21202 | 11874 | 9776 | 28684 | 28759 | 28775 | 13799 | 32389 | 20940 | 11224 | 30946 |
| | 11876 | 28248 | 11230 | 11231 | 14421 | 26847 | 28053 | 13165 | 14835 | | | |
| 558: | 14764 | 1045 | 3022 | 3605 | 2422 | 21933 | 22134 | 5536 | 6460 | 6544 | 9107 | 8888 |
| | 18862 | 10875 | | | | | | | | | | |
| 559: | 1381 | 1030 | 868 | 1542 | 3819 | 2774 | 3820 | 21941 | 28850 | 4628 | 4476 | 4241 |
| | 4240 | 5147 | 8973 | 9404 | 8550 | 8599 | 21696 | | | | | |
| 560: | 27130 | 32046 | 15646 | 29404 | 26793 | 25579 | 32671 | 32672 | 11333 | 10333 | 31884 | 1454 |
| | 1472 | 2115 | 3472 | 18454 | 21975 | 15651 | 14384 | 23892 | 29289 | 29288 | 5702 | 6249 |
| | 33344 | 10475 | 10476 | 9112 | 9113 | 9111 | 6633 | 14338 | 15955 | 14466 | 33062 | 33063 |
| | 23094 | 10513 | 10553 | 29176 | 18835 | 21702 | 22089 | 21541 | 15430 | 20124 | | |
| 561: | 1955 | 2116 | 28976 | 8530 | 8165 | 8166 | 19740 | 14262 | | | | |
| 562: | 15656 | 15655 | 15633 | 9752 | 9751 | 15570 | 15571 | 15599 | 15631 | 15650 | 15602 | 15600 |
| | 15601 | 33210 | 1144 | 1669 | 1427 | 15632 | 3576 | 3473 | 3495 | 2862 | 2713 | 3575 |
| | 3061 | 30706 | 6450 | 5444 | 9039 | 6753 | 8066 | 8969 | 8067 | 8235 | 8082 | 6807 |
| | 7811 | 8427 | 15410 | | | | | | | | | |
| 563: | 9780 | 10972 | 17211 | 27611 | 17605 | 23661 | 27822 | 27848 | 14742 | 23098 | 26820 | 11207 |
| | 24235 | 25163 | 30009 | 12858 | 12862 | 13950 | 12851 | 13944 | 14218 | 21528 | 22393 | 19188 |
| | 19187 | 14991 | 15053 | 14996 | 15027 | 12913 | 22483 | 23754 | 23756 | 15644 | 31667 | 25997 |
| | 32370 | 16828 | 20493 | 17185 | 17181 | 17089 | 17084 | 17123 | 18075 | 18670 | 24749 | 19095 |
| | 12794 | 18229 | 19858 | 19490 | 19548 | 19547 | 19571 | 19697 | 19540 | 19550 | 24407 | 24453 |
| | 20530 | 26794 | 23224 | 33371 | 21627 | 21688 | 21616 | 22283 | 22837 | 24179 | 25190 | 25821 |
| | 25783 | 11668 | 11669 | 10700 | 30170 | 30168 | 26530 | 27106 | 27054 | 25269 | 26313 | 26191 |
| | 27943 | 27215 | 29761 | 30593 | 12382 | 12496 | 12530 | 12497 | 16087 | 12630 | 12261 | 21918 |
| | 28380 | 28484 | 28318 | 24568 | 20090 | 10788 | 18013 | 11058 | 28508 | 29600 | 1161 | 30011 |
| | 30012 | 31575 | 28505 | 3560 | 15216 | 31474 | 22022 | 14467 | 20055 | 4914 | 5112 | 31993 |
| | 8372 | 8851 | 8850 | 18770 | 16933 | 20636 | 32518 | 33008 | 32519 | 33009 | 22615 | 28732 |
| | 28721 | 29237 | 29236 | 31159 | 24799 | 11025 | 11020 | 11038 | 26871 | 31441 | 15440 | |
| 564: | 31861 | 13528 | 12212 | 30265 | 22814 | 24956 | 10324 | 10309 | 30298 | 29566 | 27860 | 12571 |
| | 30555 | 18562 | 15672 | 15718 | 14612 | 32074 | 10078 | 12944 | 15094 | 15093 | 15558 | 17517 |
| | 22434 | 22491 | 22447 | 17040 | 17027 | 15522 | 17855 | 17835 | 27919 | 28080 | 28208 | 18783 |
| | 25990 | 16866 | 16862 | 27540 | 16821 | 16807 | 16885 | 29909 | 19267 | 17086 | 17112 | 17101 |
| | 18027 | 18068 | 18062 | 28592 | 28602 | 19120 | 19105 | 19043 | 18497 | 19326 | 19327 | 19290 |
| | 23632 | 19481 | 19673 | 19672 | 20484 | 20467 | 20451 | 20461 | 24369 | 20997 | 26663 | 26661 |
| | 25628 | 22793 | 21712 | 21711 | 20798 | 20762 | 20766 | 32218 | 30372 | 22375 | 22304 | 21018 |
| | 33423 | 33365 | 33408 | 21657 | 22850 | 24028 | 23149 | 25908 | 24062 | 25925 | 24651 | 24661 |
| | 26589 | 24271 | 24277 | 25426 | 24975 | 27939 | 29744 | 26132 | 25352 | 10410 | 10395 | 15823 |
| | 15824 | 15826 | 15827 | 15847 | 15853 | 28150 | 15830 | 15842 | 29686 | 29707 | 29723 | 937 |
| | 1619 | 2824 | 3234 | 2393 | 10416 | 22005 | 31102 | 15840 | 15852 | 32591 | 32592 | 12491 |
| | 15825 | 15831 | 15834 | 33299 | 15822 | 15832 | 15833 | 15837 | 15838 | 15841 | 15843 | 15844 |
| | 15845 | 15848 | 15849 | 15854 | 32813 | 15850 | 15835 | 15836 | 6440 | 7737 | 15846 | 15851 |
| | 15828 | 15829 | 15839 | 9979 | 24843 | 20323 | 18867 | 18451 | 10077 | 24325 | 24324 | 28677 |
| | 28699 | 28676 | 15461 | 15920 | 15921 | 22810 | 14970 | 22885 | 12987 | 22998 | 21751 | 26869 |
| | 14818 | 28048 | 10415 | | | | | | | | | |
| 565: | 18663 | 27444 | 23018 | 15260 | 15261 | 32470 | 33110 | 9590 | 11853 | 12759 | 12758 | 12760 |
| | 22963 | 24009 | 9951 | 20911 | 15654 | 20915 | 20912 | 20914 | 20913 | 19433 | 19432 | 19434 |
| | 13800 | 31282 | 13801 | 13803 | 13802 | 22989 | 22622 | 1296 | 32411 | 32509 | 11414 | 11415 |
| | 11413 | 11416 | 11412 | 2375 | 14290 | 29190 | 14751 | 31364 | 31363 | 31362 | 31365 | 11309 |
| | 20999 | 21000 | 21589 | 10344 | 13229 | 23675 | 5552 | 8020 | 8022 | 7688 | 8770 | 33581 |
| | 21109 | 17693 | 10494 | 10148 | | | | | | | | |
| 566: | 2219 | 1973 | 3724 | 20295 | 4366 | 5519 | 6078 | 6079 | 9357 | 7748 | 8617 | 6620 |
| | 7487 | 8616 | 9356 | 7758 | 8746 | 8657 | 7019 | | | | | |
| 567: | 23325 | 23313 | 9952 | 23316 | 794 | 31135 | 17283 | 22061 | 26917 | 21041 | 23030 | 33625 |
| | 33180 | 28669 | 28668 | 17680 | 29309 | 30013 | 30015 | 31392 | 14451 | 11816 | 13265 | 13264 |
| | 31578 | 17603 | 10474 | 33620 | 10561 | 10560 | 10559 | 14277 | 10539 | 16625 | 9971 | 24627 |
| | 19515 | 13000 | 13001 | 14795 | 15304 | 33261 | 871 | 907 | 906 | 905 | 1403 | 908 |
| | 872 | 1825 | 1398 | 1402 | 1126 | 1545 | 1401 | 1153 | 1456 | 1251 | 1544 | 1376 |
| | 1414 | 1527 | 1326 | 1382 | 1354 | 1494 | 1399 | 1370 | 1361 | 1341 | 1476 | 1587 |
| | 1504 | 1817 | 1623 | 1264 | 1639 | 1417 | 1653 | 1543 | 1651 | 1590 | 862 | 1233 |
| | 1377 | 1715 | 1400 | 33052 | 10540 | 23323 | 23063 | 2641 | 3109 | 3386 | 3273 | 2964 |
| | 9770 | 2014 | 2319 | 2635 | 3299 | 2144 | 2961 | 2963 | 2013 | 2015 | 2898 | 10538 |
| | 2993 | 1853 | 2061 | 2105 | 9769 | 3272 | 2485 | 2214 | 2718 | 2135 | 2962 | 2142 |
| | 2617 | 2139 | 2676 | 2490 | 2257 | 2965 | 2543 | 3334 | 2966 | 2289 | 2277 | 2844 |
| | 3328 | 3253 | 2134 | 1964 | 2143 | 1928 | 2724 | 1939 | 2130 | 2491 | 2967 | 1965 |
| | 2140 | 2308 | 2313 | 2310 | 2128 | 2193 | 1998 | 1850 | 2480 | 1912 | 2131 | 2192 |
| | 1851 | 2592 | 2241 | 2212 | 4052 | 1849 | 2316 | 2245 | 1996 | 4048 | 2997 | 2968 |
| | 2118 | 3086 | 2133 | 1839 | 2129 | 2297 | 2486 | 2176 | 4047 | 1894 | 2479 | 2172 |
| | 2076 | 2727 | 1947 | 4046 | 2208 | 4050 | 3066 | 2141 | 1892 | 1843 | 1913 | 2242 |
| | 2179 | 1937 | 2655 | 2251 | 2290 | 2749 | 2132 | 3023 | 4032 | 2373 | 4069 | 1896 |
| | 2492 | 2075 | 2279 | 2299 | 2171 | 2577 | 2320 | 2200 | 2155 | 2258 | 2180 | 4056 |
| | 2174 | 1891 | 1966 | 4071 | 4057 | 1865 | 4037 | 4033 | 1842 | 2000 | 3073 | 1863 |
| | 4049 | 2191 | 1899 | 2779 | 1943 | 2712 | 2234 | 2383 | 1841 | 2680 | 2164 | 1840 |
| | 2170 | 9733 | 32132 | 23108 | 20083 | 18469 | 33178 | 14945 | 10076 | 13455 | 19522 | 32011 |
| | 32013 | 32012 | 16981 | 21995 | 31472 | 20107 | 20325 | 23293 | 13487 | 23019 | 14473 | 19901 |
| | 13486 | 15423 | 18523 | 10558 | 10557 | 20075 | 20076 | 33453 | 33451 | 33450 | 33452 | 33456 |
| | 33454 | 33455 | 32395 | 23029 | 31809 | 23027 | 23028 | 19519 | 19520 | 32550 | 19516 | 32551 |
| | 19518 | 32549 | 14435 | 19517 | 23322 | 23317 | 10537 | 21855 | 10535 | 23677 | 23329 | 23676 |
| | 23315 | 6270 | 6332 | 6418 | 4726 | 4720 | 4324 | 4328 | 4354 | 5153 | 6314 | 6490 |

TABLE 2-continued

| SEQ ID NO: | homolog SEQ ID NOs | | | | | | | | | | |
|---|---|---|---|---|---|---|---|---|---|---|---|
| | | 4511 | 4301 | 4783 | 6465 | 4472 | 4337 | 4342 | 4859 | 10003 | 4218 | 4863 | 4216 |
| | | 4230 | 4448 | 4741 | 4325 | 4219 | 4573 | 4329 | 4411 | 4473 | 4330 | 4338 | 4213 |
| | | 4513 | 5389 | 5388 | 5165 | 4341 | 4351 | 4214 | 4514 | 5244 | 4232 | 5219 | 4451 |
| | | 4347 | 5218 | 5217 | 5216 | 4542 | 4231 | 4215 | 4343 | 4607 | 4340 | 5265 | 5148 |
| | | 4487 | 4217 | 4221 | 5146 | 5145 | 4452 | 5138 | 4353 | 5523 | 4483 | 4446 | 4574 |
| | | 5251 | 5252 | 5250 | 5247 | 5516 | 4786 | 4334 | 4333 | 4785 | 6464 | 6475 | 4705 |
| | | 5135 | 10005 | 4449 | 4947 | 6498 | 4925 | 4469 | 4413 | 4949 | 5997 | 4946 | 4944 |
| | | 4941 | 4939 | 4929 | 4930 | 4928 | 4194 | 4919 | 4918 | 4466 | 5144 | 32548 | 10534 |
| | | 23327 | 6476 | 4936 | 4934 | 4932 | 5478 | 4327 | 5143 | 4223 | 4943 | 4923 | 4484 |
| | | 23328 | 4727 | 4572 | 4150 | 5573 | 4942 | 4922 | 4339 | 4886 | 4455 | 4453 | 5248 |
| | | 4323 | 6392 | 4512 | 4445 | 5595 | 4945 | 4938 | 4415 | 4924 | 4352 | 4901 | 6093 |
| | | 23314 | 33053 | 33203 | 4822 | 5553 | 6480 | 5481 | 4395 | 10536 | 4427 | 5537 | 4608 |
| | | 4447 | 10002 | 5524 | 5482 | 5783 | 5156 | 5162 | 5155 | 5139 | 4900 | 5246 | 4920 |
| | | 4716 | 5140 | 4857 | 4719 | 4948 | 4940 | 4921 | 5480 | 5137 | 4926 | 5142 | 6462 |
| | | 5463 | 5141 | 5249 | 4937 | 4486 | 5163 | 5479 | 4718 | 5452 | 4220 | 4412 | 6043 |
| | | 4419 | 10004 | 4931 | 4474 | 4530 | 4478 | 4454 | 4485 | 4565 | 4935 | 5173 | 4731 |
| | | 4717 | 5136 | 4933 | 4326 | 5154 | 5164 | 5888 | 4605 | 4927 | 4737 | 5171 | 6009 |
| | | 6451 | 5152 | 5477 | 4787 | 4784 | 4229 | 4450 | 4376 | 5476 | 6218 | 5170 | 6466 |
| | | 4703 | 5558 | 6463 | 6235 | 5310 | 4704 | 4222 | 4410 | 6003 | 6446 | 6400 | 6525 |
| | | 4468 | 31946 | 23324 | 23318 | 23320 | 23319 | 23312 | 23311 | 23310 | 23309 | 8162 | 8699 |
| | | 8482 | 8879 | 8875 | 8872 | 8877 | 8873 | 8971 | 8874 | 8161 | 8605 | 8876 | 8878 |
| | | 8917 | 8958 | 8970 | 7480 | 7795 | 8455 | 8078 | 7447 | 8208 | 7210 | 8349 | 8842 |
| | | 7415 | 8445 | 7414 | 8159 | 7417 | 8841 | 8511 | 8867 | 8157 | 8928 | 8916 | 8843 |
| | | 6730 | 6710 | 6594 | 15926 | 9585 | 585 | 32546 | 23330 | 23321 | 21549 | 17866 | 17865 |
| | | 17714 | 17713 | 18410 | 18409 | 18408 | 18412 | 18411 | 18407 | 17936 | 21504 | 32134 | 22556 |
| | | 32131 | 23107 | 32321 | 32322 | 23109 | 32133 | 32137 | 32323 | 32136 | 32135 | 23326 | 33628 |
| 568: | | 10201 | 19456 | 17859 | 14247 | 11297 | 14248 | 11298 | 32716 | 11296 | 14501 | 23798 | 15796 |
| | | 15795 | 10353 | 19235 | 19110 | 19065 | 19091 | 29390 | 23540 | 23566 | 23514 | 23426 | 23637 |
| | | 23447 | 23601 | 23624 | 23633 | 23543 | 23622 | 23567 | 23482 | 23474 | 20388 | 26719 | 33373 |
| | | 26174 | 25433 | 18825 | 18827 | 18826 | 11225 | 29294 | 29295 | 14235 | 1064 | 1261 | 1765 |
| | | 14400 | 28952 | 31479 | 11258 | 30556 | 17992 | 17990 | 17991 | 17989 | 15603 | 15604 | 5979 |
| | | 6128 | 6229 | 6521 | 5663 | 5981 | 6065 | 4491 | 7968 | 8009 | 6645 | 8010 | 8279 |
| | | 6685 | 8510 | 33295 | 17616 | 10916 | 18816 | 18818 | 18817 | 18834 | 14168 | 14169 | 24909 |
| | | 10912 | 14092 | 11220 | 20717 | 16641 | 10528 | 29637 | 11267 | 29638 | 11268 | 31656 | 24994 |
| | | 17930 | 13607 | 17277 | 31918 | 23692 | 10202 | 31942 | 28925 | 12086 | | | |
| 569: | | 1419 | 3350 | 4039 | 2864 | 3723 | 3085 | 31100 | 20305 | 6355 | 6764 | 7457 | |
| 570: | | 23325 | 23313 | 9952 | 23316 | 814 | 31135 | 17283 | 22061 | 26917 | 23030 | 667 | 478 |
| | | 33625 | 712 | 33180 | 28669 | 28668 | 17680 | 29309 | 30013 | 30015 | 31392 | 14451 | 11816 |
| | | 13265 | 13264 | 31578 | 17603 | 10474 | 33620 | 10561 | 10560 | 10559 | 14277 | 10539 | 16625 |
| | | 9971 | 24627 | 19515 | 13000 | 13001 | 14795 | 871 | 907 | 906 | 905 | 1403 | 908 |
| | | 872 | 1825 | 1398 | 1402 | 1126 | 1545 | 1401 | 1153 | 1456 | 1251 | 1544 | 1376 |
| | | 1414 | 1527 | 1326 | 1382 | 1354 | 1494 | 1399 | 1370 | 1361 | 1341 | 1476 | 1587 |
| | | 1504 | 1817 | 1623 | 1264 | 1639 | 1417 | 1653 | 1543 | 1651 | 1590 | 862 | 1233 |
| | | 1377 | 1715 | 1400 | 33052 | 10540 | 23323 | 477 | 23063 | 2641 | 3109 | 3386 | 3273 |
| | | 2964 | 9770 | 2014 | 2319 | 2635 | 3299 | 2144 | 2961 | 2963 | 2013 | 2015 | 2898 |
| | | 10538 | 2993 | 1853 | 2061 | 2105 | 9769 | 3272 | 2485 | 2214 | 2718 | 2135 | 2962 |
| | | 2142 | 2617 | 2139 | 2676 | 2490 | 2257 | 2965 | 2543 | 2966 | 2289 | 2277 | 3328 |
| | | 2134 | 2143 | 1928 | 2724 | 1939 | 2130 | 2491 | 2967 | 1965 | 2140 | 2308 | 2313 |
| | | 2310 | 2128 | 2193 | 1998 | 1850 | 2480 | 2131 | 1912 | 2192 | 1851 | 2592 | 2241 |
| | | 2212 | 4052 | 1849 | 2316 | 2245 | 1996 | 4048 | 2997 | 2968 | 2118 | 3086 | 2133 |
| | | 1839 | 2129 | 2297 | 2486 | 2176 | 4047 | 1894 | 2479 | 2172 | 2076 | 2727 | 1947 |
| | | 4046 | 2208 | 4050 | 3066 | 2141 | 1892 | 1843 | 1913 | 2242 | 2179 | 1937 | 2655 |
| | | 2251 | 2290 | 2749 | 2132 | 3023 | 4032 | 2373 | 4069 | 1896 | 2492 | 2075 | 2279 |
| | | 2299 | 2171 | 2577 | 2320 | 2200 | 2155 | 2258 | 2180 | 4056 | 2174 | 1891 | 1966 |
| | | 4057 | 4071 | 1865 | 4037 | 4033 | 1842 | 2000 | 3073 | 1863 | 4049 | 2191 | 1899 |
| | | 2779 | 1943 | 2712 | 2234 | 2383 | 1841 | 2164 | 1840 | 2170 | 4043 | 2119 |
| | | 3044 | 9733 | 32132 | 23108 | 20083 | 18469 | 33178 | 14945 | 10076 | 13455 | 19522 | 32011 |
| | | 32013 | 32012 | 16981 | 20107 | 20325 | 23293 | 13487 | 23019 | 14473 | 19901 | 13486 | 15423 |
| | | 18523 | 10558 | 10557 | 20075 | 20076 | 33453 | 33451 | 33450 | 33452 | 33456 | 33454 | 33455 |
| | | 32395 | 23029 | 31809 | 23027 | 23028 | 19519 | 19520 | 32550 | 19516 | 32551 | 19518 | 32549 |
| | | 14435 | 19517 | 23322 | 23317 | 10537 | 21855 | 10535 | 23329 | 23676 | 23315 | 6270 |
| | | 6332 | 6418 | 4324 | 4328 | 4354 | 5153 | 6314 | 6490 | 4301 | 4783 | 6465 | 4472 |
| | | 4342 | 4859 | 10003 | 4218 | 4726 | 4863 | 4216 | 4230 | 4448 | 4741 | 4325 | 4337 |
| | | 4219 | 4573 | 4329 | 4411 | 4473 | 4330 | 4338 | 4213 | 4720 | 4513 | 4511 | 5389 |
| | | 5388 | 5165 | 4341 | 4351 | 4214 | 4514 | 5244 | 4232 | 5219 | 4451 | 4347 | 5218 |
| | | 5217 | 5216 | 4542 | 4231 | 4215 | 4343 | 4607 | 4340 | 5265 | 5148 | 4487 | 4217 |
| | | 4221 | 5146 | 5145 | 4452 | 5138 | 4353 | 5523 | 4483 | 4446 | 4574 | 5251 | 5252 |
| | | 5250 | 5247 | 5516 | 4786 | 4334 | 4333 | 4785 | 6464 | 6475 | 4705 | 5135 | 10005 |
| | | 4449 | 4947 | 6498 | 4925 | 4469 | 4413 | 4949 | 5997 | 6946 | 4944 | 4941 | 4939 |
| | | 4929 | 4930 | 4928 | 4194 | 4919 | 4918 | 4466 | 5144 | 32548 | 10534 | 23327 | 6476 |
| | | 4936 | 4934 | 4932 | 5478 | 4327 | 5143 | 4223 | 4943 | 4923 | 4484 | 23328 | 4727 |
| | | 4572 | 4150 | 5573 | 4942 | 4922 | 4339 | 4886 | 4455 | 4453 | 5248 | 4323 | 6392 |
| | | 4512 | 4445 | 5595 | 4945 | 4938 | 4415 | 4924 | 4352 | 4901 | 6093 | 23314 | 33053 |
| | | 33203 | 4822 | 5553 | 6480 | 5481 | 5156 | 4395 | 10536 | 4427 | 5537 | 4608 | 4447 |
| | | 10002 | 5524 | 5482 | 5783 | 5162 | 5155 | 5139 | 4900 | 5246 | 4920 | 4716 | 5140 |
| | | 4857 | 4719 | 4948 | 4940 | 4921 | 5480 | 5137 | 4926 | 5142 | 6462 | 5463 | 5141 |
| | | 5249 | 4937 | 5163 | 5479 | 4718 | 5452 | 4220 | 4412 | 6043 | 4419 | 10004 | 4931 |
| | | 4486 | 4474 | 4530 | 4478 | 4454 | 4485 | 4565 | 4935 | 5173 | 4731 | 4717 | 5136 |

TABLE 2-continued

| SEQ ID NO: | homolog SEQ ID NOs | | | | | | | | | | |
|---|---|---|---|---|---|---|---|---|---|---|---|
| | 4933 | 4326 | 5154 | 5164 | 5888 | 4605 | 4927 | 4737 | 5171 | 6009 | 6451 | 5152 |
| | 5477 | 4787 | 4784 | 4229 | 4450 | 4410 | 4376 | 5476 | 5170 | 6466 | 6218 | 4703 |
| | 5558 | 6463 | 6235 | 5310 | 4704 | 4222 | 6003 | 6446 | 6400 | 6525 | 4468 | 4355 |
| | 4477 | 4509 | 31946 | 23324 | 23318 | 23320 | 23319 | 23312 | 23311 | 23310 | 23309 | 8162 |
| | 8699 | 8482 | 8879 | 8875 | 8872 | 8877 | 8873 | 8971 | 8874 | 8161 | 8605 | 8876 |
| | 8878 | 8917 | 8958 | 8970 | 7480 | 7795 | 7447 | 8208 | 7210 | 8349 | 8842 | 7415 |
| | 8445 | 7414 | 8159 | 7417 | 8841 | 8511 | 8867 | 8157 | 8928 | 8916 | 8843 | 6730 |
| | 6710 | 6594 | 15926 | 9585 | 585 | 32546 | 23330 | 23321 | 713 | 33630 | 17866 | 17865 |
| | 17714 | 17713 | 18410 | 18409 | 18408 | 18412 | 18411 | 18407 | 17936 | 786 | 32134 | 22556 |
| | 32131 | 23107 | 32321 | 32322 | 23109 | 32133 | 32137 | 32323 | 32136 | 32135 | 23326 | 571 |
| | 792 | 586 | | | | | | | | | | |
| 571: | 14844 | 33335 | 17214 | 22103 | 21007 | 32238 | 17219 | 17218 | 30491 | 32247 | 20931 | 9597 |
| | 13551 | 32396 | 27637 | 33294 | 27612 | 27648 | 30239 | 30248 | 30260 | 11686 | 11687 | 18406 |
| | 33055 | 32926 | 33507 | 25339 | 33571 | 18655 | 14811 | 27017 | 10633 | 32103 | 32102 | 15215 |
| | 13484 | 11294 | 10251 | 10268 | 10265 | 10297 | 11215 | 11174 | 29948 | 29935 | 24082 | 24073 |
| | 29957 | 12594 | 17347 | 17370 | 17368 | 17415 | 17351 | 17302 | 17422 | 17352 | 17428 | 17339 |
| | 17293 | 17326 | 17356 | 17392 | 17305 | 17353 | 10580 | 10581 | 9986 | 25136 | 13392 | 31288 |
| | 18361 | 18355 | 18344 | 18354 | 24857 | 11725 | 13920 | 12853 | 13859 | 13889 | 12850 | 13943 |
| | 13926 | 13937 | 11721 | 11726 | 13918 | 13928 | 13904 | 13934 | 11729 | 13908 | 13946 | 14211 |
| | 31882 | 24148 | 20214 | 19774 | 19776 | 13006 | 10936 | 15957 | 15703 | 15707 | 15667 | 17733 |
| | 14623 | 14610 | 14491 | 14691 | 14690 | 15199 | 15134 | 14974 | 14989 | 14994 | 12931 | 12930 |
| | 12940 | 12873 | 12879 | 28230 | 15100 | 15090 | 15494 | 15495 | 15552 | 14157 | 17495 | 17508 |
| | 22426 | 22438 | 22466 | 22467 | 22418 | 22465 | 23824 | 23765 | 23783 | 23819 | 15287 | 17041 |
| | 17004 | 30965 | 19927 | 17688 | 17768 | 17786 | 17816 | 27899 | 27900 | 27883 | 28079 | 16687 |
| | 16716 | 16680 | 16800 | 16797 | 16784 | 16792 | 16681 | 16796 | 16776 | 16794 | 16846 | 32349 |
| | 32373 | 32366 | 667 | 27543 | 27546 | 27564 | 27598 | 27592 | 20497 | 20515 | 25987 | 29878 |
| | 29876 | 20495 | 20507 | 29907 | 20517 | 29905 | 29870 | 11884 | 11889 | 11967 | 11983 | 12014 |
| | 12010 | 11980 | 11936 | 11986 | 11891 | 11943 | 11998 | 19264 | 19247 | 19230 | 19244 | 18441 |
| | 18443 | 17149 | 17138 | 17106 | 18045 | 18032 | 18037 | 28512 | 28551 | 28515 | 28548 | 28558 |
| | 28513 | 15238 | 16386 | 16377 | 16367 | 16385 | 16335 | 16321 | 24736 | 24752 | 24724 | 24691 |
| | 24729 | 18932 | 18888 | 18877 | 18942 | 18893 | 18914 | 18883 | 18949 | 18933 | 19131 | |
| | 19071 | 19075 | 19100 | 12824 | 12796 | 712 | 33624 | 12054 | 18167 | 18214 | 18169 | 18152 |
| | 18188 | 18113 | 18203 | 18147 | 14004 | 14012 | 14022 | 13989 | 14040 | 14048 | 19368 | 19845 |
| | 19859 | 19793 | 19837 | 23713 | 23629 | 23586 | 23575 | 23451 | 23452 | 23582 | 23492 | 23596 |
| | 23599 | 23469 | 23499 | 23527 | 23572 | 19595 | 19680 | 19597 | 19675 | 19562 | 19585 | 19648 |
| | 19690 | 19543 | 19586 | 19669 | 19687 | 19602 | 19991 | 25941 | 25966 | 25000 | 24381 | 24378 |
| | 24371 | 24394 | 24470 | 24389 | 24516 | 24358 | 24370 | 24527 | 24356 | 24471 | 24487 | 24560 |
| | 24397 | 24466 | 9694 | 20348 | 17979 | 22982 | 26706 | 26707 | 26629 | 26650 | 26782 | 20937 |
| | 25586 | 25588 | 25646 | 25610 | 30752 | 30113 | 23737 | 22686 | 22724 | 22709 | 22711 | 20801 |
| | 20593 | 20808 | 12474 | 12467 | 12480 | 23192 | 12357 | 30354 | 22365 | 22321 | 22299 | 22372 |
| | 22320 | 22345 | 24297 | 33391 | 33390 | 21608 | 21623 | 21594 | 21664 | 22245 | 22289 | 22877 |
| | 22851 | 21411 | 21439 | 21444 | 21428 | 21418 | 21405 | 21438 | 21454 | 21420 | 21345 | 21321 |
| | 21293 | 21314 | 21341 | 21287 | 21356 | 21398 | 21307 | 21265 | 21260 | 21230 | 21257 | 21282 |
| | 21217 | 22223 | 23253 | 23256 | 23258 | 23268 | 23137 | 23146 | 23128 | 23144 | 24048 | 24046 |
| | 29480 | 24051 | 25931 | 29972 | 27189 | 23957 | 23948 | 23998 | 23973 | 23993 | 23988 | 23968 |
| | 23918 | 23965 | 25742 | 25183 | 25189 | 30188 | 30184 | 26063 | 27477 | 25092 | 30081 | 25818 |
| | 30058 | 25078 | 30084 | 30066 | 30057 | 25823 | 25101 | 30086 | 25075 | 25094 | 25081 | 25080 |
| | 25846 | 25843 | 25820 | 25832 | 30068 | 25847 | 25850 | 30064 | 30046 | 26947 | 25683 | 30145 |
| | 25219 | 25676 | 25213 | 25668 | 25205 | 27683 | 27672 | 27725 | 27800 | 27797 | 27746 | 27805 |
| | 27718 | 27790 | 27818 | 27787 | 27775 | 27799 | 27786 | 27750 | 27816 | 27774 | 25322 | 25453 |
| | 25464 | 25310 | 25311 | 25429 | 25471 | 25441 | 25468 | 25475 | 25457 | 25332 | 13044 | 13023 |
| | 13033 | 13037 | 13025 | 13030 | 11679 | 13029 | 13040 | 13039 | 11681 | 11666 | 11671 | 10779 |
| | 10678 | 10697 | 10755 | 10682 | 10745 | 10739 | 10747 | 10765 | 10696 | 10737 | 10761 | 10764 |
| | 10714 | 10767 | 27073 | 27043 | 13756 | 13775 | 26448 | 26501 | 26509 | 26431 | 26517 | 26488 |
| | 26464 | 26507 | 26421 | 26468 | 26467 | 26401 | 26445 | 26428 | 26519 | 26425 | 26282 | 26253 |
| | 26321 | 26372 | 26300 | 26257 | 26255 | 26243 | 26269 | 26387 | 26228 | 26273 | 26310 | 26341 |
| | 26342 | 26301 | 26291 | 26238 | 26352 | 26393 | 26381 | 26377 | 26274 | 26272 | 26337 | 26303 |
| | 26299 | 26340 | 26332 | 26297 | 26239 | 26314 | 26268 | 26375 | 26277 | 26364 | 26384 | 27975 |
| | 27261 | 27284 | 27297 | 27227 | 26396 | 9453 | 9458 | 9463 | 9522 | 9475 | 9487 | 9492 |
| | 11542 | 30598 | 30649 | 30680 | 30646 | 30639 | 30619 | 30631 | 30648 | 13314 | 26107 | 16223 |
| | 16212 | 16208 | 16216 | 10400 | 10401 | 16049 | 16065 | 16066 | 16033 | 26013 | 16063 | 16023 |
| | 12603 | 10973 | 12220 | 12245 | 10823 | 10840 | 27018 | 32757 | 17860 | 27992 | 28010 | 27999 |
| | 27988 | 28035 | 27985 | 27998 | 28030 | 27383 | 27322 | 27363 | 27321 | 27323 | 27357 | 27324 |
| | 17927 | 17928 | 28368 | 28364 | 30723 | 16037 | 28497 | 28427 | 28482 | 28294 | 28316 | 31502 |
| | 32384 | 27202 | 16950 | 14969 | 23075 | 17247 | 10357 | 20088 | 17591 | 15397 | 19159 | 15367 |
| | 18371 | 18372 | 26887 | 15744 | 15760 | 22183 | 14391 | 20837 | 10647 | 23238 | 11410 | 27165 |
| | 27440 | 17074 | 13701 | 13718 | 13687 | 13648 | 13703 | 33357 | 23721 | 20935 | 9740 | 22202 |
| | 29186 | 16399 | 16451 | 16438 | 29681 | 33359 | 29690 | 16442 | 29724 | 29683 | 13845 | 17229 |
| | 14109 | 13611 | 30557 | 23665 | 14852 | 13520 | 27457 | 21559 | 14884 | 11638 | 11579 | 9754 |
| | 11613 | 11619 | 33614 | 11612 | 11563 | 2027 | 2249 | 3844 | 2030 | 2682 | 3700 | 3987 |
| | 2773 | 3704 | 2949 | 3835 | 3761 | 2084 | 2381 | 4005 | 2683 | 3767 | 2633 | 3895 |
| | 2894 | 3229 | 2737 | 3087 | 1910 | 2634 | 3336 | 13610 | 11659 | 22150 | 22140 | 22154 |
| | 22155 | 22156 | 22046 | 29033 | 22045 | 29129 | 28978 | 21850 | 31949 | 11639 | 11436 | 33317 |
| | 29341 | 6212 | 4971 | 4362 | 6137 | 5645 | 5284 | 5149 | 5746 | 5061 | 4503 | 5230 |
| | 5232 | 4575 | 6136 | 4639 | 14564 | 7316 | 7627 | 14563 | 14562 | 14561 | 7481 | 9355 |
| | 7865 | 7761 | 9038 | 9127 | 9294 | 7325 | 7185 | 28780 | 8831 | 7655 | 9222 | 8000 |
| | 6760 | 9184 | 8429 | 7759 | 7478 | 8672 | 7550 | 9401 | 9221 | 9178 | 8669 | 7437 |
| | 9179 | 7783 | 7394 | 7802 | 10856 | 21538 | 21539 | 21540 | 17043 | 32329 | 20268 | 31867 |

TABLE 2-continued

| SEQ ID NO: | homolog SEQ ID NOs | | | | | | | | | | |
|---|---|---|---|---|---|---|---|---|---|---|---|
| | 32476 | 33610 | 32117 | 21481 | 10608 | 24828 | 25380 | 14260 | 20620 | 20647 | 20669 | 20699 |
| | 25024 | 31394 | 31393 | 21208 | 33304 | 26886 | 31866 | 17873 | 13239 | 11304 | 30694 | 14303 |
| | 17568 | 15876 | 9596 | 23829 | 28697 | 28722 | 28696 | 28742 | 28754 | 28753 | 28768 | 12996 |
| | 11809 | 16553 | 12441 | 12462 | 12438 | 12437 | 24921 | 31141 | 31163 | 31181 | 31174 | 31151 |
| | 17902 | 30917 | 30897 | 30928 | 30902 | 30936 | 30916 | 30903 | 29212 | 24146 | 22203 | 17755 |
| | 24939 | 11145 | 9851 | 9852 | 11037 | 12138 | 12094 | 12090 | 12104 | 12952 | 12961 | 626 |
| | 28247 | 10605 | 22997 | 32972 | 24933 | 31445 | 31422 | 31439 | 32037 | 28047 | 31553 | 13197 |
| | 13189 | 13169 | 13185 | | | | | | | | | |
| 572: | 17934 | 10050 | 18253 | 19351 | 24422 | 10787 | 26717 | 25527 | 22692 | 22222 | 26595 | 25445 |
| | 10759 | 30020 | 25012 | 25257 | 25256 | 18439 | 19727 | 28637 | 28636 | 27013 | 31633 | 32995 |
| | 24946 | 11265 | 15959 | 1578 | 9786 | 32755 | 32756 | 32200 | 25518 | 25519 | 13052 | 13053 |
| | 13051 | 11608 | 32240 | 17278 | 20436 | 18510 | 17747 | 13483 | 32075 | 28822 | 29225 | 28858 |
| | 22830 | 17660 | 30376 | 21963 | 28962 | 21962 | 21961 | 29043 | 13727 | 32824 | 29389 | 10071 |
| | 10072 | 13482 | 13959 | 33552 | 29641 | 30455 | 32994 | 20266 | 14299 | 5199 | 4274 | 5970 |
| | 6317 | 6442 | 5926 | 4166 | 6323 | 4371 | 4169 | 5890 | 5198 | 5490 | 4759 | 4745 |
| | 4744 | 5969 | 6441 | 6223 | 7816 | 7446 | 19702 | 8295 | 7630 | 8714 | 7815 | 7240 |
| | 8080 | 6890 | 8521 | 33094 | 15973 | 31359 | 31360 | 31358 | 22213 | 25360 | 32124 | 11359 |
| | 32045 | 18398 | 18395 | 32254 | 30826 | 16976 | 10245 | 32049 | 20843 | 30550 | 27000 | 14809 |
| 573: | 14234 | 11052 | 19938 | 29860 | 29862 | 12007 | 17082 | 14018 | 32199 | 28276 | 25670 | 16491 |
| | 16190 | 21560 | 31986 | 31983 | 1244 | 4009 | 3818 | 3186 | 4007 | 2971 | 2622 | 2109 |
| | 2969 | 2970 | 4008 | 2579 | 3187 | 3817 | 2764 | 3267 | 32500 | 13617 | 5895 | 5055 |
| | 5176 | 4515 | 5999 | 4131 | 7338 | 7106 | 9304 | 8731 | 6809 | 7522 | 8087 | 7337 |
| | 8088 | 6679 | 6902 | 7659 | 6618 | 8417 | 10584 | 10585 | 9822 | | | |
| 574: | 13007 | 25538 | 30017 | 30018 | 27415 | 1628 | 1448 | 30478 | 19999 | 14285 | 20934 | 24039 |
| | 14263 | 19893 | 18250 | 14394 | 17079 | 33002 | 13728 | 24803 | 24804 | 24805 | 6830 | 14965 |
| | 14966 | | | | | | | | | | | |
| 575: | 17214 | 30491 | 17219 | 22103 | 14844 | 27438 | 33461 | 32238 | 21007 | 17218 | 9597 | 32396 |
| | 27609 | 27612 | 28241 | 30283 | 30221 | 11686 | 11687 | 33055 | 32903 | 32933 | 32926 | 33507 |
| | 25339 | 10497 | 14414 | 33571 | 22612 | 18655 | 15067 | 32103 | 32102 | 15215 | 13484 | 11294 |
| | 10262 | 10266 | 10297 | 10251 | 10265 | 10263 | 10268 | 11174 | 11215 | 29957 | 29935 | 29948 |
| | 17410 | 17353 | 17415 | 17347 | 17293 | 17368 | 17339 | 17428 | 17326 | 17392 | 17302 | 17356 |
| | 17370 | 17422 | 17305 | 17352 | 17360 | 10899 | 10580 | 9986 | 10581 | 24224 | 25136 | 13392 |
| | 13373 | 12661 | 12701 | 31288 | 18361 | 18355 | 18344 | 18354 | 24857 | 13859 | 11729 | 13908 |
| | 11725 | 13920 | 13924 | 13889 | 11726 | 13918 | 13937 | 11721 | 12850 | 13943 | 13928 | 12853 |
| | 13926 | 14211 | 19774 | 13006 | 19776 | 10936 | 15957 | 14538 | 23643 | 15703 | 15707 | 17733 |
| | 21093 | 14680 | 33020 | 14491 | 14691 | 14690 | 15206 | 15199 | 15138 | 15134 | 15045 | 14989 |
| | 14980 | 14994 | 14974 | 12879 | 12878 | 12915 | 12931 | 12873 | 12917 | 12930 | 32301 | 28230 |
| | 32610 | 32627 | 15494 | 15495 | 14157 | 17495 | 17496 | 17508 | 22443 | 22426 | 22467 | 22438 |
| | 22418 | 22466 | 22465 | 23819 | 15287 | 23765 | 23767 | 23783 | 17005 | 17004 | 17041 | 30965 |
| | 19927 | 17688 | 17782 | 17785 | 17816 | 17768 | 17786 | 27900 | 27883 | 28079 | 16681 | |
| | 30449 | 16794 | 16687 | 16784 | 16796 | 16716 | 16797 | 16685 | 16792 | 16680 | 16846 | 32351 |
| | 32366 | 32349 | 32373 | 27546 | 27564 | 27592 | 667 | 27543 | 16873 | 15903 | 29890 | 29878 |
| | 20497 | 20517 | 29870 | 25987 | 29907 | 29876 | 20515 | 20507 | 20495 | 11908 | 12014 | 11891 |
| | 11984 | 11986 | 11998 | 11967 | 11983 | 12010 | 11889 | 11980 | 19234 | 19244 | 19230 | |
| | 19264 | 17183 | 17464 | 17144 | 17149 | 17106 | 17244 | 12728 | 18035 | 18045 | 18037 | 18032 |
| | 28513 | 28610 | 28551 | 28558 | 28512 | 28548 | 28515 | 24752 | 24724 | 24691 | 24736 | 24771 |
| | 24729 | 24707 | 24732 | 18975 | 18888 | 18883 | 18942 | 18933 | 18949 | 18877 | 18893 | 18914 |
| | 19131 | 19139 | 19071 | 12767 | 12054 | 18167 | 18203 | 18214 | 18113 | 18147 | 18152 | 18188 |
| | 18169 | 14038 | 14025 | 14004 | 14040 | 13989 | 14022 | 19368 | 19329 | 19859 | 19793 | 19845 |
| | 19809 | 19837 | 19841 | 23713 | 20104 | 23629 | 23586 | 23452 | 23499 | 23575 | 23451 | 23537 |
| | 23599 | 23457 | 23582 | 19480 | 19487 | 19675 | 19585 | 19602 | 19595 | 19562 | 19669 | 19680 |
| | 19543 | 19597 | 19685 | 19687 | 19648 | 19690 | 19586 | 19991 | 25949 | 25941 | 25966 | 25003 |
| | 25000 | 24370 | 24470 | 24371 | 24381 | 24378 | 24516 | 24394 | 24389 | 24356 | 24466 | 24560 |
| | 24527 | 24358 | 17979 | 26629 | 26706 | 26707 | 26650 | 25586 | 25588 | 25645 | 25646 | 30752 |
| | 23737 | 22686 | 22724 | 22709 | 20801 | 20593 | 20791 | 12474 | 12467 | 12480 | 23235 | 30354 |
| | 22332 | 22365 | 22321 | 22330 | 22299 | 22372 | 24297 | 33391 | 21614 | 21664 | 21623 | 21629 |
| | 21608 | 22877 | 21436 | 21420 | 21454 | 21411 | 21428 | 21444 | 21418 | 21404 | 21391 | 21353 |
| | 21307 | 21356 | 21341 | 21287 | 21321 | 21345 | 21398 | 21293 | 21300 | 21221 | 21272 | 21217 |
| | 21257 | 21282 | 21265 | 21223 | 21260 | 21230 | 23253 | 23258 | 23256 | 23268 | 23141 | 23144 |
| | 23146 | 23128 | 24051 | 24046 | 24048 | 24053 | 29480 | 27189 | 23973 | 23957 | 23948 | 23993 |
| | 23968 | 23998 | 23965 | 26063 | 30074 | 30081 | 25847 | 30066 | 25850 | 25101 | 25846 | |
| | 25818 | 25092 | 30068 | 25080 | 25820 | 30082 | 25075 | 30057 | 25834 | 30058 | 25078 | 25823 |
| | 26580 | 24247 | 30046 | 26947 | 26933 | 25218 | 27701 | 27672 | 27683 | 27800 | 27786 | 27775 |
| | 27725 | 27726 | 27807 | 27746 | 27805 | 27718 | 27816 | 27797 | 27774 | 27771 | 27750 | 25452 |
| | 25441 | 25332 | 25453 | 25464 | 25461 | 25471 | 25322 | 25457 | 25311 | 25310 | 25463 | 25429 |
| | 11681 | 13044 | 13023 | 11671 | 13033 | 13037 | 11679 | 10681 | 10737 | 10697 | 10682 | 10761 |
| | 10779 | 10767 | 10739 | 10696 | 10747 | 10755 | 10752 | 10678 | 10745 | 27073 | 27097 | 27043 |
| | 27035 | 13741 | 13740 | 26443 | 26448 | 26501 | 26467 | 26509 | 26421 | 26468 | 26507 | 26464 |
| | 26517 | 26440 | 26488 | 26243 | 26236 | 26321 | 26352 | 26255 | 26228 | 26301 | 26314 | 26372 |
| | 26239 | 26282 | 26341 | 26310 | 26272 | 26253 | 26300 | 26273 | 26257 | 26303 | 26269 | 26375 |
| | 26274 | 26377 | 26268 | 26332 | 26337 | 26393 | 26291 | 26207 | 26387 | 26182 | 27975 | 27284 |
| | 27297 | 27261 | 27227 | 27218 | 26396 | 9453 | 9458 | 9496 | 9522 | 9475 | 9500 | 9492 |
| | 9476 | 9463 | 9487 | 11542 | 13314 | 13299 | 16198 | 26107 | 16223 | 24582 | 17917 | 10376 |
| | 10400 | 10401 | 16049 | 16053 | 26033 | 26023 | 16065 | 16063 | 16066 | 16013 | 12603 | 10973 |
| | 12245 | 12220 | 32757 | 27998 | 27992 | 28007 | 28035 | 27357 | 27314 | 27383 | 28368 | 28367 |
| | 28364 | 28357 | 30723 | 28427 | 28482 | 28497 | 28294 | 28316 | 32940 | 14969 | 16950 | 10357 |
| | 11544 | 17591 | 19159 | 15397 | 18371 | 18372 | 26887 | 15744 | 15760 | 27440 | 33185 | 17074 |
| | 23238 | 10647 | 13721 | 13687 | 13701 | 13648 | 13707 | 13703 | 24916 | 9740 | 22202 | 29186 |

TABLE 2-continued

| SEQ ID NO: | homolog SEQ ID NOs | | | | | | | | | |
|---|---|---|---|---|---|---|---|---|---|---|
| | 29701 | 16399 | 29724 | 29683 | 16442 | 29681 | 33359 | 29696 | 13845 | 17229 | 14109 | 10341 |
| | 13611 | 30557 | 23665 | 17585 | 14852 | 13520 | 27457 | 24139 | 21559 | 1149 | 14884 | 14878 |
| | 11572 | 11619 | 11638 | 11579 | 9754 | 11612 | 11563 | 13796 | 2249 | 3844 | 2773 | 3761 |
| | 2084 | 3835 | 2949 | 3987 | 3704 | 2381 | 3700 | 3895 | 2737 | 2027 | 2030 | 2682 |
| | 2894 | 3229 | 2683 | 1910 | 2633 | 3926 | 2800 | 3991 | 14452 | 11659 | 13610 | 24827 |
| | 22150 | 22156 | 22046 | 22045 | 29129 | 29033 | 28978 | 19355 | 29130 | 21850 | 31949 | 11639 |
| | 11436 | 33317 | 14568 | 5284 | 6212 | 5061 | 6137 | 4971 | 4362 | 5645 | 5149 | 5230 |
| | 5746 | 4503 | 5232 | 4639 | 4575 | 14561 | 7481 | 9355 | 14564 | 7316 | 14562 | 7865 |
| | 7627 | 9038 | 7761 | 14563 | 9294 | 7325 | 8000 | 8672 | 9222 | 8429 | 7759 | 28780 |
| | 8831 | 9127 | 6760 | 9401 | 9184 | 7185 | 7655 | 7478 | 7783 | 9221 | 9178 | 8669 |
| | 9179 | 7550 | 11132 | 21538 | 21540 | 21539 | 32329 | 17043 | 31867 | 20268 | 32476 | 33610 |
| | 32117 | 10608 | 21481 | 25380 | 14260 | 20620 | 20669 | 20685 | 25024 | 31394 | 31393 | 21208 |
| | 33304 | 26886 | 31866 | 13239 | 11304 | 17568 | 30694 | 14303 | 15876 | 23035 | 19280 | 9596 |
| | 26994 | 14737 | 11815 | 23829 | 28696 | 28697 | 28726 | 28722 | 28753 | 28719 | 28335 | 28754 |
| | 28768 | 20578 | 28742 | 12437 | 12462 | 24921 | 31165 | 31204 | 31155 | 14091 | 17902 | 18658 |
| | 30936 | 30884 | 30902 | 30903 | 30916 | 30938 | 30928 | 29212 | 24146 | 22203 | 24939 | 11145 |
| | 9851 | 9852 | 11037 | 12138 | 12090 | 12094 | 12960 | 626 | 12952 | 28247 | 12961 | 12963 |
| | 10607 | 10605 | 22997 | 22832 | 16585 | 12162 | 26879 | 31422 | 31439 | 31445 | 32037 | 28047 |
| | 31553 | 13185 | 13169 | 13197 | | | | | | | | |
| 576: | 32547 | 31133 | 13543 | 12207 | 27641 | 30269 | 13140 | 32897 | 30760 | 33013 | 32501 | 12536 |
| | 32421 | 11232 | 27424 | 20146 | 14735 | 23709 | 10278 | 30293 | 29571 | 27868 | 25895 | 29958 |
| | 14856 | 17388 | 17323 | 12558 | 30006 | 15249 | 15252 | 15247 | 15250 | 15245 | 15246 | 15254 |
| | 15257 | 15256 | 12659 | 13915 | 13734 | 14193 | 21026 | 18577 | 14535 | 14363 | 17727 | 14620 |
| | 17065 | 14477 | 15193 | 15032 | 12902 | 32304 | 32606 | 15099 | 19029 | 14125 | 14134 | 17537 |
| | 22448 | 22461 | 22428 | 23805 | 15283 | 31093 | 15775 | 30968 | 30969 | 15517 | 27879 | 16242 |
| | 18780 | 21192 | 16709 | 29832 | 16860 | 27552 | 27565 | 16820 | 29844 | 16895 | 15904 | 29898 |
| | 25988 | 11924 | 11987 | 19226 | 19224 | 23639 | 23351 | 21864 | 17198 | 28348 | 17465 | 17127 |
| | 16946 | 15253 | 15248 | 18060 | 18020 | 18094 | 28554 | 28567 | 18844 | 24745 | 33625 | 18963 |
| | 19044 | 19082 | 19127 | 17966 | 18225 | 13985 | 18492 | 19325 | 19855 | 32107 | 19505 | 19658 |
| | 19589 | 19761 | 20478 | 20456 | 20337 | 20974 | 20410 | 11881 | 26701 | 30121 | 20803 | 23233 |
| | 12335 | 30327 | 22349 | 22336 | 10087 | 12277 | 24317 | 33368 | 33396 | 33427 | 21591 | 22280 |
| | 22253 | 22865 | 21379 | 21277 | 23145 | 29970 | 23932 | 26081 | 24647 | 25870 | 23171 | 25085 |
| | 25089 | 24274 | 25124 | 28829 | 25699 | 27699 | 27660 | 27654 | 27655 | 27653 | 27768 | 25481 |
| | 10711 | 24986 | 27103 | 13772 | 25263 | 25271 | 27154 | 26322 | 27931 | 27976 | 27212 | 29233 |
| | 11363 | 12038 | 11487 | 11472 | 16494 | 16453 | 12394 | 16196 | 26110 | 26130 | 16168 | 12515 |
| | 24577 | 17903 | 13277 | 10378 | 30526 | 18821 | 18822 | 26030 | 16074 | 12622 | 12257 | 10593 |
| | 28019 | 27348 | 15251 | 28421 | 33162 | 24846 | 13660 | 30745 | 30737 | 15255 | 16426 | 16417 |
| | 29731 | 29734 | 29713 | 29679 | 16423 | 23897 | 17581 | 9546 | 32852 | 33319 | 20153 | 15436 |
| | 31953 | 32825 | 32826 | 17599 | 15635 | 31973 | 1812 | 1020 | 1215 | 1720 | 1577 | 953 |
| | 1220 | 1546 | 1316 | 1339 | 23298 | 33512 | 11628 | 25388 | 2213 | 15763 | 15762 | 1933 |
| | 2652 | 3845 | 31666 | 1868 | 3221 | 2743 | 2744 | 3658 | 2742 | 3555 | 3897 | 3807 |
| | 3682 | 3815 | 2793 | 2772 | 2503 | 2418 | 3075 | 2530 | 3601 | 2792 | 3432 | 1935 |
| | 1980 | 2529 | 3814 | 2843 | 1898 | 3361 | 1890 | 3203 | 2752 | 2723 | 1867 | 2794 |
| | 3740 | 3375 | 2450 | 1934 | 2378 | 2578 | 2293 | 3683 | 2203 | 2339 | 3762 | 2223 |
| | 2642 | 3863 | 3739 | 2184 | 17289 | 32984 | 29056 | 31096 | 21979 | 29091 | 29310 | 30713 |
| | 32007 | 14402 | 24850 | 17667 | 6013 | 4585 | 5616 | 4596 | 4586 | 5958 | 4967 | 4996 |
| | 4197 | 4191 | 6492 | 4994 | 4578 | 5487 | 6522 | 4142 | 5126 | 4681 | 6499 | 6389 |
| | 5604 | 5963 | 4963 | 4966 | 4680 | 4904 | 5275 | 5588 | 4620 | 4995 | 5262 | 5706 |
| | 4993 | 4402 | 4308 | 4964 | 6348 | 5277 | 4151 | 4152 | 4775 | 4317 | 6004 | 4522 |
| | 6504 | 8100 | 8175 | 9220 | 27450 | 9345 | 8307 | 9303 | 9188 | 6751 | 7749 | 7012 |
| | 8184 | 7103 | 7575 | 8805 | 6708 | 8333 | 7576 | 7382 | 6597 | 7654 | 8176 | 8238 |
| | 8182 | 8181 | 9302 | 8180 | 7356 | 9036 | 8543 | 7011 | 8754 | 6844 | 6851 | 8179 |
| | 8999 | 8709 | 8708 | 8710 | 8205 | 8250 | 7225 | 7651 | 7404 | 6691 | 6908 | 7196 |
| | 7524 | 6835 | 7652 | 9048 | 7483 | 9301 | 7165 | 7649 | 6798 | 6658 | 7971 | 7383 |
| | 8118 | 32867 | 9983 | 10049 | 18810 | 18811 | 18812 | 24102 | 11165 | 18828 | 21536 | 21203 |
| | 33556 | 10499 | 33555 | 13658 | 14087 | 11794 | 16513 | 16982 | 31301 | 20865 | 30891 | 13840 |
| | 12117 | 12968 | 10611 | 21490 | 26866 | 26857 | 13217 | 32493 | 32523 | | | |
| 577: | 9570 | 9571 | 1348 | 1188 | 2549 | 1961 | 2358 | 1887 | 2476 | 3339 | 3383 | 2753 |
| | 4040 | 2754 | 3129 | 2202 | 3080 | 3377 | 2566 | 2648 | 2329 | 2087 | 2157 | 2771 |
| | 1959 | 2625 | 1844 | 2563 | 3351 | 2928 | 17286 | 29113 | 29112 | 14749 | 14748 | 10177 |
| | 14090 | 6367 | 5699 | 5103 | 4311 | 7616 | 8569 | 8442 | | | | |
| 578: | 33046 | 22935 | 10215 | 10214 | 31713 | 31712 | 10213 | 10212 | 31714 | 23445 | 23486 | 24489 |
| | 26723 | 26703 | 25584 | 25550 | 22773 | 22764 | 31786 | 11130 | 9443 | 10427 | 10948 | 28339 |
| | 28338 | 32385 | 1574 | 1440 | 2001 | 2311 | 2423 | 3967 | 26827 | 20059 | 30544 | 10131 |
| | 29001 | 29350 | 18874 | 32469 | 12998 | 19708 | 10953 | 29231 | 29232 | 4688 | 5724 | 5866 |
| | 4686 | 4687 | 5056 | 5865 | 6365 | 5134 | 5161 | 4528 | 6419 | 4566 | 4840 | 7587 |
| | 8620 | 8799 | 7595 | 8800 | 8996 | 9249 | 8472 | 8764 | 8272 | 7596 | 8228 | 16956 |
| | 30456 | 17076 | 33133 | 10479 | 14569 | 9926 | 13231 | 22973 | 20659 | 9924 | 27461 | 29154 |
| | 29157 | 29156 | 20611 | | | | | | | | | |
| 579: | 10652 | 26605 | 29336 | 29337 | 24953 | 26604 | 31901 | 15972 | 22181 | 31559 | 21168 | 21170 |
| | 21169 | 13227 | 22097 | 27430 | 32943 | 31557 | 13971 | 30538 | 30539 | 23034 | 17894 | 15348 |
| | 15347 | 33594 | 31649 | 31648 | 32094 | 32093 | 31922 | 32935 | 31558 | 20728 | 20079 | 10203 |
| | 898 | 1051 | 1884 | 32640 | 31940 | 32643 | 32644 | 15931 | 15930 | 22550 | 29395 |
| | 20292 | 32022 | 10191 | 21098 | 23031 | 26524 | 23086 | 13495 | 31816 | 31645 | 31644 | 30840 |
| | 18437 | 13974 | 17977 | 20103 | 28642 | 31650 | 4909 | 4761 | 23355 | 6376 | 5360 | 6412 |
| | 4689 | 26902 | 26903 | 26904 | 5947 | 5362 | 6310 | 4682 | 7837 | 8282 | 9160 | 8837 |
| | 9219 | 7322 | 8838 | 6958 | 13782 | 13781 | 13286 | 26993 | 16652 | 28907 | 31911 | 14189 |
| | 9969 | 22117 | 15981 | 25196 | 31905 | 10932 | 10931 | 10934 | 10933 | 10930 | 31802 | |

TABLE 2-continued

| SEQ ID NO: | homolog SEQ ID NOs | | | | | | | | | | |
|---|---|---|---|---|---|---|---|---|---|---|---|
| 580: | 18507 | 15657 | 11386 | 18016 | 27460 | 22123 | 21535 | 17997 | 25350 | 23446 | 24523 | 24478 |
| | 26695 | 25631 | 22794 | 22780 | 23694 | 32003 | 29286 | 28912 | 27441 | 33137 | 24040 | 9817 |
| | 18528 | 29274 | 33254 | 12423 | 13789 | 1067 | 1461 | 17998 | 24121 | 3671 | 3107 | 2145 |
| | 3108 | 3614 | 2233 | 3341 | 14089 | 14252 | 24829 | 15068 | 21992 | 29133 | 15758 | 14850 |
| | 9998 | 11736 | 15615 | 28673 | 13615 | 17695 | 30446 | 4957 | 7149 | 6938 | 8621 | 7813 |
| | 16029 | 17647 | 17646 | 10572 | 31657 | 19925 | 19523 | 32118 | 24132 | 19721 | 19533 | 32490 |
| | 31561 | 25025 | 14469 | 17230 | 18541 | 19146 | 20678 | 20961 | 29454 | 10967 | 30762 | 30761 |
| | 30763 | 15427 | 14634 | | | | | | | | | |
| 581: | 24077 | 14353 | 17049 | 24733 | 18952 | 18227 | 12301 | 25106 | 25845 | 27734 | 25296 | 26261 |
| | 26369 | 1916 | 2866 | 2404 | 28875 | 29093 | 6191 | 5333 | 6301 | 5605 | 5332 | 4642 |
| | 6278 | 4536 | 5009 | 6081 | 5334 | 7753 | 8929 | 31326 | 20863 | | | |
| 582: | 17523 | 23792 | 15280 | 27920 | 20509 | 11941 | 23440 | 23450 | 23561 | 23555 | 23558 | 19603 |
| | 24404 | 24526 | 24480 | 24561 | 24411 | 24506 | 31007 | 26751 | 26737 | 26721 | 22797 | 22713 |
| | 22252 | 23925 | 23956 | 10775 | 27306 | 9528 | 1229 | 1412 | 1151 | 1423 | 1563 | 889 |
| | 1521 | 1450 | 11565 | 2808 | 20314 | 11457 | 11138 | 5779 | 6536 | 5329 | 6050 | 5773 |
| | 6211 | 6375 | 5834 | 4532 | 4481 | 4372 | 4385 | 6286 | 5331 | 5548 | 5330 | 4580 |
| | 4599 | 8496 | 9568 | 31808 | 21679 | 10362 | 20723 | 27205 | 20929 | 28731 | 12109 | 17619 |
| | 13523 | 30496 | 16643 | 15236 | 24593 | 15736 | 11758 | 20135 | 16647 | 15386 | 11766 | 11759 |
| | 30497 | 11763 | 32392 | | | | | | | | | |
| 583: | 14764 | 22414 | 29412 | 1730 | 24942 | 3910 | 1922 | 2632 | 2555 | 3613 | 2899 | 2556 |
| | 3258 | 29016 | 29104 | 29000 | 20294 | 29200 | 29252 | 29134 | 26906 | 11275 | 33240 | 33242 |
| | 30394 | 20078 | 20254 | 15374 | 5990 | 5907 | 5803 | 7128 | 6994 | 9405 | 7927 | 8911 |
| | 9397 | 29207 | 10480 | 18862 | 21911 | 21913 | 24600 | 9804 | 9541 | 11776 | 472 | 31976 |
| 584: | 21676 | 14951 | 30234 | 25811 | 13087 | 30843 | 17261 | 22555 | 25158 | 21067 | 13420 | 12672 |
| | 18979 | 17730 | 14627 | 15106 | 17535 | 15807 | 27908 | 16254 | 16659 | 17189 | 23121 | 33045 |
| | 18715 | 16357 | 24715 | 12804 | 9886 | 19394 | 19823 | 19502 | 19582 | 29932 | 20422 | 30122 |
| | 12340 | 22240 | 22863 | 29963 | 27182 | 23971 | 25072 | 28264 | 26971 | 24970 | 31080 | 27233 |
| | 29785 | 12400 | 13340 | 28190 | 28413 | 9560 | 15378 | 4064 | 3556 | 2282 | 3396 | 3255 |
| | 2361 | 18255 | 5826 | 4885 | 6180 | 16567 | 31184 | 12137 | 11660 | 31388 | 11305 | |
| 585: | 32754 | 13529 | 23325 | 23313 | 17648 | 20851 | 12214 | 27639 | 18799 | 23335 | 30235 | 9952 |
| | 23316 | 30098 | 33627 | 33621 | 824 | 756 | 720 | 586 | 787 | 792 | 628 | 613 |
| | 33628 | 570 | 567 | 13117 | 33619 | 814 | 794 | 815 | 759 | 32922 | 31135 | 17283 |
| | 12538 | 22061 | 23277 | 16092 | 16122 | 26917 | 24089 | 16161 | 17300 | 12547 | 24229 | 30004 |
| | 21063 | 13417 | 13435 | 13376 | 13375 | 13436 | 13383 | 12679 | 12675 | 12715 | 18321 | 13882 |
| | 21029 | 18545 | 15716 | 17061 | 14497 | 15141 | 14983 | 12867 | 32608 | 19005 | 15554 | 14146 |
| | 17533 | 23801 | 15817 | 23030 | 17030 | 15524 | 17852 | 28067 | 16235 | 18785 | 21198 | 16692 |
| | 16656 | 16864 | 27536 | 478 | 667 | 16815 | 16887 | 15919 | 11906 | 19231 | 19253 | 18625 |
| | 21885 | 17166 | 17484 | 17083 | 18603 | 18071 | 28605 | 18841 | 18709 | 16349 | 18890 | 33625 |
| | 19103 | 12791 | 33624 | 465 | 33618 | 33615 | 712 | 33623 | 12069 | 18201 | 18140 | 14000 |
| | 18498 | 19416 | 19345 | 19863 | 23515 | 19507 | 19677 | 19756 | 19946 | 29911 | 25958 | 25957 |
| | 24376 | 9707 | 20343 | 20998 | 20570 | 26787 | 25639 | 30138 | 22669 | 21723 | 20765 | 32208 |
| | 23234 | 12347 | 30328 | 22297 | 12314 | 24318 | 21020 | 33410 | 21630 | 22282 | 22862 | 21390 |
| | 24205 | 23159 | 25917 | 27197 | 23927 | 30178 | 26090 | 29991 | 30000 | 27491 | 25071 | 26593 |
| | 24282 | 30047 | 28830 | 28848 | 26968 | 26985 | 26936 | 26935 | 25687 | 27663 | 27657 | |
| | 27803 | 25315 | 11664 | 10725 | 10772 | 24974 | 27096 | 27066 | 27051 | 27052 | 25275 | 27162 |
| | 31055 | 26455 | 26217 | 26196 | 27960 | 27294 | 9503 | 12030 | 11504 | 16469 | 12409 | 13337 |
| | 13354 | 13302 | 13355 | 13301 | 16201 | 26138 | 16167 | 12505 | 24579 | 24580 | 17906 | 13278 |
| | 10403 | 10391 | 16076 | 14914 | 14894 | 10821 | 10599 | 28165 | 28023 | 27344 | 27352 | 18012 |
| | 28151 | 28459 | 33180 | 28669 | 28668 | 17680 | 29309 | 30013 | 30015 | 13712 | 17257 | 31392 |
| | 14451 | 11816 | 16440 | 13265 | 13264 | 31578 | 20889 | 17603 | 10474 | 33620 | 10561 | 10560 |
| | 10559 | 14277 | 10539 | 17587 | 33634 | 14789 | 15428 | 31851 | 16625 | 9971 | 24627 | 19515 |
| | 13000 | 13001 | 14795 | 1008 | 1145 | 871 | 907 | 906 | 905 | 1403 | 908 | 872 |
| | 1825 | 1398 | 1402 | 1126 | 1545 | 1401 | 1153 | 1456 | 1251 | 1544 | 1376 | 1414 |
| | 1527 | 1326 | 1697 | 1382 | 1354 | 1494 | 1399 | 1370 | 1361 | 1341 | 1476 | 1587 |
| | 1504 | 1817 | 1623 | 1264 | 1639 | 1417 | 1653 | 1543 | 1651 | 1590 | 1642 | 862 |
| | 1233 | 1377 | 1715 | 1400 | 33052 | 17251 | 10540 | 23323 | 11597 | 477 | 23063 | 3332 |
| | 3953 | 2689 | 3952 | 2736 | 3832 | 2735 | 2698 | 2641 | 3356 | 3109 | 4093 | 3333 |
| | 3386 | 3273 | 2964 | 9770 | 2014 | 2319 | 2635 | 3299 | 2144 | 2961 | 2963 | 2013 |
| | 2015 | 2898 | 10538 | 2993 | 1853 | 2061 | 2105 | 2269 | 9769 | 3272 | 2485 | 3530 |
| | 2214 | 2718 | 2135 | 2962 | 2142 | 2617 | 2139 | 2812 | 2676 | 2490 | 2257 | 2965 |
| | 2543 | 2966 | 2289 | 2277 | 3328 | 2134 | 2143 | 1928 | 2724 | 1939 | 2130 | 2491 |
| | 2967 | 1965 | 2140 | 2308 | 2313 | 2310 | 2128 | 2193 | 1998 | 1850 | 2480 | 2131 |
| | 1912 | 2192 | 1851 | 2592 | 2241 | 2212 | 4052 | 1849 | 2316 | 2245 | 1996 | 4048 |
| | 2997 | 2968 | 2118 | 3086 | 2133 | 1839 | 2129 | 2297 | 1894 | 2486 | 2176 | 4047 |
| | 2479 | 2172 | 2076 | 2727 | 1947 | 2208 | 4050 | 3066 | 2141 | 1892 | 1843 | |
| | 1913 | 2242 | 2179 | 1937 | 2655 | 2251 | 2290 | 2749 | 2132 | 3023 | 4032 | 2373 |
| | 4069 | 1896 | 2492 | 2075 | 2279 | 2299 | 2171 | 2577 | 2320 | 2200 | 2304 | 2155 |
| | 2258 | 2180 | 4056 | 2174 | 1891 | 1966 | 4057 | 4071 | 1865 | 4037 | 4033 | 1842 |
| | 2000 | 3073 | 1863 | 4049 | 2191 | 1899 | 2779 | 1943 | 2712 | 2234 | 2383 | 9733 |
| | 32132 | 23108 | 20083 | 18469 | 14806 | 14945 | 10076 | 13455 | 19522 | 32011 | 32013 | 32012 |
| | 16981 | 29015 | 20107 | 27123 | 33311 | 20325 | 23293 | 13487 | 23019 | 14473 | 19901 | 13486 |
| | 28336 | 15423 | 18523 | 10558 | 20075 | 20076 | 33453 | 33451 | 33450 | 33452 | 33456 | 33454 |
| | 33455 | 32395 | 23029 | 31809 | 23027 | 23028 | 19519 | 19520 | 19516 | 32551 | 19518 | |
| | 32549 | 14435 | 19517 | 23322 | 23317 | 23727 | 31702 | 10537 | 21855 | 10535 | 23677 | 23329 |
| | 23676 | 23315 | 5935 | 5934 | 4350 | 5475 | 5473 | 5131 | 6257 | 4828 | 5471 | 6394 |
| | 4669 | 5711 | 4827 | 6270 | 5132 | 4663 | 5474 | 6332 | 5472 | 4668 | 6418 | 4354 |
| | 4324 | 4328 | 5153 | 6314 | 6490 | 4301 | 4783 | 6465 | 4472 | 4342 | 4859 | 10003 |
| | 4218 | 4726 | 4863 | 4216 | 4230 | 4448 | 4741 | 4325 | 4337 | 4219 | 4573 | 4329 |

TABLE 2-continued

| SEQ ID NO: | homolog SEQ ID NOs | | | | | | | | | | |
|---|---|---|---|---|---|---|---|---|---|---|---|
| | 4411 | 4473 | 4330 | 4338 | 4213 | 4720 | 4513 | 4511 | 5389 | 5388 | 5165 | 4341 |
| | 4351 | 4214 | 4514 | 5244 | 4232 | 5219 | 4451 | 4347 | 5218 | 5217 | 5216 | 4542 |
| | 4231 | 4215 | 4343 | 4607 | 4340 | 5265 | 5148 | 4487 | 4217 | 4221 | 5146 | 5145 |
| | 4452 | 5138 | 4353 | 5523 | 4483 | 4446 | 4574 | 5251 | 5252 | 5250 | 5247 | 5516 |
| | 4786 | 4334 | 4333 | 4785 | 6464 | 6475 | 4705 | 5135 | 10005 | 4449 | 4947 | 6498 |
| | 4925 | 4469 | 4413 | 4949 | 5997 | 4946 | 4944 | 4941 | 4939 | 4929 | 4930 | 4928 |
| | 4194 | 4919 | 4918 | 4466 | 5144 | 32548 | 10534 | 23327 | 6476 | 4936 | 4934 | 4932 |
| | 5478 | 4327 | 5143 | 4223 | 4390 | 4943 | 4923 | 4484 | 23328 | 4727 | 4572 | 5162 |
| | 4150 | 5573 | 4942 | 4924 | 4922 | 4339 | 4886 | 4455 | 4453 | 5248 | 4323 | 6392 |
| | 4512 | 4445 | 5595 | 4945 | 4938 | 4415 | 4352 | 4901 | 6093 | 23314 | 4427 | 33053 |
| | 33203 | 4822 | 5553 | 6480 | 5481 | 5156 | 4395 | 10536 | 5537 | 4608 | 4447 | 10002 |
| | 5524 | 5482 | 5783 | 5155 | 5139 | 4900 | 5246 | 4920 | 4716 | 5140 | 4857 | 4719 |
| | 4948 | 4940 | 4921 | 5480 | 5137 | 4926 | 5142 | 6462 | 5463 | 5141 | 5249 | 4937 |
| | 5163 | 5479 | 4718 | 5452 | 4220 | 4412 | 6043 | 4419 | 10004 | 4931 | 4486 | 4474 |
| | 4530 | 4478 | 4454 | 4485 | 4565 | 4935 | 5173 | 4731 | 4717 | 5136 | 4933 | 4326 |
| | 5154 | 5164 | 5888 | 4605 | 4927 | 5171 | 4737 | 6009 | 6451 | 5152 | 5477 | 4787 |
| | 4784 | 4229 | 4450 | 4376 | 5476 | 5170 | 4410 | 6466 | 6218 | 4703 | 6463 | 5558 |
| | 6235 | 5310 | 4704 | 4222 | 31946 | 23324 | 23318 | 23320 | 23319 | 23312 | 23311 | 23310 |
| | 23309 | 9299 | 9268 | 9298 | 9300 | 7501 | 8401 | 9217 | 8606 | 8167 | 8162 | 8699 |
| | 8482 | 8879 | 8875 | 8872 | 8877 | 8873 | 8971 | 8874 | 8161 | 8605 | 8876 | 8878 |
| | 8917 | 8958 | 9297 | 8970 | 8063 | 7480 | 8607 | 7795 | 8203 | 7565 | 7415 | 7447 |
| | 7414 | 8208 | 7210 | 7312 | 8349 | 8842 | 8445 | 8159 | 7417 | 8841 | 8511 | 8867 |
| | 8157 | 8959 | 8169 | 8928 | 8916 | 8843 | 6730 | 6594 | 15926 | 9585 | 16534 | 16953 |
| | 707 | 30215 | 20641 | 32546 | 23330 | 23321 | 28643 | 33630 | 713 | 28688 | 16534 | 17866 |
| | 17865 | 17714 | 17713 | 18410 | 18409 | 18408 | 18412 | 18411 | 18407 | 31190 | 17936 | 20198 |
| | 30911 | 11023 | 12112 | 786 | 32134 | 22556 | 32131 | 23107 | 32321 | 32322 | 23109 | 32133 |
| | 32137 | 32323 | 32136 | 32135 | 21746 | 21488 | 23326 | 16609 | 12192 | 708 | 33622 | 571 |
| | 18866 | 26868 | 13216 | 28044 | 13170 | | | | | | | |
| 586: | 31243 | 31242 | 15303 | 23325 | 23313 | 9952 | 23316 | 13118 | 31135 | 21736 | 17283 | 27470 |
| | 21777 | 26917 | 25140 | 21043 | 15800 | 23030 | 28223 | 667 | 20602 | 33625 | 712 | 30130 |
| | 22230 | 31075 | 9864 | 32235 | 10424 | 20071 | 9988 | 33180 | 28669 | 28668 | 17680 | 29309 |
| | 30013 | 30015 | 23751 | 15749 | 31624 | 33188 | 33187 | 31392 | 14334 | 14635 | 14451 | 33042 |
| | 28788 | 14231 | 10603 | 11816 | 13265 | 13264 | 31578 | 33087 | 10561 | 10560 | 10559 | 14277 |
| | 10539 | 31630 | 16625 | 9971 | 24627 | 19515 | 13000 | 13001 | 14795 | 1258 | 33052 | 28653 |
| | 31735 | 10540 | 23323 | 477 | 23063 | 3132 | 9733 | 32132 | 23108 | 20083 | 18469 | 33178 |
| | 14945 | 10076 | 13455 | 19522 | 31241 | 32011 | 32013 | 32012 | 16981 | 32491 | 31101 | 22002 |
| | 29370 | 20325 | 23293 | 13487 | 23019 | 14473 | 19278 | 15423 | 18523 | 10558 | 10557 | 32814 |
| | 20075 | 20076 | 33453 | 33451 | 33450 | 33452 | 33456 | 33454 | 33455 | 32395 | 23029 | 31809 |
| | 23027 | 23028 | 19519 | 19520 | 32550 | 19516 | 32551 | 19518 | 32549 | 14435 | 19517 | 23322 |
| | 23317 | 22969 | 33202 | 28787 | 23677 | 23315 | 23676 | 23329 | 22970 | 11111 | 31946 | 23324 |
| | 23318 | 23320 | 23319 | 23312 | 23311 | 23310 | 23309 | 14565 | 10651 | 8659 | 8660 | 6863 |
| | 8466 | 15926 | 9585 | 18463 | 32546 | 22115 | 23330 | 23321 | 33630 | 29794 | 17866 | 17865 |
| | 17714 | 17713 | 18410 | 18409 | 18408 | 18412 | 18411 | 18407 | 17936 | 786 | 32134 | 22556 |
| | 32131 | 23107 | 32321 | 32322 | 23109 | 32133 | 32137 | 32323 | 32136 | 32135 | 21516 | 14233 |
| | 32515 | 23326 | 571 | 19463 | 15874 | | | | | | | |
| 587: | 22414 | 20378 | 13220 | 26615 | 26611 | 26616 | 13224 | 26612 | 26610 | 26613 | 26614 | 13222 |
| | 13226 | 26618 | 13225 | 13223 | 13221 | 26617 | 26619 | 22822 | 20287 | 29127 | 20293 | 22059 |
| | 21991 | 5586 | 27436 | 18862 | 26892 | 24604 | 26893 | 15392 | 31978 | 26890 | 15377 | 26894 |
| | 26889 | 26891 | 28090 | 17888 | | | | | | | | |
| 588: | 11116 | 30310 | 20087 | 23471 | 26729 | 25622 | 25574 | 25547 | 21178 | 21177 | 30728 | 9665 |
| | 1829 | 1828 | 1336 | 1682 | 2739 | 2704 | 30750 | 14962 | 26905 | 33107 | 33106 | 11218 |
| | 28674 | 32865 | 10969 | 26996 | | | | | | | | |
| 589: | 18697 | 23456 | 23463 | 26812 | 26811 | 30158 | 13754 | 27158 | 31812 | 1262 | 1340 | 1496 |
| | 936 | 1164 | 1689 | 1219 | 1394 | 29105 | 29121 | 5751 | 6604 | 29738 | 20675 | 20652 |
| | 22946 | 31981 | 10223 | 11757 | 15860 | 17620 | 11740 | 32853 | 16621 | 19698 | 14777 | 19699 |
| | 11749 | 33271 | 25309 | 19700 | 20117 | 18239 | 15728 | 28671 | 16307 | 17889 | 33144 | 24606 |
| | 19157 | 15857 | 32503 | 33487 | 11741 | 24930 | 17613 | 33044 | 29327 | 22964 | 33077 | 32520 |
| | 20118 | 15878 | 18238 | 33142 | 33147 | 31990 | 33486 | 33076 | 15734 | 9563 | 16962 | 11772 |
| | 33080 | 33078 | 11782 | 11790 | 33473 | 33145 | 527 | 14264 | 17621 | 15856 | 17886 | 33143 |
| 590: | 30755 | 13526 | 13567 | 12203 | 30236 | 30101 | 13097 | 31397 | 32909 | 33206 | 29386 | 29384 |
| | 29377 | 29378 | 29380 | 29385 | 29382 | 29381 | 29379 | 29383 | 10918 | 15978 | 33549 | 10271 |
| | 16120 | 27863 | 11196 | 29946 | 17290 | 12566 | 29426 | 25134 | 21057 | 13411 | 12678 | 12714 |
| | 11266 | 18327 | 11703 | 18757 | 13844 | 20327 | 14209 | 18554 | 14375 | 15697 | 17745 | 33108 |
| | 14611 | 14673 | 15181 | 15022 | 12939 | 32936 | 15123 | 15536 | 17560 | 22460 | 23758 | 15772 |
| | 17784 | 16244 | 28093 | 21191 | 16718 | 26005 | 27535 | 16816 | 29857 | 29882 | 11885 | 19233 |
| | 17176 | 17131 | 18095 | 28565 | 33109 | 18710 | 16323 | 24711 | 18879 | 19078 | 12805 | 12075 |
| | 9898 | 33550 | 18112 | 14017 | 18488 | 19294 | 19817 | 19494 | 19656 | 19757 | 29922 | 25968 |
| | 9432 | 25005 | 20571 | 25036 | 20774 | 32198 | 23217 | 12351 | 30330 | 22346 | 12272 | 33385 |
| | 21637 | 22264 | 22884 | 21466 | 21373 | 21281 | 23127 | 24064 | 23491 | 23931 | 25732 | 24646 |
| | 24673 | 27479 | 30091 | 28268 | 25122 | 26962 | 25702 | 27761 | 25448 | 10732 | 24972 | 25268 |
| | 31061 | 26495 | 26233 | 27950 | 27286 | 11315 | 11383 | 9484 | 12032 | 11526 | 16466 | 16476 |
| | 30616 | 13332 | 26097 | 26141 | 12514 | 10375 | 30511 | 16071 | 12619 | 12249 | 14916 | 19475 |
| | 9839 | 30451 | 23037 | 32234 | 10425 | 28017 | 27374 | 18009 | 20070 | 28361 | 28125 | 32478 |
| | 28465 | 24826 | 11732 | 32556 | 25027 | 18758 | 13697 | 27412 | 15933 | 16406 | 945 | 1247 |
| | 1397 | 1559 | 20729 | 11564 | 24678 | 29092 | 20210 | 20207 | 20208 | 20209 | 17625 | 5909 |
| | 4879 | 5549 | 31943 | 4655 | 31944 | 6443 | 6127 | 4814 | 5268 | 4962 | 5242 | 4880 |
| | 5728 | 4650 | 4533 | 5197 | 5571 | 4349 | 5938 | 4430 | 4384 | 4368 | 5922 | 4968 |
| | 4806 | 5529 | 9165 | 10044 | 9190 | 6867 | 7471 | 7479 | 6692 | 10042 | 7568 | 20145 |

TABLE 2-continued

| SEQ ID NO: | homolog SEQ ID NOs | | | | | | | | | | |
|---|---|---|---|---|---|---|---|---|---|---|---|
| | 7951 | 31517 | 8598 | 8597 | 8452 | 8051 | 7836 | 7215 | 7314 | 7182 | 10043 | 8749 |
| | 7485 | 7670 | 8935 | 6771 | 31028 | 26885 | 24011 | 24013 | 24014 | 24012 | 24018 | 24015 |
| | 24016 | 24017 | 30999 | 33315 | 33129 | 33127 | 33126 | 33130 | 33128 | 31000 | 14717 | 22602 |
| | 21156 | 21153 | 21151 | 14721 | 21155 | 21152 | 21148 | 21147 | 22606 | 22603 | 22593 | 22592 |
| | 22581 | 21157 | 21154 | 21150 | 21149 | 21146 | 14719 | 22588 | 22584 | 22589 | 22591 | 22583 |
| | 22579 | 14720 | 22600 | 22590 | 22587 | 22597 | 22607 | 22605 | 22599 | 22596 | 22595 | 22585 |
| | 22582 | 22577 | 22608 | 22578 | 22598 | 22586 | 21145 | 14718 | 22601 | 22604 | 22594 | 22580 |
| | 21158 | 32555 | 18428 | 22920 | 22132 | 18662 | 14952 | 14693 | 14697 | 14694 | 14722 | 14695 |
| | 14696 | 14709 | 14710 | 14708 | 14706 | 14704 | 14705 | 14707 | 14702 | 14698 | 14699 | 14700 |
| | 14703 | 14701 | 14716 | 14715 | 14712 | 14714 | 14711 | 14713 | 28687 | 16508 | 16552 | 13234 |
| | 9672 | 31183 | 27514 | 31298 | 30921 | 31593 | 31594 | 14887 | 14890 | 14888 | 14891 | 14889 |
| | 32333 | 32332 | 12116 | 21764 | 16605 | 12185 | 19160 | 26837 | 20363 | 32263 | 33114 | 20724 |
| | 31403 | 13173 | | | | | | | | | | |
| 591: | 23597 | 24338 | 26806 | 26804 | 22756 | 1749 | 888 | 1534 | 1725 | 29144 | 29030 | 28951 |
| | 5820 | 4754 | 4554 | 4288 | 5964 | 6349 | 6271 | 4544 | 6025 | 4206 | 4278 | 5371 |
| | 6075 | 7953 | 8779 | 9289 | 9375 | 8014 | 6736 | 8719 | 8923 | 7248 | 7456 | 7590 |
| | 8002 | 7612 | 7785 | 7657 | 7432 | 7531 | 7784 | 7790 | 6666 | 8751 | 8864 | 33004 |
| | 10913 | 32115 | 33193 | 24637 | | | | | | | | |
| 592: | 23483 | 23534 | 24445 | 26644 | 26722 | 26689 | 25531 | 25532 | 22645 | 18865 | 31977 | 29331 |
| | 32854 | 32855 | 1038 | 1810 | 1042 | 1056 | 1357 | 1234 | 1389 | 948 | 1719 | 32398 |
| | 32397 | 3860 | 3220 | 3687 | 3551 | 3604 | 31097 | 21987 | 4243 | 33054 | 12749 | 11172 |
| | 18836 | 20644 | 19272 | 32881 | 24845 | 30839 | 8068 | | | | | |
| 593: | 23449 | 24469 | 26632 | 22657 | 9544 | 10871 | 1503 | 3716 | 5509 | 4426 | 8431 | 8430 |
| | 7742 | 8432 | 8456 | 17264 | 14427 | 20630 | | | | | | |
| 594: | 24610 | 15439 | 19155 | 29324 | 33477 | 9547 | 33479 | 9548 | 14834 | 33478 | 876 | 1723 |
| | 935 | 3427 | 3731 | 3204 | 28947 | 22030 | 21964 | 29099 | 5716 | 4740 | 6085 | 7097 |
| 595: | 23303 | 31546 | 896 | 1364 | 903 | 1310 | 24942 | 3883 | 22824 | 22825 | 22493 | 26906 |
| | 10877 | 11275 | 15331 | 30992 | 22912 | 4103 | 5948 | 9213 | 8464 | 10481 | 18862 | 15943 |
| 596: | 1239 | 1421 | 1931 | 29135 | 29258 | 29021 | 6402 | 4432 | 6225 | 9379 | 6696 | 6904 |
| | 6871 | 7567 | 6837 | 32279 | | | | | | | | |
| 597: | 17931 | 23278 | 12881 | 33025 | 27915 | 27550 | 29877 | 12012 | 16355 | 24702 | 19803 | 19788 |
| | 19579 | 19573 | 21601 | 25728 | 11662 | 10783 | 26373 | 26382 | 27280 | 27305 | 26150 | 28402 |
| | 1031 | 11575 | 4095 | 3426 | 3425 | 3548 | 4661 | 5925 | 6129 | 9120 | 8451 | 6841 |
| | 8130 | 9119 | 8641 | 10178 | 16524 | 12120 | 28892 | | | | | |
| 598: | 13869 | 16693 | 18186 | 23598 | 24379 | 26754 | 25524 | 22725 | 25432 | 10679 | 26125 | 16197 |
| | 26038 | 1385 | 11589 | 3477 | 2043 | 1976 | 29083 | 5591 | 6697 | 7030 | 9344 | 8462 |
| | 7517 | 7031 | 20694 | | | | | | | | | |
| 599: | 33101 | 1601 | 3031 | 3597 | 3824 | 1926 | 3166 | 2111 | 5052 | 8148 | | |
| 600: | 11554 | 11553 | 11555 | 31546 | 22414 | 14396 | 20378 | 14803 | 17597 | 1744 | 24942 | 3847 |
| | 3848 | 28639 | 19429 | 21905 | 20580 | 20582 | 21904 | 20583 | 21906 | 20581 | 33244 | 33246 |
| | 33243 | 33240 | 33242 | 33239 | 33241 | 13085 | 5568 | 4954 | 4506 | 32810 | 11551 | 11552 |
| | 10480 | 10481 | 10482 | 10483 | 27167 | | | | | | | |
| 601: | 3404 | 2616 | 6255 | 4458 | 4535 | 5207 | 8557 | 8625 | 8168 | 8488 | 7495 | 8626 |
| | 6640 | 32524 | | | | | | | | | | |
| 602: | 31379 | 30665 | 13541 | 27847 | 22512 | 11203 | 16154 | 10905 | 25779 | 13397 | 12668 | 18340 |
| | 33015 | 14222 | 14543 | 14380 | 14681 | 14489 | 32602 | 19015 | 14137 | 17548 | 15081 | 23814 |
| | 15793 | 27913 | 28063 | 16237 | 18790 | 25996 | 16806 | 21886 | 17174 | 17452 | 18602 | 18846 |
| | 18684 | 18731 | 16316 | 24698 | 12826 | 12071 | 9884 | 19412 | 19799 | 22834 | 19491 |
| | 19627 | 9704 | 20404 | 30123 | 12478 | 23212 | 30326 | 24299 | 21016 | 22869 | 24207 | 23964 |
| | 25712 | 26049 | 26952 | 25220 | 27039 | 27251 | 11365 | 11486 | 11505 | 16460 | 12389 | 13319 |
| | 30531 | 32036 | 11250 | 10846 | 28179 | 28478 | 16441 | 1695 | 1249 | 2513 | 2028 | 3012 |
| | 2951 | 2287 | 4732 | 5754 | 4255 | 4256 | 6016 | 5379 | 4757 | 8695 | 7178 | 6624 |
| | 7119 | 8278 | 8277 | 6896 | 7762 | 16505 | 31320 | 20883 | 11021 | 12098 | 31256 | 31411 |
| 603: | 1738 | 29007 | 30751 | 6263 | 5313 | 4623 | 5533 | 8280 | 7910 | 8954 | 7538 | 7537 |
| | 7486 | 18762 | | | | | | | | | | |
| 604: | 13109 | 27877 | 33014 | 29279 | 14616 | 15173 | 27582 | 24694 | 18123 | 19796 | 23526 | 24383 |
| | 24437 | 24441 | 24533 | 26678 | 26677 | 20788 | 21448 | 28254 | 27174 | 23947 | 30060 | 24265 |
| | 27670 | 27810 | 10720 | 10669 | 30160 | 30163 | 30164 | 30167 | 30169 | 27252 | 27339 | 28405 |
| | 13657 | 14763 | 22752 | 1021 | 11147 | 11406 | 11603 | 11606 | 14964 | 23016 | 3303 | 2054 |
| | 3279 | 3858 | 3688 | 17715 | 15954 | 21937 | 32167 | 21931 | 9738 | 15481 | 15479 | 5720 |
| | 6409 | 4158 | 6276 | 5213 | 4122 | 5201 | 4248 | 5200 | 4999 | 9064 | 8436 | 7096 |
| | 6648 | 6839 | 7911 | 8352 | 9023 | 6731 | 6776 | 28232 | 23104 | 20676 | 18457 | 22952 |
| | 10336 | 28737 | 22894 | 30919 | 22891 | 20125 | | | | | | |
| 605: | 9802 | 33199 | 15213 | 9745 | 13538 | 13530 | 27608 | 27647 | 30244 | 30099 | 11418 | 31676 |
| | 21585 | 10272 | 10249 | 11191 | 11179 | 24080 | 24076 | 17362 | 17346 | 17319 | 17348 |
| | 17325 | 17358 | 12573 | 25161 | 13432 | 18303 | 18316 | 12861 | 13888 | 23662 | 20384 | 20382 |
| | 14534 | 15696 | 14585 | 14592 | 15158 | 15156 | 15137 | 15002 | 14978 | 12904 | 12896 | 12926 |
| | 32305 | 15120 | 20074 | 19028 | 17520 | 17561 | 22442 | 23759 | 15291 | 14464 | 15292 | 23760 |
| | 17002 | 17791 | 17765 | 16277 | 29826 | 29819 | 28101 | 26003 | 32371 | 32365 | 27549 | 27589 |
| | 16831 | 15905 | 29895 | 20488 | 25984 | 25975 | 11920 | 11956 | 11988 | 11911 | 11975 | 11954 |
| | 19228 | 17467 | 17147 | 17125 | 17136 | 17124 | 17243 | 18034 | 28552 | 28582 | 28576 | 28574 |
| | 28563 | 18674 | 18704 | 16309 | 16395 | 16338 | 24754 | 24770 | 24723 | 18913 | 18961 | 18943 |
| | 18964 | 18897 | 18944 | 18926 | 18903 | 19125 | 19118 | 19122 | 12811 | 12807 | 9877 | 18139 |
| | 18228 | 18212 | 18101 | 14030 | 14055 | 19317 | 19860 | 19831 | 23498 | 23521 | 23625 | 23538 |
| | 23592 | 23611 | 23436 | 23423 | 19610 | 19607 | 19558 | 29927 | 20022 | 25006 | 24999 | 24455 |
| | 24555 | 24416 | 24351 | 24549 | 24417 | 24352 | 24552 | 24419 | 24559 | 24468 | 22974 | 26744 |
| | 26709 | 26735 | 26736 | 26731 | 26684 | 26675 | 26734 | 26755 | 26711 | 26668 | 25537 | 25877 |
| | 25884 | 30135 | 22655 | 22799 | 22698 | 22683 | 20809 | 20769 | 32225 | 32228 | 23200 | 23232 |

TABLE 2-continued

| SEQ ID NO: | homolog SEQ ID NOs | | | | | | | | | | |
|---|---|---|---|---|---|---|---|---|---|---|---|
| | 30367 | 22334 | 22329 | 24302 | 33433 | 33434 | 21648 | 21632 | 22569 | 22288 | 22874 | 21449 |
| | 21426 | 21427 | 21402 | 21340 | 21339 | 21297 | 21306 | 21256 | 21255 | 24200 | 23248 | 23249 |
| | 23139 | 25913 | 29488 | 29491 | 29968 | 27195 | 27184 | 23985 | 25179 | 30186 | 26089 | 25817 |
| | 25825 | 30056 | 24278 | 30041 | 25129 | 30035 | 26982 | 25259 | 27684 | 27678 | 27704 | 27662 |
| | 25455 | 25470 | 13035 | 13045 | 10695 | 10740 | 10660 | 27087 | 13749 | 13739 | 27151 | 31057 |
| | 26465 | 26487 | 26422 | 26444 | 26398 | 26289 | 26244 | 26245 | 26392 | 26335 | 26235 | 26302 |
| | 26320 | 26316 | 26371 | 27927 | 27263 | 27245 | 9483 | 11530 | 11465 | 11517 | 29759 | 29791 |
| | 29751 | 29771 | 30650 | 30600 | 12402 | 13352 | 26127 | 16178 | 16214 | 26152 | 24583 | 17924 |
| | 23681 | 16078 | 14892 | 28024 | 27990 | 27989 | 27336 | 28424 | 28418 | 28454 | 28433 | 28306 |
| | 28297 | 31797 | 14755 | 15591 | 20836 | 31796 | 13679 | 13664 | 24806 | 19288 | 23403 | 31236 |
| | 31237 | 24835 | 24834 | 16412 | 29732 | 16425 | 29689 | 16430 | 17750 | 988 | 1538 | 1315 |
| | 1313 | 1307 | 1169 | 1170 | 1581 | 1181 | 923 | 1110 | 11590 | 3834 | 3975 | 2709 |
| | 3046 | 3524 | 3527 | 3628 | 3331 | 2412 | 3047 | 23401 | 31915 | 23400 | 24913 | 23399 |
| | 23402 | 24914 | 33007 | 32088 | 29196 | 29197 | 29199 | 19940 | 29195 | 29315 | 29198 | 28955 |
| | 15855 | 28228 | 11221 | 4564 | 6254 | 5928 | 6068 | 5937 | 5653 | 4563 | 5320 | 5060 |
| | 5311 | 6000 | 6111 | 4276 | 5059 | 4597 | 6313 | 4257 | 5312 | 5302 | 5613 | 4262 |
| | 5521 | 4670 | 6524 | 6133 | 5782 | 5815 | 8353 | 9195 | 7841 | 6912 | 7918 | 7687 |
| | 6861 | 6834 | 8908 | 6581 | 6950 | 9100 | 9099 | 9194 | 33236 | 33237 | 23745 | 16032 |
| | 16033 | 16031 | 28342 | 29177 | 12748 | 32525 | 24951 | 32526 | 16636 | 25021 | 24023 | 27014 |
| | 23666 | 19154 | 20672 | 22980 | 13237 | 28870 | 28328 | 28327 | 28758 | 28772 | 28736 | 28690 |
| | 28703 | 16533 | 16564 | 16538 | 12440 | 31217 | 31194 | 30906 | 31021 | 12150 | 12964 | 31432 |
| | 31450 | 13166 | 15448 | 18438 | 24628 | 11770 | 17880 | | | | | |
| 606: | 26607 | 1758 | 1125 | 1630 | 1013 | 3799 | 2945 | 2454 | 2670 | 3798 | 2350 | 2149 |
| | 3927 | 2573 | 22008 | 29031 | 23888 | 31952 | 4854 | 4855 | 6493 | 10958 | 7774 | 8720 |
| | 6667 | | | | | | | | | | | |
| 607: | 1332 | 869 | 1080 | 28884 | 21557 | 28982 | 29247 | 30204 | 20188 | 20187 | 15572 | 3592 |
| | 2306 | 2995 | 3342 | 3659 | 2814 | | | | | | | |
| 608: | 31985 | 1011 | 18537 | 21118 | 6080 | 6119 | 8019 | 8174 | 7224 | 8814 | 3254 | 3955 |
| | 2687 | 2714 | | | | | | | | | | |
| 609: | 13534 | 30276 | 30100 | 17223 | 11604 | 13141 | 13099 | 30669 | 32310 | 31903 | 25777 | 25778 |
| | 21047 | 20380 | 14624 | 14668 | 15104 | 15540 | 22480 | 22469 | 15806 | 15766 | 28099 | 28214 |
| | 16881 | 15912 | 25978 | 17476 | 17091 | 18078 | 18090 | 16345 | 19092 | 19069 | 9901 | 19375 |
| | 19295 | 9680 | 30591 | 25892 | 20601 | 12354 | 12334 | 30349 | 12284 | 25921 | 25926 | 25185 |
| | 27509 | 25816 | 25784 | 25674 | 27813 | 24957 | 24958 | 31060 | 27260 | 9534 | 30628 | 26117 |
| | 12623 | 12844 | 10841 | 27319 | 30769 | 30768 | 10006 | 24932 | 24918 | 24917 | 26551 | 24919 |
| | 14389 | 32416 | 28625 | 9676 | 9771 | 28622 | 28623 | 994 | 1250 | 1666 | 1556 | 28624 |
| | 28626 | 27465 | 3896 | 1847 | 3875 | 3233 | 2605 | 2604 | 2392 | 2892 | 1997 | 2391 |
| | 16030 | 29041 | 28960 | 28959 | 15645 | 33600 | 24802 | 29224 | 12425 | 12424 | 5237 | 22987 |
| | 24321 | 5676 | 5695 | 5601 | 24322 | 4803 | 5787 | 9010 | 6907 | 8471 | 7352 | 6823 |
| | 6926 | 31346 | 28627 | 28628 | 16548 | 31226 | 14430 | 19722 | 28629 | 20590 | 21484 | 33629 |
| | 10047 | | | | | | | | | | | |
| 610: | 1409 | 1650 | 1992 | 3114 | 3695 | 2846 | 3492 | 29039 | 5079 | 5634 | 7856 | 8855 |
| | 8533 | 9323 | 6762 | 8989 | 18449 | 31784 | 32236 | | | | | |
| 611: | 23485 | 24384 | 26628 | 25582 | 1222 | 1116 | 31814 | 3571 | 3095 | 2405 | 2804 | 2086 |
| | 29076 | 22038 | 31103 | 4543 | 6363 | 4228 | 5373 | 5378 | 4736 | 4906 | 8254 | 7756 |
| | 7958 | 7327 | 8995 | 8978 | 21685 | 9437 | 23673 | 20722 | | | | |
| 612: | 11554 | 11553 | 11555 | 11558 | 11559 | 31546 | 14396 | 20378 | 31617 | 3622 | 3522 | 2662 |
| | 28639 | 22493 | 28928 | 29026 | 21904 | 21905 | 20580 | 20582 | 20583 | 20581 | 21906 | 33240 |
| | 33242 | 33241 | 33239 | 13085 | 6388 | 5084 | 6008 | 4624 | 5772 | 8925 | 6782 | 7977 |
| | 9399 | 11552 | 10480 | 10483 | 10482 | 10481 | 17617 | | | | | |
| 613: | 13568 | 23325 | 23313 | 9952 | 23316 | 13105 | 815 | 759 | 31135 | 17283 | 22061 | 26917 |
| | 25133 | 21071 | 15785 | 23030 | 33625 | 25039 | 465 | 22284 | 31073 | 33180 | 28669 |
| | 28668 | 17680 | 29309 | 30013 | 30015 | 31392 | 14451 | 11816 | 13265 | 13264 | 31578 | 17603 |
| | 10474 | 10561 | 10560 | 10559 | 14277 | 10539 | 24627 | 16625 | 9971 | 19515 | 13000 | 13001 |
| | 14795 | 871 | 907 | 906 | 905 | 1403 | 908 | 872 | 1825 | 1398 | 1402 | 1126 |
| | 1545 | 1401 | 1153 | 1456 | 1251 | 1544 | 1376 | 1414 | 1527 | 1326 | 1382 | 1354 |
| | 1494 | 1399 | 1370 | 1361 | 1341 | 1476 | 1587 | 1504 | 1817 | 1623 | 1264 | 1639 |
| | 1417 | 1653 | 1543 | 1651 | 1590 | 862 | 1233 | 1377 | 1715 | 1400 | 33052 | 10540 |
| | 23323 | 477 | 23063 | 2641 | 3109 | 3386 | 3273 | 2964 | 9770 | 2014 | 2319 | 2635 |
| | 3299 | 2144 | 2961 | 2963 | 2013 | 2015 | 2898 | 10538 | 2993 | 1853 | 2061 | 3272 |
| | 2105 | 9769 | 2485 | 2214 | 2718 | 2135 | 2962 | 2142 | 2139 | 2676 | 2490 |
| | 2257 | 2965 | 2543 | 2966 | 2289 | 2277 | 3328 | 2134 | 2143 | 1928 | 2724 | 1939 |
| | 2130 | 2491 | 2967 | 1965 | 2140 | 2308 | 2128 | 2313 | 2310 | 2193 | 1998 | 1850 |
| | 2480 | 2131 | 1912 | 2192 | 1851 | 2592 | 2241 | 2212 | 4052 | 1849 | 2316 | 2245 |
| | 1996 | 4048 | 2997 | 2968 | 2118 | 2133 | 1839 | 2129 | 2297 | 2486 | 2176 |
| | 4047 | 1894 | 2479 | 2172 | 2076 | 2727 | 1947 | 4046 | 2208 | 4050 | 3066 | 2141 |
| | 1892 | 1843 | 1913 | 2242 | 2179 | 1937 | 2655 | 2251 | 2290 | 2749 | 2132 | 3023 |
| | 4032 | 2373 | 4069 | 1896 | 2492 | 2075 | 2279 | 2299 | 2171 | 2577 | 2320 | 2200 |
| | 2155 | 2258 | 2180 | 4056 | 2174 | 1891 | 4057 | 1966 | 4071 | 1865 | 4037 | 4033 |
| | 1842 | 2000 | 3073 | 1863 | 4049 | 2191 | 1899 | 2779 | 1943 | 2712 | 2234 | 2383 |
| | 9733 | 32132 | 23108 | 20083 | 18469 | 14945 | 10076 | 13455 | 19522 | 32011 | 32013 | 32012 |
| | 16981 | 20107 | 20325 | 23293 | 13487 | 23019 | 14473 | 19901 | 13486 | 15423 | 18523 | 10558 |
| | 20075 | 20076 | 33453 | 33451 | 33450 | 33452 | 33454 | 33456 | 33455 | 32395 | 23029 | 31809 |
| | 23027 | 23028 | 19519 | 19520 | 32550 | 19516 | 32551 | 19518 | 32549 | 14435 | 19517 | 23322 |
| | 23317 | 10537 | 21855 | 10535 | 23677 | 23329 | 23676 | 23315 | 6270 | 6332 | 6418 | 4324 |
| | 4328 | 4354 | 5153 | 6314 | 6490 | 4301 | 4783 | 6465 | 4472 | 4342 | 4859 | 10003 |
| | 4218 | 4726 | 4863 | 4216 | 4230 | 4448 | 4741 | 4325 | 4337 | 4219 | 4573 | 4329 |
| | 4411 | 4473 | 4330 | 4338 | 4213 | 4720 | 4513 | 4511 | 5389 | 5388 | 5165 | 4341 |

TABLE 2-continued

| SEQ ID NO: | homolog SEQ ID NOs | | | | | | | | | | |
|---|---|---|---|---|---|---|---|---|---|---|---|
| | 4351 | 4214 | 4514 | 5244 | 4232 | 5219 | 4451 | 4347 | 5218 | 5217 | 5216 | 4542 |
| | 4231 | 4215 | 4343 | 4607 | 4340 | 5265 | 5148 | 4487 | 4217 | 4221 | 5146 | 5145 |
| | 4452 | 5138 | 4353 | 5523 | 4483 | 4446 | 4574 | 5251 | 5252 | 5250 | 5247 | 5516 |
| | 4786 | 4334 | 4333 | 4785 | 6464 | 6475 | 4705 | 5135 | 10005 | 4449 | 4947 | 6498 |
| | 4925 | 4469 | 4413 | 4949 | 5997 | 4946 | 4944 | 4941 | 4939 | 4929 | 4930 | 4928 |
| | 4194 | 4919 | 4918 | 4466 | 5144 | 32548 | 10534 | 23327 | 6476 | 4936 | 4934 | 4932 |
| | 5478 | 4327 | 5143 | 4223 | 4943 | 4923 | 4455 | 4484 | 23328 | 4727 | 4572 | 4150 |
| | 5573 | 4942 | 4922 | 4339 | 4886 | 4453 | 5248 | 4323 | 6392 | 4512 | 4445 | 5595 |
| | 4945 | 4938 | 4415 | 4924 | 4352 | 4901 | 6093 | 23314 | 33053 | 33203 | 4822 | 5553 |
| | 6480 | 5481 | 4395 | 10536 | 4427 | 5537 | 4608 | 4447 | 10002 | 5524 | 5482 | 5783 |
| | 5156 | 5162 | 5155 | 5139 | 4900 | 5246 | 4716 | 5140 | 4857 | 4719 | 4948 |
| | 4940 | 4921 | 5480 | 5137 | 4926 | 5142 | 6462 | 5463 | 5141 | 5249 | 4937 | 5163 |
| | 5479 | 4718 | 5452 | 4220 | 4412 | 6043 | 4419 | 10004 | 4931 | 4486 | 4474 | 4530 |
| | 4478 | 4454 | 4485 | 4565 | 4935 | 5173 | 4731 | 4717 | 5136 | 4933 | 4326 | 5154 |
| | 5164 | 5888 | 4605 | 4927 | 4737 | 5171 | 6009 | 6451 | 5152 | 5477 | 4787 | 4784 |
| | 4229 | 4450 | 4376 | 5476 | 5170 | 6466 | 6218 | 4703 | 6463 | 5558 | 6235 | 5310 |
| | 4704 | 4222 | 31946 | 23324 | 23318 | 23320 | 23319 | 23312 | 23311 | 23310 | 23309 | 8162 |
| | 8699 | 8482 | 8879 | 8875 | 8872 | 8877 | 8873 | 8971 | 8874 | 8161 | 8605 | 8878 |
| | 8876 | 8917 | 8958 | 8970 | 7480 | 7795 | 7447 | 8208 | 7210 | 8349 | 8842 | 7415 |
| | 8445 | 7414 | 8159 | 7417 | 8841 | 8511 | 8867 | 8157 | 8928 | 8916 | 8843 | 6730 |
| | 6710 | 6594 | 15926 | 9585 | 707 | 585 | 32546 | 23330 | 23321 | 16503 | 17866 | 17865 |
| | 17714 | 17713 | 18410 | 18409 | 18408 | 18412 | 18411 | 18407 | 17936 | 32134 | 22556 | 32131 |
| | 23107 | 32321 | 32322 | 23109 | 32133 | 32137 | 32323 | 32136 | 32135 | 23326 | | |
| 614: | 14723 | 13123 | 32406 | 22084 | 11281 | 11280 | 11279 | 14753 | 17637 | 15590 | 27134 | 32532 |
| | 17429 | 22570 | 17430 | 15629 | 14761 | 14760 | 23014 | 13965 | 32083 | 32530 | 17334 | 25769 |
| | 21033 | 12925 | 24740 | 12815 | 12780 | 18150 | 19852 | 23565 | 23430 | 19578 | 19536 | 19748 |
| | 24342 | 24409 | 24541 | 26679 | 25609 | 30132 | 22742 | 22637 | 22747 | 22677 | 21459 | 21327 |
| | 21243 | 27191 | 23959 | 25840 | 26585 | 30033 | 27754 | 31046 | 26453 | 26309 | 27208 | 12041 |
| | 16169 | 27337 | 28395 | 10977 | 33534 | 23175 | 10334 | 13263 | 1518 | 1672 | 3525 | 2675 |
| | 3992 | 3714 | 3982 | 2331 | 3276 | 2376 | 3981 | 2985 | 3378 | 32973 | 29312 | 28931 |
| | 32573 | 27136 | 15756 | 15351 | 10866 | 10974 | 4652 | 5673 | 6116 | 6121 | 6115 | 5386 |
| | 4653 | 4184 | 9339 | 8480 | 7611 | 8955 | 8639 | 9746 | 9747 | 24854 | 31592 | 11239 |
| | 18472 | 23669 | 20628 | 15938 | 9915 | 16938 | 29805 | | | | | |
| 615: | 33195 | 17944 | 33588 | 18526 | 32474 | 13576 | 13555 | 13569 | 13236 | 27606 | 30103 | 13100 |
| | 13093 | 13144 | 13119 | 32904 | 32910 | 32902 | 32916 | 24115 | 17564 | 27833 | 17563 | 33506 |
| | 9772 | 17262 | 10254 | 10260 | 10293 | 10289 | 10280 | 21683 | 16110 | 30301 | 30290 | 29575 |
| | 29576 | 11211 | 11183 | 29940 | 24090 | 24088 | 25896 | 16130 | 29592 | 16152 | 16149 | 17312 |
| | 17291 | 17419 | 17299 | 17296 | 17322 | 17404 | 17295 | 17369 | 10901 | 10887 | 10893 | 12565 |
| | 12554 | 12564 | 24236 | 25152 | 25137 | 21048 | 13426 | 13389 | 13367 | 13387 | 13428 | 13424 |
| | 13415 | 13433 | 12656 | 12669 | 12658 | 12665 | 12655 | 12695 | 12697 | 12706 | 18350 | 18338 |
| | 18367 | 11730 | 13925 | 11722 | 13933 | 13903 | 13919 | 13927 | 13857 | 21682 | 13909 | 13938 |
| | 11714 | 13875 | 13899 | 13870 | 13891 | 10925 | 31509 | 14198 | 14190 | 14203 | 18553 | 18571 |
| | 18552 | 14539 | 14530 | 14524 | 14544 | 14531 | 14371 | 14377 | 15687 | 15692 | 15688 | 15683 |
| | 15685 | 14605 | 14589 | 14597 | 14686 | 14499 | 14513 | 15147 | 15210 | 15153 | 15038 | 15051 |
| | 14997 | 12945 | 12912 | 12890 | 12887 | 32294 | 32630 | 32616 | 32609 | 32614 | 15115 | 15111 |
| | 15103 | 15121 | 19019 | 19023 | 19006 | 19024 | 19013 | 19025 | 15530 | 15537 | 14150 | 14129 |
| | 14139 | 14141 | 19166 | 17534 | 17527 | 22444 | 22420 | 22437 | 22440 | 14461 | 23802 | 23795 |
| | 23780 | 15281 | 20226 | 15769 | 15798 | 15804 | 17024 | 17012 | 16996 | 16997 | 17006 | 17026 |
| | 19933 | 15614 | 15617 | 17831 | 17780 | 17778 | 17813 | 17799 | 17834 | 28060 | 16248 | 16264 |
| | 16252 | 16281 | 16262 | 16287 | 16275 | 16273 | 21196 | 16788 | 16771 | 16689 | 16682 | 16785 |
| | 16712 | 16769 | 25991 | 16663 | 16669 | 16869 | 32350 | 32369 | 27599 | 27537 | 27600 | 27591 |
| | 16801 | 16827 | 16803 | 16874 | 16896 | 16889 | 29836 | 29847 | 29839 | 29835 | 16877 | 29854 |
| | 16875 | 15899 | 15902 | 20489 | 11989 | 11961 | 11905 | 12006 | 11893 | 11921 | 11971 | 19232 |
| | 19207 | 19212 | 21872 | 21867 | 17177 | 17187 | 17173 | 17163 | 17190 | 17192 | 17478 | 17457 |
| | 17460 | 17448 | 17470 | 17451 | 17146 | 17152 | 17098 | 17141 | 17090 | 18589 | 18605 | 18607 |
| | 18597 | 18606 | 12735 | 12733 | 18061 | 18092 | 18064 | 18039 | 18028 | 18046 | 18031 | 18033 |
| | 28516 | 28571 | 28545 | 28604 | 28583 | 28608 | 28561 | 28575 | 28588 | 28538 | 28539 | 28514 |
| | 18692 | 18695 | 18721 | 18720 | 16325 | 16364 | 16396 | 16341 | 16352 | 24767 | 27411 | 24751 |
| | 24699 | 24718 | 24697 | 24743 | 24689 | 24693 | 24708 | 24832 | 18965 | 18885 | 18889 | 18931 |
| | 18983 | 18891 | 18985 | 18899 | 18941 | 18989 | 19101 | 19117 | 19070 | 19126 | 19067 | 19039 |
| | 19060 | 19116 | 19061 | 19123 | 19080 | 12818 | 12809 | 12817 | 12074 | 12084 | 9883 | 9897 |
| | 9891 | 9874 | 9899 | 9890 | 18204 | 18207 | 18136 | 18173 | 18226 | 18222 | 18127 | 18159 |
| | 18107 | 18220 | 13997 | 14028 | 14010 | 14054 | 14015 | 13982 | 14058 | 14039 | 14034 | 14024 |
| | 19379 | 19413 | 19384 | 19377 | 19367 | 19386 | 19389 | 19376 | 19340 | 19311 | 19339 | 19306 |
| | 10075 | 19873 | 19813 | 19800 | 19826 | 19795 | 19791 | 19854 | 19484 | 19504 | 19504 | 19650 |
| | 19666 | 19668 | 19581 | 19692 | 19569 | 19590 | 19637 | 19631 | 19759 | 20482 | 29923 | 20481 |
| | 25939 | 20459 | 25956 | 20012 | 20015 | 22571 | 24035 | 25008 | 25009 | 20972 | 20564 | 20548 |
| | 25057 | 30107 | 25048 | 30114 | 21716 | 21724 | 20786 | 32214 | 32183 | 23186 | 23194 | 23189 |
| | 23198 | 23236 | 23218 | 23185 | 12352 | 30345 | 30361 | 30317 | 30366 | 22369 | 22312 | 22324 |
| | 22325 | 12288 | 12307 | 12285 | 33407 | 33386 | 33370 | 33435 | 33393 | 33360 | 33425 | 33428 |
| | 21690 | 21621 | 21619 | 21622 | 22294 | 22254 | 22843 | 21478 | 21414 | 21450 | 21463 | 21410 |
| | 21437 | 21447 | 21443 | 21394 | 21305 | 21388 | 21289 | 21380 | 21320 | 21323 | 21334 | 21354 |
| | 21363 | 21385 | 21338 | 21318 | 21288 | 21284 | 21294 | 21348 | 21335 | 21214 | 21237 | 21269 |
| | 21262 | 21231 | 24193 | 24210 | 24201 | 24192 | 24183 | 24202 | 24173 | 23264 | 23161 | 23163 |
| | 23129 | 25912 | 29961 | 29962 | 27198 | 27179 | 24004 | 23961 | 30173 | 25727 | 30182 | 26067 |
| | 26068 | 26076 | 26061 | 24652 | 29992 | 25869 | 24655 | 25868 | 23173 | 30052 | 30050 | 30077 |
| | 26602 | 26597 | 24261 | 24295 | 24289 | 24296 | 24286 | 24258 | 24264 | 28292 | 25781 | 25786 |
| | 25782 | 28843 | 26977 | 26927 | 26943 | 26975 | 26978 | 26983 | 26966 | 25231 | 25216 | 25677 |

TABLE 2-continued

| SEQ ID NO: | homolog SEQ ID NOs | | | | | | | | | | |
|---|---|---|---|---|---|---|---|---|---|---|---|
| | 25212 | 27692 | 27667 | 27729 | 27776 | 27721 | 27777 | 27791 | 27717 | 25328 | 25472 | 25314 |
| | 25456 | 25312 | 25459 | 25489 | 25442 | 25440 | 10754 | 10674 | 10782 | 10689 | 10780 | 10710 |
| | 10792 | 10706 | 24961 | 27070 | 27085 | 27068 | 27031 | 27057 | 13750 | 25282 | 25266 | 25294 |
| | 31066 | 31090 | 26458 | 26442 | 26471 | 26520 | 26430 | 26209 | 26327 | 26195 | 27955 | 27958 |
| | 27300 | 27265 | 27295 | 27223 | 27293 | 27219 | 27210 | 9452 | 9516 | 9482 | 11483 | 11464 |
| | 11531 | 11519 | 11469 | 11541 | 11506 | 11482 | 11539 | 29778 | 29770 | 29769 | 29763 | 16468 |
| | 29789 | 30614 | 30608 | 30679 | 30601 | 30594 | 12405 | 12406 | 12388 | 13311 | 13345 | 26126 |
| | 16229 | 16227 | 26111 | 26112 | 12525 | 12509 | 24574 | 10366 | 10385 | 30516 | 16041 | 16077 |
| | 26044 | 26035 | 26025 | 16060 | 26012 | 16056 | 16064 | 12599 | 12611 | 12021 | 18633 | 18635 |
| | 12618 | 12624 | 12256 | 14899 | 28191 | 28008 | 27318 | 27351 | 27355 | 27359 | 28409 | 28381 |
| | 28410 | 28399 | 28131 | 28438 | 28491 | 28476 | 28458 | 28300 | 28322 | 24812 | 13715 | 13724 |
| | 13655 | 13723 | 13713 | 13700 | 13682 | 15751 | 31626 | 15742 | 24024 | 16408 | 16403 | 16400 |
| | 16422 | 29693 | 32268 | 33458 | 9668 | 21684 | 17583 | 1093 | 11599 | 11635 | 4054 | 4053 |
| | 22141 | 22151 | 20206 | 28923 | 32816 | 5192 | 5929 | 9008 | 8236 | 8682 | 7807 | 7347 |
| | 8866 | 30827 | 31029 | 17567 | 28234 | 28765 | 32324 | 28711 | 28755 | 28771 | 28777 | |
| | 16563 | 16576 | 16541 | 16549 | 16535 | 16511 | 12439 | 32492 | 31169 | 31161 | 31139 | 31157 |
| | 31210 | 11645 | 31292 | 31305 | 31302 | 19684 | 20876 | 20199 | 20004 | 31778 | 21506 | 23105 |
| | 30893 | 30951 | 30944 | 31604 | 31024 | 24145 | 11016 | 11033 | 12099 | 31269 | 12145 | 12950 |
| | 12959 | 12974 | 12978 | 12969 | 12986 | 10606 | 31777 | 21743 | 21769 | 21748 | 21483 | 21485 |
| | 16611 | 16601 | 12190 | 12182 | 26831 | 26849 | 26840 | 26848 | 26862 | 26844 | 26830 | 21681 |
| | 31425 | 31419 | 12754 | 13172 | 13175 | 13183 | 13181 | 21139 | 14802 | | | |
| 616: | 33046 | 22935 | 10215 | 31712 | 23612 | 24473 | 26623 | 25556 | 22679 | 31786 | 11130 | 9443 |
| | 10427 | 22821 | 27528 | 27529 | 10945 | 14287 | 33470 | 28338 | 28339 | 32385 | 26045 | 1078 |
| | 20058 | 20057 | 24935 | 32139 | 28868 | 22034 | 18517 | 33088 | 32469 | 12998 | 32991 | 10531 |
| | 29231 | 29232 | 6145 | 4185 | 5749 | 6090 | 6147 | 8397 | 8073 | 8509 | 8998 | 9095 |
| | 9180 | 9094 | 8915 | 8997 | 6735 | 7732 | 17435 | 29230 | 16644 | 17076 | 10552 | 15295 |
| | 9926 | 9925 | 13231 | 9924 | 22954 | 29154 | 29156 | 20611 | | | | |
| 617: | 31945 | 873 | 870 | 1595 | 959 | 3705 | 2701 | 3291 | 2482 | 2933 | 1927 | 2627 |
| | 3292 | 1949 | 2060 | 22017 | 30657 | 6399 | 5863 | 4463 | 6204 | 4489 | 5603 | 6327 |
| | 5359 | 9183 | 9182 | 8007 | 8111 | 8581 | 8150 | 6720 | 8936 | 6632 | 8582 | 6598 |
| | 6680 | | | | | | | | | | | |
| 618: | 14764 | 11554 | 11553 | 11555 | 31546 | 29412 | 1045 | 979 | 24942 | 2606 | 3028 | 3750 |
| | 3749 | 2607 | 3493 | 3006 | 28901 | 30193 | 28968 | 21904 | 20580 | 21906 | 20583 | 20581 |
| | 21905 | 20582 | 33240 | 33242 | 33239 | 33241 | 30394 | 20078 | 5105 | 5625 | 8883 | 7933 |
| | 7932 | 7810 | 7982 | 32810 | 11551 | 27445 | 27436 | 24600 | 20116 | 15888 | | |
| 619: | 30231 | 29276 | 14351 | 17731 | 21890 | 21895 | 20962 | 12828 | 13777 | 19333 | 9689 | 15748 |
| | 12358 | 12293 | 27472 | 27496 | 25705 | 27738 | 16490 | 29752 | 30613 | 26147 | 30527 | 10835 |
| | 28145 | 28118 | 3666 | 4051 | 4030 | 2272 | 2271 | 2063 | 33189 | 5910 | 4332 | 4387 |
| | 6141 | 6387 | 6320 | 6029 | 6264 | 5385 | 4367 | 6329 | 18813 | 9732 | 32113 | 33177 |
| | 18830 | 18829 | 32885 | 31537 | 13049 | 31230 | 31323 | 20864 | 20589 | 13162 | | |
| 620: | 23532 | 24522 | 25619 | 1683 | 4020 | 3183 | 2207 | 2650 | 3040 | 2850 | 2851 | 3053 |
| | 3036 | 2569 | 3572 | 2281 | 1988 | 1970 | 3070 | 2246 | 2094 | 2720 | 1885 | 4841 |
| | 5861 | 9086 | 8017 | 6977 | 7775 | 6794 | 7436 | 9429 | 7228 | 7233 | 8481 | 6976 |
| | 15476 | | | | | | | | | | | |
| 621: | 22815 | 10867 | 20536 | 24336 | 25621 | 9576 | 9577 | 19998 | 21692 | 10007 | 20157 | 28784 |
| | 33482 | 1678 | 1092 | 1428 | 10511 | 3758 | 2782 | 29311 | 29102 | 33513 | 32982 | 29234 |
| | 5033 | 33089 | 16944 | 14868 | 11792 | 10486 | 17263 | 33329 | 9407 | | | |
| 622: | 32587 | 31497 | 9914 | 27135 | 21110 | 33569 | 31548 | 10256 | 25904 | 17383 | 13422 | 13361 |
| | 15653 | 15140 | 14982 | 20142 | 23768 | 14455 | 16993 | 17845 | 17773 | 27890 | 28064 | 29879 |
| | 12015 | 19256 | 17092 | 28550 | 24741 | 9900 | 18179 | 18102 | 18178 | 23610 | 23442 | 23550 |
| | 23623 | 19532 | 31127 | 24448 | 24421 | 24413 | 20391 | 23296 | 25663 | 25647 | 25890 | 21807 |
| | 22633 | 22721 | 22699 | 20781 | 32211 | 22341 | 33420 | 21689 | 21412 | 21403 | 21473 | 21299 |
| | 21386 | 21219 | 21216 | 23937 | 23926 | 23975 | 23991 | 23962 | 23936 | 23949 | 25187 | 27506 |
| | 30059 | 30075 | 25115 | 25852 | 25844 | 25826 | 30040 | 26973 | 26921 | 25258 | 27715 | 27705 |
| | 27756 | 27812 | 27782 | 10770 | 10718 | 10730 | 27077 | 27038 | 27046 | 13742 | 13761 | 26505 |
| | 26490 | 26500 | 26329 | 26305 | 26315 | 26395 | 26385 | 26275 | 26306 | 26390 | 26258 | |
| | 9497 | 13342 | 16200 | 12222 | 11247 | 10833 | 27311 | 27389 | 27325 | 27331 | 27420 | 14968 |
| | 14301 | 18376 | 31773 | 14061 | 17712 | 30016 | 15297 | 13695 | 13722 | 30551 | 1816 | 11611 |
| | 27530 | 3211 | 1832 | 31852 | 21956 | 21958 | 21957 | 21955 | 33251 | 24106 | 32954 | 24849 |
| | 16014 | 26541 | 6372 | 6333 | 7332 | 9255 | 6793 | 31015 | 32330 | 26545 | 26544 | 26537 |
| | 25019 | 17701 | 16036 | 20102 | 13285 | 28804 | 28717 | 31188 | 18802 | 30882 | 25345 | |
| | 25343 | 25344 | 25341 | 25340 | 25342 | 24566 | 11039 | 11022 | 11011 | 12110 | 12141 | 12111 |
| | 12089 | 12956 | 30558 | 13200 | | | | | | | | |
| 623: | 27439 | 32868 | 10208 | 22613 | 18256 | 17559 | 18123 | 19796 | 19671 | 24998 | 24997 | 24383 |
| | 24533 | 20430 | 25558 | 22693 | 22727 | 20805 | 20788 | 23947 | 27252 | 28370 | 11129 | 15307 |
| | 27011 | 10530 | 14164 | 15757 | 14763 | 22752 | 1071 | 11406 | 33563 | 11606 | 11602 | 10639 |
| | 33000 | 2721 | 3908 | 13012 | 17715 | 33258 | 14099 | 17943 | 17890 | 16039 | 15954 | 30466 |
| | 30465 | 30464 | 15953 | 27527 | 20320 | 32579 | 32578 | 32167 | 32545 | 15072 | 11288 | 33173 |
| | 12487 | 21931 | 11139 | 12596 | 15481 | 15479 | 9738 | 5908 | 4178 | 4706 | 5299 | 5298 |
| | 4767 | 23336 | 10336 | 32665 | 28748 | 11044 | 31276 | 17682 | 33190 | | | |
| 624: | 1123 | 1105 | 1480 | 2760 | 2640 | 6512 | | | | | | |
| 625: | 22614 | 28807 | 1768 | 28953 | 6192 | 8912 | 8567 | 4021 | 2902 | 2385 | 3501 | 3309 |
| | 2903 | 3051 | 3067 | | | | | | | | | |
| 626: | 17218 | 32247 | 33070 | 13551 | 32396 | 27648 | 28241 | 30260 | 30239 | 11687 | 11686 | 18406 |
| | 32926 | 32903 | 25339 | 10497 | 14414 | 33571 | 18655 | 23099 | 32103 | 32102 | 11294 | 10297 |
| | 10266 | 11215 | 11174 | 29957 | 12594 | 17293 | 17392 | 10899 | 31632 | 13392 | 12661 | 12701 |
| | 31288 | 18344 | 18354 | 24857 | 13928 | 12850 | 13943 | 13905 | 13937 | 11721 | 11729 | 13908 |
| | 14211 | 31882 | 24148 | 20214 | 10936 | 15957 | 14538 | 15667 | 15707 | 17733 | 25308 | 14680 |

TABLE 2-continued

| SEQ ID NO: | homolog SEQ ID NOs | | | | | | | | | | |
|---|---|---|---|---|---|---|---|---|---|---|---|
| | 12930 | 32610 | 15100 | 29221 | 14157 | 17508 | 17495 | 22418 | 22467 | 23765 | 23782 | 23783 |
| | 23819 | 15287 | 17005 | 19927 | 15613 | 17816 | 17785 | 27900 | 27907 | 27883 | 28079 | 16794 |
| | 16776 | 16784 | 16846 | 32366 | 27546 | 15903 | 20517 | 11891 | 19244 | 17183 | 17464 | 17106 |
| | 17244 | 18037 | 28558 | 28515 | 28513 | 15238 | 16385 | 16367 | 16321 | 16335 | 24691 | 24724 |
| | 18883 | 18881 | 18933 | 18932 | 19075 | 19100 | 12773 | 12054 | 18113 | 13989 | 14048 | 14025 |
| | 14040 | 19368 | 19793 | 23713 | 23596 | 23492 | 23572 | 23469 | 19687 | 19991 | 25941 | 25966 |
| | 24527 | 24471 | 24397 | 24466 | 24370 | 9694 | 26650 | 26782 | 25646 | 25645 | 30113 | 12467 |
| | 23192 | 12357 | 30354 | 22320 | 33390 | 21664 | 22289 | 22851 | 21428 | 21438 | 21471 | 21341 |
| | 21314 | 21293 | 21287 | 21383 | 21257 | 21230 | 21282 | 23253 | 23256 | 23268 | 23146 | 23128 |
| | 23144 | 29480 | 27189 | 30188 | 25189 | 26063 | 27477 | 25101 | 25846 | 30086 | 25843 | 25823 |
| | 25080 | 26947 | 25668 | 25213 | 25219 | 27672 | 27683 | 27774 | 27816 | 25453 | 25461 | 25429 |
| | 25471 | 25457 | 25475 | 13030 | 13040 | 11679 | 11671 | 13025 | 11666 | 13023 | 10682 | 10764 |
| | 10747 | 10767 | 10745 | 24980 | 27073 | 27043 | 13775 | 13740 | 13741 | 26488 | 26428 | 26425 |
| | 26468 | 26467 | 26519 | 26393 | 26274 | 26377 | 26314 | 27975 | 27297 | 26396 | 9475 | 9522 |
| | 11542 | 29783 | 30619 | 13314 | 16212 | 16216 | 26107 | 10401 | 26013 | 16066 | 12603 | 10973 |
| | 12220 | 10840 | 27018 | 17860 | 27988 | 28030 | 27321 | 27357 | 17927 | 28364 | 28368 | 28357 |
| | 16037 | 30723 | 28482 | 28316 | 31502 | 10929 | 13830 | 20088 | 17591 | 15367 | 18372 | 26887 |
| | 20043 | 13648 | 13687 | 14450 | 33357 | 20935 | 23721 | 22202 | 29186 | 29724 | 16442 | 13611 |
| | 30557 | 23665 | 27457 | 14884 | 14878 | 11563 | 33614 | 2894 | 3801 | 1910 | 14452 | 22154 |
| | 31949 | 11639 | 11436 | 33317 | 4503 | 5230 | 5232 | 5231 | 9178 | 8669 | 9179 | 6668 |
| | 10856 | 21539 | 21540 | 32476 | 31867 | 24828 | 32006 | 25380 | 20647 | 25024 | 31393 | 31394 |
| | 33304 | 31866 | 14066 | 19280 | 9596 | 28753 | 28768 | 16553 | 12441 | 12462 | 24921 | 31174 |
| | 31151 | 21144 | 30902 | 30936 | 30916 | 29212 | 24146 | 22203 | 11037 | 12090 | 12138 | 12104 |
| | 32972 | 31439 | 32037 | 28047 | 31553 | 13185 | | | | | | |
| 627: | 10188 | 26608 | 32646 | 32645 | 17282 | 15190 | 12922 | 28209 | 23489 | 23626 | 24410 | 24440 |
| | 26799 | 22798 | 22739 | 22630 | 23132 | 23934 | 16182 | 26990 | 27353 | 22561 | 28341 | 32953 |
| | 31338 | 990 | 924 | 1175 | 961 | 1573 | 1194 | 1405 | 10190 | 1856 | 32642 | 21204 |
| | 21205 | 21999 | 21998 | 31478 | 26916 | 6426 | 5054 | 8684 | 6957 | 6615 | 8722 | 7820 |
| | 7046 | 7818 | 7819 | 7779 | 6638 | 31647 | 24110 | 23398 | 11223 | 26546 | 25020 | 20625 |
| | 9588 | 20712 | 15925 | 15581 | 23024 | 23023 | 28501 | 17938 | 19465 | 19466 | 19464 | 17933 |
| | 19726 | 32562 | 17937 | 22820 | 18763 | 11028 | 12119 | 9553 | 17883 | 10216 | 18776 | 18774 |
| | 18775 | 18772 | 18773 | 18771 | | | | | | | | |
| 628: | 13554 | 23325 | 23313 | 9952 | 23316 | 13089 | 759 | 31135 | 17283 | 22061 | 26917 | 25150 |
| | 21077 | 15790 | 23030 | 478 | 667 | 33625 | 33623 | 33615 | 25047 | 31062 | 33180 | 28669 |
| | 28668 | 17680 | 29309 | 30013 | 30015 | 31392 | 14451 | 11816 | 13265 | 13264 | 31578 | 17603 |
| | 10474 | 33620 | 14277 | 10539 | 16625 | 9971 | 24627 | 19515 | 13000 | 13001 | 14795 | 871 |
| | 907 | 906 | 905 | 1403 | 908 | 872 | 1825 | 1398 | 1402 | 1126 | 1545 | 1401 |
| | 1153 | 1456 | 1251 | 1544 | 1376 | 1414 | 1527 | 1326 | 1382 | 1354 | 1494 | 1399 |
| | 1370 | 1361 | 1341 | 1476 | 1587 | 1504 | 1817 | 1623 | 1264 | 1639 | 1417 | 1653 |
| | 1543 | 1651 | 1590 | 862 | 1233 | 1377 | 1715 | 1400 | 33052 | 10540 | 23323 | 23063 |
| | 2641 | 3109 | 3386 | 3273 | 2964 | 9770 | 2014 | 2319 | 2635 | 3299 | 2144 | 2961 |
| | 2963 | 2013 | 2015 | 2898 | 10538 | 2993 | 1853 | 2061 | 2105 | 9769 | 3272 | 2485 |
| | 2214 | 2718 | 2135 | 2962 | 2142 | 2617 | 2139 | 2676 | 2490 | 2257 | 2965 | 2543 |
| | 2966 | 2289 | 2277 | 3328 | 2134 | 2143 | 1928 | 2724 | 1939 | 2130 | 2491 | 2967 |
| | 1965 | 2140 | 2308 | 2313 | 2310 | 2128 | 2193 | 1998 | 1850 | 2480 | 2131 | 1912 |
| | 4052 | 2192 | 1851 | 2592 | 2241 | 2212 | 1849 | 2316 | 2245 | 1996 | 4048 | 2997 |
| | 2968 | 2118 | 3086 | 2133 | 1839 | 2129 | 2297 | 4046 | 2486 | 2176 | 4047 | 1894 |
| | 2479 | 2172 | 2076 | 2727 | 1947 | 2208 | 4050 | 3066 | 2141 | 1892 | 1843 | 1913 |
| | 2242 | 2179 | 1937 | 2655 | 2251 | 2290 | 2749 | 2132 | 3023 | 4032 | 2373 | 4069 |
| | 1896 | 2492 | 2075 | 2279 | 2299 | 2171 | 2577 | 2320 | 2200 | 2155 | 2258 | 2180 |
| | 4056 | 2174 | 1891 | 1966 | 4071 | 4057 | 1865 | 4037 | 4033 | 1842 | 2000 | 3073 |
| | 1863 | 4049 | 2191 | 1899 | 2779 | 1943 | 2712 | 9733 | 32132 | 23108 | 20083 | 18469 |
| | 14945 | 10076 | 13455 | 19522 | 32011 | 32013 | 32012 | 16981 | 20107 | 20325 | 23293 | 13487 |
| | 23019 | 14473 | 19901 | 13486 | 15423 | 18523 | 10558 | 20075 | 20076 | 33453 | 33451 | 33450 |
| | 33452 | 33456 | 33454 | 33455 | 32395 | 23029 | 31809 | 23027 | 23028 | 19519 | 19520 | 32550 |
| | 19512 | 32551 | 19518 | 32549 | 14435 | 19517 | 23322 | 23311 | 10537 | 21855 | 10535 | 23677 |
| | 23329 | 23676 | 23315 | 6270 | 6332 | 6418 | 4324 | 4328 | 4354 | 5153 | 6314 | 6490 |
| | 4301 | 4783 | 6465 | 4472 | 4342 | 4859 | 10003 | 4218 | 4726 | 4863 | 4216 | 4230 |
| | 4448 | 4741 | 4325 | 4337 | 4219 | 4573 | 4329 | 4411 | 4473 | 4330 | 4338 | 4213 |
| | 4720 | 4513 | 4511 | 5389 | 5388 | 5165 | 4341 | 4351 | 4214 | 4514 | 5244 | 4232 |
| | 5219 | 4451 | 4347 | 5218 | 5217 | 5216 | 4542 | 4231 | 4215 | 4343 | 4607 | 4340 |
| | 5265 | 5148 | 4487 | 4217 | 4221 | 5146 | 5145 | 4452 | 5138 | 4353 | 5523 | 4483 |
| | 4446 | 4574 | 5251 | 5252 | 5250 | 5247 | 5516 | 4786 | 4334 | 4333 | 4785 | 6464 |
| | 6475 | 4705 | 5135 | 10005 | 4449 | 4947 | 6498 | 4925 | 4469 | 4413 | 4949 | 5997 |
| | 4946 | 4944 | 4941 | 4939 | 4929 | 4930 | 4928 | 4194 | 4919 | 4918 | 4466 | 5144 |
| | 32548 | 10534 | 23327 | 6476 | 4936 | 4934 | 4932 | 5478 | 4327 | 5143 | 4223 | 4943 |
| | 4923 | 4484 | 23328 | 4727 | 4572 | 4150 | 5573 | 4942 | 4922 | 4339 | 4886 | 4455 |
| | 4453 | 5248 | 4323 | 6392 | 4512 | 4445 | 5595 | 4945 | 4938 | 4415 | 4924 | 4352 |
| | 4901 | 6093 | 23314 | 33053 | 33203 | 4822 | 5553 | 6480 | 5481 | 4395 | 10534 | 4427 |
| | 5537 | 4608 | 4447 | 10002 | 5524 | 5482 | 5783 | 5156 | 5162 | 5155 | 5139 | 4900 |
| | 5246 | 4920 | 4716 | 5140 | 4857 | 4719 | 4948 | 4940 | 4921 | 5480 | 5137 | 4926 |
| | 5142 | 6462 | 5463 | 5141 | 5249 | 4937 | 5163 | 5479 | 4718 | 5452 | 4220 | 4412 |
| | 6043 | 4419 | 10004 | 4931 | 4486 | 4530 | 4478 | 4454 | 4485 | 4565 | 4935 |
| | 5173 | 5171 | 4731 | 4717 | 5136 | 4933 | 4326 | 5154 | 6009 | 5164 | 5888 | 4605 |
| | 4927 | 4737 | 6451 | 5152 | 5477 | 4787 | 4784 | 4229 | 4450 | 4376 | 5476 | 5170 |
| | 6466 | 6218 | 4703 | 31946 | 23324 | 23318 | 23320 | 23319 | 23312 | 23311 | 23310 | 23309 |
| | 8162 | 8699 | 8482 | 8879 | 8875 | 8872 | 8877 | 8873 | 8971 | 8874 | 8161 | 8605 |
| | 8876 | 8878 | 8917 | 8958 | 8970 | 7480 | 7795 | 7447 | 8208 | 7210 | 8349 | 8842 |

TABLE 2-continued

| SEQ ID NO: | homolog SEQ ID NOs | | | | | | | | | | |
|---|---|---|---|---|---|---|---|---|---|---|---|
| | 7415 | 8445 | 7414 | 8159 | 7417 | 8841 | 8511 | 8867 | 8157 | 8928 | 8916 | 8843 |
| | 6730 | 6710 | 6594 | 15926 | 9585 | 707 | 585 | 32546 | 23330 | 23321 | 33630 | 713 |
| | 16507 | 17866 | 17865 | 17714 | 17713 | 18410 | 18409 | 18408 | 18412 | 18411 | 18407 | 17936 |
| | 786 | 32134 | 22556 | 32131 | 23107 | 32321 | 32322 | 23109 | 32133 | 32137 | 32323 | 32136 |
| | 32135 | 23326 | | | | | | | | | | |
| 629: | 33105 | 30663 | 9779 | 33286 | 13542 | 13563 | 13560 | 13604 | 13536 | 15662 | 12195 | 30271 |
| | 30257 | 25067 | 31544 | 30104 | 13107 | 31955 | 13088 | 32748 | 9799 | 32319 | 27831 | 27825 |
| | 27826 | 12427 | 9813 | 9777 | 18462 | 15569 | 30307 | 30306 | 32574 | 10292 | 30294 | 16107 |
| | 30297 | 29572 | 16113 | 29565 | 12722 | 29950 | 24095 | 25897 | 17397 | 17331 | 17316 | 10903 |
| | 12560 | 12555 | 12544 | 32126 | 25754 | 25141 | 21042 | 21050 | 13363 | 12683 | 12720 | 20823 |
| | 20822 | 18364 | 18368 | 13849 | 13863 | 32649 | 14197 | 20385 | 18575 | 18570 | 18542 | 15231 |
| | 14541 | 14379 | 15690 | 15689 | 15720 | 15680 | 14608 | 17055 | 14509 | 14506 | 15191 | 15144 |
| | 15143 | 15030 | 15041 | 15042 | 12943 | 12886 | 33526 | 32289 | 32617 | 19017 | 15538 | 15559 |
| | 14140 | 14121 | 20938 | 19462 | 17549 | 17526 | 22456 | 22459 | 14462 | 23815 | 15286 | 23807 |
| | 12429 | 15774 | 15815 | 17013 | 30973 | 19932 | 15506 | 17811 | 17812 | 28066 | 28068 | 16299 |
| | 28089 | 21195 | 16698 | 16665 | 16847 | 32359 | 32378 | 27568 | 27601 | 27595 | 16830 | 29851 |
| | 20520 | 20502 | 11953 | 11914 | 11899 | 11942 | 11915 | 19208 | 19240 | 21874 | 21879 | 17175 |
| | 13013 | 17453 | 17130 | 17140 | 18604 | 12743 | 18049 | 18096 | 28527 | 28526 | 28606 | 28532 |
| | 18677 | 33532 | 16311 | 16354 | 16343 | 24720 | 24769 | 18957 | 18907 | 18928 | 18880 | 19057 |
| | 12761 | 12819 | 12816 | 12076 | 18185 | 13979 | 13996 | 19396 | 19372 | 19328 | 19312 | 19783 |
| | 19828 | 19876 | 23454 | 19509 | 19598 | 19629 | 19689 | 19600 | 19640 | 25945 | 20455 | 24547 |
| | 9691 | 20984 | 20398 | 20561 | 20541 | 26649 | 26705 | 25568 | 25590 | 33331 | 25043 | 25876 |
| | 25050 | 30128 | 25028 | 22783 | 20784 | 20598 | 20800 | 32194 | 23182 | 23230 | 30363 | 30338 |
| | 22327 | 22326 | 22306 | 22376 | 12291 | 33381 | 33369 | 21650 | 21641 | 21646 | 21651 | 22232 |
| | 22231 | 22870 | 21367 | 21235 | 23262 | 23147 | 24056 | 25935 | 23960 | 23923 | 25746 | 25713 |
| | 26082 | 25797 | 24666 | 27474 | 27493 | 25108 | 30093 | 24267 | 24294 | 24269 | 28290 | 28282 |
| | 30043 | 26923 | 25203 | 25686 | 25682 | 25669 | 27694 | 10464 | 27773 | 25451 | 10721 | 10723 |
| | 10719 | 10665 | 10793 | 10791 | 13746 | 13747 | 25287 | 25280 | 31091 | 31068 | 26477 | 26482 |
| | 26361 | 26334 | 27966 | 27303 | 27221 | 27225 | 27240 | 9450 | 9520 | 11507 | 11484 | 29753 |
| | 29750 | 29758 | 30597 | 30611 | 12376 | 12383 | 13290 | 16225 | 12510 | 12532 | 10406 | 30509 |
| | 26028 | 16058 | 12615 | 12253 | 14940 | 14911 | 10829 | 21002 | 28001 | 28033 | 27360 | 27326 |
| | 28363 | 28120 | 28441 | 28437 | 28426 | 28299 | 13670 | 21166 | 30734 | 10653 | 31662 | 11136 |
| | 29728 | 29694 | 10346 | 27164 | 27163 | 19283 | 15889 | 1157 | 1604 | 1762 | 1736 | 1160 |
| | 1081 | 32087 | 14552 | 14879 | 11570 | 11594 | 20229 | 3665 | 2861 | 3503 | 2697 | 3660 |
| | 3655 | 22146 | 9734 | 31707 | 31708 | 32937 | 16723 | 20267 | 12489 | 13621 | 24020 | 21704 |
| | 10150 | 14060 | 11311 | 9916 | 33134 | 28728 | 28763 | 16583 | 16522 | 16565 | 16502 | 12448 |
| | 12436 | 31144 | 31201 | 31186 | 31810 | 31322 | 32403 | 21507 | 21520 | 30918 | 30886 | 21587 |
| | 30687 | 23640 | 23641 | 20587 | 11050 | 31268 | 31255 | 12108 | 31253 | 12155 | 12977 | 21761 |
| | 15587 | 16587 | 12164 | 26841 | 31424 | 31447 | 33521 | 13159 | 10218 | 20197 | 15445 | 11789 |
| | 15583 | 15405 | | | | | | | | | | |
| 630: | 17706 | 32387 | 1298 | 1217 | 1591 | 1776 | 2869 | 3909 | 18539 | 30588 | 29282 | 28949 |
| | 30835 | 31467 | 21003 | 5594 | 4667 | 5652 | 5651 | 5650 | 5004 | 4110 | 6262 | 6167 |
| | 5003 | 5005 | 5214 | 4109 | 6069 | 7678 | 8658 | 7213 | 9350 | 8143 | 7879 | 7878 |
| | 6761 | 8769 | 7677 | 8325 | 6740 | 6849 | 8156 | 8155 | 9093 | 6955 | 7340 | 9076 |
| | 8944 | 8154 | 8142 | 9177 | 7877 | 8419 | 8721 | 7709 | 7320 | 7405 | 9417 | 8993 |
| | 8248 | 8727 | 8499 | 8172 | 32504 | 11784 | | | | | | |
| 631: | 12215 | 32925 | 10294 | 27856 | 25901 | 17309 | 20381 | 15684 | 22451 | 17014 | 15525 | 16849 |
| | 32356 | 27559 | 11977 | 17121 | 18053 | 28581 | 18901 | 19051 | 20476 | 25007 | 24346 | 20986 |
| | 25642 | 30318 | 22359 | 33379 | 21603 | 21333 | 21254 | 23266 | 24060 | 29988 | 29995 | 25856 |
| | 25128 | 26459 | 26225 | 16195 | 12601 | 28133 | 28873 | 22817 | 13672 | 16432 | 20084 | 1537 |
| | 2064 | 2085 | 2500 | 4801 | 5871 | 4800 | 7212 | 9377 | 8975 | 31880 | 10547 | 32078 |
| | 20670 | 10153 | 16676 | 28716 | 30949 | 20963 | 29974 | 13184 | 33484 | | | |
| 632: | 19324 | 1300 | 1633 | 3591 | 2770 | 3959 | 2334 | 24571 | 33339 | 4360 | 6456 | 5622 |
| | 4865 | 4728 | 6532 | 4320 | 6158 | 6107 | 4729 | 6534 | 5369 | 6533 | 6294 | 5860 |
| | 5367 | 5368 | 7497 | 8329 | 8330 | 7201 | 8583 | 8104 | 7274 | | | |
| 633: | 30490 | 9787 | 13546 | 32703 | 31872 | 32702 | 32704 | 31904 | 27618 | 32743 | 32693 | 32741 |
| | 32738 | 32689 | 32695 | 32745 | 32747 | 32697 | 14342 | 11055 | 14340 | 30991 | 29474 | 29473 |
| | 29471 | 29469 | 29464 | 29461 | 29468 | 29467 | 29472 | 29463 | 29462 | 29465 | 29470 | 29466 |
| | 21561 | 21565 | 21566 | 21564 | 21562 | 21563 | 21567 | 17222 | 15761 | 555 | 31493 | 16973 |
| | 15947 | 19951 | 11292 | 10253 | 33349 | 17330 | 31287 | 13877 | 13929 | 22533 | 23036 | 20213 |
| | 19778 | 19777 | 13005 | 19775 | 15706 | 15198 | 15201 | 14990 | 14987 | 12919 | 12924 | 12914 |
| | 14798 | 17503 | 22453 | 23776 | 17770 | 19950 | 19943 | 19941 | 19945 | 19942 | 19949 | 19948 |
| | 19946 | 19944 | 19947 | 27918 | 16777 | 33613 | 25983 | 11972 | 17159 | 31491 | 31492 | 17155 |
| | 17119 | 19973 | 19967 | 19966 | 19971 | 19969 | 19962 | 19970 | 19964 | 19968 | 19965 | 19974 |
| | 19961 | 19972 | 19963 | 19956 | 19955 | 19954 | 19952 | 19953 | 12726 | 18051 | 28569 | 18737 |
| | 16384 | 18906 | 19111 | 18213 | 18231 | 14013 | 14047 | 23714 | 23502 | 19779 | 19670 | 19604 |
| | 19681 | 19649 | 29928 | 20011 | 20009 | 24565 | 22976 | 17869 | 17868 | 26770 | 25660 | 25049 |
| | 22729 | 22373 | 21598 | 22296 | 21392 | 23160 | 29477 | 23917 | 23987 | 23992 | 23955 | 24642 |
| | 29994 | 25815 | 25109 | 25839 | 24259 | 30155 | 27697 | 27767 | 25473 | 11663 | 13042 | 10675 |
| | 13738 | 31059 | 26427 | 26263 | 9493 | 12523 | 16075 | 12259 | 28032 | 15366 | 15364 | 32729 |
| | 22522 | 22516 | 22515 | 22517 | 32736 | 32734 | 31683 | 17946 | 32877 | 33498 | 28331 | 33502 |
| | 14271 | 32827 | 14071 | 33530 | 32828 | 13661 | 32393 | 26162 | 10161 | 10162 | 10155 | 10156 |
| | 10157 | 10160 | 10159 | 10158 | 10163 | 10154 | 31751 | 31750 | 32876 | 20185 | 28330 | 17954 |
| | 17950 | 17951 | 17956 | 17953 | 17949 | 20158 | 13015 | 31753 | 31752 | 31748 | 31749 | 31755 |
| | 31754 | 31756 | 31766 | 31765 | 31763 | 31764 | 31757 | 31758 | 31762 | 31761 | 31760 | 31759 |
| | 29268 | 31494 | 32513 | 31490 | 16427 | 21001 | 17234 | 17239 | 15949 | 17948 | 17955 | 22090 |
| | 11832 | 11831 | 10477 | 32956 | 32957 | 32875 | 17952 | 32874 | 17947 | 33503 | 33504 | 33500 |
| | 33499 | 22098 | 23913 | 23911 | 23907 | 23905 | 23906 | 23904 | 23902 | 23901 | 23903 | 11835 |

TABLE 2-continued

| SEQ ID NO: | homolog SEQ ID NOs | | | | | | | | | | |
|---|---|---|---|---|---|---|---|---|---|---|---|
| | 11834 | 11839 | 11842 | 11841 | 11833 | 11840 | 11838 | 11849 | 11836 | 11846 | 11845 | 11848 |
| | 11843 | 11851 | 11847 | 11844 | 11837 | 11850 | 17945 | 32878 | 33501 | 20159 | 33497 | 16931 |
| | 21576 | 21575 | 21574 | 9853 | 21211 | 11449 | 17659 | 32460 | 18651 | 14445 | 14443 | 15451 |
| | 14444 | 10440 | 10441 | 14270 | 15434 | 14805 | 15406 | 24595 | 13736 | 24636 | 9441 | 28860 |
| | 15731 | 15474 | 14281 | 15730 | 29333 | 32844 | 32502 | 1787 | 1767 | 874 | 32438 | 23074 |
| | 14292 | 33281 | 11584 | 9797 | 11630 | 32871 | 3988 | 3989 | 2729 | 2918 | 2716 |
| | 3284 | 1938 | 2324 | 1905 | 15927 | 3643 | 3885 | 23334 | 4075 | 2239 | 3111 | 3821 |
| | 24853 | 3502 | 3670 | 2237 | 2222 | 2295 | 3447 | 2623 | 3625 | 2189 | 2044 | 3884 |
| | 3446 | 2540 | 3950 | 2426 | 3344 | 2571 | 2939 | 3504 | 3990 | 2071 | 2590 | 2432 |
| | 4026 | 2019 | 3194 | 3805 | 2980 | 3680 | 2188 | 17237 | 17240 | 17238 | 31489 | 20222 |
| | 15630 | 31888 | 31889 | 22143 | 13282 | 14769 | 28995 | 28963 | 22004 | 21968 | 28964 | 20282 |
| | 32680 | 21969 | 17649 | 13793 | 21902 | 32682 | 32728 | 17629 | 32701 | 31871 | 16965 | 15945 |
| | 16966 | 11070 | 11080 | 16964 | 16968 | 16967 | 15950 | 17609 | 11082 | 11081 | 11073 | 11071 |
| | 11072 | 11084 | 11083 | 11085 | 11086 | 11088 | 11087 | 16974 | 15948 | 33115 | 9730 | 33116 |
| | 31877 | 27442 | 19468 | 19467 | 9731 | 9840 | 9591 | 31885 | 21573 | 21571 | 21570 | 21572 |
| | 21569 | 21568 | 14824 | 14339 | 23073 | 21900 | 21899 | 21898 | 21901 | 32726 | 32681 | 32635 |
| | 13479 | 21903 | 32737 | 32686 | 32744 | 32694 | 32735 | 22526 | 22520 | 32685 | 22525 | 22519 |
| | 32732 | 22521 | 32683 | 32727 | 32730 | 10979 | 10978 | 29628 | 29632 | 29630 | 29629 | 29633 |
| | 29631 | 32244 | 21680 | 6067 | 5819 | 6431 | 5729 | 5918 | 5921 | 4797 | 4798 | 30397 |
| | 5203 | 5555 | 5421 | 4799 | 5920 | 5422 | 5424 | 5919 | 4796 | 5917 | 6288 | 4244 |
| | 6175 | 4795 | 4208 | 5058 | 5554 | 5904 | 5906 | 5971 | 5647 | 5849 | 6176 | 5423 |
| | 5556 | 5443 | 5053 | 5818 | 5014 | 6177 | 5206 | 6194 | 33348 | 10194 | 8574 | 9266 |
| | 9267 | 6719 | 7909 | 6707 | 8942 | 7708 | 7704 | 9265 | 6639 | 9331 | 6721 | 13446 |
| | 7875 | 7153 | 23005 | 9330 | 9332 | 30192 | 8526 | 9333 | 9133 | 7812 | 32533 | 9011 |
| | 6626 | 7604 | 7216 | 30662 | 30661 | 8217 | 8604 | 8216 | 7754 | 8941 | 7373 | 7834 |
| | 7603 | 7602 | 9232 | 8724 | 7606 | 7601 | 7600 | 8129 | 7179 | 7607 | 7067 | 8527 |
| | 8218 | 7887 | 7817 | 7259 | 7605 | 8324 | 7099 | 8985 | 11658 | 11115 | 10195 | 10198 |
| | 10197 | 10196 | 17241 | 31014 | 13008 | 13009 | 19362 | 13014 | 20171 | 31387 | 33496 | 32580 |
| | 13017 | 20165 | 20166 | 20164 | 20160 | 20161 | 20162 | 13016 | 20163 | 20169 | 20170 | 20168 |
| | 16654 | 20172 | 20173 | 20175 | 20174 | 20176 | 20180 | 20177 | 20178 | 20179 | 20181 | 20184 |
| | 20182 | 20183 | 13778 | 13779 | 21537 | 22749 | 30727 | 13733 | 13238 | 22112 | 31890 | 31887 |
| | 31886 | 32434 | 32431 | 32432 | 32433 | 32462 | 32435 | 14244 | 22524 | 22523 | 22518 | 22918 |
| | 16645 | 33282 | 10976 | 17235 | 17236 | 15212 | 23069 | 23064 | 32457 | 32456 | 32594 | 22919 |
| | 22909 | 15946 | 16970 | 17610 | 16972 | 16971 | 15951 | 16969 | 15952 | 28738 | 32731 | 17656 |
| | 17654 | 17658 | 17655 | 17652 | 17653 | 17657 | 32443 | 23065 | 23067 | 29800 | 32733 | 32684 |
| | 11076 | 11074 | 32705 | 11079 | 11078 | 31873 | 11075 | 17677 | 31870 | 32706 | 32698 | 32699 |
| | 31869 | 32700 | 31868 | 18294 | 18290 | 18278 | 18274 | 18276 | 18273 | 18275 | 18272 | 18277 |
| | 18271 | 18293 | 18261 | 18260 | 18291 | 18289 | 18295 | 18286 | 18279 | 18282 | 18281 | 18285 |
| | 18283 | 18280 | 18269 | 18268 | 18270 | 18267 | 23061 | 18264 | 18266 | 18263 | 23060 | 23059 |
| | 18288 | 18292 | 18287 | 18265 | 32440 | 32441 | 19976 | 19990 | 19983 | 19978 | 19975 | 19988 |
| | 19985 | 19981 | 19982 | 19979 | 19987 | 19980 | 19984 | 19977 | 19989 | 19986 | 23070 | 32444 |
| | 20167 | 30939 | 30904 | 18647 | 18648 | 18646 | 18481 | 18478 | 18482 | 18479 | 18475 | 18474 |
| | 18480 | 18477 | 10021 | 10017 | 10023 | 10022 | 10020 | 10019 | 10018 | 10013 | 10012 | 10014 |
| | 10016 | 10011 | 10010 | 10015 | 10009 | 20370 | 20375 | 20371 | 20374 | 20373 | 20372 | 20369 |
| | 20368 | 18476 | 31691 | 32746 | 32696 | 32740 | 32739 | 32690 | 23071 | 23066 | 32447 | 32449 |
| | 32448 | 23068 | 23072 | 32446 | 32453 | 32597 | 32596 | 32595 | 32436 | 32437 | 32442 | 32450 |
| | 32451 | 32452 | 32454 | 32455 | 32459 | 32458 | 32461 | 32430 | 32439 | 32445 | 32742 | 32692 |
| | 32687 | 32688 | 32691 | 11018 | 12143 | 31251 | 31246 | 12130 | 12954 | 19959 | 19957 | 19958 |
| | 19960 | 665 | 13171 | | | | | | | | | |
| 634: | 23618 | 1224 | 1754 | 3565 | 30468 | 9444 | 5488 | 8262 | 7348 | 6868 | 6622 | 27429 |
| 635: | 14764 | 11553 | 11554 | 11555 | 20378 | 33057 | 33056 | 1778 | 2708 | 3774 | 3531 | 20303 |
| | 20376 | 29086 | 26906 | 33244 | 33246 | 33240 | 6321 | 6274 | 6149 | 8313 | 7727 | 8312 |
| | 7468 | 7008 | 7839 | 7007 | 18862 | 21913 | 21911 | 21909 | | | | |
| 636: | 1280 | 32021 | 29146 | 29147 | 15401 | | | | | | | |
| 637: | 1395 | 1444 | 1624 | 3898 | 2354 | 3779 | 6488 | 5833 | 5539 | 6543 | 7920 | 9031 |
| | 7541 | 8075 | 8676 | 8650 | 8651 | 8077 | 6637 | 7921 | 9030 | 8076 | 9198 | 8425 |
| | 8827 | 8508 | 8074 | 15858 | 9549 | | | | | | | |
| 638: | 23303 | 22414 | 1045 | 24942 | 2002 | 2221 | 3463 | 2088 | 22493 | 15331 | 22912 | 20078 |
| | 6408 | | | | | | | | | | | |
| 639: | 11325 | 17887 | 33493 | 3437 | 2452 | 22003 | 4611 | 5279 | 6243 | | | |
| 640: | 33196 | 21137 | 11447 | 24851 | 13573 | 12197 | 30266 | 30278 | 27171 | 30106 | 31637 | 13127 |
| | 13131 | 32899 | 32927 | 27851 | 27837 | 27843 | 20047 | 32969 | 10282 | 10318 | 10258 | 11198 |
| | 24093 | 24078 | 16153 | 16134 | 17378 | 17401 | 17387 | 17317 | 25768 | 21064 | 13401 | 13395 |
| | 12648 | 18329 | 13940 | 13867 | 13894 | 13923 | 13897 | 13922 | 17664 | 10545 | 14199 | 21031 |
| | 15705 | 14583 | 15200 | 15157 | 14988 | 15001 | 12889 | 15556 | 14126 | 17530 | 22468 |
| | 22431 | 23797 | 14460 | 15778 | 17022 | 15508 | 17844 | 17829 | 17775 | 27880 | 16265 | 29829 |
| | 16256 | 28218 | 18786 | 21194 | 16706 | 16694 | 25998 | 29831 | 16871 | 32372 | 27581 | 16809 |
| | 29858 | 29889 | 25981 | 29899 | 11907 | 11929 | 11925 | 11965 | 19219 | 19258 | 19249 | 19239 |
| | 17117 | 17129 | 17114 | 18608 | 18091 | 18024 | 18043 | 32941 | 28543 | 28591 | 18700 | 18707 |
| | 18727 | 16392 | 16314 | 16333 | 16327 | 24728 | 24746 | 24761 | 24731 | 18946 | 18895 | 18977 |
| | 19072 | 19132 | 19136 | 19121 | 12812 | 28910 | 12789 | 12059 | 12048 | 17968 | 18218 | 18171 |
| | 18165 | 18156 | 18210 | 18180 | 18125 | 14059 | 13990 | 13999 | 14057 | 18484 | 19418 | 19383 |
| | 19414 | 19305 | 19836 | 19856 | 19867 | 19840 | 23448 | 23580 | 19486 | 19566 | 19612 | 19694 |
| | 19570 | 19754 | 25943 | 29920 | 25001 | 20980 | 20396 | 25592 | 30136 | 25029 | 20597 | 20770 |
| | 32213 | 32189 | 23201 | 30346 | 30332 | 22330 | 22347 | 12287 | 21012 | 33432 | 33415 | 21628 |
| | 21660 | 22565 | 22567 | 22237 | 22286 | 22979 | 22858 | 21413 | 21416 | 21470 | 21445 | 21469 |
| | 21468 | 21406 | 21442 | 21319 | 21381 | 21322 | 21378 | 21317 | 21248 | 21241 | 21274 | 24220 |
| | 25919 | 30489 | 27172 | 23966 | 23940 | 23919 | 24007 | 30190 | 30181 | 25173 | 26086 | 29999 |

TABLE 2-continued

| SEQ ID NO: | homolog SEQ ID NOs | | | | | | | | | | |
|---|---|---|---|---|---|---|---|---|---|---|---|
| | 25103 | 25848 | 25096 | 25819 | 30062 | 25084 | 26588 | 28266 | 25132 | 30049 | 26950 | 25224 |
| | 25230 | 25680 | 27658 | 27714 | 27784 | 27751 | 27779 | 27789 | 27740 | 25443 | 25465 | 25319 |
| | 25330 | 25428 | 13024 | 11683 | 13026 | 11682 | 10715 | 10703 | 10683 | 10662 | 10698 | 10671 |
| | 10690 | 27090 | 27065 | 13752 | 31071 | 26413 | 26497 | 26506 | 26405 | 26226 | 26203 | 26211 |
| | 26283 | 26330 | 26219 | 27982 | 27213 | 27222 | 27232 | 27230 | 9508 | 9506 | 12029 | 11532 |
| | 16481 | 16462 | 16465 | 30623 | 12416 | 12380 | 12419 | 13323 | 13317 | 16189 | 16226 | 26135 |
| | 12527 | 17913 | 10402 | 18823 | 18820 | 26020 | 14927 | 14895 | 27462 | 28205 | 28183 | 28181 |
| | 14311 | 14310 | 28034 | 27329 | 27338 | 27341 | 29306 | 28351 | 28149 | 28468 | 31834 | 31831 |
| | 31848 | 31825 | 31830 | 31846 | 31847 | 31845 | 31842 | 31839 | 31828 | 31840 | 31822 | 31821 |
| | 31820 | 31819 | 31829 | 31832 | 31827 | 31843 | 31841 | 31838 | 31818 | 31837 | 31836 | 31835 |
| | 31824 | 31817 | 31844 | 30440 | 30439 | 31833 | 31826 | 30442 | 30434 | 30425 | 30420 | 30437 |
| | 30428 | 30427 | 30426 | 30424 | 30422 | 30421 | 30418 | 30417 | 30441 | 30438 | 30436 | 30435 |
| | 30433 | 30432 | 30431 | 30429 | 30419 | 31823 | 30423 | 30430 | 24796 | 15368 | 21686 | 13704 |
| | 13720 | 14309 | 30732 | 25503 | 29697 | 16418 | 11095 | 30378 | 18768 | 15441 | 15627 | 15380 |
| | 20143 | 15235 | 10219 | 13493 | 1489 | 1216 | 1728 | 14308 | 11605 | 2020 | 2469 |
| | 3616 | 1876 | 2467 | 1952 | 2468 | 3857 | 2901 | 3615 | 3170 | 3060 | 3870 | 3871 |
| | 2620 | 2008 | 3810 | 3172 | 22913 | 21950 | 30714 | 29348 | 22021 | 28956 | 32634 | 24042 |
| | 29210 | 4679 | 4826 | 5739 | 4640 | 5286 | 4271 | 5740 | 4638 | 5741 | 5700 | 4911 |
| | 5743 | 4824 | 6381 | 5742 | 4912 | 4643 | 4752 | 4749 | 4259 | 8026 | 9078 | 8048 |
| | 21167 | 9261 | 9262 | 7626 | 8049 | 9256 | 8410 | 7851 | 8796 | 8757 | 7028 | 7505 |
| | 8798 | 8797 | 23057 | 23058 | 7506 | 7843 | 7200 | 7964 | 8411 | 8807 | 8207 | 31115 |
| | 14307 | 18425 | 18424 | 18423 | 18422 | 18421 | 20322 | 9807 | 23338 | 18814 | 18815 | 10554 |
| | 19421 | 15636 | 20646 | 23667 | 30383 | 30377 | 30380 | 30488 | 15066 | 30409 | 21130 |
| | 21127 | 21129 | 11426 | 11423 | 9858 | 11427 | 11424 | 11290 | 15064 | 11422 | 9861 | 22382 |
| | 22549 | 9857 | 11425 | 20275 | 15062 | 9859 | 31375 | 15063 | 9860 | 31110 | 15065 | 26821 |
| | 32151 | 30385 | 27526 | 30381 | 32150 | 32140 | 30386 | 32146 | 32143 | 30388 | 32154 | 32153 |
| | 32147 | 32145 | 32144 | 30384 | 30382 | 32148 | 32142 | 32149 | 32152 | 14241 | 9862 | 32155 |
| | 30387 | 32141 | 11408 | 11407 | 32002 | 30874 | 30872 | 30876 | 30875 | 30873 | 30867 | 30869 |
| | 30871 | 30868 | 30870 | 11385 | 24924 | 32156 | 30408 | 30399 | 30414 | 32157 | 25523 | 30407 |
| | 30415 | 30416 | 22949 | 13251 | 31112 | 13250 | 13248 | 13246 | 30412 | 23693 | 30410 | 30411 |
| | 30413 | 28675 | 28725 | 28747 | 31849 | 29809 | 29804 | 16581 | 12463 | 31185 | 31191 | 31222 |
| | 31180 | 22495 | 22496 | 22494 | 17280 | 21524 | 31113 | 30909 | 30908 | 22914 | 11029 | 12107 |
| | 31264 | 12105 | 12103 | 12970 | 12957 | 21489 | 31114 | 31560 | 12173 | 23305 | 32257 | 32256 |
| | 32255 | 21126 | 21122 | 21124 | 21123 | 21119 | 21121 | 21120 | 21125 | 21128 | 13199 | 13186 |
| | 13160 | | | | | | | | | | | |
| 641: | 24477 | 26752 | 22776 | 28635 | 1333 | 3266 | 2912 | 2833 | 2777 | 3125 | 3823 | 3822 |
| | 29040 | 6131 | 5278 | 31892 | 29743 | | | | | | | |
| 642: | 25337 | 3496 | 2722 | 3586 | 3169 | 2921 | 2646 | 2138 | 2810 | 2136 | 2022 | 2166 |
| | 1957 | 4027 | 2922 | 3453 | 4382 | 5726 | 4903 | 8804 | 8029 | 8030 | 7124 | 7384 |
| | 7858 | 6552 | 7527 | 6652 | 8677 | 7553 | 7554 | 6831 | 7660 | 7886 | 6621 | 6945 |
| | 8881 | 6944 | 7469 | 8204 | | | | | | | | |
| 643: | 28796 | 29240 | 29122 | 28987 | 6580 | 6860 | | | | | | |
| 644: | 11446 | 30701 | 21802 | 18014 | 33328 | 22063 | 22387 | 15483 | 15484 | 21096 | 22528 | 22383 |
| | 1617 | 3483 | 22384 | 22385 | 25023 | 13050 | 31238 | 21897 | 14294 | 21781 | 21782 | 5764 |
| | 31928 | 9083 | | | | | | | | | | |
| 645: | 23500 | 23585 | 24550 | 24396 | 26815 | 26814 | 26656 | 25655 | 22730 | 22714 | 18252 | 18871 |
| | 947 | 3052 | 2079 | 3449 | 20312 | 21967 | 22506 | 22074 | 5931 | 5355 | 5671 | 4825 |
| | 6168 | 6542 | 5703 | 4296 | 9212 | 9153 | 9412 | 8314 | 31368 | 24948 | 20658 | 18863 |
| | 14282 | 18249 | 15449 | | | | | | | | | |
| 646: | 23549 | 24517 | 26669 | 22748 | 19193 | 20919 | 15381 | 15446 | 17879 | 27148 | 1760 | 1095 |
| | 1511 | 1208 | 1805 | 1743 | 2694 | 3648 | 2205 | 3207 | 2453 | 2695 | 3145 | 2693 |
| | 3146 | 2667 | 2280 | 2840 | 2474 | 9578 | 29053 | 15743 | 6048 | 5880 | 4406 | 5592 |
| | 5450 | 6047 | 6113 | 5825 | 5503 | 32109 | 20618 | 15623 | | | | |
| 647: | 29227 | 20848 | 27628 | 27627 | 27629 | 12756 | 21107 | 14863 | 28236 | 31628 | 29942 | 17359 |
| | 17376 | 10883 | 10904 | 13932 | 14522 | 14542 | 14480 | 14479 | 14487 | 15146 | 15039 | 12918 |
| | 12869 | 19002 | 19016 | 17502 | 17543 | 23811 | 17854 | 17807 | 16782 | 27597 | 11937 | 21859 |
| | 21887 | 21888 | 16942 | 17116 | 28537 | 28536 | 16379 | 24730 | 18947 | 12842 | 12799 | 18162 |
| | 18161 | 18221 | 13977 | 19839 | 23627 | 19565 | 25963 | 25962 | 26694 | 21718 | 21717 | 12471 |
| | 12472 | 22366 | 21465 | 21401 | 21372 | 21298 | 21296 | 21332 | 21218 | 21253 | 24044 | 23995 |
| | 25181 | 25865 | 25854 | 25116 | 30088 | 25692 | 27713 | 27676 | 26439 | 26206 | 26386 | 27956 |
| | 27229 | 9498 | 26478 | 26145 | 16174 | 16048 | 14905 | 14906 | 27368 | 28142 | 28143 | 23279 |
| | 18413 | 13691 | 10555 | 11134 | 29722 | 29712 | 20204 | 12485 | 28750 | 31229 | 30920 | 18994 |
| | 12134 | 12973 | 12175 | 29366 | 15665 | 30686 | | | | | | |
| 648: | 23288 | 33200 | 13579 | 32932 | 27838 | 13966 | 10317 | 10314 | 10313 | 29581 | 16162 | 17400 |
| | 17386 | 10907 | 13379 | 13425 | 13418 | 12645 | 18347 | 14545 | 14360 | 15722 | 15668 | 14505 |
| | 14511 | 14481 | 15136 | 14977 | 12868 | 32295 | 32291 | 32623 | 19011 | 15550 | 14147 | 14144 |
| | 14162 | 22455 | 22454 | 15278 | 23788 | 14459 | 15816 | 17032 | 30980 | 17037 | 15618 | 17841 |
| | 17838 | 17851 | 17821 | 27895 | 28073 | 16266 | 16286 | 16783 | 16853 | 16867 | 27542 | 16838 |
| | 11993 | 11926 | 19259 | 19269 | 21882 | 17172 | 17455 | 17099 | 17104 | 18610 | 18594 | 12744 |
| | 18050 | 28621 | 28523 | 18729 | 18693 | 16329 | 16350 | 24687 | 24706 | 24704 | 24762 | 18970 |
| | 19056 | 12779 | 12820 | 9872 | 9871 | 18211 | 14042 | 14041 | 19382 | 19415 | 19789 | 19807 |
| | 19805 | 19868 | 19664 | 19606 | 19572 | 25940 | 25944 | 25959 | 29919 | 24447 | 20996 | 21715 |
| | 12476 | 23191 | 12339 | 22374 | 12289 | 24307 | 21654 | 33398 | 22849 | 21365 | 21251 | 24218 |
| | 24217 | 24219 | 27173 | 27177 | 25738 | 25740 | 25790 | 25863 | 30061 | 25111 | 28836 | 26976 |
| | 26969 | 25697 | 27671 | 27707 | 27737 | 11675 | 13036 | 24967 | 27107 | 27116 | 13776 | 26498 |
| | 26486 | 26262 | 26391 | 26246 | 27981 | 27257 | 27217 | 27282 | 27268 | 9460 | 9494 | 11516 |
| | 11518 | 16470 | 12403 | 13305 | 13344 | 13338 | 26100 | 26159 | 10373 | 10369 | 30520 | 14902 |
| | 28175 | 28180 | 28401 | 28374 | 28487 | 23344 | 32383 | 13666 | 29709 | 27467 | 3445 | 3476 |

TABLE 2-continued

| SEQ ID NO: | homolog SEQ ID NOs | | | | | | | | | | |
|---|---|---|---|---|---|---|---|---|---|---|---|
| | 2400 | 2068 | 2768 | 2532 | 2262 | 2292 | 2122 | 2624 | 30587 | 6484 | 6526 | 6422 |
| | 4359 | 6063 | 4820 | 7449 | 7662 | 6846 | 7376 | 6711 | 11064 | 17981 | 19182 | 19179 |
| | 33011 | 33010 | 28709 | 12456 | 31162 | 31291 | 20873 | 21090 | 14518 | 12991 | 12989 | 28250 |
| | 10622 | 21772 | 16602 | 12183 | 26860 | 23084 | 13205 | | | | | |
| 649: | 1325 | 1453 | 1322 | 2614 | 3430 | 1946 | 2397 | 3474 | 2235 | 20211 | 29084 | 28941 |
| | 28942 | 21989 | 29194 | 28940 | 29005 | 5623 | 4871 | 6510 | 6509 | 6448 | 6106 | 6882 |
| | 7805 | 15435 | 27456 | | | | | | | | | |
| 650: | 17227 | 19279 | 14726 | 15225 | 12211 | 30241 | 13104 | 32413 | 13086 | 26572 | 32915 | 31938 |
| | 33446 | 14399 | 14398 | 31334 | 31333 | 31332 | 30461 | 16960 | 22190 | 27463 | 14725 | 16111 |
| | 27861 | 24079 | 16157 | 17327 | 10882 | 12550 | 24228 | 25148 | 21084 | 13434 | 12642 | 12686 |
| | 29271 | 18346 | 13884 | 16763 | 9798 | 21030 | 18548 | 14521 | 14361 | 14588 | 9725 | 14512 |
| | 15197 | 15036 | 12882 | 33253 | 15230 | 32612 | 15118 | 19001 | 15542 | 17510 | 22457 | 23785 |
| | 15765 | 30959 | 15521 | 17772 | 28057 | 16271 | 28095 | 18788 | 21189 | 16704 | 32357 | 27593 |
| | 16840 | 29842 | 11974 | 18444 | 21547 | 21878 | 17208 | 17443 | 17118 | 18621 | 18048 | 19427 |
| | 28533 | 18699 | 16313 | 24685 | 18904 | 12050 | 15239 | 10982 | 17967 | 18196 | 13991 | |
| | 18496 | 19366 | 19786 | 23519 | 23617 | 19477 | 19622 | 19755 | 25942 | 25960 | 20020 | 24497 |
| | 24557 | 20333 | 20979 | 17980 | 15224 | 26732 | 26670 | 26788 | 25572 | 25652 | 30119 | 25888 |
| | 22678 | 22718 | 20790 | 32223 | 23225 | 30343 | 22367 | 10086 | 12310 | 24305 | 21015 | 33382 |
| | 21644 | 22191 | 22197 | 22192 | 22193 | 22194 | 22195 | 22198 | 22199 | 22200 | 23369 | |
| | 23367 | 22243 | 22845 | 21435 | 21352 | 24180 | 23261 | 29475 | 24063 | 24006 | 25724 | 26077 |
| | 23167 | 25070 | 26599 | 24284 | 25126 | 26984 | 11450 | 30143 | 25488 | 10663 | 27058 | 25298 |
| | 27153 | 31078 | 26407 | 26265 | 26190 | 9451 | 12031 | 11525 | 29774 | 30643 | 12413 | 13353 |
| | 16194 | 16192 | 12524 | 24586 | 17925 | 10368 | 30521 | 16055 | 26042 | 12607 | 12027 | 18639 |
| | 14934 | 10594 | 28206 | 27366 | 28486 | 13706 | 29720 | 9669 | 16927 | 20261 | 1086 | 31581 |
| | 31582 | 13243 | 11583 | 3901 | 3213 | 1903 | 3902 | 3900 | 3038 | 3124 | 3214 | 2120 |
| | 1895 | 32024 | 33079 | 5174 | 6154 | 4436 | 4435 | 5431 | 5542 | 5430 | 5175 | 5322 |
| | 7961 | 8232 | 8474 | 8706 | 7504 | 9264 | 7190 | 7680 | 8707 | 7680 | 8231 | 7712 | 8977 |
| | 8940 | 7542 | 9393 | 9388 | 8127 | 7838 | 23889 | 23890 | 11319 | 11320 | 10862 | 21924 |
| | 10859 | 10860 | 18414 | 9757 | 9760 | 9759 | 9758 | 17986 | 16024 | 16025 | 17987 | 16022 |
| | 16023 | 9756 | 10861 | 20155 | 10858 | 10501 | 21159 | 24952 | 10500 | 11173 | 31902 | 29598 |
| | 13460 | 11229 | 20702 | 20441 | 32985 | 13798 | 9439 | 9440 | 22189 | 23101 | 23103 | 23102 |
| | 30877 | 30880 | 20591 | 30878 | 30881 | 29409 | 29408 | 30879 | 28702 | 32125 | 16498 | 29795 |
| | 12450 | 31583 | 31147 | 31306 | 20872 | 23363 | 23356 | 23368 | 23364 | 15664 | 10467 | 10466 |
| | 19919 | 29413 | 20828 | 20827 | 19918 | 23361 | 23366 | 23362 | 23358 | 23371 | 23370 | 23891 |
| | 11318 | 23365 | 23360 | 23359 | 23357 | 30932 | 24147 | 12102 | 16594 | 12171 | 29153 | 26859 |
| | 22215 | | | | | | | | | | | |
| 651: | 33238 | 27449 | 13136 | 16094 | 33354 | 12552 | 33264 | 25772 | 25751 | 25153 | 31231 | 29218 |
| | 10632 | 18573 | 20141 | 27904 | 28221 | 18115 | 23593 | 19592 | 20423 | 20392 | 32217 | 22301 |
| | 23250 | 23132 | 23978 | 23989 | 31035 | 27166 | 31671 | 31672 | 25357 | 28341 | 9993 | 1053 |
| | 852 | 1360 | 1675 | 2940 | 2558 | 2559 | 18453 | 18452 | 28973 | 29259 | 29136 | 9660 |
| | 9661 | 9658 | 10642 | 9657 | 9659 | 9655 | 10640 | 10645 | 9656 | 10641 | 10643 | 9654 |
| | 10644 | 24944 | 17275 | 32401 | 31348 | 28856 | 27128 | 5619 | 4980 | 9241 | 9060 | 18764 |
| | 32408 | 33509 | 17281 | 20539 | 20538 | 18505 | 18400 | 16546 | 16497 | 16575 | 16574 | 29806 |
| | 12097 | 12142 | 12091 | 12087 | 26528 | 20129 | 14791 | 24633 | 33609 | 32843 | | |
| 652: | 33467 | 1564 | 1241 | 899 | 3638 | 3637 | 2158 | 2925 | 3438 | 20366 | 10577 | 24010 |
| | 21545 | 5572 | 5034 | 5195 | 5075 | 5771 | 4992 | 7267 | 7578 | 6805 | 8117 | 7429 |
| | 24809 | 652 | 15819 | 15437 | | | | | | | | |
| 653: | 1406 | 1319 | 1284 | 1424 | 1485 | 1383 | 1320 | 2430 | 2303 | 3636 | 3349 | 2988 |
| | 29047 | 21951 | 30715 | 10053 | 6350 | 4600 | 5508 | 5375 | 4163 | 6240 | 4497 | 4594 |
| | 5196 | 5067 | 6077 | 5376 | 6299 | 5276 | 9149 | 9148 | 9151 | 9150 | 8011 | 7507 |
| | 9218 | 6925 | 7277 | 7647 | 7648 | 9015 | 7209 | 15464 | 17212 | 15890 | | |
| 654: | 1466 | 1796 | 3407 | 3642 | 3369 | 2389 | 9580 | 32708 | 8986 | 7387 | 9396 | 31355 |
| | 32425 | | | | | | | | | | | |
| 655: | 929 | 2958 | 3519 | 1911 | 6295 | 7562 | 7127 | 9029 | 28672 | 20448 | 20053 | 20054 |
| 656: | 5365 | 6120 | 4161 | 8982 | 7071 | 7072 | 8152 | 6737 | 6619 | | | |
| 657: | 23604 | 24431 | 24474 | 26625 | 25602 | 1001 | 1119 | 5624 | 5419 | 24788 | 22941 | 17258 |
| 658: | 9583 | 9827 | 33632 | 15221 | 12209 | 30232 | 13146 | 12216 | 32923 | 20326 | 33012 | 19276 |
| | 18875 | 14416 | 12995 | 10507 | 27828 | 16021 | 12540 | 16013 | 15928 | 15220 | 10301 | 30303 |
| | 29577 | 27869 | 29952 | 16158 | 16140 | 29584 | 31027 | 17329 | 12563 | 24226 | 25757 | 21046 |
| | 12662 | 12702 | 18314 | 11711 | 13865 | 15222 | 14192 | 21036 | 18551 | 14348 | 15678 | 17722 |
| | 14595 | 14685 | 14476 | 15167 | 15011 | 12893 | 29594 | 32631 | 15124 | 19031 | 29220 | 15527 |
| | 15561 | 17871 | 17519 | 22484 | 31670 | 23790 | 15780 | 17019 | 15519 | 27898 | 18796 | 21184 |
| | 26000 | 27594 | 16822 | 16890 | 11973 | 21865 | 32570 | 17199 | 17459 | 17137 | 18593 | 18074 |
| | 28590 | 18849 | 10510 | 18691 | 18716 | 16372 | 31669 | 33617 | 18905 | 18968 | 10508 | 19096 |
| | 12829 | 12058 | 9893 | 17965 | 18189 | 13994 | 18494 | 19350 | 19884 | 23716 | 23533 | |
| | 19501 | 19599 | 19764 | 20485 | 20458 | 24349 | 9697 | 20340 | 20975 | 20401 | 32990 | 20556 |
| | 10505 | 25603 | 25893 | 22802 | 21726 | 20816 | 23211 | 12336 | 30347 | 30329 | 22318 | 10090 |
| | 12296 | 24304 | 21017 | 33404 | 21647 | 22255 | 22852 | 21371 | 24197 | 24199 | 24203 | 23255 |
| | 23271 | 29476 | 25932 | 23922 | 23979 | 25719 | 26080 | 25798 | 25866 | 23169 | 27501 | 25855 |
| | 26582 | 24257 | 28281 | 30044 | 28841 | 26979 | 25700 | 27731 | 25486 | 10666 | 24963 | 27111 |
| | 25284 | 27152 | 31053 | 26402 | 26224 | 26187 | 27254 | 11382 | 9524 | 12044 | 11477 | 16473 |
| | 16479 | 30595 | 12381 | 12369 | 13347 | 16215 | 12499 | 24575 | 17910 | 13274 | 10409 | 30530 |
| | 16045 | 12621 | 12247 | 14919 | 10838 | 10592 | 27356 | 18001 | 28134 | 28452 | 23684 | |
| | 23686 | 23687 | 22184 | 10506 | 21106 | 31738 | 22498 | 26888 | 33287 | 33288 | 19703 | 13675 |
| | 14117 | 12331 | 12333 | 12323 | 12324 | 12325 | 12326 | 12327 | 12330 | 9593 | 16428 | 29730 |
| | 29715 | 29733 | 29706 | 9755 | 33289 | 21163 | 20259 | 1712 | 21853 | 1673 | 1240 | 1745 |
| | 1049 | 23685 | 21852 | 25016 | 23741 | 11587 | 3218 | 2080 | 24245 | 2809 | 2265 | 2300 |
| | 2889 | 1836 | 3697 | 2890 | 32654 | 31668 | 33351 | 33352 | 20964 | 33150 | 30659 | 20284 |

TABLE 2-continued

| SEQ ID NO: | homolog SEQ ID NOs | | | | | | | | | | |
|---|---|---|---|---|---|---|---|---|---|---|---|
| | 18473 | 9946 | 12320 | 12322 | 12321 | 22166 | 12318 | 33117 | 6040 | 6261 | 4773 | 4618 |
| | 4751 | 5869 | 5868 | 4769 | 5867 | 5966 | 5870 | 4113 | 4403 | 6164 | 6073 | 4303 |
| | 5204 | 4984 | 4975 | 6380 | 6265 | 8122 | 9340 | 8489 | 8759 | 8760 | 6814 | 8761 |
| | 7353 | 7098 | 7278 | 8762 | 7246 | 9155 | 9154 | 9414 | 7040 | 7120 | 15485 | 31361 |
| | 16722 | 23688 | 22527 | 21529 | 28110 | 19770 | 14947 | 16515 | 9992 | 19270 | 11473 | 23091 |
| | 23090 | 14759 | 9720 | 11166 | 33131 | 16635 | 15070 | 21703 | 11090 | 11057 | 23660 | 20626 |
| | 22971 | 12328 | 20186 | 27451 | 11324 | 20045 | 12329 | 11271 | 13478 | 30848 | 11421 | 28741 |
| | 16550 | 12443 | 17699 | 29338 | 23691 | 31205 | 31330 | 31319 | 20885 | 20881 | 20046 | 23690 |
| | 30943 | 31608 | 32005 | 12332 | 12106 | 21763 | 16588 | 12165 | 15922 | 26834 | 10509 | 23682 |
| | 23683 | 12319 | 23689 | | | | | | | | | |
| 659: | 1583 | 897 | 864 | 1752 | 1753 | 3879 | 2447 | 2944 | 2347 | 2035 | 1855 | 2831 |
| | 2449 | 3405 | 2448 | 2348 | 2987 | 2446 | 2102 | 3005 | 1837 | 28851 | 5314 | 5315 |
| | 5041 | 4520 | 6487 | 5885 | 6398 | 5762 | 9263 | 8967 | 7903 | 7397 | 7625 | 8463 |
| | 8394 | 8592 | 7498 | 8591 | 7491 | 7107 | 7108 | 6694 | 7902 | 9403 | 9972 | |
| 660: | 23609 | 1740 | 1167 | 3966 | 17220 | 29141 | 10962 | 10959 | 10961 | 10960 | 5469 | 5115 |
| | 5095 | 5679 | 6162 | 4612 | 4702 | 5678 | 6330 | 7833 | 6885 | 8478 | 7145 | 8483 |
| | 6975 | 9065 | 8602 | 7144 | 32839 | 15455 | | | | | | |
| 661: | 32709 | 20936 | 10316 | 10255 | 10288 | 10315 | 11181 | 17350 | 14107 | 13388 | 18353 | 18301 |
| | 21034 | 15713 | 17068 | 14122 | 22433 | 22432 | 22429 | 30891 | 17011 | 19931 | 17840 | 17808 |
| | 17839 | 17853 | 27556 | 27573 | 29893 | 29901 | 11918 | 11928 | 12008 | 19260 | 19213 | 19261 |
| | 17477 | 12741 | 18023 | 18026 | 18025 | 18021 | 28607 | 28546 | 24701 | 24779 | 18984 | 18939 |
| | 18951 | 19085 | 19130 | 19129 | 19128 | 19291 | 19352 | 19802 | 19886 | 19747 | 25936 | 25970 |
| | 24494 | 20990 | 22370 | 22313 | 33416 | 33424 | 21593 | 22880 | 21539 | 22838 | 25745 | 25793 |
| | 24662 | 26590 | 26944 | 27069 | 27040 | 25304 | 27267 | 27291 | 12042 | 12377 | 10397 | 10393 |
| | 10394 | 12598 | 12020 | 18634 | 28355 | 28417 | 28435 | 28429 | 20193 | 33303 | 1236 | 3768 |
| | 3025 | 3594 | 3222 | 29117 | 28969 | 5669 | 4762 | 5719 | 5851 | 6326 | 4529 | 5862 |
| | 6300 | 4816 | 6485 | 5035 | 6423 | 7482 | 9200 | 8897 | 8012 | 26091 | 8896 | 7123 |
| | 6884 | 7044 | 9415 | 9070 | 6642 | 6750 | 19181 | 21916 | 19180 | 27126 | 28871 | 24144 |
| | 12990 | 31452 | 11760 | | | | | | | | | |
| 662: | 1184 | 2069 | 2761 | 3420 | 2710 | 28965 | 6285 | 5432 | 5433 | 5522 | 6160 | 9041 |
| | 7381 | 8778 | 8198 | 6582 | 32890 | | | | | | | |
| 663: | 27643 | 10279 | 17746 | 30970 | 17798 | 19223 | 29217 | 9705 | 20415 | 23213 | 23986 | 27499 |
| | 25120 | 28269 | 25696 | 27811 | 25484 | 13760 | 26432 | 26357 | 31386 | 12502 | 12846 | 10847 |
| | 21138 | 31009 | 31011 | 21851 | 29682 | 1267 | 1411 | 22125 | 20313 | 28971 | 4418 | 6421 |
| | 8943 | 6921 | 7925 | 8433 | 31457 | 26824 | 32647 | 28734 | 12151 | 31265 | 13174 | 32847 |
| 664: | 27204 | 13545 | 13557 | 13540 | 32267 | 32239 | 25069 | 25802 | 13130 | 13098 | 32917 | 16913 |
| | 11238 | 23100 | 12539 | 23410 | 10291 | 27855 | 9435 | 29376 | 11213 | 25899 | 17308 | 17328 |
| | 12585 | 24237 | 25776 | 25147 | 13368 | 16306 | 19741 | 18254 | 18356 | 11713 | 13871 | 14204 |
| | 21032 | 14547 | 15691 | 14596 | 22092 | 15175 | 12884 | 31383 | 29373 | 33570 | 21577 | 32599 |
| | 15122 | 15544 | 17516 | 15277 | 22424 | 22471 | 15809 | 15786 | 30972 | 15620 | 17810 | |
| | 16255 | 16705 | 16868 | 32375 | 16884 | 29866 | 11992 | 19209 | 21857 | 17126 | 12730 | 17999 |
| | 18097 | 28578 | 18678 | 16368 | 16317 | 24737 | 24759 | 18976 | 19059 | 12787 | 12081 | 12055 |
| | 9880 | 18181 | 19343 | 19847 | 19865 | 23529 | 19615 | 19749 | 25947 | 20454 | 24360 | 20402 |
| | 20575 | 20549 | 26708 | 25051 | 25031 | 25037 | 26712 | 20789 | 20782 | 32227 | 12356 | 30369 |
| | 22353 | 33395 | 21595 | 22292 | 22281 | 22853 | 21432 | 21349 | 21273 | 23246 | 24043 | 29969 |
| | 28256 | 27188 | 25731 | 26083 | 24650 | 24659 | 25822 | 25082 | 26591 | 24253 | 28263 | 26928 |
| | 25222 | 27669 | 27757 | 25490 | 10677 | 24981 | 27092 | 27032 | 31086 | 26412 | 26221 | 26183 |
| | 27933 | 27979 | 27262 | 27231 | 9478 | 9472 | 12040 | 11503 | 13294 | 26104 | 12519 | 10363 |
| | 27994 | 27388 | 28383 | 28123 | 28495 | 28324 | 21103 | 15365 | 13685 | 14792 | 22886 | 29700 |
| | 16429 | 9671 | 25382 | 14882 | 32412 | 32963 | 32964 | 23118 | 18644 | 32472 | 9736 | 17255 |
| | 18378 | 27140 | 18432 | 31706 | 31705 | 16649 | 9436 | 23739 | 23738 | 12430 | 33514 | 29181 |
| | 15477 | 31665 | 30757 | 13524 | 25026 | 16559 | 29799 | 31175 | 13048 | 30947 | 31600 | 22185 |
| | 14115 | 14116 | 33005 | 11019 | 12976 | 21753 | 21493 | 12172 | 12174 | 26843 | 26855 | 31443 |
| 665: | 30490 | 9787 | 13546 | 32703 | 32704 | 32702 | 31872 | 31904 | 27618 | 32743 | 32693 | 32738 |
| | 32741 | 32689 | 32745 | 32695 | 32747 | 32697 | 11055 | 14342 | 14340 | 30991 | 29471 | 29462 |
| | 29474 | 29473 | 29463 | 29469 | 29464 | 29468 | 29465 | 29461 | 29472 | 29467 | 29470 | 29466 |
| | 21565 | 21561 | 21566 | 21564 | 21562 | 21563 | 21567 | 17222 | 633 | 13102 | 15761 | 555 |
| | 31493 | 16973 | 15947 | 19951 | 11292 | 10253 | 33349 | 17330 | 31287 | 13877 | 13929 | 12852 |
| | 13945 | 22533 | 20213 | 19777 | 19775 | 13005 | 19778 | 15706 | 15198 | 15201 | 14990 | 14987 |
| | 12919 | 12924 | 12914 | 14798 | 17503 | 22453 | 23776 | 17770 | 19950 | 19943 | 19941 | 19949 |
| | 19948 | 19945 | 19942 | 19946 | 19947 | 19944 | 27918 | 16777 | 33613 | 25983 | 11972 | 17159 |
| | 31491 | 31492 | 17119 | 17155 | 19971 | 19973 | 19962 | 19970 | 19966 | 19969 | 19964 | 19967 |
| | 19965 | 19961 | 19968 | 19974 | 19963 | 19972 | 19952 | 19956 | 19955 | 19953 | 19954 | 12726 |
| | 18051 | 28569 | 18737 | 16384 | 18906 | 19111 | 18213 | 18231 | 14013 | 14047 | 23714 | 23502 |
| | 19779 | 19604 | 19649 | 19670 | 19681 | 29928 | 20011 | 20009 | 22976 | 17869 | 17868 | 26770 |
| | 25660 | 25049 | 22729 | 22373 | 21598 | 22296 | 21392 | 23160 | 29477 | 23917 | 23987 | 23992 |
| | 24642 | 29994 | 25815 | 25109 | 25839 | 24259 | 30155 | 27697 | 27767 | 25473 | 11663 | 13042 |
| | 10675 | 13738 | 31059 | 26427 | 26263 | 9493 | 12523 | 16075 | 12259 | 28187 | 28032 | 15366 |
| | 15364 | 22522 | 32729 | 32515 | 22516 | 22517 | 32734 | 32736 | 31683 | 17946 | 32877 | 28331 |
| | 33498 | 33502 | 14271 | 32827 | 14071 | 33530 | 32828 | 13661 | 32393 | 26162 | 10162 | 10156 |
| | 10161 | 10155 | 10157 | 10160 | 10159 | 10163 | 10158 | 10154 | 31751 | 31750 | 32876 | 20185 |
| | 28330 | 17954 | 17950 | 17951 | 17956 | 17953 | 17949 | 20158 | 13015 | 31753 | 31752 | 31748 |
| | 31749 | 31755 | 31754 | 31756 | 31757 | 31766 | 31763 | 31765 | 31786 | 31758 | 31762 | 31761 |
| | 31760 | 31759 | 29268 | 31494 | 32513 | 31490 | 16427 | 21001 | 17234 | 17239 | 15949 | 17948 |
| | 17955 | 22090 | 11832 | 11831 | 10477 | 32956 | 32957 | 32875 | 32874 | 17952 | 17947 | 33503 |
| | 33504 | 22098 | 23913 | 23911 | 23907 | 23905 | 23906 | 23904 | 23902 | 23901 | 23903 | 33499 |
| | 33500 | 11835 | 11833 | 11841 | 11834 | 11839 | 11842 | 11845 | 11846 | 11848 | 11847 | 11840 |
| | 11836 | 11851 | 11843 | 11838 | 11844 | 11849 | 11850 | 11837 | 32878 | 17945 | 33501 | 20159 |

TABLE 2-continued

| SEQ ID NO: | homolog SEQ ID NOs | | | | | | | | | | |
|---|---|---|---|---|---|---|---|---|---|---|---|
| | 33497 | 16931 | 21576 | 21575 | 21574 | 9853 | 21211 | 11449 | 10441 | 18651 | 17659 | 14445 |
| | 14443 | 10440 | 32460 | 15451 | 14444 | 14805 | 15406 | 15731 | 9441 | 24636 | 29333 | 24595 |
| | 13736 | 28860 | 14270 | 15474 | 14281 | 15434 | 15730 | 32844 | 32502 | 20140 | 20139 | 9545 |
| | 15413 | 1787 | 1767 | 874 | 32438 | 23074 | 14292 | 33281 | 11584 | 9797 | 11630 | 32871 |
| | 3988 | 3280 | 3989 | 2729 | 2716 | 3284 | 1905 | 15927 | 2918 | 3885 | 1938 | 2324 |
| | 3643 | 3447 | 3670 | 23334 | 2222 | 2623 | 2295 | 3821 | 2239 | 4075 | 3625 |
| | 2189 | 2044 | 3502 | 24853 | 2237 | 3446 | 3950 | 2426 | 3884 | 2540 | 3344 | 3504 |
| | 4026 | 2939 | 2071 | 2019 | 3990 | 2571 | 2590 | 3194 | 3680 | 2980 | 3805 | 2188 |
| | 2602 | 17237 | 17240 | 31489 | 20222 | 15630 | 31889 | 31888 | 22143 | 19277 | 13282 | 14769 |
| | 28995 | 28963 | 22004 | 21968 | 28964 | 21969 | 32680 | 20282 | 29110 | 21902 | 32728 | 32682 |
| | 17629 | 32701 | 31871 | 16965 | 16966 | 15945 | 11080 | 16964 | 11080 | 16968 | 16967 | 15950 |
| | 17609 | 11081 | 11082 | 11084 | 11073 | 11071 | 11083 | 11085 | 11072 | 11086 | 11088 | 16974 |
| | 15948 | 33115 | 9730 | 33116 | 31877 | 27442 | 19468 | 19467 | 9731 | 9840 | 9591 | 31885 |
| | 21569 | 21573 | 21572 | 21570 | 21571 | 21568 | 14824 | 14339 | 23073 | 21900 | 21899 | 21898 |
| | 21901 | 32726 | 32681 | 32635 | 32686 | 13479 | 21903 | 32737 | 32744 | 32694 | 32735 | 22526 |
| | 22525 | 22520 | 32685 | 22519 | 22521 | 32732 | 32683 | 32727 | 32730 | 10979 | 10978 | 29628 |
| | 29629 | 29633 | 29632 | 29630 | 29631 | 32244 | 21680 | 5819 | 6431 | 5729 | 6067 | 5555 |
| | 5421 | 5918 | 5921 | 4799 | 30397 | 5920 | 4798 | 5203 | 4797 | 5422 | 5424 | 4796 |
| | 5917 | 6288 | 5919 | 4208 | 5058 | 6175 | 4795 | 5904 | 4244 | 5647 | 5906 | 5849 |
| | 5554 | 5423 | 6176 | 5556 | 5443 | 5053 | 5818 | 4581 | 6194 | 5014 | 6177 | 33348 |
| | 10194 | 8574 | 9266 | 7909 | 6719 | 9267 | 6707 | 7875 | 9331 | 7704 | 23005 | 9265 |
| | 6721 | 13446 | 9330 | 6639 | 9332 | 8526 | 7708 | 30192 | 7153 | 8942 | 9333 | 7216 |
| | 9011 | 9133 | 8216 | 8217 | 32533 | 7812 | 30662 | 8604 | 30661 | 6626 | 7754 | 7604 |
| | 9232 | 7373 | 7834 | 8941 | 8724 | 7602 | 7603 | 7606 | 7600 | 7601 | 8129 | 7067 |
| | 7179 | 7607 | 8218 | 8527 | 7887 | 7817 | 7645 | 9139 | 7266 | 8324 | 7099 | 7605 |
| | 8538 | 7259 | 11658 | 11115 | 10197 | 10195 | 10198 | 10196 | 17241 | 31014 | 21140 | 11133 |
| | 13008 | 13009 | 19362 | 13014 | 20171 | 31387 | 32580 | 13017 | 20165 | 20166 | 20164 |
| | 20160 | 20161 | 20162 | 13016 | 20163 | 20169 | 20170 | 20168 | 16654 | 20172 | 20173 | 20175 |
| | 20174 | 20176 | 20180 | 20177 | 20178 | 20179 | 20181 | 20184 | 20182 | 20183 | 13778 | 13779 |
| | 21537 | 22749 | 30727 | 13733 | 13238 | 22112 | 31890 | 31887 | 31886 | 32434 | 32431 | 32432 |
| | 32433 | 32462 | 32435 | 14244 | 22523 | 22524 | 22518 | 22918 | 16645 | 33282 | 10976 | 17235 |
| | 17236 | 15212 | 23069 | 23064 | 32457 | 32456 | 32594 | 22919 | 22909 | 16970 | 15946 | 16972 |
| | 16971 | 17610 | 15951 | 16969 | 15952 | 28738 | 28718 | 28723 | 32731 | 17655 | 17658 | 17652 |
| | 17656 | 17654 | 17653 | 17657 | 32443 | 23065 | 23067 | 29800 | 32733 | 32684 | 11076 | 32705 |
| | 11079 | 11077 | 11078 | 11074 | 31873 | 11075 | 32706 | 31870 | 32698 | 32699 | 32700 | 31869 |
| | 31868 | 18294 | 18290 | 18274 | 18276 | 18273 | 18272 | 18275 | 18278 | 18277 | 18271 | 18293 |
| | 18291 | 18289 | 18295 | 18286 | 18283 | 18282 | 18280 | 18285 | 18281 | 18279 | 18263 | 18269 |
| | 18267 | 23059 | 18270 | 18288 | 18292 | 18287 | 32441 | 32440 | 19976 | 19978 | 19983 | 19981 |
| | 19975 | 19988 | 19985 | 19979 | 19982 | 19990 | 19987 | 19980 | 19977 | 19984 | 19989 | 19986 |
| | 23070 | 32444 | 20167 | 30939 | 30904 | 18647 | 18648 | 18646 | 10021 | 18474 | 18479 | 18478 |
| | 10023 | 10022 | 10020 | 18482 | 18480 | 18475 | 10017 | 10019 | 10018 | 18481 | 18477 | 10012 |
| | 10013 | 10014 | 10011 | 10016 | 10010 | 10015 | 10009 | 20370 | 20375 | 20371 | 20374 | 20373 |
| | 20372 | 20369 | 20368 | 31691 | 18476 | 32746 | 32696 | 32739 | 32740 | 32690 | 23071 | 23066 |
| | 32447 | 32449 | 32448 | 23068 | 23072 | 32446 | 32453 | 32597 | 32596 | 32595 | 32437 | 32436 |
| | 32442 | 32450 | 32451 | 32452 | 32454 | 32455 | 32459 | 32458 | 32461 | 32430 | 32439 | 32445 |
| | 32742 | 32692 | 32687 | 32688 | 32691 | 11018 | 31251 | 12143 | 31246 | 12130 | 12954 | 19958 |
| | 19957 | 19959 | 19960 | 13171 | | | | | | | | |
| 666: | 851 | 1228 | 3409 | 2227 | 4081 | 2501 | 4041 | 28997 | 29149 | 31495 | 30655 | 29013 |
| | 20283 | 29012 | 31106 | 4203 | 5590 | 6209 | 5016 | 5043 | 7560 | 8869 | 7441 | 6883 |
| | 6880 | 7238 | 9369 | 6987 | 7551 | 6932 | 7530 | 8892 | 6821 | 6847 | 8086 | 27447 |
| 667: | 14844 | 20931 | 9597 | 27612 | 30239 | 30221 | 30248 | 33055 | 32903 | 32926 | 33571 | 14811 |
| | 11294 | 10268 | 10251 | 24082 | 29935 | 29948 | 24073 | 12594 | 17422 | 17351 | 17368 | 25136 |
| | 24857 | 11725 | 13920 | 14211 | 31882 | 24148 | 20214 | 19774 | 19776 | 10936 | 15957 | 14680 |
| | 15199 | 14989 | 12931 | 28230 | 14157 | 17508 | 22466 | 30965 | 17041 | 19927 | 17688 | 17768 |
| | 27900 | 28079 | 16800 | 16797 | 32349 | 32373 | 29876 | 20515 | 29878 | 12010 | 11889 | 11986 |
| | 12014 | 17138 | 17244 | 28551 | 15238 | 16386 | 24752 | 24736 | 24724 | 18877 | 18942 | 18888 |
| | 19076 | 12796 | 33624 | 712 | 12054 | 18214 | 18167 | 14022 | 19859 | 19845 | 23586 | 19595 |
| | 25000 | 9694 | 22975 | 17979 | 26706 | 26707 | 20937 | 25586 | 25588 | 23737 | 20801 | 23192 |
| | 12357 | 22299 | 24297 | 33391 | 21623 | 21608 | 21444 | 21321 | 21345 | 21398 | 21265 | 23253 |
| | 23268 | 27189 | 26063 | 27477 | 25818 | 25092 | 30145 | 27672 | 27683 | 27805 | 27725 | 27800 |
| | 27787 | 27746 | 25464 | 13033 | 13023 | 10697 | 24980 | 13756 | 26509 | 26501 | 26448 | 26517 |
| | 26228 | 26341 | 26269 | 26310 | 26282 | 26372 | 26257 | 26300 | 26255 | 26253 | 26301 | 26387 |
| | 26273 | 26321 | 27284 | 27261 | 9458 | 11542 | 10400 | 16049 | 16065 | 12603 | 10973 | 12220 |
| | 10823 | 27018 | 32757 | 17860 | 28010 | 27992 | 27999 | 27383 | 28368 | 32384 | 27202 | 17247 |
| | 20088 | 17591 | 15397 | 15367 | 26887 | 15744 | 15760 | 22183 | 14391 | 20837 | 10647 | 27165 |
| | 11410 | 13701 | 33357 | 23721 | 20935 | 9740 | 22202 | 16438 | 14852 | 2249 | 3844 | 2381 |
| | 2949 | 2773 | 3987 | 3704 | 3700 | 3835 | 2084 | 3761 | 2630 | 3767 | 3895 | 2737 |
| | 22150 | 22140 | 22155 | 22156 | 22046 | 22045 | 28978 | 11639 | 11436 | 29341 | 6212 | 5284 |
| | 5061 | 14564 | 7316 | 7627 | 14563 | 7325 | 14562 | 14561 | 7481 | 9355 | 7185 | 7865 |
| | 9038 | 9294 | 7761 | 8000 | 9184 | 8429 | 8934 | 7759 | 8672 | 7783 | 9401 | 10856 |
| | 17043 | 10608 | 33610 | 32117 | 21481 | 21208 | 33304 | 26886 | 11304 | 13239 | 17568 | 19280 |
| | 9596 | 23829 | 11809 | 12996 | 12462 | 24921 | 31141 | 31163 | 17902 | 29212 | 24146 | 22203 |
| | 24939 | 11037 | 12094 | 12090 | 12138 | 12104 | 12952 | 28247 | 10605 | 32972 | 571 | 24925 |
| | 32037 | 28047 | | | | | | | | | | |
| 668: | 20378 | 1045 | 24942 | 3891 | 22493 | 21904 | 21905 | 20582 | 20581 | 20583 | 33240 | 33242 |
| | 33239 | 11556 | 20078 | 20254 | 15374 | 29207 | 10482 | 10480 | 18862 | 9804 | 11769 | 33268 |
| | 29330 | | | | | | | | | | | |

TABLE 2-continued

| SEQ ID NO: | homolog SEQ ID NOs | | | | | | | | | | |
|---|---|---|---|---|---|---|---|---|---|---|---|
| 669: | 22091 | 14386 | 14387 | 10582 | 1773 | 1288 | 1497 | 1358 | 3741 | 2473 | 2440 | 3968 |
|  | 2121 | 3685 | 1830 | 21977 | 14553 | 12487 | 5767 | 9147 | 6967 | 7814 | 8507 | 8849 |
|  | 6933 | 19939 | 14744 | | | | | | | | | |
| 670: | 15939 | 33485 | 1043 | 1334 | 1737 | 3773 | 2852 | 3399 | 3486 | 3497 | 2610 | 3696 |
|  | 2564 | 2611 | 3428 | 2677 | 2291 | 3269 | 3362 | 3413 | 2785 | 2959 | 2853 | 3270 |
|  | 3717 | 3376 | 1978 | 2628 | 1915 | 2099 | 3532 | 3652 | 2153 | 2050 | 2042 |
|  | 2332 | 2244 | 2696 | 2209 | 2960 | 2025 | 2152 | 22001 | 30710 | 21945 | 14405 | 5081 |
|  | 6430 | 4982 | 4735 | 5839 | 4444 | 4969 | 4983 | 4821 | 5912 | 4988 | 4394 | 5636 |
|  | 6517 | 5540 | 5806 | 5420 | 5559 | 4853 | 6086 | 5809 | 6163 | 6455 | 4811 | 4539 |
|  | 6304 | 4989 | 5541 | 6034 | 6193 | 6171 | 5988 | 6039 | 5593 | 4546 | 4568 | 4589 |
|  | 4305 | 5087 | 5202 | 9051 | 7701 | 9152 | 8562 | 7341 | 7922 | 9161 | 7797 | 8052 |
|  | 8230 | 6661 | 8479 | 8893 | 7319 | 8979 | 7503 | 8559 | 9410 | 6608 | 7125 | 7693 |
|  | 6554 | 7672 | 7416 | 7342 | 8267 | 7256 | 6631 | 6611 | 7073 | 6924 | 6653 | 7885 |
|  | 6895 | 7066 | 7171 | 7198 | 7788 | 6854 | 7371 | 8113 | 8114 | 7172 | 6550 | 7042 |
|  | 7419 | 7183 | 7203 | 6806 | 7065 | 6956 | 8370 | 7032 | 8138 | 6877 | 8652 | 7074 |
|  | 6859 | 6607 | 7169 | 7192 | 7141 | 7191 | 7075 | 7363 | 8369 | | | |
| 671: | 11774 | 1641 | | | | | | | | | | |
| 672: | 23439 | 24348 | 24530 | 26646 | 26778 | 25573 | 25637 | 22632 | 22694 | 11302 | 32833 | 15444 |
|  | 985 | 1422 | 1347 | 1929 | 2162 | 2218 | 4085 | 2197 | 29243 | 4557 | 4284 | 6228 |
|  | 4587 | 4641 | 32713 | 16955 | 11122 | 30717 | 24790 | 20703 | | | | |
| 673: | 30014 | 1777 | 1647 | 1646 | 1645 | 1213 | 1174 | 1582 | 1449 | 3406 | 3271 | 2797 |
|  | 3033 | 3034 | 2502 | 2516 | 2799 | 2798 | 3192 | 1991 | 2048 | 2829 | 2495 | 4031 |
|  | 29137 | 4774 | 4678 | 5913 | 4537 | 4685 | 4591 | 5066 | 6100 | 5065 | 5101 | 4377 |
|  | 6200 | 4809 | 5794 | 5261 | 7564 | 7710 | 9305 | 8197 | 8795 | 8343 | 8572 | 6605 |
|  | 7722 | 8603 | 9024 | 9371 | 8196 | 6687 | 27448 | | | | | |
| 674: | 25752 | 14973 | 28219 | 909 | 975 | 29246 | 24797 | 6318 | 5696 | 20049 | 7876 | 6878 |
|  | 15452 | 15443 | 774 | | | | | | | | | |
| 675: | 14764 | 31003 | 31002 | 22414 | 29460 | 895 | 1101 | 1047 | 1441 | 1592 | 10878 | 32955 |
|  | 10879 | 13842 | 13843 | 26616 | 26611 | 13225 | 13220 | 26619 | 13221 | 13222 | 26613 | 26617 |
|  | 13224 | 26618 | 26612 | 13223 | 26610 | 26615 | 13226 | 26614 | 3693 | 3518 | 3316 | 3195 |
|  | 2651 | 2250 | 2657 | 2848 | 3619 | 3317 | 1917 | 2734 | 1831 | 1893 | 3308 | 31128 |
|  | 15331 | 5550 | 8210 | 8816 | 7017 | 7399 | 7433 | 6962 | 7117 | 9424 | 6676 | 6833 |
|  | 24614 | 32849 | | | | | | | | | | |
| 676: | 14847 | 33198 | 13532 | 20846 | 27626 | 30225 | 15868 | 17222 | 13147 | 15761 | 26911 | 555 |
|  | 33574 | 14643 | 14650 | 14649 | 14648 | 14647 | 14646 | 14659 | 14660 | 14642 | 14664 |
|  | 11417 | 21673 | 18297 | 14838 | 10252 | 10325 | 30305 | 30299 | 29569 | 16125 | 11188 | 17345 |
|  | 17375 | 10881 | 12562 | 12574 | 12575 | 12584 | 33214 | 9868 | 31287 | 18310 | 13885 | 11712 |
|  | 13868 | 11717 | 12854 | 13947 | 13855 | 10646 | 22533 | 23036 | 20213 | 18550 | 18568 | 14520 |
|  | 15706 | 14581 | 15132 | 14971 | 21583 | 17242 | 32629 | 19000 | 15545 | 17497 | 17504 | 17494 |
|  | 22453 | 23777 | 23773 | 23825 | 30986 | 15612 | 17769 | 17857 | 27918 | 16699 | 32367 | 32364 |
|  | 27567 | 15894 | 29908 | 20514 | 11948 | 12016 | 18440 | 17159 | 23412 | 17441 | 17155 | 12726 |
|  | 18051 | 28600 | 28579 | 16332 | 24727 | 18934 | 18920 | 19111 | 12813 | 18200 | 18208 | 18175 |
|  | 18164 | 18145 | 14011 | 19402 | 19835 | 23714 | 23525 | 23548 | 23554 | 23479 | 23573 | 23461 |
|  | 23419 | 19779 | 19593 | 19556 | 19544 | 20010 | 24544 | 24345 | 24521 | 24339 | 24420 | 24534 |
|  | 24484 | 24372 | 24382 | 24388 | 24426 | 24564 | 24460 | 24548 | 24536 | 17988 | 20565 | 22981 |
|  | 26767 | 26808 | 26805 | 26750 | 25564 | 25598 | 25625 | 25562 | 25589 | 25626 | 25886 | 22660 |
|  | 22661 | 22784 | 22697 | 22685 | 20810 | 23228 | 23183 | 30352 | 30365 | 22373 | 21598 | 22568 |
|  | 22275 | 22293 | 22270 | 22876 | 21392 | 21270 | 29477 | 23656 | 23977 | 23945 | 23941 | 29994 |
|  | 27502 | 25079 | 25831 | 26594 | 24260 | 30030 | 30152 | 27711 | 27730 | 27778 | 27815 | 25458 |
|  | 13032 | 13763 | 13748 | 31059 | 26513 | 26399 | 26466 | 26472 | 26446 | 26204 | 26354 | 27226 |
|  | 11379 | 9457 | 30677 | 13303 | 12522 | 12526 | 17921 | 22546 | 22545 | 22547 | 16079 | 27423 |
|  | 27995 | 27330 | 28392 | 28447 | 23088 | 18519 | 18515 | 27149 | 13662 | 13719 | 13689 | 13652 |
|  | 32393 | 13488 | 30749 | 26162 | 14639 | 14644 | 14645 | 14667 | 15259 | 14446 | 19771 | 24813 |
|  | 29727 | 16407 | 16398 | 11818 | 29265 | 11227 | 33606 | 18992 | 24125 | 1520 | 1618 | 1795 |
|  | 989 | 10351 | 32429 | 10352 | 10350 | 32428 | 27464 | 11625 | 32871 | 1982 | 20222 | 33459 |
|  | 22143 | 13282 | 20291 | 32173 | 9595 | 19468 | 19467 | 22415 | 23073 | 21903 | 21162 | 6537 |
|  | 5227 | 5936 | 4378 | 7439 | 7177 | 31014 | 11276 | 32580 | 13017 | 22749 | 30727 | 13733 |
|  | 13238 | 33358 | 22112 | 16301 | 15343 | 15054 | 29427 | 29428 | 22538 | 22537 | 22540 | 22539 |
|  | 33516 | 14401 | 29737 | 15821 | 15820 | 22542 | 22544 | 32811 | 22543 | 22541 | 31501 | 31500 |
|  | 32462 | 32435 | 31912 | 14295 | 20634 | 20619 | 20689 | 33140 | 20714 | 22945 | 22536 | 22534 |
|  | 22535 | 31563 | 31453 | 22956 | 24988 | 24989 | 24990 | 18527 | 13240 | 32880 | 11405 | 15212 |
|  | 14465 | 25195 | 22909 | 28778 | 28766 | 29792 | 14638 | 14652 | 14651 | 14653 | 14654 | 31140 |
|  | 30939 | 31998 | 14663 | 32446 | 25194 | 25193 | 25192 | 32455 | 32430 | 32439 | 11030 | 12122 |
|  | 24326 | 12953 | 22999 | 16600 | 12181 | 12191 | 24926 | 14641 | 14640 | 14662 | 665 | 14655 |
|  | 14656 | 14658 | 14657 | 28782 | 14666 | 14665 | 9586 | 13210 | | | | |
| 677: | 23619 | 24341 | 22768 | 1094 | 902 | 2806 | 2150 | 3976 | 2805 | 31468 | 22024 | 4651 |
|  | 4269 | 4664 | 7972 | 9130 | 17661 | 14862 | 24783 | 20130 | 9558 | | | |
| 678: | 22815 | 10867 | 17570 | 20799 | 10084 | 29459 | 1517 | 10511 | 2884 | 3580 | 3113 | 29008 |
|  | 33523 | 24940 | 4273 | 9088 | 15942 | | | | | | | |
| 679: | 23441 | 24518 | 25633 | 22769 | 1827 | 1969 | 3039 | 2031 | 2318 | 3607 | 3419 | 3514 |
|  | 4060 | 3418 | 10604 | 29352 | 22007 | 21943 | 30658 | 6283 | 6169 | 5877 | 4562 | 5007 |
|  | 4955 | 5372 | 5814 | 4662 | 6875 | 6770 | 7186 | 9423 | 6865 | 6920 | 7229 | 9253 |
|  | 9374 | | | | | | | | | | | |
| 680: | 17547 | 26131 | 11137 | 1077 | 1801 | 1087 | 1025 | 995 | 3752 | 3623 | 5660 | 4707 |
|  | 5209 | 4551 | 8767 | | | | | | | | | |
| 681: | 18507 | 15657 | 11386 | 32182 | 27460 | 33120 | 22123 | 21535 | 17997 | 23446 | 24523 | 24478 |
|  | 26695 | 25631 | 30765 | 22780 | 22794 | 23694 | 28912 | 33137 | 27441 | 18528 | 29269 | 33254 |
|  | 12423 | 13789 | 1067 | 1474 | 1461 | 17998 | 3694 | 2825 | 3729 | 3358 | 2424 | 14252 |

TABLE 2-continued

| SEQ ID NO: | homolog SEQ ID NOs | | | | | | | | | | |
|---|---|---|---|---|---|---|---|---|---|---|---|
| | 24829 | 15068 | 33092 | 10359 | 21992 | 29133 | 9998 | 18100 | 15615 | 10542 | 31655 | 10543 |
| | 13615 | 17695 | 30446 | 18405 | 6386 | 7899 | 8987 | 8025 | 7960 | 8276 | 16029 | 17647 |
| | 17646 | 10572 | 31657 | 19925 | 19523 | 32118 | 18541 | 19146 | 20678 | 20961 | 24640 | 29454 |
| | 10967 | 10332 | 22562 | 30763 | 30761 | 14634 | | | | | | |
| 682: | 22617 | 11553 | 11554 | 11555 | 31546 | 14396 | 20378 | 24942 | 14949 | 4087 | 2672 | 21773 |
| | 11103 | 11105 | 11106 | 11107 | 11108 | 11104 | 29299 | 29114 | 19429 | 21906 | 21905 | 20580 |
| | 20582 | 21904 | 20583 | 20581 | 33240 | 33239 | 33242 | 33241 | 13085 | 11556 | 11557 | 20078 |
| | 5756 | 4193 | 4438 | 7584 | 11551 | 10481 | 10480 | 10483 | 10482 | 18862 | 21913 | 21909 |
| | 21911 | 21910 | 21914 | 21907 | 21908 | 22620 | 22619 | | | | | |
| 683: | 904 | 1821 | 1139 | 965 | 1465 | 919 | 3839 | 3837 | 3957 | 3956 | 3287 | 2040 |
| | 1948 | 3836 | 3589 | 3120 | 29082 | 30709 | 30023 | 29401 | 30708 | 30021 | 30022 | 4950 |
| | 5962 | 6182 | 4748 | 4747 | 6511 | 4746 | 6725 | 9193 | 7148 | 9192 | 8571 | 8202 |
| | 6811 | 6601 | 26995 | | | | | | | | | |
| 684: | 27516 | 1562 | 1373 | 1663 | 2010 | 3864 | 3171 | 2009 | 2011 | 3865 | 2885 | 2596 |
| | 2201 | 2211 | 2039 | 3065 | 22010 | 4660 | 5253 | 6470 | 4595 | 6496 | 5538 | 4153 |
| | 4804 | 4147 | 4805 | 6123 | 4279 | 7801 | 8364 | 7804 | 7264 | 9271 | 9430 | 8815 |
| | 8365 | 8661 | 8742 | 7253 | 6936 | 7937 | 6985 | 8758 | 9004 | 6584 | 8898 | 9002 |
| | 9003 | 8823 | 8570 | 20065 | 12483 | | | | | | | |
| 685: | 23616 | 24472 | 26630 | 25629 | 22789 | 884 | 1252 | 1301 | 2740 | 3811 | 2533 | 3200 |
| | 3110 | 3672 | 3673 | 2787 | 2778 | 2786 | 10496 | 30211 | 5879 | 6395 | 4380 | 7904 |
| | 7894 | 8160 | 9135 | 8623 | 6562 | 8624 | 6747 | 7893 | 8649 | 7936 | 7726 | 7391 |
| | 7403 | 11702 | 23176 | 25364 | | | | | | | | |
| 686: | 1241 | 1438 | 3438 | 3417 | 1872 | 2276 | 28894 | 28929 | 5572 | 7939 | 8151 | 24809 |
| | 32842 | 32465 | 9559 | | | | | | | | | |
| 687: | 15209 | 15048 | 19335 | 24434 | 26655 | 25595 | 22656 | 20761 | 9722 | 28883 | 18446 | 1112 |
| | 20042 | 3542 | 3101 | 2374 | 2414 | 32391 | 5687 | 5335 | 6547 | 7861 | 9126 | 8674 |
| | 8675 | 7713 | 8947 | 7050 | 7862 | 32589 | 32859 | | | | | |
| 688: | 1306 | 1278 | 2154 | 3397 | 28937 | 4157 | 5753 | 6049 | 5337 | 4570 | 8164 | 9074 |
| | 9075 | 8909 | | | | | | | | | | |
| 689: | 18507 | 27460 | 33120 | 26626 | 11788 | 28912 | 27441 | 21213 | 33254 | 13789 | 1643 | 1622 |
| | 14470 | 22118 | 11236 | 24829 | 15068 | 10356 | 15758 | 9998 | 20225 | 10542 | 31655 | 13615 |
| | 32266 | 32265 | 30446 | 5492 | 16029 | 17647 | 17646 | 10572 | 30393 | 9052 | 8565 | 6759 |
| 690: | 15418 | 960 | 3969 | 2298 | 2327 | 2364 | 31469 | 22025 | 4348 | 5891 | 6074 | 4778 |
| | 4143 | 4588 | 4776 | 4777 | 8400 | 7039 | 8398 | 8399 | 9288 | | | |
| 691: | 10215 | 10214 | 10213 | 31712 | 31713 | 10212 | 23494 | 24543 | 26802 | 26798 | 25618 | 22720 |
| | 10947 | 10948 | 1352 | 2542 | 3041 | 30544 | 10131 | 18874 | 19708 | 10953 | 4116 | 6055 |
| | 5893 | 6788 | 9072 | 6651 | 8517 | 6919 | 16983 | 14434 | 22940 | 15433 | 20123 | |
| 692: | 19354 | 14329 | 1598 | 30203 | 20307 | 29023 | 20289 | 20288 | 29125 | 20290 | 14245 | 6015 |
| 693: | 14857 | 30541 | 20063 | 1024 | 1162 | 943 | 3216 | 2565 | 3838 | 3224 | 6396 | 5018 |
| | 5017 | 4482 | 5030 | 6397 | 6393 | 4579 | 7582 | 7579 | 9167 | 7581 | 7188 | 8903 |
| | 8902 | 7580 | 8421 | 9013 | 15409 | | | | | | | |
| 694: | 1661 | 1566 | 3738 | 5658 | 5439 | 4245 | 5440 | 6206 | 6778 | 8132 | 8139 | 31979 |
| | 13729 | 33263 | | | | | | | | | | |
| 695: | 1012 | 2916 | 1857 | 2433 | 1968 | 2268 | 2466 | 1834 | 4548 | 5672 | 5357 | 5358 |
| | 4722 | 4721 | 5989 | 8785 | 7569 | 8976 | 8274 | 8093 | 6591 | 9306 | 8740 | 7570 |
| | 9307 | 8367 | 8513 | 7928 | 9381 | 6727 | 6636 | 9367 | 7365 | 9382 | | |
| 696: | 14765 | 22833 | 18807 | 1311 | 3068 | 3290 | 3441 | 16764 | 4104 | 7736 | 31279 | 15465 |
| 697: | 27006 | 29287 | 20089 | 22388 | 31651 | 31547 | 27145 | 13151 | 32543 | 23551 | 23420 | 24499 |
| | 24505 | 26651 | 26780 | 26627 | 25634 | 25571 | 25576 | 25539 | 22778 | 22707 | 22648 | 22649 |
| | 22702 | 22646 | 20324 | 12592 | 23391 | 30831 | 30832 | 18520 | 918 | 1309 | 25496 | 30453 |
| | 29188 | 33204 | 21135 | 21134 | 25387 | 11153 | 29284 | 29070 | 15609 | 21934 | 22051 | 11640 |
| | 32088 | 22827 | 28243 | 33350 | 28876 | 11053 | 13258 | 11286 | 9812 | 27948 | 27947 | 30697 |
| | 9958 | 32082 | 25348 | 25347 | 32528 | 17575 | 15370 | 10185 | 10186 | 10187 | 31538 | 10926 |
| | 29179 | 6353 | 4695 | 5026 | 4693 | 6020 | 5546 | 5685 | 5841 | 5377 | 4129 | 4173 |
| | 6473 | 5698 | 5633 | 6358 | 4692 | 5415 | 4856 | 4961 | 6471 | 4690 | 5499 | 4691 |
| | 4361 | 4837 | 6472 | 6535 | 4429 | 5632 | 4389 | 4872 | 5840 | 4465 | 5384 | 5445 |
| | 5446 | 6531 | 5887 | 4694 | 6245 | 4134 | 6019 | 6379 | 5039 | 5530 | 4619 | 5414 |
| | 6481 | 6023 | 4908 | 6352 | 5566 | 5830 | 4306 | 8050 | 17638 | 14243 | 17719 | 24842 |
| | 19514 | 9937 | 28660 | 28869 | 22113 | 16480 | 13489 | 13474 | 20893 | 20894 | 11438 | 11437 |
| | 14170 | 11222 | 9748 | 10870 | 9938 | 15626 | 29599 | 13517 | 15334 | 15333 | 15332 | 19144 |
| | 11419 | 13780 | 18797 | 32544 | 16088 | 9843 | 33065 | 17835 | 22182 | 20152 | 13963 | 23658 |
| | 9592 | 22933 | 20648 | 13459 | 16947 | 32988 | 19720 | 33235 | 30693 | 9936 | 11409 | 13490 |
| | 18522 | 14948 | 14820 | 12591 | 14440 | 11431 | 31462 | 19907 | 31464 | 27414 | 31463 | 14297 |
| | 28329 | 17891 | 11282 | 32679 | 32678 | 28506 | 9923 | 14289 | 14426 | 22111 | 22110 | 30450 |
| | 27002 | | | | | | | | | | | |
| 698: | 1729 | 1282 | 5707 | 5808 | 6267 | 4516 | 5946 | 5792 | 31987 | 21584 | | |
| 699: | 24764 | 12806 | 19870 | 25184 | 25737 | 27270 | 27258 | 11513 | 15881 | 1692 | 1033 | 860 |
| | 992 | 29203 | 28944 | 5638 | 4813 | 6130 | 5944 | 8293 | 8224 | 7258 | 31212 | 3588 |
| | 2464 | | | | | | | | | | | |
| 700: | 33176 | 17934 | 11114 | 18253 | 19351 | 24422 | 26717 | 25527 | 22692 | 22222 | 26595 | 25445 |
| | 10759 | 25012 | 25257 | 25256 | 18439 | 19727 | 28637 | 29036 | 18659 | 13241 | 27013 | 31633 |
| | 32995 | 24946 | 15959 | 1115 | 15643 | 9786 | 22096 | 32390 | 25519 | 25518 | 13051 | 13052 |
| | 13053 | 11608 | 32240 | 17278 | 20436 | 3816 | 3364 | 1989 | 18510 | 17747 | 28822 | 28858 |
| | 22830 | 17660 | 30376 | 29062 | 13727 | 32824 | 29389 | 13482 | 13957 | 13958 | 33552 | 30455 |
| | 32994 | 14299 | 4207 | 5996 | 8453 | 15973 | 31357 | 31356 | 25360 | 22213 | 32124 | 20682 |
| | 11359 | 32045 | 18398 | 18395 | 30826 | 16976 | 15057 | 15056 | 15055 | 10245 | 14314 | 32049 |
| | 20843 | 30550 | 31798 | 27000 | 14809 | | | | | | | |

TABLE 2-continued

| SEQ ID NO: | homolog SEQ ID NOs | | | | | | | | | | |
|---|---|---|---|---|---|---|---|---|---|---|---|
| 701: | 22416 | 23604 | 24431 | 24474 | 26625 | 25602 | 25565 | 1001 | 1119 | 3048 | 1909 | 2317 |
|  | 1907 | 1906 | 1923 | 3609 | 2726 | 3304 | 3305 | 2098 | 5624 | 5419 | 8952 | 6822 |
|  | 7245 | 9395 | 8065 | 24788 | 22941 | 17258 |  |  |  |  |  |  |
| 702: | 1200 | 1735 | 1800 | 4068 |  |  |  |  |  |  |  |  |
| 703: | 1005 | 893 | 3608 | 2296 | 1879 | 1900 | 22028 | 28867 | 30707 | 7892 | 6946 | 11775 |
|  | 15388 |  |  |  |  |  |  |  |  |  |  |  |
| 704: | 10650 | 23422 | 24510 | 26809 | 26758 | 22688 | 30990 | 30988 | 30989 | 19734 | 1823 | 3573 |
|  | 2983 | 2979 | 3468 | 2572 | 3082 | 2260 | 2990 | 3003 | 3251 | 2576 | 3431 | 2986 |
|  | 2049 | 2217 | 2113 | 1941 | 2091 | 2585 | 4098 | 1940 | 2195 | 17288 | 6033 | 6415 |
|  | 5426 | 4555 | 6268 | 4290 | 5191 | 6312 | 5500 | 5456 | 7558 | 7412 | 7957 | 8725 |
|  | 6818 | 9343 | 7288 | 7949 | 6573 | 7000 | 6819 | 8220 | 7681 | 7618 | 8594 | 7528 |
|  | 7049 | 7094 | 6887 | 9380 | 6969 | 8042 | 6900 | 7529 | 7526 | 6948 | 27139 | 17249 |
|  | 10485 | 30716 | 20674 | 19153 |  |  |  |  |  |  |  |  |
| 705: | 23579 | 24427 | 24444 | 26710 | 22751 | 20154 | 32846 | 1747 | 1331 | 3728 | 29002 | 5080 |
|  | 4267 | 4141 | 4283 | 8237 | 6901 | 8331 | 8780 | 9063 | 8460 | 8584 | 13464 | 20698 |
| 706: | 32163 | 32538 | 30454 | 12559 | 25761 | 21065 | 13914 | 18576 | 15192 | 15031 | 14799 | 18129 |
|  | 23302 | 25105 | 30149 | 27783 | 25478 | 10708 | 26256 | 29748 | 17666 | 9911 | 16034 | 15589 |
|  | 23339 | 15970 | 15625 | 9955 | 1799 | 11432 | 11627 | 4024 | 1864 | 2413 | 4023 | 13011 |
|  | 25955 | 13453 | 15263 | 30774 | 16980 | 32018 | 11274 | 13807 | 18098 | 10578 | 33207 | 4200 |
|  | 5845 | 5846 | 4199 | 4958 | 7869 | 7069 | 8437 | 7954 | 7317 | 9341 | 9358 | 22624 |
|  | 27453 | 27452 | 24844 | 11260 |  |  |  |  |  |  |  |  |
| 707: | 13553 | 13570 | 23325 | 23313 | 9952 | 23316 | 33627 | 33628 | 824 | 586 | 756 | 787 |
|  | 33621 | 792 | 628 | 613 | 720 | 570 | 567 | 31789 | 31790 | 31787 | 31135 | 17283 |
|  | 22061 | 10307 | 27854 | 26917 | 25763 | 25758 | 30001 | 14356 | 15528 | 22478 | 23030 | 15424 |
|  | 15425 | 17023 | 19935 | 17830 | 18079 | 18081 | 28521 | 19090 | 19088 | 33615 | 12060 | 20971 |
|  | 30118 | 30126 | 12470 | 23207 | 23231 | 33374 | 33376 | 21658 | 27497 | 31788 | 28277 | 30038 |
|  | 31038 | 27957 | 27972 | 30627 | 16171 | 30524 | 27371 | 33180 | 28669 | 28668 | 17680 | 29309 |
|  | 30013 | 30015 | 30729 | 31392 | 14451 | 11816 | 13265 | 13264 | 31578 | 17603 | 10474 | 33620 |
|  | 14277 | 10539 | 17720 | 31984 | 16625 | 9971 | 24627 | 19515 | 13000 | 13001 | 14795 | 33330 |
|  | 1305 | 1704 | 1102 | 871 | 907 | 906 | 905 | 1403 | 908 | 872 | 1825 | 1398 |
|  | 1402 | 1126 | 1545 | 1401 | 1153 | 1456 | 1251 | 1544 | 1376 | 1414 | 1527 | 1326 |
|  | 1382 | 1354 | 1494 | 1399 | 1370 | 1361 | 1341 | 1476 | 1587 | 1504 | 1817 | 1623 |
|  | 1264 | 1639 | 1417 | 1653 | 1543 | 1651 | 1590 | 862 | 1233 | 1377 | 1715 | 1400 |
|  | 33052 | 10540 | 23323 | 23063 | 2029 | 3984 | 2839 | 2586 | 3293 | 2210 | 2487 | 2832 |
|  | 2811 | 2488 | 3983 | 2477 | 2641 | 3109 | 3144 | 3386 | 2538 | 3273 | 2964 | 9770 |
|  | 2014 | 2319 | 2635 | 3299 | 2144 | 2961 | 2963 | 2013 | 2015 | 2898 | 10538 | 2993 |
|  | 1853 | 2061 | 2105 | 9769 | 3272 | 2485 | 2416 | 2214 | 2718 | 2135 | 2962 | 2142 |
|  | 2617 | 2139 | 2676 | 2490 | 2257 | 2965 | 2543 | 2966 | 2289 | 2277 | 3328 | 2134 |
|  | 2143 | 1928 | 2724 | 1939 | 2130 | 2491 | 2967 | 1965 | 2140 | 2308 | 2313 | 2310 |
|  | 2128 | 2193 | 1998 | 1850 | 2480 | 2131 | 1912 | 3689 | 2192 | 1851 | 2592 | 2241 |
|  | 2212 | 4052 | 1849 | 2316 | 2245 | 1996 | 4048 | 2997 | 2968 | 2118 | 3086 | 2133 |
|  | 1839 | 2129 | 2297 | 2486 | 2176 | 4047 | 1894 | 2479 | 2172 | 2076 | 2727 | 1947 |
|  | 4046 | 2208 | 4050 | 3066 | 2141 | 1892 | 1843 | 3294 | 1913 | 2242 | 2179 | 1937 |
|  | 2655 | 2251 | 2749 | 2132 | 3023 | 4032 | 2373 | 4069 | 1896 | 2492 | 2075 |
|  | 2279 | 2299 | 2171 | 2577 | 2320 | 2200 | 2155 | 2258 | 2180 | 4056 | 2174 | 1891 |
|  | 1966 | 4071 | 4057 | 1865 | 4037 | 4033 | 1842 | 2000 | 2004 | 3414 | 3073 | 1863 |
|  | 4049 | 2191 | 1899 | 2779 | 1943 | 2712 | 9733 | 32132 | 23108 | 20083 | 18469 | 14945 |
|  | 10076 | 13455 | 19522 | 32011 | 32013 | 32012 | 16981 | 20017 | 20325 | 23293 | 13487 | 23019 |
|  | 14473 | 13644 | 19901 | 13486 | 15423 | 18523 | 10558 | 20075 | 20076 | 33453 | 33451 | 33450 |
|  | 33452 | 33456 | 33454 | 33455 | 32395 | 23029 | 31809 | 23027 | 23028 | 19519 | 19520 | 32550 |
|  | 19516 | 32551 | 19518 | 32549 | 14435 | 19517 | 23322 | 23317 | 22531 | 10537 | 21855 | 10535 |
|  | 23677 | 23329 | 23676 | 23315 | 6143 | 5437 | 5436 | 5927 | 5435 | 5438 | 4261 | 5113 |
|  | 5434 | 6302 | 6270 | 6332 | 5561 | 6418 | 4324 | 4328 | 4354 | 5153 | 6314 | 6490 |
|  | 4301 | 4783 | 6465 | 4472 | 4342 | 4859 | 10003 | 4218 | 4726 | 4863 | 4216 | 4230 |
|  | 4448 | 4741 | 4325 | 4337 | 4219 | 4573 | 4329 | 4411 | 4473 | 4330 | 4338 | 4213 |
|  | 4720 | 4513 | 4511 | 5389 | 5388 | 5165 | 4341 | 4351 | 4214 | 4514 | 5244 | 4232 |
|  | 5219 | 4451 | 4347 | 5218 | 5217 | 5216 | 4542 | 4231 | 4215 | 4343 | 4607 | 4340 |
|  | 5265 | 5148 | 4487 | 4217 | 4221 | 5146 | 5145 | 4452 | 5138 | 4353 | 5523 | 4483 |
|  | 4446 | 4574 | 5251 | 5252 | 5250 | 5247 | 5516 | 4786 | 4334 | 4333 | 4785 | 6464 |
|  | 6475 | 4705 | 5135 | 10005 | 4449 | 4947 | 6498 | 4925 | 4469 | 4413 | 4949 | 5997 |
|  | 4946 | 4944 | 4941 | 4939 | 4929 | 4930 | 4194 | 4928 | 4919 | 4918 | 4466 | 5144 |
|  | 32548 | 10534 | 23327 | 6476 | 4936 | 4934 | 4932 | 5478 | 4327 | 5143 | 4223 | 4943 |
|  | 4923 | 4484 | 23328 | 4727 | 4572 | 4150 | 5573 | 4942 | 4922 | 4339 | 4886 | 4455 |
|  | 4453 | 5248 | 4323 | 6392 | 4512 | 4445 | 5595 | 4945 | 4938 | 4415 | 4924 | 4352 |
|  | 4901 | 6093 | 23314 | 4900 | 33053 | 33203 | 4822 | 5553 | 6480 | 5481 | 4395 | 10536 |
|  | 4427 | 5537 | 4608 | 4447 | 10002 | 5524 | 5162 | 5482 | 5783 | 5156 | 5155 | 5139 |
|  | 5246 | 4920 | 4716 | 5140 | 4857 | 4719 | 4948 | 4940 | 4921 | 5480 | 5137 | 4926 |
|  | 5142 | 6462 | 5463 | 5141 | 5249 | 4937 | 5163 | 5479 | 4718 | 5452 | 4220 | 4412 |
|  | 6043 | 4419 | 10004 | 4931 | 4486 | 4478 | 4530 | 4478 | 4454 | 4485 | 4565 | 4935 |
|  | 5171 | 5416 | 5173 | 4731 | 4717 | 5136 | 4933 | 4326 | 5154 | 5164 | 5888 | 4605 |
|  | 4927 | 4737 | 6009 | 6451 | 5780 | 6198 | 5152 | 5477 | 4787 | 4784 | 4229 | 4450 |
|  | 4376 | 5476 | 5170 | 6466 | 6218 | 4703 | 31946 | 23324 | 23318 | 23320 | 23319 | 23312 |
|  | 23311 | 23310 | 23309 | 7552 | 8532 | 6616 | 6949 | 9402 | 8032 | 9026 | 8458 | 7430 |
|  | 7287 | 7549 | 8036 | 8034 | 7942 | 8162 | 8424 | 8699 | 8482 | 8879 | 8875 | 8872 |
|  | 8877 | 8873 | 8971 | 8874 | 8161 | 8845 | 8531 | 8605 | 9025 | 8876 | 8878 | 8917 |
|  | 8958 | 8033 | 7326 | 8970 | 7480 | 7663 | 9027 | 9322 | 7795 | 6918 | 8031 | 6999 |
|  | 7589 | 7789 | 7447 | 8208 | 7210 | 8349 | 8842 | 7415 | 8445 | 7414 | 8159 | 7417 |
|  | 8841 | 8511 | 7546 | 8867 | 8157 | 8928 | 8916 | 8580 | 9338 | 8843 | 6730 | 6710 |

TABLE 2-continued

| SEQ ID NO: | homolog SEQ ID NOs | | | | | | | | | | |
|---|---|---|---|---|---|---|---|---|---|---|---|
| | 8990 | 6594 | 15926 | 9585 | 585 | 32546 | 31354 | 23330 | 23321 | 21550 | 33630 | 713 |
| | 16500 | 29798 | 16540 | 17866 | 17865 | 17714 | 17713 | 18410 | 18409 | 18408 | 18412 | 18411 |
| | 18407 | 16614 | 16617 | 16615 | 16613 | 16616 | 16619 | 16618 | 31310 | 17936 | 20869 | 30926 |
| | 786 | 32134 | 22556 | 32131 | 23107 | 32321 | 32322 | 23109 | 32133 | 32137 | 32323 | 32136 |
| | 32135 | 23326 | | | | | | | | | | |
| 708: | 33460 | 27410 | 13566 | 23325 | 23313 | 9952 | 23316 | 787 | 33627 | 814 | 759 | 31135 |
| | 32308 | 17283 | 20352 | 22061 | 27408 | 27409 | 10257 | 26917 | 16131 | 25774 | 13883 | 15711 |
| | 15699 | 14515 | 12870 | 17546 | 22487 | 23813 | 15779 | 23030 | 17000 | 16994 | 17788 | 17774 |
| | 28088 | 16772 | 478 | 20503 | 11931 | 19229 | 21893 | 17135 | 18598 | 18072 | 16336 | 19099 |
| | 12766 | 12790 | 14053 | 14052 | 19321 | 19851 | 19797 | 19551 | 24374 | 25881 | 30125 | 22322 |
| | 33366 | 21666 | 24189 | 27175 | 25725 | 10661 | 13764 | 26496 | 26210 | 27207 | 9509 | 9505 |
| | 16191 | 28394 | 28396 | 33180 | 28669 | 28668 | 17680 | 29309 | 22214 | 30013 | 30015 | 31392 |
| | 14451 | 11816 | 13265 | 13264 | 31578 | 17603 | 10474 | 33620 | 10561 | 10560 | 10559 | 14277 |
| | 10539 | 16625 | 9971 | 24627 | 19515 | 13000 | 13001 | 14795 | 871 | 907 | 906 | 905 |
| | 1403 | 908 | 872 | 1825 | 1398 | 1402 | 1126 | 1545 | 1401 | 1153 | 1456 | 1251 |
| | 1544 | 1376 | 1414 | 1527 | 1326 | 1382 | 1354 | 1494 | 1399 | 1370 | 1361 | 1341 |
| | 1476 | 1587 | 1504 | 1817 | 1264 | 1623 | 1417 | 1639 | 1653 | 1543 | 1651 | 1590 |
| | 862 | 1233 | 1715 | 1377 | 1400 | 33052 | 10540 | 23323 | 11598 | 23063 | 2641 | 3109 |
| | 3386 | 3299 | 2319 | 3273 | 2961 | 2964 | 9770 | 2014 | 2635 | 2144 | 2963 | 2013 |
| | 2015 | 2898 | 1853 | 10538 | 2993 | 2061 | 2105 | 9769 | 3272 | 2485 | 2214 | 2962 |
| | 2718 | 2135 | 2142 | 2617 | 2139 | 2676 | 2490 | 2543 | 2257 | 2965 | 2289 | 2966 |
| | 2277 | 3328 | 2134 | 2143 | 1928 | 2967 | 2310 | 2724 | 1939 | 2130 | 2491 | 1965 |
| | 2140 | 2308 | 2128 | 2313 | 2193 | 1998 | 1850 | 2480 | 2131 | 1912 | 2192 | 1851 |
| | 2592 | 2241 | 2212 | 4052 | 1849 | 2316 | 2245 | 1996 | 4048 | 2997 | 2968 | 2118 |
| | 3086 | 2133 | 1839 | 2129 | 2297 | 2727 | 2486 | 2176 | 2479 | 4047 | 1894 | 2172 |
| | 2076 | 2655 | 1947 | 4046 | 2208 | 4050 | 3066 | 2141 | 1892 | 1843 | 1913 | 2242 |
| | 2179 | 1937 | 2251 | 2290 | 2749 | 2132 | 3023 | 4032 | 2373 | 4057 | 4069 | 1896 |
| | 2492 | 2075 | 2279 | 2299 | 2171 | 2577 | 2320 | 2200 | 2155 | 2258 | 2180 | 4056 |
| | 2174 | 1891 | 1966 | 4071 | 1865 | 4037 | 4033 | 1842 | 2000 | 3073 | 1863 | 4049 |
| | 2191 | 1899 | 2779 | 1943 | 2712 | 2234 | 2383 | 9733 | 32132 | 23108 | 20083 | 18469 |
| | 14945 | 10076 | 13455 | 19522 | 32011 | 32013 | 32012 | 16981 | 20107 | 20325 | 23293 | 13487 |
| | 23019 | 14473 | 19901 | 13486 | 15423 | 18523 | 10558 | 10557 | 20075 | 20076 | 33453 | 33451 |
| | 33452 | 33450 | 33456 | 33454 | 33455 | 32395 | 23029 | 31809 | 23027 | 23028 | 19519 | 19520 |
| | 32550 | 19516 | 32551 | 19518 | 32549 | 14435 | 19517 | 23322 | 23317 | 10537 | 21855 | 10535 |
| | 23677 | 23329 | 23676 | 23315 | 6270 | 6332 | 6418 | 6490 | 4301 | 5218 | 4329 | 5389 |
| | 6465 | 4472 | 4449 | 4342 | 4859 | 10003 | 4218 | 4216 | 4230 | 4448 | 4741 | 4325 |
| | 4219 | 4573 | 4473 | 4330 | 4213 | 4513 | 4341 | 4214 | 4514 | 5244 | 4232 | 4469 |
| | 5219 | 4347 | 5216 | 4215 | 4343 | 5148 | 4487 | 4217 | 4221 | 5145 | 4452 | 5138 |
| | 5523 | 4446 | 4574 | 5251 | 5250 | 5516 | 4786 | 4333 | 4785 | 6475 | 5135 | 10005 |
| | 4726 | 6464 | 4334 | 5997 | 4946 | 4944 | 4941 | 4194 | 4919 | 4918 | 4324 | 4783 |
| | 32548 | 23327 | 4328 | 6314 | 4354 | 6476 | 4939 | 5153 | 5144 | 5143 | 4337 | 4411 |
| | 5388 | 5165 | 4351 | 4949 | 4943 | 4923 | 4451 | 5217 | 4542 | 4231 | 4607 | 4413 |
| | 4340 | 5265 | 4353 | 4483 | 23328 | 4572 | 4150 | 6498 | 5573 | 4942 | 4925 | 4453 |
| | 4863 | 4338 | 4720 | 4511 | 4947 | 4705 | 5146 | 4445 | 5252 | 5247 | 10534 | 5595 |
| | 4945 | 4929 | 4930 | 4928 | 4327 | 4901 | 23314 | 4932 | 33053 | 33203 | 4822 | 5553 |
| | 6480 | 5481 | 4466 | 4395 | 10536 | 5524 | 4936 | 4934 | 5537 | 5478 | 4886 | 5155 |
| | 4608 | 10002 | 4323 | 4223 | 5482 | 5783 | 5156 | 4484 | 4727 | 4415 | 4924 | 4922 |
| | 4339 | 4455 | 4900 | 5248 | 5246 | 6392 | 4512 | 4926 | 4716 | 5140 | 5139 | 6093 |
| | 4948 | 4938 | 4352 | 5137 | 4719 | 4940 | 4427 | 4937 | 4447 | 6462 | 4857 | 4920 |
| | 5452 | 5162 | 5142 | 5163 | 10004 | 4921 | 5480 | 5141 | 5249 | 5463 | 5173 | 4731 |
| | 5136 | 6043 | 4933 | 4931 | 5154 | 4718 | 4717 | 4935 | 4927 | 5479 | 4220 | 4412 |
| | 5164 | 4419 | 4454 | 4565 | 4486 | 4474 | 4530 | 4478 | 5152 | 4485 | 4787 | 4229 |
| | 5477 | 4326 | 5888 | 4605 | 4737 | 5171 | 4784 | 6009 | 6451 | 5476 | 4450 | 5170 |
| | 4703 | 4410 | 4704 | 4376 | 4222 | 6466 | 5558 | 6218 | 5310 | 6446 | 6463 | 6235 |
| | 31946 | 23324 | 23318 | 23320 | 23319 | 23312 | 23311 | 23310 | 23309 | 8162 | 8699 | 8482 |
| | 8879 | 8875 | 8872 | 8877 | 8873 | 8971 | 8874 | 8161 | 8605 | 8876 | 8878 | 8917 |
| | 8958 | 8970 | 7480 | 7795 | 7447 | 8445 | 8159 | 8208 | 8841 | 7210 | 8349 | 8842 |
| | 7415 | 7414 | 7417 | 8511 | 8867 | 8157 | 8928 | 8916 | 8843 | 6730 | 6710 | 6594 |
| | 15926 | 9585 | 707 | 585 | 29277 | 32546 | 23330 | 23321 | 713 | 28700 | 29802 | 16529 |
| | 29814 | 17866 | 17865 | 17714 | 17713 | 18410 | 18409 | 18408 | 18412 | 18407 | 18411 | 20529 |
| | 31150 | 17936 | 22556 | 32131 | 23107 | 32321 | 32322 | 23109 | 32133 | 32137 | 32323 |
| | 32136 | 32135 | 23326 | 13167 | | | | | | | | |
| 709: | 33238 | 13136 | 13961 | 14436 | 32531 | 32529 | 28326 | 23672 | 14437 | 23671 | 13964 | 23670 |
| | 33354 | 25751 | 18535 | 28914 | 17254 | 28221 | 18115 | 20431 | 20423 | 23250 | 23252 | 23978 |
| | 30596 | 30641 | 30609 | 31674 | 31673 | 31671 | 1054 | 1196 | 1445 | 1967 | 3669 |
| | 3230 | 29045 | 28801 | 29046 | 29097 | 31551 | 32401 | 28856 | 27128 | 14300 | 6151 | 4108 |
| | 4780 | 7757 | 7624 | 7174 | 6659 | 8259 | 11223 | 33285 | 18505 | 18585 | 16546 | 16497 |
| | 12156 | 12142 | 15882 | 11743 | 32464 | 33326 | 20114 | 15621 | 14318 | 11773 | 16623 | 24601 |
| | 20067 | 33103 | 20133 | 16622 | 22965 | | | | | | | |
| 710: | 23116 | 23117 | 11331 | 25350 | 10634 | 23552 | 24538 | 26791 | 26667 | 22781 | 9795 | 23354 |
| | 16727 | 28015 | 31921 | 28340 | 24121 | 10176 | 32983 | 17704 | 20086 | 19533 | 24132 | 19721 |
| | 31561 | 20654 | 10970 | 10964 | 11263 | 16765 | | | | | | |
| 711: | 1299 | 1644 | 3951 | 14574 | 1920 | 3321 | 2703 | 3479 | 3783 | 29346 | 28980 | 20280 |
| | 11322 | 11321 | 19903 | 5254 | 5949 | 9409 | 8269 | 6881 | 10806 | 15442 | 20137 | 31117 |
| 712: | 27438 | 32710 | 33070 | 9597 | 13551 | 28241 | 30221 | 11687 | 11686 | 32903 | 32926 | 33507 |
| | 10497 | 14414 | 33571 | 18655 | 32103 | 32102 | 15215 | 13484 | 12594 | 17365 | 10899 | 12661 |
| | 12701 | 31288 | 24857 | 13935 | 14211 | 20214 | 13006 | 10936 | 14538 | 23643 | 14358 | 14610 |
| | 25308 | 32077 | 21093 | 14691 | 15138 | 14980 | 12915 | 12917 | 28230 | 15090 | 15494 | 15495 |

TABLE 2-continued

| SEQ ID NO: | homolog SEQ ID NOs | | | | | | | | | | |
|---|---|---|---|---|---|---|---|---|---|---|---|
| | 15552 | 14157 | 17495 | 22466 | 23819 | 15287 | 19927 | 15613 | 17688 | 16685 | 32368 | 15903 |
| | 29870 | 11998 | 18441 | 18443 | 17183 | 17464 | 17244 | 18037 | 18045 | 18032 | 18738 | 16319 |
| | 16381 | 24771 | 24707 | 18940 | 18938 | 18144 | 18216 | 19368 | 19809 | 19617 | 19991 | 25941 |
| | 24405 | 9694 | 22975 | 20348 | 17979 | 22982 | 20937 | 25646 | 30752 | 30113 | 22724 | 22686 |
| | 22670 | 22711 | 20801 | 20593 | 12474 | 12467 | 12480 | 24297 | 21664 | 23011 | 22851 | 22883 |
| | 23253 | 23268 | 24051 | 25931 | 29972 | 27189 | 30184 | 26053 | 27477 | 25834 | 28833 | 27672 |
| | 27771 | 25480 | 25463 | 10768 | 13741 | 13740 | 26336 | 26388 | 27928 | 27218 | 9476 | 9492 |
| | 30619 | 30631 | 24582 | 17917 | 10840 | 10597 | 27018 | 17860 | 27996 | 17927 | 17928 | 28357 |
| | 28316 | 27202 | 16950 | 14969 | 10327 | 17591 | 20220 | 23654 | 12482 | 26887 | 15744 | 27440 |
| | 17074 | 23653 | 15611 | 14450 | 23720 | 29186 | 13845 | 17229 | 14109 | 23665 | 21559 | 13610 |
| | 11659 | 24827 | 29033 | 22046 | 29129 | 28978 | 22045 | 32158 | 21850 | 31949 | 14288 | 11639 |
| | 11436 | 10856 | 11132 | 21540 | 24828 | 25024 | 31394 | 31393 | 33304 | 26886 | 19280 | 28719 |
| | 28335 | 20578 | 16553 | 12462 | 31165 | 31304 | 17902 | 21144 | 18658 | 30903 | 30936 | 30938 |
| | 29212 | 24146 | 22203 | 17755 | 24939 | 9851 | 11145 | 9852 | 11037 | 11012 | 22832 | 32972 |
| | 24933 | 32037 | 28047 | 12841 | 33624 | | | | | | | |
| 713: | 9564 | 31891 | 20532 | 13549 | 13544 | 12213 | 27613 | 27634 | 30264 | 30233 | 33557 | 31539 |
| | 30097 | 10349 | 787 | 33621 | 570 | 567 | 33627 | 792 | 11157 | 13129 | 794 | 815 |
| | 24995 | 17274 | 31505 | 759 | 32906 | 17681 | 11154 | 21671 | 17283 | 12537 | 19274 | 14517 |
| | 18628 | 17993 | 27015 | 19997 | 32981 | 21108 | 22389 | 17257 | 32170 | 10340 | 30309 | 24134 |
| | 14733 | 10248 | 16096 | 16112 | 27867 | 26917 | 11200 | 11202 | 14422 | 24094 | 31742 | 17406 |
| | 12582 | 24838 | 24227 | 24243 | 25764 | 25167 | 11830 | 11452 | 11453 | 11454 | 21055 | 26552 |
| | 13407 | 13413 | 19743 | 16918 | 18333 | 18339 | 12849 | 13942 | 13912 | 11720 | 13939 | 13228 |
| | 14191 | 21027 | 18567 | 14366 | 14374 | 14369 | 14355 | 27120 | 15677 | 17725 | 23711 | 25201 |
| | 25202 | 25200 | 14582 | 17071 | 32887 | 14670 | 14495 | 15195 | 15034 | 15050 | 12929 | 32292 |
| | 32615 | 15114 | 25198 | 15564 | 14142 | 17507 | 22479 | 31779 | 15084 | 14458 | 32417 | 15773 |
| | 23030 | 16992 | 19928 | 15523 | 17764 | 27902 | 28058 | 16294 | 29821 | 16291 | 28226 | 18794 |
| | 31562 | 16778 | 16795 | 26001 | 16857 | 32374 | 667 | 478 | 16823 | 16882 | 20494 | 11979 |
| | 19205 | 21877 | 17182 | 17108 | 18599 | 12732 | 18080 | 28584 | 18847 | 11158 | 18711 | 18682 |
| | 16363 | 16337 | 24773 | 24696 | 18972 | 19089 | 28909 | 33618 | 33615 | 12066 | 9895 | 18163 |
| | 14046 | 14023 | 19336 | 19878 | 19798 | 23490 | 19508 | 19621 | 19760 | 20466 | 20464 | 20017 |
| | 21927 | 15746 | 24996 | 24362 | 9692 | 28859 | 20976 | 20983 | 14104 | 20562 | 26653 | 25607 |
| | 25544 | 30116 | 30127 | 30112 | 22779 | 21720 | 20783 | 32191 | 23181 | 12342 | 30320 | 22317 |
| | 12315 | 33375 | 21687 | 22951 | 22219 | 22842 | 21472 | 21384 | 21220 | 24029 | 25914 | 24065 |
| | 28261 | 27200 | 27176 | 24002 | 25729 | 25735 | 26059 | 24653 | 25867 | 27475 | 25095 | 26601 |
| | 24291 | 28272 | 25131 | 26958 | 26964 | 25672 | 27696 | 27765 | 25323 | 13031 | 10735 | 10742 |
| | 10659 | 10685 | 10744 | 24960 | 27102 | 27110 | 27055 | 25261 | 31701 | 31675 | 31518 | 31052 |
| | 26492 | 26363 | 26278 | 27945 | 27935 | 27974 | 27242 | 27250 | 11380 | 11375 | 9515 | 9473 |
| | 9513 | 12033 | 11463 | 29780 | 30630 | 12384 | 13328 | 13334 | 26095 | 16217 | 12533 | 10372 |
| | 30513 | 30505 | 30510 | 30515 | 26027 | 16070 | 16042 | 16054 | 12613 | 12229 | 14942 | 14938 |
| | 10830 | 28020 | 27984 | 27333 | 18003 | 28375 | 28397 | 28140 | 28471 | 28477 | 28309 | 28313 |
| | 33180 | 28669 | 28668 | 17680 | 29309 | 30767 | 32130 | 17432 | 32128 | 10939 | 33561 | 30013 |
| | 460 | 13663 | 21930 | 17626 | 20531 | 12488 | 18504 | 24025 | 18461 | 11816 | 14447 | 16397 |
| | 13265 | 13264 | 31578 | 17603 | 10474 | 33620 | 10539 | 17580 | 32280 | 28644 | 15941 | 1416 |
| | 1019 | 33052 | 32038 | 17665 | 10540 | 27443 | 477 | 10628 | 1870 | 2733 | 1871 |
| | 2731 | 3016 | 2325 | 2732 | 9733 | 20083 | 18393 | 18469 | 14945 | 19522 | 22158 | 32011 |
| | 32013 | 32012 | 29143 | 20325 | 23293 | 33029 | 14473 | 14567 | 14566 | 9789 | 15423 | 33453 |
| | 33451 | 33450 | 33452 | 33456 | 33454 | 33455 | 32395 | 23029 | 23027 | 23028 | 11306 | 19519 |
| | 19520 | 32550 | 19516 | 32551 | 19518 | 32549 | 14435 | 19517 | 10463 | 5117 | 4724 | 6281 |
| | 5774 | 6282 | 5220 | 9079 | 8640 | 8194 | 20355 | 15926 | 22107 | 22108 | 9811 | 11814 |
| | 23747 | 707 | 585 | 31913 | 20720 | 23708 | 32546 | 10207 | 30746 | 31907 | 31906 | 31908 |
| | 33276 | 9965 | 14409 | 21551 | 23827 | 23828 | 28706 | 23742 | 16577 | 29810 | 16520 | 29803 |
| | 16554 | 29812 | 12460 | 31198 | 31172 | 20526 | 32050 | 27143 | 31313 | 31329 | 31299 | 20882 |
| | 20879 | 20877 | 19169 | 21523 | 30895 | 22109 | 12096 | 12949 | 10617 | 21766 | 21515 | 16591 |
| | 12168 | 708 | 26874 | 31407 | 31438 | 13164 | 13191 | 13193 | | | | |
| 714: | 33138 | 17600 | 31235 | 12431 | 30249 | 30285 | 30286 | 30229 | 13110 | 19705 | 20735 | 21009 |
| | 28880 | 28233 | 14320 | 32870 | 28877 | 28878 | 28879 | 22093 | 18513 | 18512 | 15641 |
| | 22819 | 33474 | 32168 | 9847 | 33174 | 13257 | 15229 | 10066 | 11738 | 17379 | 30002 | 13390 |
| | 15135 | 14975 | 15563 | 9761 | 16892 | 20510 | 11944 | 29595 | 18675 | 16344 | 24710 | 18936 |
| | 18116 | 18219 | 19815 | 23444 | 23545 | 19652 | 24425 | 33347 | 21543 | 21544 | 30110 | 32203 |
| | 23214 | 12280 | 12316 | 12313 | 22206 | 22285 | 22839 | 21451 | 21247 | 23157 | 27181 | 23943 |
| | 30183 | 25102 | 30028 | 26945 | 25226 | 25474 | 27071 | 13744 | 26514 | 26286 | 27963 |
| | 11511 | 29755 | 16475 | 13312 | 16186 | 26155 | 26146 | 24587 | 31008 | 31010 | 28360 | 32879 |
| | 21105 | 9956 | 18629 | 16433 | 29280 | 6404 | 5020 | 4401 | 4357 | 7870 | 16952 | 21803 |
| | 15606 | 16555 | 9841 | 30956 | 25383 | 820 | | | | | | |
| 715: | 30770 | 29833 | 14238 | 22930 | 20888 | 1431 | 1487 | 1552 | 1026 | 1557 | 1488 | 4074 |
| | 3289 | 3288 | 4073 | 2021 | 1860 | 2338 | 2541 | 33067 | 21985 | 29078 | 22050 | 31542 |
| | 16917 | 13448 | 16634 | 30864 | 4180 | 4181 | 6190 | 6140 | 6343 | 5755 | 4386 | 4852 |
| | 5102 | 4850 | 6344 | 4851 | 4433 | 31899 | 7978 | 8185 | 8187 | 8718 | 7561 | 9140 |
| | 8717 | 7297 | 8950 | 8951 | 8497 | 8186 | 9006 | 6852 | 8801 | 6588 | 8561 | |
| 716: | 33046 | 22935 | 23438 | 24485 | 26803 | 25612 | 22760 | 31786 | 11130 | 9443 | 10427 | 22821 |
| | 27528 | 10946 | 32385 | 1066 | 1815 | 1209 | 11284 | 25385 | 2427 | 3995 | 3996 | 20060 |
| | 32139 | 17435 | 29230 | 17076 | 10226 | 24793 | 15295 | 9926 | 13231 | 33172 | 20691 | 9924 |
| | 22954 | 27461 | 29154 | 29157 | 20611 | 13475 | 15234 | | | | | |
| 717: | 1182 | 2509 | 3587 | 5318 | 5643 | 8265 | 8871 | 6566 | | | | |
| 718: | 10217 | 11761 | 881 | 3489 | 3484 | 3523 | 29398 | 32014 | 5496 | 5297 | 5404 | 4584 |
| | 4437 | 7344 | | | | | | | | | | |
| 719: | 30392 | 24618 | 1062 | 28936 | 5945 | 6411 | 4286 | 6995 | 2439 | | | |

TABLE 2-continued

| SEQ ID NO: | homolog SEQ ID NOs | | | | | | | | | | |
|---|---|---|---|---|---|---|---|---|---|---|---|
| 720: | 13578 | 23325 | 23313 | 9952 | 23316 | 17221 | 13111 | 759 | 31135 | 17283 | 22061 | 26917 |
| | 25142 | 15808 | 23030 | 28211 | 33625 | 25879 | 31058 | 33180 | 28669 | 28668 | 17680 | 29309 |
| | 30013 | 30015 | 31392 | 14451 | 11816 | 13265 | 13264 | 31578 | 17603 | 10474 | 33620 | 10561 |
| | 10560 | 10559 | 14277 | 10539 | 16625 | 9971 | 24627 | 19515 | 13000 | 13001 | 14795 | 871 |
| | 907 | 906 | 905 | 1403 | 908 | 872 | 1825 | 1398 | 1402 | 1126 | 1545 | 1401 |
| | 1153 | 1456 | 1251 | 1544 | 1376 | 1414 | 1527 | 1326 | 1382 | 1354 | 1494 | 1399 |
| | 1370 | 1361 | 1341 | 1476 | 1587 | 1504 | 1817 | 1623 | 1264 | 1639 | 1417 | 1653 |
| | 1543 | 1651 | 1590 | 862 | 1233 | 1377 | 1715 | 1400 | 33052 | 10540 | 23323 | 477 |
| | 23063 | 2641 | 3109 | 3386 | 3273 | 2964 | 9770 | 2014 | 2319 | 2635 | 3299 | 2144 |
| | 2961 | 2963 | 2013 | 2015 | 2898 | 10538 | 2993 | 1853 | 2061 | 2105 | 9769 | 3272 |
| | 2485 | 2214 | 2718 | 2135 | 2962 | 2142 | 2617 | 2139 | 2676 | 2490 | 2257 | 2965 |
| | 2543 | 2966 | 2289 | 2277 | 3328 | 2134 | 2143 | 1928 | 2724 | 1939 | 2130 | 2491 |
| | 2967 | 1965 | 2140 | 2308 | 2313 | 2310 | 2128 | 2193 | 1998 | 1850 | 2480 | 2131 |
| | 1912 | 2192 | 1851 | 2592 | 2241 | 2212 | 4052 | 1849 | 2316 | 2245 | 1996 | 4048 |
| | 2997 | 2968 | 2118 | 3086 | 2133 | 1839 | 2129 | 2297 | 2486 | 2176 | 4047 | 1894 |
| | 2479 | 2172 | 2076 | 2727 | 1947 | 4046 | 2208 | 4050 | 3066 | 2141 | 1892 | 1843 |
| | 1913 | 2242 | 2179 | 1937 | 2655 | 2251 | 2290 | 2749 | 2132 | 3023 | 4032 | 2373 |
| | 4069 | 1896 | 2492 | 2075 | 2279 | 2299 | 2171 | 2200 | 2577 | 2320 | 2155 | 2258 |
| | 2180 | 4056 | 2174 | 1891 | 4057 | 1966 | 4071 | 1865 | 4037 | 4033 | 1842 | 2000 |
| | 3073 | 1863 | 4049 | 2191 | 1899 | 2779 | 1943 | 2712 | 2234 | 2383 | 9733 | 32132 |
| | 23108 | 20083 | 18469 | 14945 | 10076 | 13455 | 19522 | 32011 | 32013 | 32012 | 16981 | 20107 |
| | 20325 | 23293 | 13487 | 23019 | 14473 | 19901 | 13486 | 15423 | 18523 | 10558 | 20075 | 20076 |
| | 33453 | 33451 | 33450 | 33274 | 33456 | 33454 | 33455 | 23029 | 31809 | 23027 | 23028 |
| | 19519 | 19520 | 32550 | 19516 | 32551 | 19518 | 32549 | 14435 | 19517 | 23322 | 23317 | 10537 |
| | 21855 | 10535 | 23677 | 23329 | 23676 | 23315 | 6270 | 6332 | 6418 | 4324 | 4328 | 4354 |
| | 5153 | 6314 | 6490 | 4301 | 4783 | 6465 | 4472 | 4342 | 4859 | 10003 | 4218 | 4726 |
| | 4863 | 4216 | 4230 | 4448 | 4741 | 4325 | 4337 | 4219 | 4573 | 4329 | 4411 | 4473 |
| | 4330 | 4338 | 4213 | 4720 | 4513 | 4511 | 5389 | 5388 | 5165 | 4341 | 4351 | 4214 |
| | 4514 | 5244 | 4232 | 5219 | 4451 | 4347 | 5218 | 5217 | 5216 | 4542 | 4231 | 4215 |
| | 4343 | 4607 | 4340 | 5265 | 5148 | 4487 | 4217 | 4221 | 5146 | 5145 | 4452 | 5138 |
| | 4353 | 5523 | 4483 | 4446 | 4574 | 5251 | 5252 | 5250 | 5247 | 5516 | 4786 | 4334 |
| | 4333 | 4785 | 6464 | 6475 | 4705 | 5135 | 10005 | 4449 | 4947 | 6498 | 4925 | 4469 |
| | 4413 | 4949 | 5997 | 4946 | 4944 | 4941 | 4939 | 4934 | 4929 | 4930 | 4928 | 4194 |
| | 4919 | 4918 | 4466 | 5144 | 32548 | 10534 | 23327 | 6476 | 4936 | 4932 | 5478 | 4327 |
| | 5143 | 4223 | 4943 | 4923 | 4484 | 23328 | 4727 | 4572 | 4150 | 5573 | 4942 | 4922 |
| | 4339 | 4886 | 4455 | 4453 | 5248 | 4323 | 6392 | 4512 | 4445 | 5595 | 4945 | 4938 |
| | 4415 | 4924 | 4352 | 4901 | 6093 | 23314 | 33053 | 33203 | 4822 | 5553 | 6480 | 5481 |
| | 4395 | 10536 | 4427 | 5537 | 4608 | 4447 | 10002 | 5524 | 5482 | 5783 | 5156 | 5162 |
| | 5155 | 5139 | 4900 | 5246 | 4920 | 4716 | 5140 | 4857 | 4719 | 4948 | 4940 | 4921 |
| | 5480 | 5137 | 4926 | 5142 | 6462 | 4220 | 5463 | 5141 | 5249 | 4937 | 5163 | 5479 |
| | 4718 | 5452 | 4412 | 6043 | 4419 | 10004 | 4931 | 4486 | 4474 | 4530 | 4478 | 4454 |
| | 4485 | 4565 | 4935 | 5173 | 4731 | 4717 | 5136 | 4933 | 4326 | 5154 | 5164 | 5888 |
| | 4605 | 4927 | 4737 | 5152 | 5171 | 6009 | 6451 | 5477 | 4787 | 4784 | 4229 | 4450 |
| | 4376 | 5476 | 4410 | 5170 | 6466 | 6218 | 4703 | 5558 | 6463 | 6235 | 5310 | 4704 |
| | 4222 | 31946 | 23324 | 23318 | 23320 | 23319 | 23312 | 23311 | 23310 | 23309 | 8162 | 8699 |
| | 8482 | 8879 | 8875 | 8872 | 8877 | 8873 | 8971 | 8874 | 8161 | 8605 | 8876 | 8878 |
| | 8917 | 8958 | 8970 | 7480 | 7795 | 7447 | 8208 | 7210 | 8349 | 8842 | 7415 | 8445 |
| | 7414 | 8159 | 7417 | 8841 | 8511 | 8867 | 8157 | 8928 | 8916 | 8843 | 6730 | 6710 |
| | 6594 | 15926 | 9585 | 707 | 585 | 32546 | 23330 | 23321 | 16504 | 17866 | 17865 | 17714 |
| | 17713 | 18410 | 18409 | 18408 | 18412 | 18411 | 18407 | 17936 | 32134 | 22556 | 32131 | 23107 |
| | 32321 | 32322 | 23109 | 32133 | 32137 | 32323 | 32136 | 32135 | 21513 | 21514 | 23326 | 33622 |
| 721: | 32248 | 32245 | 24862 | 11228 | 33098 | 32473 | 13108 | 13143 | 27853 | 23349 | 23678 | 10290 |
| | 10319 | 10312 | 16102 | 29573 | 11206 | 17367 | 12572 | 9664 | 25750 | 21086 | 13374 | 18343 |
| | 11707 | 13850 | 13898 | 14194 | 18561 | 15714 | 14376 | 14598 | 14591 | 15164 | 15009 |
| | 15128 | 14143 | 14120 | 22441 | 23769 | 14456 | 15797 | 30982 | 30979 | 17833 | 27909 | 28096 |
| | 28084 | 16678 | 16661 | 16851 | 27580 | 16835 | 20512 | 20513 | 11947 | 11949 | 19254 | 19257 |
| | 19250 | 19265 | 21114 | 21113 | 18596 | 28518 | 28615 | 16366 | 16380 | 18935 | 12776 | 12803 |
| | 9879 | 18158 | 14014 | 13797 | 19323 | 19808 | 23715 | 19644 | 19686 | 19660 | 19634 | 20472 |
| | 20474 | 20463 | 25058 | 20815 | 32192 | 12279 | 33422 | 22225 | 27178 | 27187 | 23920 | 25168 |
| | 26171 | 26062 | 25100 | 30055 | 28275 | 25130 | 26934 | 25695 | 25208 | 25709 | 27753 | 25427 |
| | 10769 | 10778 | 10771 | 27098 | 27036 | 13765 | 13768 | 31069 | 26508 | 26331 | 26201 | 27925 |
| | 27959 | 9489 | 9501 | 9530 | 32667 | 30604 | 13300 | 10407 | 30514 | 16072 | 12612 | 10975 |
| | 12264 | 28022 | 28366 | 28481 | 28315 | 10928 | 16038 | 15088 | 16436 | 16450 | 32835 | 14788 |
| | 15726 | 14787 | 33274 | 15429 | 13521 | 32652 | 16979 | 16725 | 32553 | 1741 | 1596 |
| | 1308 | 1070 | 11573 | 11615 | 14950 | 27604 | 1908 | 3553 | 2715 | 3010 | 2867 | 3600 |
| | 4012 | 3880 | 3059 | 33611 | 4013 | 2256 | 2717 | 2326 | 2387 | 2224 | 2226 | 3118 |
| | 2728 | 3021 | 4011 | 2881 | 3494 | 2589 | 4014 | 2668 | 29241 | 22009 | 29111 | 31471 |
| | 22967 | 14408 | 14954 | 16903 | 16977 | 19712 | 4561 | 6519 | 6520 | 4312 | 5383 | 4196 |
| | 5810 | 5382 | 4974 | 4649 | 5380 | 5381 | 6293 | 5972 | 4973 | 4972 | 5121 | 5382 |
| | 4428 | 4375 | 4569 | 8469 | 6665 | 6656 | 7872 | 7189 | 8515 | 8984 | 8356 | 7873 |
| | 8357 | 8355 | 8239 | 7321 | 6660 | 7998 | 8663 | 7874 | 6893 | 7118 | 8514 | 8359 |
| | 8983 | 7721 | 6555 | 8358 | 8064 | 6843 | 8609 | 7738 | 9231 | 7423 | 7220 | 8450 |
| | 7047 | 25232 | 15582 | 15575 | 9781 | 13515 | 28790 | 31384 | 14827 | 20579 | 24903 | 9724 |
| | 23039 | 33306 | 31576 | 17611 | 20892 | 16528 | 31213 | 31154 | 20878 | 28249 | 10616 | 21482 |
| | 31414 | 30997 | 13202 | 30996 | 23085 | 13209 | 13196 |

TABLE 2-continued

| SEQ ID NO: | homolog SEQ ID NOs | | | | | | | | | | |
|---|---|---|---|---|---|---|---|---|---|---|---|
| 722: | 28805 | 23584 | 24344 | 26726 | 25623 | 22755 | 1699 | 1327 | 1681 | 1711 | 30758 | 3368 |
|  | 2948 | 3888 | 3886 | 3887 | 2978 | 32751 | 9598 | 4464 | 5090 | 5078 | 6170 | 6064 |
|  | 6545 | 6540 | 4715 | 5077 | 5091 | 4479 | 9156 | 6990 | 7313 | 7304 | 8320 | 8319 |
|  | 7778 | 6951 | 6716 | 23002 | 20616 | 24810 | 17878 | 32560 |  |  |  |  |
| 723: | 31932 | 31934 | 19461 | 20081 | 20080 | 19723 | 14967 | 14630 | 14957 | 14274 | 14275 | 20923 |
|  | 14629 | 20924 | 14276 | 31933 | 3398 | 3490 | 28994 | 29020 | 20306 | 14571 | 6922 | 8006 |
|  | 7966 | 7965 | 9049 | 28803 | 31935 | 15387 | 15729 |  |  |  |  |  |
| 724: | 14296 | 22529 | 33340 | 30796 | 30810 | 20033 | 20027 | 20031 | 30802 | 31638 | 9847 | 30791 |
|  | 30811 | 20028 | 30823 | 20025 | 20029 | 28808 | 1714 | 30783 | 30789 | 30792 | 30793 | 30784 |
|  | 30803 | 30815 | 30816 | 30818 | 30817 | 30804 | 33111 | 3859 | 29100 | 13480 | 13481 | 21988 |
|  | 22023 | 30788 | 30787 | 30775 | 30779 | 30785 | 30780 | 30777 | 30778 | 30776 | 30795 | 30800 |
|  | 30798 | 30799 | 30797 | 30812 | 30813 | 15073 | 30814 | 6124 | 30822 | 7786 | 9318 | 9370 |
|  | 6609 | 9317 | 30805 | 30820 | 30786 | 30781 | 30819 | 30808 | 30807 | 30809 | 30806 | 10067 |
|  | 14821 | 11217 | 30801 | 30794 | 30821 | 30782 | 30790 | 20030 | 20032 |  |  |  |
| 725: | 1478 | 2073 | 9187 | 7656 | 7243 | 9555 | 33165 | 15862 |  |  |  |  |
| 726: | 11558 | 11559 | 31546 | 28634 | 29412 | 14396 | 979 | 24942 | 26615 | 21773 | 11102 | 11098 |
|  | 11106 | 11107 | 11105 | 11108 | 11103 | 11099 | 11097 | 11096 | 11101 | 11100 | 11275 | 30394 |
|  | 11551 | 27445 | 27436 | 21094 | 24600 | 22619 | 22620 | 33296 |  |  |  |  |
| 727: | 13632 | 33290 | 15759 | 33058 | 28237 | 28239 | 28238 | 29617 | 29611 | 29623 | 29620 | 29619 |
|  | 29618 | 29616 | 29615 | 29614 | 29612 | 29610 | 29605 | 29601 | 29613 | 29607 | 29602 | 29622 |
|  | 29621 | 29603 | 29608 | 29606 | 29604 | 29609 | 26912 | 15585 | 26908 | 26909 | 14819 | 24142 |
|  | 16629 | 23764 | 24905 | 15293 | 19916 | 25354 | 25353 | 15271 | 13616 | 32040 | 32041 | 32039 |
|  | 22500 | 32621 | 16040 | 16302 | 33309 | 29885 | 11888 | 18894 | 20002 | 23453 | 9973 | 29238 |
|  | 20331 | 21808 | 23297 | 10192 | 14841 | 14840 | 14842 | 20852 | 18653 | 33312 | 21738 | 28659 |
|  | 9945 | 20156 | 14112 | 11149 | 20442 | 21136 | 11059 | 23119 | 13787 | 23408 | 23409 | 13284 |
|  | 20733 | 14762 | 17627 | 33518 | 15958 | 22080 | 31614 | 27170 | 14330 | 10942 | 30547 | 29214 |
|  | 30486 | 33069 | 22806 | 30534 | 13614 | 21740 | 9981 | 22120 | 20024 | 22553 | 20023 | 22121 |
|  | 22929 | 17974 | 16028 | 18654 | 987 | 28881 | 19424 | 17662 | 18765 | 29278 | 24852 | 24945 |
|  | 32675 | 33249 | 30458 | 30457 | 30459 | 30460 | 25381 | 19145 | 2931 | 3359 | 2913 | 10439 |
|  | 13628 | 14188 | 20056 | 26900 | 14441 | 22505 | 33051 | 22907 | 32138 | 29634 | 11795 | 28862 |
|  | 28861 | 31661 | 31660 | 28863 | 20447 | 16928 | 14410 | 14411 | 31382 | 31618 | 18643 | 24920 |
|  | 31767 | 13456 | 23285 | 31815 | 11313 | 11314 | 24929 | 24928 | 17703 | 20732 | 11308 | 20958 |
|  | 20957 | 25506 | 11316 | 11317 | 20731 | 21578 | 21579 | 30863 | 20967 | 32978 | 10920 | 10921 |
|  | 10922 | 10923 | 22201 | 19472 | 19471 | 11456 | 20265 | 24037 | 13784 | 32888 | 32889 | 12746 |
|  | 26825 | 19191 | 28640 | 19190 | 16935 | 23120 | 30545 | 28855 | 20438 | 32243 | 27446 | 23719 |
|  | 11142 | 18460 | 20637 | 14448 | 18435 | 11442 | 22497 | 28802 | 29169 | 19435 | 29675 | 10335 |
|  | 32044 | 24038 | 31929 | 9742 | 9743 | 9741 | 33291 | 20730 | 31883 | 24602 | 33280 |  |
| 728: | 18117 | 19479 | 30364 | 11771 | 22938 | 1201 | 3757 | 2877 | 3313 | 31466 | 21993 | 30834 |
|  | 6322 | 5462 | 5641 | 5461 | 4170 | 4253 | 5648 | 5983 | 30845 |  |  |  |
| 729: | 13735 | 27875 | 16141 | 25156 | 12652 | 12693 | 17554 | 19772 | 21693 | 16241 | 17158 | 16361 |
|  | 23544 | 26631 | 26728 | 30134 | 20802 | 25927 | 31087 | 14886 | 29266 | 20144 | 18652 | 1637 |
|  | 1032 | 1356 | 1433 | 28954 | 31924 | 11141 | 6403 | 5494 | 9982 | 20249 | 30719 | 24949 |
|  | 14438 | 30683 | 9791 | 12186 |  |  |  |  |  |  |  |  |
| 730: | 14764 | 23303 | 22414 | 1242 | 1146 | 1854 | 3516 | 22493 | 30200 | 29054 | 26906 | 10877 |
|  | 15331 | 14472 | 14471 | 22912 | 5789 | 8190 | 7532 | 27445 | 27436 | 18524 | 18862 | 29323 |
| 731: | 22988 | 1463 | 1536 | 1468 | 3764 | 2442 | 3715 | 3411 | 2190 | 2441 | 3243 | 2830 |
|  | 9582 | 9581 | 29317 | 28898 | 30467 | 5664 | 6173 | 4172 | 4861 | 6244 | 4697 | 6187 |
|  | 4128 | 4101 | 5831 | 4545 | 4414 | 8554 | 7629 | 7329 | 6804 | 8477 | 8206 | 8189 |
|  | 9077 | 6797 | 9019 | 8039 | 7842 | 7970 | 7781 | 7782 | 6610 | 7780 | 6704 | 6898 |
| 732: | 10502 | 33256 | 25807 | 13112 | 10050 | 33595 | 10460 | 10261 | 30296 | 29570 | 29425 | 17385 |
|  | 17315 | 12581 | 11114 | 13398 | 13406 | 12677 | 12682 | 12713 | 12719 | 18322 | 13853 | 12859 |
|  | 18566 | 14525 | 17723 | 14478 | 15139 | 14981 | 32296 | 19012 | 15549 | 14132 | 14161 | 22474 |
|  | 30962 | 17035 | 17781 | 16285 | 16715 | 27555 | 27563 | 16808 | 16891 | 15915 | 11982 | 11969 |
|  | 19251 | 19221 | 17480 | 17109 | 18611 | 18085 | 18083 | 28613 | 18747 | 18746 | 18680 | 16376 |
|  | 24831 | 24774 | 18959 | 19083 | 19086 | 9896 | 17964 | 18223 | 13978 | 19387 | 19403 | 19879 |
|  | 19811 | 19691 | 25951 | 24422 | 24406 | 33599 | 20989 | 26717 | 25527 | 20793 | 32222 | 22335 |
|  | 22380 | 12309 | 21638 | 21592 | 22218 | 21331 | 24187 | 23148 | 28255 | 27180 | 30185 | 30172 |
|  | 25792 | 24663 | 30037 | 25671 | 27736 | 13028 | 10759 | 10694 | 30157 | 24971 | 27118 | 27062 |
|  | 31030 | 26400 | 26414 | 26202 | 26535 | 11326 | 9479 | 11489 | 11481 | 16495 | 13320 | 13327 |
|  | 26157 | 10398 | 26040 | 14931 | 28202 | 28195 | 28419 | 28147 | 28460 | 11093 | 20947 | 15369 |
|  | 9433 | 22532 | 19727 | 18659 | 16421 | 16424 | 28002 | 21116 | 21115 | 31641 | 21174 | 1613 |
|  | 1811 | 9786 | 27531 | 3508 | 4029 | 18510 | 27203 | 24904 | 22829 | 17660 | 20309 | 29116 |
|  | 29115 | 13727 | 10657 | 13960 | 33552 | 10173 | 10172 | 10174 | 31005 | 4289 | 5617 | 8286 |
|  | 9215 | 8732 | 6723 | 9216 | 15973 | 31356 | 31357 | 28918 | 20682 | 10541 | 15360 | 29865 |
|  | 30826 | 30825 | 16976 | 15056 | 15057 | 15055 | 20003 | 9962 | 29639 | 14314 | 16499 | 31214 |
|  | 9821 | 20843 | 30550 | 18993 | 30445 | 27000 | 31613 | 31435 | 13177 |  |  |  |
| 733: | 3978 | 2546 | 2707 | 3977 | 19195 | 29017 | 4346 | 4345 | 6567 | 7255 | 7155 | 9308 |
|  | 7512 | 6840 | 7269 | 9310 | 9309 | 8575 | 9106 | 7585 | 6783 | 6599 | 17276 | 17622 |
|  | 26579 | 26578 |  |  |  |  |  |  |  |  |  |  |
| 734: | 17632 | 13559 | 13562 | 27605 | 32326 | 25068 | 13120 | 13133 | 13106 | 24941 | 10284 | 10283 |
|  | 29185 | 16093 | 30291 | 29580 | 29953 | 17321 | 17337 | 12549 | 24242 | 24241 | 25139 | 25135 |
|  | 25166 | 21085 | 13902 | 18547 | 15956 | 14357 | 15681 | 14618 | 14602 | 17052 | 15145 | 15040 |
|  | 12942 | 26163 | 15097 | 15125 | 15529 | 14127 | 14153 | 22446 | 15764 | 17008 | 17805 |  |
|  | 17804 | 28094 | 28216 | 28225 | 18784 | 16773 | 32354 | 32352 | 29852 | 29880 | 11968 | 12017 |
|  | 11945 | 19217 | 19218 | 24105 | 22086 | 18588 | 28542 | 18898 | 18948 | 12063 | 9892 | 18206 |
|  | 14051 | 14005 | 19322 | 19297 | 19482 | 20021 | 20558 | 25889 | 25033 | 25044 | 21729 | 20777 |
|  | 12469 | 23193 | 23215 | 30335 | 12302 | 33363 | 21642 | 22256 | 23269 | 23154 | 24071 | 30535 |
|  | 19285 | 24283 | 25788 | 25704 | 27745 | 25444 | 10746 | 25290 | 31031 | 31048 | 26504 | 26426 |

TABLE 2-continued

| SEQ ID NO: | homolog SEQ ID NOs | | | | | | | | | | |
|---|---|---|---|---|---|---|---|---|---|---|---|
| | 26473 | 26516 | 26491 | 26227 | 26346 | 26349 | 27941 | 27936 | 11523 | 11524 | 11522 | 30633 |
| | 26099 | 16183 | 16184 | 16172 | 30523 | 26019 | 16080 | 12609 | 12608 | 18637 | 27364 | 27343 |
| | 17650 | 14637 | 20842 | 22077 | 22205 | 11857 | 11642 | 20247 | 31125 | 11135 | 10001 | 25502 |
| | 29691 | 13268 | 14885 | 11125 | 16975 | 9040 | 10209 | 30754 | 30487 | 27310 | 27309 | 10034 |
| | 15086 | 20276 | 9920 | 12590 | 20277 | 10032 | 10033 | 20278 | 23655 | 27525 | 22548 | 14240 |
| | 24021 | 10031 | 11411 | 30400 | 31874 | 20279 | 10025 | 10026 | 10024 | 10041 | 10040 | 10035 |
| | 10030 | 10027 | 10028 | 10038 | 10037 | 10029 | 10039 | 10036 | 13249 | 31111 | 13247 | 23077 |
| | 28678 | 29816 | 29797 | 16539 | 13235 | 9673 | 15505 | 14839 | 9816 | 15877 | 31311 | 20870 |
| | 33332 | 33066 | 21521 | 30894 | 31598 | 29979 | 12971 | 21486 | 16584 | 12161 | 26842 | 18430 |
| | 28052 | 23083 | 13179 | | | | | | | | | |
| 735: | 27027 | 31939 | 25235 | 25234 | 25249 | 25240 | 27839 | 23239 | 14560 | 14559 | 14095 | 14558 |
| | 14557 | 14096 | 14724 | 30565 | 30585 | 30571 | 30568 | 30576 | 30578 | 30577 | 30570 | 30569 |
| | 30586 | 30563 | 30562 | 30573 | 30572 | 30579 | 30574 | 16097 | 16123 | 11192 | 16135 | 10885 |
| | 12548 | 20091 | 12270 | 14814 | 14813 | 14812 | 14815 | 14810 | 14236 | 13427 | 12681 | 12718 |
| | 18318 | 14331 | 18546 | 14523 | 16003 | 16004 | 16005 | 16006 | 16008 | 16007 | 14483 | 15169 |
| | 15013 | 32628 | 19003 | 16261 | 25248 | 25247 | 16667 | 16666 | 16878 | 13636 | 21884 | 23695 |
| | 17164 | 17456 | 18615 | 18724 | 16371 | 31958 | 12825 | 25237 | 25236 | 25239 | 25238 | 25241 |
| | 25242 | 25250 | 25251 | 19393 | 19318 | 19882 | 20552 | 21721 | 12361 | 10085 | 12308 | 30566 |
| | 23378 | 24198 | 30174 | 26085 | 23168 | 28832 | 30146 | 24979 | 27064 | 25300 | 27161 | 27248 |
| | 9523 | 11510 | 12415 | 13346 | 26158 | 26149 | 17916 | 14923 | 28204 | 18004 | 28456 | 25246 |
| | 25245 | 27022 | 27024 | 27025 | 27023 | 27026 | 27028 | 27029 | 25243 | 25244 | 29678 | 917 |
| | 1076 | 1586 | 1109 | 915 | 10478 | 3708 | 3455 | 4058 | 3050 | 2451 | 2930 | 3703 |
| | 3373 | 3911 | 3297 | 2401 | 2057 | 3674 | 3158 | 3401 | 1993 | 2575 | 1901 | 1994 |
| | 1995 | 2380 | 10873 | 14816 | 14817 | 19358 | 17285 | 32471 | 5401 | 5501 | 6031 | 5402 |
| | 6032 | 4502 | 5442 | 4235 | 5110 | 5455 | 5502 | 5403 | 5457 | 5903 | 5705 | 4400 |
| | 5883 | 5589 | 4315 | 5266 | 6432 | 4844 | 5993 | 7598 | 8241 | 7571 | 8242 | 6981 |
| | 7139 | 8705 | 8945 | 9234 | 8094 | 6791 | 6980 | 7766 | 18426 | 22406 | 22405 |
| | 22409 | 22410 | 10520 | 22397 | 22396 | 22407 | 10518 | 10519 | 33441 | 33438 | 33445 | 33443 |
| | 33442 | 33440 | 33444 | 33437 | 33439 | 31488 | 29411 | 29410 | 22398 | 22400 | 22399 | 22411 |
| | 22401 | 22408 | 22402 | 10521 | 22403 | 22404 | 27020 | 27021 | 19908 | 10523 | 819 | 17679 |
| | 16923 | 17678 | 16921 | 30575 | 30582 | 30580 | 30584 | 30583 | 30581 | 30564 | 30567 | 16919 |
| | 16920 | 16922 | 31202 | 10436 | 10435 | 10433 | 10432 | 10431 | 10434 | 20444 | 20445 | 20443 |
| | 20446 | 29166 | 29167 | 29164 | 29163 | 29165 | 23389 | 23384 | 23383 | 23373 | 23372 | 20824 |
| | 20093 | 20825 | 20096 | 10468 | 29740 | 20098 | 20826 | 20101 | 20095 | 19921 | 10470 | 29739 |
| | 15663 | 10472 | 19920 | 20100 | 10471 | 10469 | 20099 | 20094 | 29414 | 20097 | 23375 | 23377 |
| | 23376 | 23374 | 23385 | 23386 | 23380 | 23379 | 23381 | 23382 | 31612 | 23388 | 10522 |
| | 23390 | 31610 | 31611 | 19910 | 19909 | 22412 | 21759 | 29155 | 26876 | | | |
| 736: | 1113 | | | | | | | | | | | |
| 737: | 22165 | 24085 | 17340 | 21917 | 15184 | 15025 | 15107 | 17518 | 22490 | 22450 | 23789 | 15279 |
| | 16852 | 27585 | 11935 | 17148 | 17128 | 18070 | 18057 | 28612 | 24744 | 18922 | 19042 | 19047 |
| | 18138 | 20477 | 20465 | 20968 | 32196 | 12345 | 30351 | 22379 | 33413 | 33400 | 21617 | 21421 |
| | 21460 | 21308 | 21326 | 21242 | 25922 | 25929 | 27193 | 23909 | 26069 | 24660 | 30070 | 25829 |
| | 27668 | 27709 | 27809 | 27801 | 24978 | 27211 | 12494 | 10387 | 25500 | 27347 | 28371 | 28122 |
| | 31012 | 13683 | 31864 | 29699 | 1141 | 1275 | 3296 | 3932 | 2018 | 2996 | 2637 | 22032 |
| | 29318 | 28985 | 4379 | 5959 | 5844 | 5076 | 5843 | 5842 | 9053 | 7523 | 7428 | 8745 |
| | 8563 | 28715 | 21095 | 23674 | 31218 | 22164 | 30913 | 12159 | 15393 | | | |
| 738: | 33464 | 10059 | 18656 | 16009 | 31629 | 19719 | 15168 | 15012 | 23770 | 23761 | 27922 | 28083 |
| | 32355 | 19198 | 33211 | 18752 | 18754 | 18755 | 18900 | 18111 | 18194 | 23564 | 23505 | 23491 |
| | 23591 | 23455 | 23488 | 23636 | 23470 | 23614 | 23496 | 23495 | 23620 | 19587 | 24513 | 24337 |
| | 24375 | 24334 | 24528 | 24454 | 9684 | 9686 | 9693 | 9710 | 20426 | 26774 | 26813 | 26773 |
| | 26643 | 26704 | 26786 | 26652 | 26639 | 22705 | 22758 | 22681 | 22767 | 22700 | 22738 | 22652 |
| | 22654 | 20804 | 23984 | 23994 | 25664 | 26378 | 11492 | 11491 | 30671 | 12397 | 16163 | 12267 |
| | 12240 | 11251 | 10850 | 11245 | 10825 | 28188 | 28192 | 28012 | 19765 | 29729 | 29735 | 29680 |
| | 19469 | 19767 | 19768 | 1561 | 1523 | 1458 | 1292 | 1135 | 999 | 1137 | 1460 | 1609 |
| | 19710 | 26915 | 19709 | 29281 | 11607 | 3116 | 4004 | 3115 | 26884 | 22057 | 11651 | 31366 |
| | 31367 | 20205 | 14633 | 4891 | 7162 | 9196 | 9406 | 9820 | 32249 | 9819 | 9919 | 31703 |
| | 20664 | 20651 | 13152 | 20649 | 28812 | 33551 | 18000 | 33278 | 28752 | 16506 | 29162 | 29161 |
| | 29160 | 29159 | 29158 | 18296 | 11042 | 12149 | 13215 | 13187 | | | | |
| 739: | 13469 | 11120 | 1529 | 1640 | 1530 | 3771 | 2705 | 3155 | 3570 | 3179 | 2514 | 29025 |
| | 6305 | 4133 | 6390 | 6391 | 4614 | 5289 | 8931 | 8494 | 7750 | 8737 | 8476 | 9311 |
| | 7767 | 7728 | 9312 | 8366 | 8738 | 7621 | 7620 | 8913 | 8865 | 13637 | | |
| 740: | 1283 | 1548 | 2548 | 3641 | 3018 | 2545 | 5974 | 4997 | 6051 | 5001 | 9091 | 8631 |
| | 9364 | 8632 | 9362 | 8633 | 7515 | 6903 | 7296 | 6595 | 33481 | 15573 | 33164 | |
| 741: | 12202 | 27619 | 31857 | 17431 | 15605 | 16105 | 16114 | 24087 | 12545 | 21087 | 12660 | 14200 |
| | 18543 | 14346 | 15675 | 17073 | 15207 | 15046 | 16991 | 15513 | 17762 | 20505 | 11933 | 19203 |
| | 18614 | 12738 | 28586 | 16339 | 18916 | 12839 | 12049 | 9910 | 19888 | 23605 | 24393 | 9687 |
| | 26692 | 26810 | 22731 | 23220 | 12338 | 30333 | 22314 | 12290 | 29215 | 25716 | 27485 | 30073 |
| | 24293 | 28287 | 27700 | 27674 | 27769 | 24984 | 13769 | 25265 | 31054 | 26451 | 26344 | 26293 |
| | 27304 | 9532 | 11509 | 16492 | 30506 | 10824 | 28229 | 28414 | 28229 | 22962 | 20108 | 30375 |
| | 30373 | 22960 | 29685 | 1708 | 1635 | 16911 | 16910 | 16912 | 32084 | 32085 | 31119 | 31120 |
| | 31121 | 2103 | 3964 | 2615 | 3924 | 3965 | 23723 | 23724 | 29334 | 21973 | 12193 | 12194 |
| | 22083 | 31856 | 31855 | 30374 | 23887 | 31858 | 24117 | 24119 | 24118 | 21131 | 32283 | 32282 |
| | 28906 | 32281 | 32284 | 18466 | 11701 | 22813 | 31118 | 4985 | 4987 | 5642 | 4986 | 6749 |
| | 8008 | 9275 | 8576 | 7459 | 8461 | 33517 | 10211 | 10872 | 11060 | 11061 | 24791 | 19152 |
| | 14166 | 31225 | 31290 | 20860 | 21525 | 31997 | 21518 | 31381 | 18626 | 32427 | 30696 | |
| 742: | 10652 | 26605 | 10189 | 29336 | 26608 | 32646 | 32645 | 24953 | 26604 | 31901 | 15972 | 14237 |
| | 21168 | 21170 | 21169 | 22097 | 27430 | 33573 | 33572 | 32943 | 23034 | 17894 | 12428 | 28341 |
| | 15348 | 15347 | 31646 | 17592 | 33594 | 31649 | 31648 | 32935 | 31922 | 20728 | 23033 | 10203 |

TABLE 2-continued

| SEQ ID NO: | homolog SEQ ID NOs | | | | | | | | | | |
|---|---|---|---|---|---|---|---|---|---|---|---|
| | 23032 | 1036 | 10857 | 17252 | 11170 | 3661 | 3651 | 3806 | 2584 | 2278 | 32640 | 32641 |
| | 32642 | 32636 | 32637 | 32638 | 10064 | 32644 | 32643 | 32639 | 22550 | 28916 | 28927 | 29035 |
| | 29245 | 28896 | 28938 | 28945 | 28895 | 21942 | 28946 | 29260 | 29261 | 29347 | 29244 | 22054 |
| | 29060 | 29027 | 28957 | 20285 | 20838 | 21098 | 23031 | 26524 | 31654 | 18630 | 32536 | 18402 |
| | 31645 | 31644 | 23663 | 10224 | 18437 | 31551 | 13974 | 17977 | 6091 | 6292 | 5190 | 5046 |
| | 7868 | 6693 | 7156 | 9247 | 7511 | 6718 | 6612 | 9384 | 7402 | 7599 | 8512 | 6574 |
| | 7540 | 8820 | 8540 | 13782 | 13781 | 23398 | 13286 | 26992 | 11223 | 16652 | 31911 | 14189 |
| | 22105 | 13447 | 9969 | 22117 | 15981 | 25196 | 10932 | 10931 | 10930 | 10933 | 10934 | 26897 |
| | 24621 | 11009 | 14832 | 26899 | 26895 | 26898 | 26896 | 15863 | 11778 | 24611 | 32840 | 16986 |
| | 18859 | 24620 | 18860 | 15859 | 15733 | 11777 | 31980 | | | | | |
| 743: | 17215 | 23122 | 30256 | 30255 | 25808 | 13090 | 30853 | 30859 | 30861 | 30850 | 30852 | 30851 |
| | 30858 | 30860 | 16000 | 21796 | 10109 | 10104 | 10105 | 10106 | 10111 | 10117 | 26559 | 21787 |
| | 23123 | 26564 | 15989 | 24888 | 24890 | 24889 | 25762 | 21082 | 33024 | 14995 | 12866 | 15566 |
| | 23803 | 15282 | 10103 | 26569 | 26568 | 28059 | 26555 | 21789 | 24848 | 32309 | 32159 | 28601 |
| | 19331 | 19583 | 24496 | 26563 | 15987 | 25578 | 30117 | 20773 | 30359 | 21797 | 21733 | 21731 |
| | 21732 | 26560 | 21286 | 30054 | 30078 | 28847 | 31082 | 12036 | 12408 | 16181 | 13271 | 18638 |
| | 14935 | 32965 | 32232 | 18002 | 18008 | 21786 | 21785 | 15994 | 21783 | 16001 | 15750 | 31625 |
| | 15660 | 10193 | 24599 | 15658 | 15659 | 17900 | 31620 | 1718 | 981 | 16089 | 2185 | 3780 |
| | 2776 | 3781 | 2947 | 3713 | 1930 | 2238 | 3167 | 3692 | 1862 | 10461 | 29081 | 14432 |
| | 26554 | 30856 | 30854 | 30855 | 30857 | 4321 | 4282 | 4507 | 4475 | 4613 | 8895 | 7717 |
| | 7516 | 8634 | 8415 | 8894 | 9000 | 21794 | 21799 | 20653 | 26556 | 21798 | 24870 | 24869 |
| | 24868 | 24871 | 24872 | 10135 | 10138 | 10136 | 10143 | 10140 | 10139 | 10134 | 10144 | 10141 |
| | 10132 | 10145 | 10142 | 10137 | 10133 | 24873 | 24112 | 24113 | 24111 | 24895 | 24894 | 24874 |
| | 24876 | 24878 | 24875 | 22116 | 17671 | 24877 | 17691 | 17690 | 17674 | 17672 | 17673 | 17670 |
| | 17675 | 24879 | 24880 | 24882 | 24881 | 24883 | 24887 | 24885 | 24886 | 24884 | 21734 | 21735 |
| | 24893 | 24892 | 24891 | 24897 | 24896 | 24899 | 24898 | 24901 | 24902 | 24900 | 16544 | 21792 |
| | 15990 | 21784 | 10082 | 26561 | 10094 | 15986 | 15992 | 15991 | 26567 | 15988 | 26565 | 15984 |
| | 26566 | 15983 | 26562 | 21801 | 26570 | 15993 | 10122 | 10107 | 10121 | 10110 | 10123 | 10108 |
| | 10120 | 26558 | 10112 | 10113 | 10119 | 10118 | 21790 | 10115 | 10114 | 10116 | 21503 | 10129 |
| | 21793 | 26553 | 21800 | 10128 | 21795 | 21788 | 15998 | 15999 | 26557 | 21791 | 31601 | 31621 |
| | 26838 | 16940 | 16941 | 22557 | 16984 | 31369 | | | | | | |
| 744: | 23613 | 23472 | 24403 | 24451 | 26790 | 26776 | 25659 | 25549 | 22754 | 22667 | 1808 | 1272 |
| | 1670 | 1802 | 1803 | 3960 | 2893 | 2475 | 2199 | 2496 | 2384 | 3584 | 3949 | 3078 |
| | 3277 | 3947 | 3948 | 21965 | 20315 | 19359 | 15217 | 24938 | 6373 | 5655 | 5666 | 5583 |
| | 4186 | 6052 | 4730 | 6458 | 8578 | 6738 | 9918 | 9315 | 8211 | 9162 | 7137 | 9316 |
| | 9917 | 7995 | 8090 | 7547 | 8756 | 8091 | 7138 | 8212 | 8729 | 7912 | 7994 | 9033 |
| | 8214 | 8213 | 7136 | 7113 | 32316 | 22923 | 20718 | 14768 | 14767 | 19915 | 20191 | 14797 |
| 745: | 24910 | 1785 | 1794 | 1611 | 1372 | 1271 | 900 | 1612 | 1751 | 1610 | 1638 | 17231 |
| | 33031 | 7142 | | | | | | | | | | |
| 746: | 25627 | 25545 | 21171 | 14739 | 1000 | 3720 | 2977 | 3182 | 3547 | 3506 | 4076 | 2167 |
| | 17676 | 31109 | 28899 | 28900 | 29201 | 26176 | 15574 | 6260 | 5957 | 5799 | 4905 | 7058 |
| | 8408 | 8144 | 7291 | 9103 | 7996 | 7064 | 32110 | 29172 | 32253 | 16915 | 16914 | 14807 |
| 747: | 30237 | 10189 | 29336 | 26604 | 15972 | 28209 | 28594 | 23489 | 23626 | 24440 | 24410 | 20405 |
| | 26799 | 25034 | 22630 | 23250 | 23252 | 23934 | 25439 | 10736 | 13227 | 27353 | 13971 | 30539 |
| | 30538 | 31338 | 990 | 924 | 961 | 1573 | 1175 | 1405 | 1194 | 1856 | 13631 | 14064 |
| | 32639 | 15931 | 15930 | 21999 | 21998 | 26916 | 14065 | 14063 | 31645 | 23663 | 30841 | 18437 |
| | 13974 | 6426 | 5054 | 8684 | 6615 | 6957 | 8722 | 7820 | 7046 | 7818 | 7819 | 6638 |
| | 7779 | 26993 | 16652 | 20625 | 9588 | 20712 | 15925 | 15581 | 23023 | 23024 | 28501 | 19465 |
| | 17933 | 19726 | 19466 | 17938 | 32562 | 19464 | 31257 | 31975 | 32858 | 32863 | 32945 | 31013 |
| | 24840 | 10216 | 627 | 11742 | 9553 | 17883 | | | | | | |
| 748: | 33256 | 29367 | 10050 | 33595 | 10460 | 17385 | 12677 | 12713 | 17723 | 15549 | 17109 | 19083 |
| | 18223 | 13978 | 19387 | 19351 | 25951 | 24422 | 24406 | 33599 | 26717 | 25527 | 22636 | 22692 |
| | 23148 | 28344 | 30185 | 26595 | 10759 | 30157 | 16495 | 9433 | 30019 | 22532 | 20000 | 33305 |
| | 18659 | 28002 | 27013 | 31641 | 24946 | 11265 | 21174 | 1057 | 32996 | 22983 | 25336 | 15462 |
| | 2654 | 2026 | 2052 | 3077 | 3878 | 3235 | 17233 | 33463 | 10865 | 29226 | 24993 | 22829 |
| | 22828 | 17660 | 13727 | 10070 | 13960 | 10172 | 10174 | 10173 | 33356 | 31005 | 9028 | 11875 |
| | 22213 | 25360 | 20682 | 18397 | 18396 | 32254 | 30826 | 16976 | 10245 | 14314 | 32049 | 20843 |
| | 20941 | 20944 | 20945 | 20943 | 20946 | 20942 | 31799 | 20349 | 30445 | 27000 | 14809 | 14747 |
| 749: | 32565 | 33633 | 25403 | 25404 | 20151 | 18429 | 30313 | 18448 | 27873 | 11190 | 17414 | 24232 |
| | 13429 | 18313 | 13907 | 32607 | 28853 | 28069 | 16897 | 19263 | 22514 | 18592 | 16373 | 24776 |
| | 19108 | 12830 | 19332 | 19885 | 20341 | 20566 | 22675 | 10091 | 33364 | 21645 | 23130 | 29966 |
| | 23170 | 28280 | 26980 | 27112 | 27155 | 26189 | 27954 | 27961 | 9525 | 11476 | 18650 | 29760 |
| | 16489 | 13348 | 17909 | 13273 | 16082 | 10591 | 19107 | 22910 | 28451 | 16409 | 29684 | 887 |
| | 1199 | 1198 | 1350 | 1374 | 11451 | 3260 | 3894 | 2146 | 2462 | 3261 | 3893 | 2904 |
| | 2581 | 5352 | 5580 | 5343 | 5348 | 5349 | 5350 | 5581 | 5347 | 5304 | 4292 | 5042 |
| | 6026 | 6250 | 5977 | 5712 | 5293 | 20605 | 5453 | 5902 | 5292 | 5341 | 5305 | 5345 |
| | 5233 | 5210 | 5338 | 5344 | 5340 | 6486 | 7351 | 9319 | 7641 | 7643 | 8257 | 8700 |
| | 9009 | 8862 | 7642 | 7644 | 9320 | 6787 | 8701 | 6565 | 8085 | 7799 | 7029 | 8084 |
| | 7331 | 6569 | 8258 | 8863 | 12453 | 31206 | 20585 | 27010 | 31605 | 21770 | 16598 | 12179 |
| | 26854 | 31400 | 28050 | | | | | | | | | |
| 750: | 10320 | 10264 | 25900 | 17334 | 14217 | 17034 | 17003 | 17001 | 17846 | 17787 | 27579 | 29845 |
| | 29846 | 16880 | 29868 | 19255 | 17081 | 18645 | 28541 | 24753 | 12070 | 23576 | 19578 | 25954 |
| | 20545 | 23184 | 30358 | 21659 | 23959 | 23914 | 26173 | 24644 | 24675 | 25859 | 30033 | 25215 |
| | 27806 | 27754 | 13019 | 26493 | 26453 | 26231 | 26309 | 27967 | 29776 | 29777 | 29768 | 30612 |
| | 30678 | 26139 | 10371 | 28124 | 28148 | 10073 | 20069 | 29702 | 16413 | 6816 | 8965 | 17898 |
| | 18798 | 17596 | 15459 | 17595 | 14758 | 17569 | 28913 | 32960 | 9960 | 21117 | 22186 | 12993 |
| | 12962 | 10623 | 22994 | 28854 | 13244 | 26839 | 26865 | 26872 | 17594 | 13201 | 13168 | 17593 |

TABLE 2-continued

| SEQ ID NO: | homolog SEQ ID NOs | | | | | | | | | | |
|---|---|---|---|---|---|---|---|---|---|---|---|
| 751: | 33072 | | | | | | | | | | |
| 752: | 31554 | 30287 | 30288 | 30284 | 30259 | 9970 | 9825 | 16002 | 27864 | 10910 | 12644 | 12688 |
| | 14550 | 19036 | 14145 | 22417 | 28082 | 15908 | 21860 | 17471 | 18036 | 19138 | 19652 | 22298 |
| | 22839 | 21358 | 21360 | 21359 | 9529 | 29749 | 16165 | 16170 | 16180 | 26148 | 12241 | 28135 |
| | 28136 | 11444 | 1009 | 1048 | 3360 | 2795 | 3718 | 2012 | 2816 | 2366 | 2815 | 2817 |
| | 2365 | 2342 | 2067 | 2322 | 2263 | 1888 | 28334 | 20953 | 478 | 20951 | 20950 | 20955 |
| | 20952 | 15264 | 15265 | 5073 | 5072 | 6503 | 5723 | 4461 | 28333 | 6502 | 6181 | 5308 |
| | 4138 | 5309 | 8121 | 7499 | 9211 | 9376 | 9141 | 6742 | 7349 | 7222 | 7891 | 8243 |
| | 7698 | 9392 | 7699 | 7923 | 7924 | 8506 | 20274 | 20273 | 20271 | 20272 | 7610 | 26527 |
| | 26526 | 11113 | | | | | | | | | | |
| 753: | 1179 | 1491 | 1877 | 22044 | 5528 | 4123 | 5467 | 5468 | 9238 | 8163 | | |
| 754: | 22815 | 10867 | 29459 | 20918 | 21112 | 1688 | 1378 | 29184 | 10511 | 2531 | 22501 | 4252 |
| | 5545 | 4121 | 4120 | 5631 | 6541 | 4910 | 7683 | 7969 | | | | |
| 755: | 21160 | 11331 | 23462 | 24537 | 24408 | 26791 | 26667 | 26756 | 25617 | 25636 | 22766 | 22643 |
| | 32043 | 930 | 2489 | 2370 | 3794 | 3190 | 2369 | 2643 | 3076 | 3793 | 2307 | 19273 |
| | 29003 | 19902 | 5758 | 6197 | 7060 | 9059 | 7375 | 8486 | 7295 | 8487 | 8847 | 32108 |
| | 30498 | 28893 | 32251 | 31775 | 20711 | 32583 | 31331 | 14837 | 33476 | | | |
| 756: | 13533 | 23325 | 23313 | 9952 | 23316 | 13126 | 31135 | 17283 | 22061 | 26917 | 25753 | 25145 |
| | 21058 | 21078 | 21053 | 21060 | 15792 | 15812 | 23030 | 667 | 478 | 33625 | 30120 | 25032 |
| | 22221 | 22223 | 22268 | 31084 | 31077 | 33180 | 28669 | 28668 | 17680 | 29309 | 30013 | 30015 |
| | 31392 | 14451 | 11816 | 13265 | 13264 | 31578 | 17603 | 10474 | 33620 | 10561 | 10560 | 10559 |
| | 14277 | 10539 | 16625 | 9971 | 24627 | 19515 | 13000 | 13001 | 14795 | 871 | 907 | 906 |
| | 905 | 1403 | 908 | 872 | 1825 | 1398 | 1402 | 1126 | 1545 | 1401 | 1153 | 1456 |
| | 1251 | 1544 | 1376 | 1414 | 1527 | 1326 | 1382 | 1354 | 1494 | 1399 | 1370 | 1361 |
| | 1341 | 1476 | 1587 | 1504 | 1817 | 1623 | 1264 | 1639 | 1417 | 1653 | 1543 | 1651 |
| | 1590 | 862 | 1233 | 1377 | 1715 | 1400 | 33052 | 10540 | 23323 | 477 | 23063 | 2641 |
| | 3109 | 3386 | 3273 | 2964 | 9770 | 2014 | 2319 | 2635 | 3299 | 2144 | 2961 | 2963 |
| | 2013 | 2015 | 2898 | 10538 | 2993 | 1853 | 2061 | 2105 | 9769 | 3272 | 2485 | 2214 |
| | 2718 | 2135 | 2962 | 2142 | 2617 | 2139 | 2676 | 2490 | 2257 | 2965 | 2543 | 2966 |
| | 2289 | 2277 | 3328 | 2134 | 2143 | 1928 | 2724 | 1939 | 2130 | 2491 | 2967 | 1965 |
| | 2140 | 2308 | 2313 | 2310 | 2128 | 2193 | 1998 | 1850 | 2480 | 2131 | 1912 | 2192 |
| | 1851 | 2592 | 2241 | 2212 | 4052 | 1849 | 2316 | 2245 | 1996 | 4048 | 2997 | 2968 |
| | 2118 | 3086 | 2133 | 1839 | 2129 | 2297 | 2486 | 2176 | 4047 | 1894 | 2479 | 2172 |
| | 2076 | 2727 | 1947 | 4046 | 2208 | 4050 | 3066 | 2141 | 1892 | 1843 | 1913 | 2242 |
| | 2179 | 1937 | 2655 | 2251 | 2290 | 2749 | 2132 | 3023 | 4032 | 2373 | 4069 | 1896 |
| | 2492 | 2075 | 2279 | 2299 | 2171 | 2577 | 2320 | 2200 | 2155 | 2258 | 2180 | 4056 |
| | 2174 | 1891 | 4057 | 1966 | 4071 | 1865 | 4037 | 4033 | 1842 | 2000 | 3073 | 1863 |
| | 2712 | 4049 | 2191 | 1899 | 2779 | 1943 | 2234 | 2383 | 2680 | 1841 | 2164 | 9733 |
| | 32132 | 23108 | 20083 | 18469 | 33178 | 14945 | 10076 | 13455 | 19522 | 32011 | 32013 | 32012 |
| | 16981 | 20107 | 20325 | 23293 | 13487 | 23019 | 14473 | 19901 | 13486 | 15423 | 18523 | 10558 |
| | 10557 | 20075 | 20076 | 33453 | 33451 | 33450 | 33452 | 33456 | 33454 | 33455 | 32395 | 23029 |
| | 31809 | 23027 | 23028 | 19519 | 19520 | 32550 | 19516 | 32551 | 19518 | 32549 | 14435 | 19517 |
| | 23322 | 23317 | 10537 | 21855 | 10535 | 23677 | 23329 | 23676 | 23315 | 6270 | 6332 | 6418 |
| | 4324 | 4328 | 4354 | 5153 | 6314 | 6490 | 4301 | 4783 | 6465 | 4472 | 4342 | 4859 |
| | 10003 | 4218 | 4726 | 4863 | 4216 | 4230 | 4448 | 4741 | 4325 | 4337 | 4219 | 4573 |
| | 4329 | 4411 | 4473 | 4330 | 4338 | 4213 | 4720 | 4513 | 4511 | 5389 | 5388 | 5165 |
| | 4341 | 4351 | 4214 | 4514 | 5244 | 4232 | 5219 | 4451 | 4347 | 5218 | 5217 | 5216 |
| | 4542 | 4231 | 4215 | 4343 | 4607 | 4340 | 5265 | 5148 | 4487 | 4217 | 4221 | 5146 |
| | 5145 | 4452 | 5138 | 4353 | 5523 | 4483 | 4446 | 4574 | 5251 | 5252 | 5250 | 5247 |
| | 5516 | 4786 | 4334 | 4333 | 4785 | 6464 | 6475 | 4705 | 5135 | 10005 | 4449 | 4947 |
| | 6498 | 4925 | 4469 | 4413 | 4949 | 5997 | 4946 | 4944 | 4941 | 4939 | 4929 | 4930 |
| | 4928 | 4194 | 4919 | 4918 | 4466 | 5144 | 32548 | 10534 | 23327 | 6476 | 4936 | 4934 |
| | 4932 | 5478 | 4327 | 5143 | 4223 | 4943 | 4923 | 4484 | 23328 | 4727 | 4572 | 4150 |
| | 5573 | 4942 | 4922 | 4339 | 4886 | 4455 | 4453 | 5248 | 4323 | 6392 | 5162 | 4512 |
| | 4445 | 5595 | 4945 | 4938 | 4415 | 4924 | 4352 | 4901 | 6093 | 23314 | 33053 | 33203 |
| | 4822 | 5553 | 6480 | 4419 | 5481 | 4395 | 10536 | 4427 | 5537 | 4608 | 4447 | 10002 |
| | 5524 | 5482 | 5783 | 5156 | 5155 | 5139 | 4900 | 5246 | 4920 | 4716 | 5140 | 4857 |
| | 4719 | 4948 | 4940 | 4921 | 5480 | 5137 | 4926 | 5142 | 6462 | 5463 | 5141 | 5249 |
| | 4937 | 5163 | 5479 | 4718 | 5452 | 4220 | 4412 | 6043 | 10004 | 4931 | 4486 | 4474 |
| | 4530 | 4478 | 4454 | 4485 | 4565 | 4935 | 5173 | 4731 | 4717 | 5136 | 4933 | 4326 |
| | 5154 | 5164 | 5888 | 4605 | 4927 | 4737 | 5171 | 6009 | 6451 | 5152 | 5477 | 4787 |
| | 4784 | 4229 | 4450 | 4376 | 5476 | 5170 | 6466 | 6218 | 4703 | 4410 | 5558 | 6463 |
| | 6235 | 5310 | 4704 | 4222 | 6446 | 6400 | 6003 | 31946 | 23324 | 23318 | 23320 | 23319 |
| | 23312 | 23311 | 23310 | 23309 | 8162 | 8699 | 8482 | 8879 | 8875 | 8872 | 8877 | 8873 |
| | 8971 | 8874 | 8161 | 8605 | 8876 | 8878 | 8917 | 8958 | 8970 | 7480 | 7795 | 7447 |
| | 8208 | 7210 | 8349 | 8842 | 7415 | 8445 | 7414 | 8159 | 7417 | 8841 | 8511 | 8867 |
| | 8157 | 8928 | 8916 | 8843 | 6730 | 6710 | 6594 | 15926 | 9585 | 707 | 585 | 32546 |
| | 23330 | 23321 | 33630 | 713 | 16572 | 16501 | 17866 | 17865 | 17714 | 17713 | 18410 | 18409 |
| | 18408 | 18412 | 18411 | 18407 | 17936 | 22556 | 32134 | 32131 | 23107 | 32321 | 32322 | 23109 |
| | 32133 | 32137 | 32323 | 32136 | 32135 | 21492 | 23326 | | | | | |
| 757: | 914 | 1005 | 1155 | 1677 | 1664 | 893 | 1351 | 1662 | 1798 | 3639 | 3640 | 3574 |
| | 3593 | 3189 | 2346 | 6474 | 4654 | 5448 | 9142 | 6551 | 6866 | 7184 | 8519 | 33612 |
| 758: | 1483 | 3457 | 3452 | 2938 | 3138 | 2924 | 2515 | 30398 | 21976 | 29094 | 5567 | 6405 |
| | 5074 | 9073 | 8341 | 15399 | 15390 | 25252 | | | | | | |
| 759: | 32258 | 27308 | 14845 | 32318 | 30725 | 13571 | 13565 | 14734 | 17631 | 14114 | 10426 | 12201 |
| | 27633 | 11054 | 17932 | 30258 | 30242 | 15884 | 25804 | 15647 | 25801 | 824 | 33627 | 567 |
| | 756 | 33628 | 586 | 787 | 570 | 720 | 33621 | 792 | 628 | 613 | 815 | 13094 |
| | 10546 | 814 | 33619 | 794 | 32919 | 32918 | 10600 | 11112 | 18499 | 18500 | 25401 | 17283 |

TABLE 2-continued

| SEQ ID NO: | homolog SEQ ID NOs | | | | | | | | | | |
|---|---|---|---|---|---|---|---|---|---|---|---|
| | 31634 | 27824 | 27849 | 27823 | 22611 | 12541 | 19897 | 19898 | 13149 | 13491 | 13002 | 30308 |
| | 31923 | 24569 | 14689 | 10250 | 10311 | 10322 | 16090 | 16117 | 27878 | 26917 | 11186 | 11199 |
| | 29949 | 16138 | 16143 | 17382 | 17389 | 17374 | 17426 | 17342 | 10891 | 12569 | 24230 | 24225 |
| | 15977 | 25766 | 25160 | 25165 | 11861 | 21074 | 21056 | 13396 | 13400 | 13391 | 13402 | 12674 |
| | 12657 | 12712 | 12696 | 31285 | 31286 | 24120 | 18320 | 18299 | 18308 | 18305 | 18330 | 18300 |
| | 18363 | 12863 | 13893 | 13866 | 13876 | 13873 | 28227 | 31001 | 14215 | 14216 | 14207 | 17642 |
| | 17640 | 14576 | 21037 | 18557 | 14529 | 14362 | 15715 | 15669 | 15670 | 17744 | 14594 | 14622 |
| | 14586 | 17058 | 17063 | 17051 | 14677 | 14500 | 15208 | 15183 | 15162 | 15007 | 15024 | 12895 |
| | 12871 | 12911 | 15131 | 15101 | 19030 | 15560 | 15547 | 30682 | 17536 | 17513 | 17505 | 22482 |
| | 22445 | 15078 | 23787 | 23804 | 23778 | 23757 | 15290 | 14463 | 15783 | 15802 | 23030 | 17031 |
| | 30984 | 15512 | 17761 | 17767 | 17837 | 17850 | 17848 | 27911 | 16239 | 16289 | 29828 | 28087 |
| | 18777 | 18787 | 18791 | 21183 | 16780 | 16711 | 16703 | 16697 | 26002 | 16859 | 16858 | 27603 |
| | 667 | 478 | 16824 | 29840 | 16902 | 15896 | 15911 | 20511 | 20508 | 29869 | 11930 | 11946 |
| | 11997 | 11957 | 19202 | 19237 | 21892 | 17201 | 17188 | 17161 | 17446 | 17475 | 17085 | 17154 |
| | 12740 | 18076 | 18065 | 18066 | 28595 | 28511 | 28611 | 18837 | 18840 | 18722 | 18679 | 18714 |
| | 18743 | 18701 | 18687 | 16348 | 16360 | 16394 | 24735 | 24768 | 24712 | 18921 | 18960 | 33625 |
| | 18945 | 18917 | 19094 | 19040 | 19109 | 12782 | 33615 | 33618 | 33623 | 33624 | 712 | 465 |
| | 12810 | 12065 | 18215 | 18187 | 18166 | 18106 | 13983 | 13998 | 14044 | 18487 | 19392 | 19399 |
| | 19419 | 19292 | 19308 | 19330 | 19864 | 19844 | 19874 | 23718 | 23717 | 23615 | 19478 | 19594 |
| | 19695 | 19539 | 19574 | 31385 | 19763 | 9869 | 29924 | 25938 | 29918 | 29910 | 25010 | 24551 |
| | 24504 | 24479 | 9709 | 9711 | 9681 | 20338 | 20993 | 20973 | 20424 | 20397 | 26642 | 25583 |
| | 25543 | 25045 | 25060 | 25052 | 25046 | 25042 | 22717 | 21714 | 20811 | 20763 | 20596 | 20776 |
| | 20599 | 32229 | 32230 | 23237 | 23197 | 23222 | 23219 | 30321 | 22363 | 22302 | 22378 | 10088 |
| | 12282 | 24310 | 33403 | 33362 | 33411 | 33361 | 21602 | 21626 | 22394 | 31108 | 22229 | 22273 |
| | 22276 | 22295 | 22840 | 22848 | 22864 | 21475 | 21440 | 21453 | 21315 | 21370 | 21364 | 21228 |
| | 21259 | 21240 | 21252 | 24208 | 24170 | 23263 | 25915 | 24057 | 25924 | 23951 | 23999 | 23982 |
| | 23972 | 23969 | 25730 | 25178 | 25733 | 25736 | 25734 | 26065 | 26087 | 26084 | 26079 | 24645 |
| | 24643 | 24674 | 29993 | 23174 | 27476 | 27483 | 27492 | 25861 | 30071 | 25086 | 25827 | 25849 |
| | 26600 | 26583 | 26592 | 24256 | 24281 | 28283 | 26951 | 26953 | 26946 | 26954 | 19780 | 25689 |
| | 25675 | 27651 | 27681 | 27679 | 27702 | 27814 | 27720 | 27817 | 26571 | 25479 | 25424 | 25485 |
| | 25449 | 11677 | 10738 | 10717 | 10699 | 10716 | 10667 | 10785 | 27086 | 27072 | 27080 |
| | 27042 | 27048 | 13770 | 25279 | 25273 | 25293 | 31043 | 31042 | 31050 | 26481 | 26523 | 26511 |
| | 26403 | 26368 | 26200 | 26230 | 26353 | 26178 | 26188 | 27946 | 27932 | 27953 | 27285 | 27298 |
| | 11367 | 11372 | 9507 | 9464 | 9454 | 9488 | 9510 | 12043 | 16496 | 30670 | 30647 | 30637 |
| | 30645 | 12363 | 12411 | 12387 | 13318 | 13313 | 13322 | 13324 | 26140 | 26102 | 26098 | 16199 |
| | 26123 | 26121 | 12531 | 24584 | 17918 | 13276 | 10383 | 10390 | 16057 | 16081 | 16062 | 16052 |
| | 12604 | 12610 | 12024 | 12028 | 18642 | 18636 | 12634 | 12633 | 12242 | 12255 | 12258 | 12235 |
| | 14917 | 14893 | 14926 | 10820 | 10817 | 10853 | 28194 | 28156 | 28173 | 28189 | 28037 | 27376 |
| | 27379 | 27367 | 32499 | 32498 | 32497 | 28386 | 28119 | 28445 | 28469 | 28303 | 33180 | 28669 |
| | 28668 | 9572 | 15275 | 17245 | 17680 | 29309 | 11661 | 28346 | 14403 | 31487 | 32812 | 30013 |
| | 15272 | 30994 | 13492 | 31514 | 31515 | 28347 | 31513 | 27405 | 13647 | 13681 | 15274 | 24570 |
| | 28670 | 32512 | 11816 | 28500 | 29711 | 29272 | 29698 | 9753 | 13265 | 13264 | 31578 | 32974 |
| | 17603 | 10474 | 33620 | 10539 | 17584 | 33266 | 24116 | 11303 | 20364 | 16625 | 9971 | 24627 |
| | 19515 | 13000 | 13001 | 14795 | 1210 | 871 | 907 | 906 | 905 | 1403 | 908 | 872 |
| | 1825 | 1398 | 1402 | 1126 | 1545 | 1401 | 1153 | 1456 | 1251 | 1544 | 1376 | 1414 |
| | 1527 | 1326 | 1382 | 1354 | 1494 | 1399 | 32976 | 25522 | 33052 | 10540 | 11571 | 11632 |
| | 11634 | 477 | 11600 | 11588 | 11596 | 23063 | 22917 | 20960 | 2750 | 2321 | 3205 | 1897 |
| | 4091 | 1848 | 3936 | 2108 | 3310 | 2266 | 2641 | 3109 | 3386 | 3273 | 2964 | 9770 |
| | 2014 | 2319 | 2635 | 3299 | 2144 | 2961 | 2963 | 2013 | 2015 | 2898 | 10538 | 2993 |
| | 1853 | 2061 | 2105 | 9769 | 3272 | 2485 | 2214 | 2718 | 2135 | 2962 | 2142 | 2617 |
| | 2139 | 2254 | 2676 | 2490 | 2257 | 2965 | 9733 | 20083 | 18469 | 33515 | 33554 | 10949 |
| | 14945 | 19522 | 32011 | 32013 | 32012 | 29071 | 21936 | 28993 | 11008 | 17663 | 17685 | 24855 |
| | 20325 | 23293 | 15936 | 15935 | 16653 | 13487 | 14473 | 17870 | 19901 | 13486 | 9599 | 15423 |
| | 33453 | 33451 | 33450 | 33452 | 33456 | 33454 | 33455 | 32395 | 23029 | 24572 | 23027 | 23028 |
| | 19519 | 19520 | 32550 | 19516 | 32551 | 19518 | 32549 | 14435 | 19517 | 32975 | 11860 | 4790 |
| | 5599 | 5598 | 5710 | 4254 | 4550 | 5166 | 6270 | 5985 | 6332 | 6216 | 5511 | 6418 |
| | 21691 | 9260 | 8407 | 8946 | 9054 | 8794 | 9269 | 7826 | 6767 | 8162 | 7617 | 8699 |
| | 8482 | 8879 | 8875 | 8872 | 8877 | 8873 | 8971 | 8874 | 8161 | 8605 | 20250 | 8876 |
| | 8878 | 8917 | 8958 | 8970 | 6671 | 7328 | 9258 | 7480 | 8183 | 9259 | 7795 | 7671 |
| | 15926 | 32496 | 11063 | 11062 | 11065 | 15273 | 33163 | 17783 | 23013 | 32475 | 14406 | 31124 |
| | 31910 | 707 | 32116 | 32119 | 585 | 30443 | 33113 | 18995 | 18459 | 32546 | 19895 | 10874 |
| | 15270 | 32419 | 30654 | 15061 | 25505 | 13004 | 14242 | 24815 | 33179 | 9800 | 33345 | 28864 |
| | 15341 | 9856 | 23126 | 33630 | 713 | 28698 | 28760 | 28746 | 28764 | 16519 | 29808 | 16532 |
| | 16579 | 16531 | 16569 | 12457 | 31192 | 31195 | 31200 | 17976 | 33060 | 31314 | 20966 | 24811 |
| | 22095 | 21497 | 30954 | 30953 | 30914 | 29976 | 29980 | 12095 | 31252 | 31271 | 12147 |
| | 12136 | 12951 | 786 | 12994 | 10621 | 15302 | 10484 | 33622 | 708 | 571 | 26845 | 26850 |
| | 33466 | 33468 | 31406 | 31398 | 28039 | 28042 | 28051 | 13156 | 13161 | 13195 |
| 760: | 32673 | 33462 | 12213 | 27634 | 27613 | 31539 | 25803 | 10349 | 13101 | 31505 | 32924 | 32912 |
| | 17681 | 18668 | 10626 | 10345 | 21672 | 33598 | 14953 | 23707 | 19274 | 14517 | 18628 | 17993 |
| | 33505 | 19997 | 15594 | 17608 | 10241 | 10339 | 10340 | 23097 | 26609 | 10495 | 10275 | 10310 |
| | 16104 | 16128 | 27874 | 11175 | 14422 | 25898 | 29947 | 24084 | 17393 | 17298 | 12568 | 24838 |
| | 24227 | 24243 | 30005 | 21075 | 21080 | 26552 | 13409 | 19742 | 18331 | 18317 | 13851 | 11710 |
| | 13860 | 26882 | 13228 | 14212 | 21039 | 18556 | 14374 | 14369 | 14366 | 27120 | 15698 | 15717 |
| | 17740 | 14577 | 23896 | 17059 | 32887 | 14684 | 14504 | 15196 | 15035 | 12875 | 12909 | 32292 |
| | 32298 | 32307 | 32601 | 32603 | 15109 | 15531 | 15526 | 17529 | 22492 | 22462 | 15084 | 23796 |
| | 23817 | 32417 | 15794 | 17028 | 19928 | 15523 | 17795 | 17836 | 27894 | 28058 | 29821 | 16294 |
| | 16291 | 28078 | 28226 | 18792 | 16789 | 16799 | 16790 | 16679 | 26001 | 16863 | 32374 | 27558 |
| | 16823 | 16899 | 29891 | 11913 | 11903 | 19225 | 19266 | 21889 | 17182 | 17088 | 12732 | 18067 |

TABLE 2-continued

| SEQ ID NO: | homolog SEQ ID NOs | | | | | | | | | | |
|---|---|---|---|---|---|---|---|---|---|---|---|
| | 28603 | 18847 | 11158 | 18682 | 16342 | 24766 | 24738 | 18912 | 18930 | 19106 | 33618 | 12047 |
| | 9873 | 18120 | 18182 | 14033 | 19336 | 19872 | 19849 | 19814 | 23621 | 19508 | 19676 | 19683 |
| | 19596 | 20483 | 29913 | 20017 | 20007 | 21927 | 15746 | 24996 | 24361 | 9678 | 20983 | 20425 |
| | 20563 | 26741 | 26739 | 26653 | 25607 | 25544 | 25038 | 22779 | 22716 | 22728 | 21720 | 21728 |
| | 20787 | 32195 | 23179 | 12350 | 30342 | 30362 | 22355 | 22303 | 12315 | 33409 | 21613 | 21806 |
| | 22227 | 22856 | 22857 | 21434 | 21480 | 21351 | 21397 | 21280 | 21222 | 24029 | 23260 | 29479 |
| | 29489 | 25911 | 24070 | 28261 | 27190 | 23933 | 23958 | 25739 | 25170 | 26078 | 26057 | 24653 |
| | 29984 | 25867 | 24672 | 27510 | 27490 | 25097 | 28289 | 30026 | 25127 | 26960 | 25681 | 27673 |
| | 27796 | 27735 | 27747 | 25437 | 11680 | 11665 | 13046 | 11667 | 10744 | 24973 | 27102 | 13771 |
| | 13759 | 25277 | 31047 | 26423 | 26436 | 26356 | 26267 | 26185 | 27945 | 27935 | 27973 | 27272 |
| | 27278 | 11362 | 11368 | 9512 | 9538 | 11508 | 16454 | 30632 | 12384 | 13330 | 26095 | 16217 |
| | 12518 | 10370 | 10411 | 30510 | 30515 | 30513 | 30505 | 30525 | 16070 | 12228 | 14942 | 10816 |
| | 32463 | 24104 | 27984 | 27320 | 27377 | 18003 | 28408 | 28393 | 28385 | 28140 | 28127 | 28455 |
| | 28428 | 28325 | 28323 | 17248 | 17574 | 17432 | 30767 | 32130 | 32128 | 10529 | 33495 | 33561 |
| | 460 | 30395 | 13705 | 13651 | 17626 | 30766 | 20948 | 20531 | 12488 | 18461 | 14447 | 29704 |
| | 10205 | 18015 | 15412 | 1565 | 940 | 1060 | 32038 | 17665 | 27443 | 18540 | 32399 | 14880 |
| | 14883 | 11574 | 10628 | 3612 | 3736 | 2738 | 18393 | 22142 | 22158 | 22153 | 22157 | 29285 |
| | 29096 | 14412 | 19769 | 10463 | 4913 | 4637 | 5635 | 5189 | 9206 | 9408 | 7484 | 6684 |
| | 9239 | 6575 | 7989 | 9811 | 11814 | 22102 | 33033 | 32112 | 31913 | 33336 | 23708 | 21004 |
| | 30746 | 14409 | 21553 | 28710 | 28708 | 23742 | 28632 | 16568 | 12864 | 12449 | 31196 | 31193 |
| | 20526 | 32050 | 27143 | 31299 | 31329 | 20882 | 20877 | 20879 | 20866 | 21496 | 30933 | 30941 |
| | 22109 | 11041 | 12118 | 12965 | 12988 | 10617 | 21749 | 21512 | 16599 | 12180 | 26863 | 31433 |
| | 27532 | 13164 | 13193 | | | | | | | | | |
| 761: | 27649 | 27646 | 27638 | 30279 | 30267 | 30668 | 17711 | 14313 | 10321 | 10305 | 27865 | 29945 |
| | 17303 | 12561 | 32127 | 11092 | 24234 | 21052 | 21062 | 21051 | 12671 | 12710 | 12705 | 22899 |
| | 13852 | 20248 | 14208 | 20383 | 27121 | 15754 | 14604 | 33560 | 17057 | 14516 | 14474 | 14475 |
| | 12934 | 12908 | 12885 | 32624 | 32632 | 15127 | 22489 | 22464 | 30983 | 17021 | 17847 | 17827 |
| | 27905 | 27906 | 28100 | 21199 | 21181 | 16714 | 16688 | 16691 | 16861 | 16844 | 32361 | 25979 |
| | 11959 | 21894 | 17197 | 17207 | 17115 | 16388 | 16389 | 18954 | 18962 | 18892 | 19104 | 19053 |
| | 19064 | 18121 | 18205 | 14008 | 13980 | 14003 | 14001 | 19319 | 19315 | 29931 | 29933 | 20470 |
| | 20460 | 20457 | 20018 | 20039 | 20040 | 9679 | 9690 | 20540 | 20557 | 26724 | 26654 | 26775 |
| | 26727 | 25644 | 20779 | 32197 | 32224 | 30331 | 12305 | 12297 | 22847 | 21417 | 21424 | 21433 |
| | 21409 | 21479 | 21350 | 21374 | 21303 | 21396 | 21279 | 21233 | 21215 | 23265 | 23267 | 23131 |
| | 29482 | 24068 | 26052 | 26066 | 29982 | 24641 | 25875 | 24656 | 27495 | 27481 | 30090 | 30079 |
| | 30150 | 27712 | 27675 | 25434 | 25321 | 25324 | 30159 | 13774 | 25281 | 31063 | 26494 | 26480 |
| | 26232 | 26367 | 26376 | 26292 | 27937 | 27965 | 11793 | 9486 | 9466 | 16483 | 29745 | 16488 |
| | 16222 | 26114 | 26113 | 16203 | 10386 | 10379 | 10381 | 30517 | 26016 | 12233 | 14915 | 11243 |
| | 10819 | 10839 | 11248 | 28005 | 27997 | 27986 | 27375 | 28154 | 28121 | 20819 | 24107 | 14251 |
| | 13516 | 15356 | 10814 | 33259 | 13690 | 13692 | 30735 | 16416 | 16419 | 29692 | 1120 | 952 |
| | 1462 | 1882 | 2539 | 1881 | 2762 | 11561 | 28905 | 22145 | 29019 | 20297 | 20298 | 20296 |
| | 29249 | 32405 | 24807 | 33217 | 23106 | 9942 | 5744 | 6146 | 4456 | 4739 | 15642 | 8665 |
| | 7772 | 6984 | 6982 | 6983 | 7771 | 8290 | 8225 | 7773 | 8666 | 8558 | 9244 | 8806 |
| | 7445 | 9372 | 7770 | 6796 | 8226 | 7444 | 8927 | 8289 | 6586 | 8693 | 7440 | 23081 |
| | 31740 | 18857 | 9814 | 10630 | 17985 | 10551 | 11240 | 16766 | 30764 | 31458 | 18997 | 31737 |
| | 31736 | 31876 | 33275 | 22133 | 21552 | 16514 | 10629 | 31227 | 31138 | 31317 | 20871 | 9963 |
| | 21500 | 30915 | 30922 | 31603 | 22610 | 21758 | 21767 | 21757 | 15577 | 13190 | | |
| 762: | 1022 | 1471 | 1061 | 1028 | 3558 | 2434 | 3668 | 29087 | 20377 | 6227 | 4182 | 5575 |
| | 7908 | 7980 | 7981 | | | | | | | | | |
| 763: | 13440 | 27142 | 13441 | 27141 | 17604 | 31126 | 11210 | 29936 | 17341 | 25771 | 25770 | 18349 |
| | 15172 | 12877 | 14151 | 17525 | 27584 | 25986 | 11978 | 18706 | 18924 | 12837 | 23753 | 19834 |
| | 23628 | 23608 | 20064 | 30370 | 21631 | 22844 | 29484 | 27186 | 25110 | 25836 | 30034 | 25693 |
| | 25450 | 11672 | 13767 | 26454 | 26515 | 26308 | 27952 | 27247 | 9461 | 30629 | 32477 | 28011 |
| | 27312 | 28406 | 28490 | 14279 | 14428 | 31350 | 31351 | 31352 | 19994 | 9842 | 24823 | 16414 |
| | 1192 | 949 | 3804 | 3367 | 2117 | 3093 | 2822 | 2587 | 2356 | 3803 | 1945 | 3143 |
| | 3563 | 3440 | 3231 | 2159 | 3517 | 2006 | 31104 | 22056 | 15241 | 10587 | 12751 | 6311 |
| | 5800 | 5745 | 6219 | 4538 | 6088 | 5294 | 6156 | 5451 | 7025 | 8351 | 14692 | 8283 |
| | 7661 | 7361 | 6813 | 7369 | 6911 | 6812 | 7109 | 22921 | 24785 | 14468 | 28739 | 16516 |
| | 31158 | 14429 | 30945 | 32656 | 31418 | 20120 | | | | | | |
| 764: | 1780 | 3743 | 3742 | 21935 | 4893 | 5659 | 6368 | 4895 | 4894 | 6606 | 8099 | 8854 |
| | 6590 | 27003 | 15470 | | | | | | | | | |
| 765: | 32534 | 17876 | 11118 | 1807 | 1259 | 1486 | 1457 | 2551 | 3400 | 2678 | 2679 | 2863 |
| | 3176 | 3564 | 3789 | 2730 | 3090 | 3790 | 29148 | 5395 | 5394 | 6497 | 7583 | 8395 |
| 766: | 23303 | 14764 | 11553 | 11554 | 22414 | 1045 | 24942 | 1954 | 3149 | 30024 | 19429 | 21905 |
| | 20580 | 20582 | 33239 | 33240 | 33242 | 13085 | 11556 | 11557 | 20078 | 8467 | 6576 | 8495 |
| | 7330 | 7146 | 11551 | 10482 | 10481 | 10480 | 18862 | 21913 | 21911 | 21914 | 24605 | |
| 767: | 9739 | 17635 | 30268 | 11117 | 9744 | 29187 | 23346 | 14743 | 17284 | 14390 | 10273 | 21778 |
| | 11176 | 12723 | 24075 | 17292 | 30008 | 15244 | 13930 | 10937 | 17046 | 33021 | 15161 | 15005 |
| | 12906 | 18536 | 23092 | 20939 | 17501 | 17514 | 17515 | 15076 | 23775 | 16987 | 17801 | 17793 |
| | 16701 | 27534 | 11902 | 19197 | 18401 | 18990 | 9889 | 18141 | 13995 | 23541 | 19541 | 19554 |
| | 19667 | 22187 | 24500 | 9700 | 9683 | 9685 | 9713 | 20395 | 20390 | 20420 | 20400 | 20399 |
| | 25552 | 22787 | 32190 | 12479 | 21662 | 22079 | 22564 | 22566 | 21423 | 21408 | 21312 | 21302 |
| | 21249 | 23259 | 23155 | 29481 | 23996 | 26054 | 27507 | 27498 | 25118 | 30147 | 25217 | 25229 |
| | 30144 | 25214 | 25708 | 25462 | 11678 | 10701 | 25285 | 25270 | 25267 | 25264 | 26416 | 26312 |
| | 26347 | 27983 | 29757 | 30618 | 16211 | 26009 | 12223 | 12845 | 10848 | 10843 | 11246 | 10831 |
| | 10849 | 11252 | 10851 | 27993 | 27332 | 28430 | 13466 | 25351 | 13667 | 29710 | 16932 | 16930 |
| | 15447 | 31988 | 938 | 1490 | 941 | 939 | 942 | 1152 | 11610 | 3829 | 3338 | 2147 |
| | 2636 | 1983 | 2649 | 29073 | 27125 | 15350 | 4272 | 4712 | 4713 | 5057 | 4711 | 12317 |
| | 26620 | 20709 | 10588 | 13665 | 10355 | 11884 | 11883 | 23830 | 30689 | 30688 | 28727 | 29811 |

TABLE 2-continued

| SEQ ID NO: | homolog SEQ ID NOs | | | | | | | | | | |
|---|---|---|---|---|---|---|---|---|---|---|---|
| | 16551 | 29817 | 12461 | 9784 | 30901 | 15480 | 29406 | 29405 | 11013 | 12092 | 22995 | 29407 |
| | 28045 | | | | | | | | | | |
| 768: | 20119 | 1345 | 1404 | 7250 | 7987 | 6703 | | | | | |
| 769: | 15737 | 17614 | 11764 | 1089 | 1615 | 3792 | 3791 | 28981 | 5627 | 4490 | 4195 | 6538 |
| | 8304 | 9243 | 8059 | 6961 | 8342 | 7114 | 8060 | | | | |
| 770: | 15472 | 15473 | 1625 | 1655 | 3626 | 2583 | 3318 | 5491 | | | |
| 771: | 23712 | 24438 | 1090 | 1158 | 1274 | 1764 | 20286 | 15504 | 5321 | 5960 | 7975 | 7633 |
| | 7976 | 9270 | 7470 | 7974 | 7451 | 7973 | 6689 | 8755 | 8298 | 6850 | 7068 | 7275 |
| | 6991 | | | | | | | | | | |
| 772: | 33449 | 24954 | 28872 | 23556 | 23581 | 24330 | 24535 | 26667 | 26686 | 26791 | 25640 | 25657 |
| | 22676 | 22631 | 30828 | 21212 | 19284 | 31921 | 28340 | 28503 | 13283 | 11257 | 11256 | 944 |
| | 966 | 977 | 31340 | 31339 | 29635 | 24866 | 10954 | 31342 | 31341 | 18873 | 31344 | 31343 |
| | 31345 | 15371 | 15242 | 10338 | 11549 | 32715 | 20959 | 18856 | 22831 | 18876 | 20708 | 13253 |
| | 17897 | 22953 | 10970 | 10058 | 22071 | 22073 | 22072 | 22070 | 22066 | 22069 | 22068 | 22067 |
| 773: | 1589 | | | | | | | | | | |
| 774: | 25752 | 14973 | 28219 | 909 | 29246 | 24797 | 6318 | 20049 | 7876 | 6878 | 7359 | 15443 |
| 775: | 23433 | 24327 | 22673 | 1459 | 10944 | 2914 | 3707 | 3706 | 4078 | 3319 | 22029 | 5736 |
| | 5464 | 9096 | 6743 | 8124 | 6698 | 6699 | | | | | |
| 776: | 30699 | 30700 | 23635 | 24465 | 24150 | 24154 | 26715 | 22706 | 22759 | 24153 | 24157 | 22390 |
| | 24151 | 24155 | 24152 | 24156 | 27468 | 23834 | 22897 | 23835 | 22936 | 1667 | 1668 | 22128 |
| | 22127 | 22130 | 22129 | 23836 | 24149 | 3828 | 4045 | 2608 | 2328 | 1981 | 11289 | 31099 |
| | 21984 | 21954 | 21953 | 29037 | 32028 | 28793 | 30198 | 18582 | 18583 | 18584 | 13635 | 10180 |
| | 10179 | 5615 | 6083 | 5256 | 5570 | 6082 | 4890 | 23397 | 5364 | 8371 | 7901 | 7234 |
| | 8812 | 9098 | 8459 | 7168 | 8610 | 7959 | 6775 | 7907 | 28235 | | |
| 777: | 22614 | 28807 | 3067 | 1869 | 3264 | 3002 | 3265 | 3915 | 3914 | 3263 | 2644 | 33028 |
| | 8912 | 23664 | | | | | | | | | |
| 778: | 22614 | 28807 | | 1779 | 2395 | 33028 | 22082 | 6192 | 23664 | 33269 | 22937 | |
| 779: | 32557 | 15262 | 1114 | 1091 | 22889 | 29340 | 2367 | 2499 | 22890 | 22896 | 22888 | 33192 |
| | 15074 | 6445 | 6491 | 7741 | 9001 | 8201 | 10054 | 11283 | 21582 | 22895 | 21581 | 22892 |
| | 22893 | 11646 | 11648 | 11647 | | | | | | | |
| 780: | 17601 | 33118 | 31694 | 33559 | 27852 | 10525 | 28502 | 24912 | 19168 | 28534 | 28530 | 16365 |
| | 18132 | 19302 | 23473 | 23546 | 23466 | 23634 | 23562 | 23577 | 24415 | 24507 | 24399 | 24450 |
| | 24529 | 24414 | 25587 | 22704 | 11467 | 11327 | 15269 | 19457 | 19458 | 32939 | 14265 | 11649 |
| | 20356 | 10147 | 22990 | 22991 | 33171 | 33168 | 33167 | 33166 | 33170 | 33169 | 11873 | 21739 |
| | 27407 | 1721 | 30548 | 20195 | 15503 | 20189 | 31682 | 21675 | 19189 | 20006 | 24019 | 11069 |
| | 30196 | 28943 | 29204 | 15886 | 15885 | 21928 | 31919 | 20705 | 20922 | 9569 | 23735 | 19706 |
| | 15638 | 6102 | 5939 | 6774 | 8439 | 18870 | 7646 | 6643 | 7714 | 8438 | 18869 | 15875 |
| | 9351 | 28810 | 28811 | 18503 | 30993 | 16677 | 15966 | 16907 | 15968 | 16906 | 15967 | 15969 |
| | 16905 | 16909 | 16908 | 15960 | 15961 | 15963 | 15965 | 15962 | 15964 | 11882 | 31019 | 9826 |
| | 17687 | 23294 | 24950 | 9448 | 17434 | 13261 | 33151 | 21699 | 21700 | 21698 | 12750 | 29677 |
| | 19725 | 9967 | 9966 | 32582 | 32581 | 32593 | 19185 | 23089 | 15060 | 23093 | 10656 | 32466 |
| | 11433 | 32938 | 20821 | 20820 | 10164 | 12848 | 31577 | 13962 | 30552 | 20710 | 20666 | 12752 |
| | 25497 | 14830 | 25498 | 23652 | 20005 | 23342 | 15640 | 23651 | 20317 | 20830 | 20316 | 27406 |
| | 24103 | 23012 | 14828 | 10526 | 33037 | 33124 | 33121 | 15359 | 10813 | 33122 | 21176 |
| | 21780 | 14876 | 32098 | 32063 | 32061 | 32062 | 32099 | 32097 | 32096 | 32054 | 32056 | 32055 |
| | 32060 | 32101 | 32053 | 32058 | 10627 | 32059 | 32095 | 32052 | 32100 | 32051 | 24141 | 32057 |
| | 30561 | 32505 | 21556 | 32048 | 23113 | 31860 | 9762 | 30493 | 30492 | 19914 | 20221 | 15305 |
| | 20269 | 32415 | | | | | | | | | |
| 781: | 30842 | 25775 | 28224 | 23559 | 22278 | 11291 | 950 | 978 | 3567 | 2435 | 2337 | 3840 |
| | 3841 | 3629 | 3566 | 3226 | 2796 | 22106 | 6199 | 5881 | 5178 | 6153 | 5486 | 6324 |
| | 5236 | 5894 | 5694 | 9172 | 9171 | 7270 | 9170 | 8744 | 8956 | 8743 | 6713 | 7435 |
| | 22391 | | | | | | | | | | |
| 782: | 29578 | 31480 | 31483 | 31485 | 31484 | 31482 | 31481 | 31486 | 7173 | 24943 | |
| 783: | 10983 | 10996 | 10995 | 10984 | 10992 | 10994 | 10993 | 10997 | 10998 | 11006 | 11005 | 11004 |
| | 11003 | 10987 | 10988 | 11002 | 11001 | 20062 | 14404 | 26989 | 10981 | 10980 | 10982 | 10991 |
| | 10989 | 10990 | 23411 | 10986 | 1759 | 1407 | 1731 | 1524 | 1270 | 1694 | 1291 | 22939 |
| | 17436 | 3126 | 2216 | 4006 | 2493 | 2702 | 3104 | 3557 | 2353 | 3934 | 3935 | 3163 |
| | 3057 | 3933 | 2078 | 3538 | 10586 | 14239 | 31094 | 21980 | 18374 | 22019 | 21944 | 29068 |
| | 24864 | 23292 | 12999 | 15331 | 20077 | 19460 | 13518 | 6084 | 5640 | 5258 | 4175 | 5159 |
| | 5713 | 5157 | 4760 | 29415 | 5158 | 4617 | 8656 | 9290 | 9291 | 6953 | 8044 | 8315 |
| | 8748 | 7389 | 8961 | 7735 | 7734 | 8275 | 7733 | 8043 | 10985 | 11000 | 10999 | 23110 |
| 784: | 1426 | 1479 | 17615 | | | | | | | | |
| 785: | 14103 | | | | | | | | | | |
| 786: | 27437 | 23325 | 23313 | 12199 | 30262 | 9952 | 23316 | 586 | 720 | 824 | 756 | 33627 |
| | 628 | 787 | 33621 | 792 | 613 | 33628 | 570 | 567 | 33619 | 814 | 815 | 794 |
| | 9849 | 30995 | 32901 | 31135 | 17283 | 27845 | 14108 | 31006 | 30747 | 22061 | 9810 | 27871 |
| | 26917 | 24092 | 16139 | 16156 | 17306 | 12641 | 18365 | 13911 | 14304 | 31863 | 14230 | 15676 |
| | 14488 | 12907 | 18999 | 15551 | 14159 | 14149 | 17552 | 22481 | 23821 | 15288 | 23030 | 15510 |
| | 17763 | 16240 | 18789 | 25993 | 32353 | 16843 | 16893 | 19204 | 21869 | 17156 | 17440 | 17145 |
| | 18587 | 18613 | 12737 | 18077 | 28585 | 18839 | 18683 | 16310 | 19093 | 33615 | 12061 | 19369 |
| | 19348 | 19881 | 19782 | 19618 | 29930 | 29915 | 20332 | 20991 | 21713 | 20780 | 32207 | 23190 |
| | 30337 | 22315 | 22316 | 10093 | 12276 | 33372 | 21661 | 22267 | 22873 | 24194 | 24186 | 29487 |
| | 23915 | 25169 | 25747 | 26088 | 25794 | 24668 | 25098 | 24287 | 24246 | 25787 | 28840 | 30151 |
| | 25706 | 25483 | 10704 | 25306 | 27157 | 9449 | 11529 | 16486 | 12398 | 12498 | 24576 | 24590 |
| | 17926 | 17922 | 13270 | 10364 | 16044 | 14939 | 10589 | 28200 | 28376 | 28440 | 33180 | 28669 |
| | 28668 | 17680 | 29309 | 30013 | 30015 | 13709 | 31392 | 14451 | 11816 | 13265 | 13264 | 31578 |
| | 17603 | 10474 | 33620 | 10561 | 10560 | 10559 | 14277 | 10539 | 16625 | 9971 | 24627 | 19515 |
| | 15471 | 9994 | 29325 | 13000 | 13001 | 14795 | 32759 | 871 | 907 | 906 | 905 | 1403 |

TABLE 2-continued

| SEQ ID NO: | homolog SEQ ID NOs | | | | | | | | | | |
|---|---|---|---|---|---|---|---|---|---|---|---|
| | 908 | 872 | 1825 | 1398 | 1402 | 1126 | 1545 | 1401 | 1153 | 1456 | 1251 | 1544 |
| | 1376 | 1414 | 1527 | 1326 | 1382 | 1354 | 1558 | 1494 | 1399 | 1370 | 1361 | 1341 |
| | 1476 | 1587 | 1504 | 1817 | 1623 | 1264 | 1639 | 1417 | 1653 | 1543 | 1651 | 1590 |
| | 862 | 1233 | 1377 | 1715 | 1400 | 33052 | 10540 | 23323 | 477 | 11624 | 23063 | 3499 |
| | 4028 | 2641 | 3109 | 3386 | 3246 | 3273 | 2964 | 9770 | 2014 | 2319 | 2635 | 3299 |
| | 2144 | 2961 | 2963 | 2013 | 2015 | 2898 | 10538 | 2993 | 1853 | 2061 | 2105 | 9769 |
| | 3272 | 2485 | 2214 | 2718 | 2135 | 2962 | 2142 | 2617 | 2139 | 2676 | 2490 | 2257 |
| | 2965 | 2543 | 2966 | 2289 | 2277 | 3328 | 2134 | 2143 | 1928 | 2724 | 1939 | 2130 |
| | 2491 | 2967 | 1965 | 2140 | 2308 | 2313 | 2310 | 2128 | 2193 | 1998 | 1850 | 2480 |
| | 1912 | 2131 | 2192 | 1851 | 2592 | 2241 | 2212 | 4052 | 1849 | 2316 | 2245 | 1996 |
| | 4048 | 2784 | 2997 | 2968 | 2118 | 3086 | 2133 | 1839 | 2129 | 2297 | 2486 | 2176 |
| | 4047 | 1894 | 2479 | 2172 | 2076 | 2727 | 1947 | 4046 | 2208 | 4050 | 3066 | 2141 |
| | 1892 | 1843 | 1913 | 2242 | 2179 | 1937 | 2655 | 2251 | 2290 | 3500 | 2749 | 2132 |
| | 3023 | 4032 | 2373 | 4069 | 1896 | 2492 | 2075 | 2279 | 2299 | 2171 | 2577 | 2320 |
| | 2200 | 2155 | 2258 | 2180 | 4056 | 2174 | 1891 | 1966 | 4071 | 4057 | 1865 | 4037 |
| | 4033 | 1842 | 2000 | 3073 | 1863 | 4049 | 2191 | 1899 | 2779 | 1943 | 2712 | 2234 |
| | 2383 | 1841 | 9733 | 32132 | 23108 | 20083 | 18469 | 33178 | 14945 | 10076 | 13455 | 19522 |
| | 32011 | 32013 | 32012 | 16981 | 20107 | 20325 | 23293 | 13487 | 23019 | 14473 | 19901 | 13486 |
| | 15423 | 18523 | 10558 | 10557 | 20075 | 20076 | 33453 | 33451 | 33450 | 33452 | 33456 | 33454 |
| | 33455 | 32395 | 23029 | 31809 | 23027 | 23028 | 20092 | 19519 | 19520 | 32550 | 19516 | 32551 |
| | 19518 | 32549 | 14435 | 19517 | 23322 | 23317 | 10537 | 21855 | 10535 | 23677 | 23329 | 23676 |
| | 23315 | 6270 | 6507 | 6332 | 6418 | 4301 | 4324 | 4726 | 4328 | 4329 | 5389 | 4354 |
| | 5153 | 6314 | 6490 | 4783 | 6465 | 4472 | 4342 | 4859 | 10003 | 4218 | 4863 | 4216 |
| | 4230 | 4448 | 4741 | 4325 | 4337 | 4219 | 4573 | 4411 | 4473 | 4330 | 4338 | 4213 |
| | 4720 | 4513 | 4511 | 5388 | 5165 | 4341 | 4351 | 4214 | 4514 | 5244 | 4232 | 4949 |
| | 5219 | 4451 | 4347 | 5218 | 5217 | 5216 | 4542 | 4231 | 4215 | 4343 | 4607 | 4340 |
| | 5265 | 5148 | 4487 | 4217 | 4221 | 5146 | 5145 | 4452 | 5138 | 4353 | 5523 | 4483 |
| | 4446 | 4574 | 5251 | 5252 | 5250 | 5247 | 5516 | 4786 | 4334 | 4333 | 4785 | 6464 |
| | 6475 | 4705 | 5135 | 10005 | 4449 | 4947 | 6498 | 4925 | 4469 | 4413 | 5997 | 4946 |
| | 4944 | 4941 | 4939 | 4929 | 4930 | 4928 | 4194 | 4919 | 4918 | 4327 | 4466 | 5144 |
| | 32548 | 10534 | 23327 | 6476 | 4936 | 4934 | 4932 | 5478 | 5143 | 4572 | 4223 | 4943 |
| | 4923 | 4484 | 23328 | 4727 | 4150 | 5573 | 4942 | 4922 | 4339 | 4886 | 4455 | 4453 |
| | 5248 | 4323 | 6392 | 4512 | 5156 | 4445 | 5595 | 4945 | 4938 | 4415 | 4924 | 4352 |
| | 4901 | 6093 | 23314 | 4608 | 33053 | 33203 | 4822 | 5524 | 5553 | 6480 | 5481 | 4395 |
| | 10536 | 4427 | 5537 | 4447 | 10002 | 5482 | 5783 | 5162 | 5155 | 5139 | 4900 | 5246 |
| | 4920 | 4716 | 4857 | 4719 | 4948 | 4940 | 4921 | 5480 | 5137 | 4926 | 5142 | |
| | 6462 | 5463 | 5141 | 5249 | 4937 | 5163 | 5479 | 4718 | 5452 | 4220 | 4412 | 6043 |
| | 4419 | 10004 | 4931 | 4486 | 4474 | 4530 | 4478 | 4454 | 4485 | 4565 | 4935 | 5173 |
| | 4731 | 4717 | 5136 | 4933 | 4326 | 5154 | 5164 | 5888 | 4605 | 4927 | 4737 | 5171 |
| | 6009 | 6451 | 5152 | 5477 | 4787 | 4784 | 4229 | 4450 | 4410 | 4376 | 5476 | 5170 |
| | 6466 | 6218 | 4703 | 6463 | 5558 | 6235 | 5310 | 4704 | 4222 | 6003 | 6446 | 31946 |
| | 23324 | 23318 | 23320 | 23319 | 23312 | 23311 | 23310 | 23309 | 8162 | 6947 | 8699 | 8482 |
| | 8879 | 8875 | 8872 | 8877 | 8873 | 8971 | 8874 | 8161 | 8605 | 8876 | 8878 | 8917 |
| | 8958 | 8970 | 7480 | 7795 | 7447 | 8208 | 7415 | 7210 | 7414 | 8349 | 8842 | 8445 |
| | 8159 | 7417 | 8841 | 8511 | 8867 | 8157 | 8928 | 8916 | 8843 | 6730 | 6710 | 6594 |
| | 6923 | 15926 | 9585 | 23895 | 21925 | 707 | 585 | 32546 | 23330 | 18427 | 23321 | 20085 |
| | 33630 | 28779 | 17866 | 17865 | 17714 | 17713 | 18410 | 18409 | 18408 | 18412 | 18411 | 18407 |
| | 31143 | 17936 | 30905 | 11049 | 12154 | 14305 | 22992 | 32134 | 22556 | 32131 | 23107 | 32321 |
| | 32322 | 23109 | 32133 | 32137 | 32323 | 32136 | 32135 | 32326 | 26851 | | | |
| 787: | 17633 | 23325 | 23313 | 9952 | 23316 | 30105 | 13134 | 759 | 31135 | 17283 | 22061 | 26917 |
| | 25151 | 21076 | 17066 | 15784 | 23030 | 478 | 33625 | 33623 | 25059 | 22249 | 25301 | 31070 |
| | 33180 | 28669 | 28668 | 17680 | 29309 | 30015 | 31392 | 14451 | 11816 | 13265 | 13264 | |
| | 31578 | 17603 | 10474 | 33620 | 10561 | 10560 | 10559 | 14277 | 10539 | 16625 | 9971 | 24627 |
| | 19515 | 13000 | 13001 | 14795 | 871 | 907 | 906 | 905 | 1403 | 908 | 872 | 1825 |
| | 1398 | 1402 | 1126 | 1545 | 1401 | 1153 | 1456 | 1251 | 1544 | 1376 | 1414 | 1527 |
| | 1326 | 1382 | 1354 | 1494 | 1399 | 1370 | 1361 | 1341 | 1476 | 1587 | 1504 | 1817 |
| | 1623 | 1264 | 1639 | 1417 | 1653 | 1543 | 1651 | 1590 | 862 | 1233 | 1377 | 1715 |
| | 1400 | 33052 | 10540 | 23323 | 23063 | 2641 | 3109 | 3386 | 3273 | 2964 | 9770 | 2014 |
| | 2319 | 2635 | 3299 | 2144 | 2961 | 2963 | 2013 | 2015 | 2898 | 10538 | 2993 | 1853 |
| | 2061 | 2105 | 9769 | 3272 | 2485 | 2214 | 2718 | 2135 | 2962 | 2142 | 2617 | 2139 |
| | 2676 | 2490 | 2257 | 2965 | 2543 | 2966 | 2289 | 2277 | 3328 | 2134 | 2143 | 1928 |
| | 2724 | 1939 | 2130 | 2491 | 2967 | 1965 | 2140 | 2313 | 2308 | 2310 | 2128 | 2193 |
| | 1998 | 1850 | 2480 | 1912 | 2131 | 2192 | 1851 | 2316 | 2592 | 2241 | 2212 | 4052 |
| | 1849 | 2245 | 1996 | 4048 | 2997 | 2968 | 2118 | 3086 | 2133 | 1839 | 2129 | 2297 |
| | 2486 | 2176 | 4047 | 1894 | 2479 | 2172 | 2076 | 4046 | 1947 | 2208 | 4050 | |
| | 3066 | 2141 | 1892 | 1843 | 1913 | 2242 | 2179 | 1937 | 2655 | 2251 | 2290 | 2749 |
| | 2132 | 3023 | 4032 | 2373 | 4069 | 1896 | 2492 | 2075 | 2279 | 2299 | 2171 | 2577 |
| | 2320 | 2200 | 2155 | 2258 | 2180 | 4056 | 2174 | 1891 | 1966 | 4071 | 4057 | 1865 |
| | 4037 | 4033 | 1842 | 2000 | 3073 | 1863 | 4049 | 2191 | 1899 | 2779 | 1943 | 2712 |
| | 2234 | 2383 | 1841 | 9733 | 32132 | 23108 | 20083 | 18469 | 33178 | 14945 | 10076 | 13455 |
| | 19522 | 32011 | 32013 | 32012 | 16981 | 20107 | 20325 | 23293 | 13487 | 23019 | 14473 | 19901 |
| | 13486 | 15423 | 18523 | 10558 | 10557 | 20075 | 20076 | 33453 | 33451 | 33450 | 33452 | 33456 |
| | 33454 | 33455 | 32395 | 23029 | 31809 | 23027 | 23028 | 19519 | 19520 | 32550 | 19516 | 32551 |
| | 19518 | 32549 | 14435 | 19517 | 23322 | 23317 | 10537 | 21855 | 10535 | 23677 | 23329 | 23676 |
| | 23315 | 6270 | 6332 | 6418 | 4324 | 4328 | 4354 | 5153 | 6314 | 6490 | 4301 | 5247 |
| | 4783 | 6465 | 4472 | 4342 | 4859 | 10003 | 4218 | 4726 | 4863 | 4216 | 4230 | 4448 |
| | 4741 | 4325 | 4337 | 4219 | 4573 | 4329 | 4411 | 4473 | 4330 | 4338 | 4213 | 4720 |
| | 4513 | 4511 | 5389 | 5388 | 5165 | 4341 | 4351 | 4214 | 4514 | 5244 | 4232 | 5219 |

TABLE 2-continued

| SEQ ID NO: | homolog SEQ ID NOs | | | | | | | | | | |
|---|---|---|---|---|---|---|---|---|---|---|---|
| | 4451 | 4347 | 5218 | 5217 | 5216 | 4542 | 4231 | 4215 | 4343 | 4607 | 4340 | 5265 |
| | 5148 | 4487 | 4217 | 4221 | 5146 | 5145 | 4452 | 5138 | 4353 | 5523 | 4483 | 4446 |
| | 4574 | 5251 | 5252 | 5250 | 5516 | 4786 | 4334 | 4333 | 4785 | 6464 | 6475 | 4705 |
| | 5135 | 10005 | 4449 | 4947 | 6498 | 4925 | 4469 | 4413 | 4949 | 5997 | 4946 | 4944 |
| | 4941 | 4939 | 4929 | 4930 | 4928 | 4194 | 4919 | 4918 | 4466 | 5144 | 32548 | 10534 |
| | 23327 | 6476 | 4936 | 4934 | 4932 | 5478 | 4327 | 5143 | 4223 | 4943 | 4923 | 4484 |
| | 23328 | 4727 | 4572 | 4150 | 5573 | 4942 | 4922 | 4339 | 4886 | 4455 | 4453 | 5248 |
| | 4323 | 6392 | 4512 | 4445 | 5595 | 4945 | 4938 | 4415 | 4924 | 4352 | 4901 | 6093 |
| | 23314 | 33053 | 33203 | 4822 | 5553 | 6480 | 5481 | 4447 | 4395 | 10536 | 4427 | 5537 |
| | 4608 | 10002 | 5524 | 5482 | 5783 | 5156 | 5162 | 5155 | 5139 | 4900 | 5246 | 4920 |
| | 4716 | 5140 | 4857 | 4719 | 4948 | 4940 | 4921 | 5480 | 5137 | 4926 | 5142 | 6462 |
| | 5463 | 5141 | 5249 | 4937 | 5163 | 5479 | 4718 | 5452 | 4220 | 4412 | 6043 | 4419 |
| | 10004 | 4931 | 5171 | 4486 | 4474 | 4530 | 4478 | 4454 | 4485 | 4565 | 4935 | 5173 |
| | 4731 | 4717 | 5136 | 4933 | 4326 | 5154 | 5164 | 5888 | 4605 | 4927 | 4737 | 6009 |
| | 6451 | 5152 | 5477 | 4787 | 4784 | 4229 | 4450 | 4376 | 5476 | 5170 | 6466 | 4410 |
| | 6218 | 4703 | 5558 | 6463 | 6235 | 5310 | 4704 | 4222 | 6003 | 6446 | 31946 | 23324 |
| | 23318 | 23320 | 23319 | 23312 | 23311 | 23310 | 23309 | 8162 | 8699 | 8482 | 8879 | 8875 |
| | 8872 | 8877 | 8873 | 8971 | 8874 | 8161 | 8605 | 8876 | 8878 | 8917 | 8958 | 8970 |
| | 7480 | 7795 | 7447 | 8208 | 7210 | 8349 | 8842 | 7415 | 8445 | 7414 | 8159 | 7417 |
| | 8841 | 8511 | 8867 | 8157 | 8928 | 8916 | 8843 | 6730 | 6710 | 6594 | 15926 | 9585 |
| | 585 | 32546 | 23330 | 23321 | 713 | 16536 | 17866 | 17865 | 17714 | 17713 | 18410 | 18409 |
| | 18408 | 18412 | 18411 | 18407 | 17936 | 21501 | 32134 | 22556 | 32131 | 23107 | 32321 | 32322 |
| | 23109 | 32133 | 32137 | 32323 | 32136 | 32135 | 23326 | | | | | |
| 788: | 26640 | 26819 | 21171 | 14740 | 927 | 1073 | 3252 | 3785 | 3769 | 29079 | 28792 | 22049 |
| | 30195 | 5621 | 4459 | 4319 | 4881 | 5584 | 7263 | 7163 | 8454 | 6572 | 8252 | 8103 |
| | 31813 | 32253 | 16915 | 16914 | 15741 | 33480 | | | | | | |
| 789: | 23076 | 13558 | 12208 | 30243 | 25063 | 13096 | 32931 | 31898 | 23659 | 13638 | 13641 | 13642 |
| | 13643 | 10296 | 16103 | 16124 | 27858 | 27870 | 11204 | 24091 | 17336 | 12583 | 25767 | 21083 |
| | 13405 | 12667 | 12708 | 11287 | 18341 | 11704 | 13846 | 14195 | 14350 | 17738 | 14613 | 14669 |
| | 15165 | 15010 | 12921 | 32604 | 15092 | 15553 | 17557 | 15810 | 17015 | 15518 | 17815 | 28062 |
| | 21185 | 16848 | 29856 | 11960 | 19243 | 17186 | 18054 | 28587 | 16362 | 24772 | 18909 | 19050 |
| | 12068 | 18126 | 14016 | 18493 | 19395 | 19344 | 19877 | 19611 | 20473 | 25971 | 24476 | 9698 |
| | 20982 | 20573 | 26779 | 25536 | 30108 | 22775 | 20794 | 32204 | 23223 | 12343 | 30355 | 22323 |
| | 12273 | 33378 | 21633 | 22226 | 22879 | 21461 | 21368 | 21325 | 21234 | 21267 | 24054 | 24069 |
| | 23910 | 25795 | 27494 | 30094 | 28267 | 25123 | 26957 | 25685 | 27695 | 27764 | 25438 | 10741 |
| | 24982 | 27115 | 25292 | 31049 | 26478 | 26362 | 27938 | 27980 | 27241 | 9481 | 11466 | 16459 |
| | 16484 | 30635 | 12404 | 13326 | 16221 | 16187 | 12495 | 10365 | 26008 | 12614 | 12230 | 14909 |
| | 10836 | 27372 | 18011 | 28377 | 28138 | 28479 | 28314 | 13955 | 13669 | 30733 | 31280 | 20330 |
| | 29721 | 1713 | 1726 | 1016 | 1432 | 1338 | 1388 | 1580 | 1171 | 1384 | 11568 | 3867 |
| | 3866 | 29108 | 4144 | 6530 | 5662 | 4404 | 6634 | 7298 | 9223 | 32171 | 15974 | 22208 |
| | 27428 | 20621 | 11434 | 14062 | 28745 | 16512 | 12458 | 31177 | 30887 | 12158 | 21750 | 21495 |
| | 26836 | 31412 | 31893 | 28046 | 13639 | 13640 | 15389 | | | | | |
| 790: | 1284 | 1319 | 1383 | 1320 | 1406 | 1424 | 1485 | 29047 | 21951 | 30715 | 6350 | 5508 |
| | 4497 | 4600 | 5375 | 6240 | 4163 | 5196 | 4594 | 5067 | 6077 | 5376 | 6299 | 5276 |
| | 9148 | 8011 | 9151 | 9149 | 7507 | 9150 | 6925 | 7277 | 9218 | 7647 | 7648 | 9015 |
| | 7209 | 18514 | | | | | | | | | | |
| 791: | 1269 | 1212 | 1223 | 3777 | 3307 | 3778 | 2826 | 3306 | 2823 | 3199 | 3650 | 1845 |
| | 4038 | 22037 | 4370 | 6453 | 5816 | 6452 | 4644 | 7045 | 9117 | 7473 | 9118 | 8024 |
| | 7715 | 7043 | 7472 | 8692 | 9557 | 15732 | | | | | | |
| 792: | 23325 | 23313 | 9952 | 23316 | 814 | 759 | 31135 | 17283 | 22061 | 26917 | 23030 | 33180 |
| | 28669 | 28668 | 17680 | 29309 | 30013 | 30015 | 31392 | 14451 | 11816 | 13265 | 13264 | 31578 |
| | 17603 | 10474 | 33620 | 10561 | 10560 | 10559 | 14277 | 10539 | 16625 | 9971 | 24627 | 19515 |
| | 13000 | 13001 | 14795 | 871 | 907 | 906 | 905 | 1403 | 908 | 872 | 1825 | 1398 |
| | 1402 | 1126 | 1545 | 1401 | 1153 | 1456 | 1251 | 1544 | 1376 | 1414 | 1527 | 1326 |
| | 1382 | 1354 | 1494 | 1399 | 1370 | 1361 | 1341 | 1476 | 1587 | 1504 | 1817 | 1623 |
| | 1264 | 1639 | 1417 | 1653 | 1543 | 1651 | 1590 | 862 | 1233 | 1377 | 1715 | 1400 |
| | 33052 | 10540 | 23323 | 477 | 23063 | 2641 | 3109 | 3386 | 3273 | 2964 | 9770 | 2014 |
| | 2319 | 2635 | 3299 | 2144 | 2961 | 2963 | 2013 | 2015 | 2898 | 10538 | 2993 | 1853 |
| | 2061 | 2105 | 9769 | 3272 | 2485 | 2214 | 2718 | 2135 | 2962 | 2142 | 2617 | 2139 |
| | 2676 | 2490 | 2257 | 2965 | 2543 | 2966 | 2289 | 2277 | 3328 | 2134 | 1928 | 2143 |
| | 2724 | 1939 | 2130 | 2491 | 2967 | 1965 | 2140 | 2308 | 2313 | 2310 | 2128 | 2193 |
| | 1998 | 1850 | 2480 | 2131 | 1912 | 2192 | 1851 | 2592 | 2241 | 2212 | 4052 | 1849 |
| | 2316 | 2245 | 1996 | 4048 | 2997 | 2968 | 2118 | 3086 | 2133 | 1839 | 2129 | 2297 |
| | 2486 | 2176 | 2479 | 4047 | 1894 | 2172 | 2076 | 2727 | 1947 | 4046 | 2208 | 4050 |
| | 3066 | 2141 | 1892 | 1843 | 1913 | 2242 | 2179 | 1937 | 2655 | 2251 | 2290 | 2749 |
| | 2132 | 3023 | 4032 | 2373 | 4069 | 1896 | 2492 | 2075 | 2279 | 2299 | 2171 | 2577 |
| | 2320 | 2200 | 2155 | 2258 | 2180 | 4056 | 2174 | 1891 | 1966 | 4071 | 4057 | 1865 |
| | 4037 | 4033 | 1842 | 2000 | 3073 | 1863 | 4049 | 2191 | 1899 | 2779 | 1943 | 2712 |
| | 2234 | 2383 | 1841 | 2680 | 2164 | 2170 | 4043 | 2119 | 9733 | 32132 | 23108 |
| | 20083 | 18469 | 33178 | 14945 | 10076 | 13455 | 19522 | 32011 | 32013 | 32012 | 16981 | 20107 |
| | 20325 | 23293 | 13487 | 23019 | 14473 | 19901 | 13486 | 15423 | 18523 | 10558 | 10557 | 20075 |
| | 20076 | 33453 | 33451 | 33450 | 33452 | 33456 | 33454 | 33455 | 32395 | 23029 | 31809 | 23027 |
| | 23028 | 19519 | 19520 | 32550 | 19516 | 23549 | 19518 | 32549 | 14435 | 19517 | 23322 | 23317 |
| | 10537 | 21855 | 10535 | 23677 | 23329 | 23676 | 23315 | 6270 | 6332 | 6418 | 4324 | 4328 |
| | 4354 | 5153 | 6314 | 6490 | 4301 | 4783 | 6465 | 4472 | 4342 | 4859 | 10003 | 4218 |
| | 4726 | 4863 | 4216 | 4230 | 4448 | 4741 | 4325 | 4337 | 4219 | 4573 | 4329 | 4411 |
| | 4473 | 4330 | 4338 | 4213 | 4720 | 4513 | 4511 | 5389 | 5388 | 5165 | 4341 | 4351 |
| | 4214 | 4514 | 5244 | 4232 | 5219 | 4451 | 4347 | 5218 | 5217 | 5216 | 4542 | 4231 |

TABLE 2-continued

| SEQ ID NO: | homolog SEQ ID NOs | | | | | | | | | | |
|---|---|---|---|---|---|---|---|---|---|---|---|
| | 4215 | 4343 | 4607 | 4340 | 5265 | 5148 | 4487 | 4217 | 4221 | 5146 | 5145 | 4452 |
| | 5138 | 4353 | 5523 | 4483 | 4446 | 4574 | 5251 | 5252 | 5250 | 5247 | 5516 | 4786 |
| | 4334 | 4333 | 4785 | 6464 | 6475 | 4705 | 5135 | 10005 | 4449 | 4947 | 6498 | 4925 |
| | 4469 | 4413 | 4949 | 5997 | 4946 | 4944 | 4941 | 4939 | 4929 | 4930 | 4928 | 4194 |
| | 4919 | 4918 | 4466 | 5144 | 32548 | 10534 | 23327 | 6476 | 4936 | 4934 | 4932 | 5478 |
| | 4327 | 5143 | 4223 | 4943 | 4923 | 4484 | 23328 | 4727 | 4572 | 4150 | 5573 | 4942 |
| | 4922 | 4339 | 4886 | 4455 | 4453 | 5248 | 4323 | 6392 | 4512 | 4924 | 4445 | 5595 |
| | 4945 | 4938 | 4415 | 4352 | 4901 | 6093 | 23314 | 33053 | 33203 | 4822 | 5553 | 6480 |
| | 5481 | 4395 | 10536 | 4427 | 5537 | 4608 | 4447 | 10002 | 5524 | 5482 | 5783 | 5156 |
| | 5162 | 5155 | 5139 | 4900 | 5246 | 4920 | 4716 | 5140 | 4857 | 4719 | 4948 | 4940 |
| | 4921 | 5480 | 5137 | 4926 | 5142 | 6462 | 5463 | 5141 | 5249 | 4937 | 5163 | 5479 |
| | 4718 | 5452 | 4220 | 4412 | 6043 | 4419 | 10004 | 4931 | 4486 | 4474 | 4530 | 4478 |
| | 4454 | 4485 | 4565 | 4935 | 5173 | 4731 | 4717 | 5136 | 4933 | 4326 | 5154 | 5164 |
| | 5888 | 4605 | 4927 | 4737 | 5171 | 6009 | 6451 | 5152 | 5477 | 4787 | 4784 | 4229 |
| | 4450 | 4376 | 5476 | 5170 | 6466 | 6218 | 4703 | 5558 | 6463 | 6235 | 5310 | 4704 |
| | 4222 | 4410 | 6003 | 6446 | 6400 | 6525 | 4468 | 4355 | 4477 | 31946 | 23324 | 23318 |
| | 23320 | 23319 | 23312 | 23311 | 23310 | 23309 | 8162 | 8699 | 8482 | 8879 | 8875 | 8872 |
| | 8877 | 8873 | 8971 | 8874 | 8161 | 8605 | 8876 | 8878 | 8917 | 8958 | 8970 | 7480 |
| | 7795 | 8208 | 8349 | 8842 | 7417 | 8511 | 7447 | 8445 | 8159 | 8841 | 7210 | 7415 |
| | 7414 | 8867 | 8157 | 8928 | 8916 | 8843 | 6730 | 6710 | 6594 | 15926 | 9585 | 585 |
| | 32546 | 23330 | 23321 | 713 | 17866 | 17865 | 17714 | 17713 | 18410 | 18409 | 18408 | 18412 |
| | 18411 | 18407 | 17936 | 32134 | 22556 | 32131 | 23107 | 32321 | 32322 | 23109 | 32137 | 32133 |
| | 32323 | 32136 | 32135 | 23326 | 571 | 570 | | | | | | |
| 793: | 20321 | 20360 | 32862 | 19178 | 23392 | 29004 | 22060 | 29239 | 28934 | 5045 | 9346 | 8107 |
| | 7084 | 2074 | 2567 | 3096 | | | | | | | | |
| 794: | 32564 | 13550 | 20245 | 33307 | 567 | 759 | 33341 | 18655 | 11205 | 17417 | 25756 | 21049 |
| | 31288 | 18342 | 13010 | 10422 | 17048 | 15049 | 12897 | 15557 | 14155 | 22427 | 22473 | 15767 |
| | 19927 | 28079 | 16793 | 32373 | 32349 | 27571 | 667 | 29859 | 29886 | 11898 | 17143 | 18620 |
| | 18019 | 18086 | 28589 | 18669 | 16358 | 24713 | 18887 | 19124 | 14026 | 19819 | 19546 | 20345 |
| | 22982 | 25894 | 24315 | 33436 | 21635 | 23011 | 23268 | 23142 | 24052 | 23990 | 30171 | 25830 |
| | 24275 | 27690 | 27686 | 10713 | 25297 | 31056 | 26470 | 26512 | 26280 | 26298 | 26205 | 27236 |
| | 9468 | 16455 | 12535 | 17911 | 17912 | 10973 | 17860 | 28038 | 28362 | 28480 | 10421 | 31502 |
| | 17591 | 30666 | 18450 | 21141 | 33620 | 15384 | 14227 | 24140 | 24138 | 24615 | 32861 | 24635 |
| | 1722 | 871 | 907 | 906 | 905 | 3596 | 3922 | 3298 | 4065 | 1999 | 3802 | 2112 |
| | 2478 | 2458 | 3223 | 2907 | 3257 | 2855 | 21097 | 28638 | 32080 | 32030 | 28966 | 29316 |
| | 28967 | 32081 | 13496 | 11639 | 5238 | 5239 | 4212 | 5954 | 5557 | 5953 | 4671 | 4167 |
| | 5259 | 5281 | 6489 | 4211 | 5565 | 8406 | 8405 | 9287 | 8136 | 7241 | 7755 | 9166 |
| | 7798 | 7244 | 8868 | 8679 | 8824 | 8504 | 7110 | 6838 | 7131 | 18502 | 707 | 19280 |
| | 11091 | 9767 | 28686 | 29801 | 16557 | 12441 | 31171 | 31304 | 21519 | 24146 | 22203 | 11010 |
| | 12088 | 786 | 24933 | 31413 | 28781 | 13137 | | | | | | |
| 795: | 1813 | 858 | 1716 | 1482 | 1344 | 1734 | 885 | 877 | 3241 | 2618 | 2598 | 2597 |
| | 2194 | 3026 | 1859 | 4291 | 4791 | 4434 | 4792 | 4793 | 4307 | 4364 | 4531 | 8302 |
| | 7809 | 7407 | 8802 | 8840 | 8409 | 8125 | 9159 | 7408 | 7808 | 8803 | 6715 | 8939 |
| | 7157 | 6729 | 6578 | 7760 | 6681 | 7906 | 6717 | 8568 | | | | |
| 796: | 2470 | 2911 | 3434 | | | | | | | | | |
| 797: | 23595 | 24357 | 24395 | 26745 | 25551 | 22774 | 22931 | 32752 | 1004 | 1002 | 1003 | 1273 |
| | 859 | 1232 | 1797 | 1679 | 1142 | 894 | 1724 | 1243 | 1418 | 920 | 12755 | 14420 |
| | 2656 | 2077 | 13153 | 2639 | 3133 | 3134 | 2790 | 2725 | 2880 | 3621 | 2789 | 3055 |
| | 2016 | 2791 | 3056 | 1944 | 3135 | 11160 | 13281 | 24109 | 20061 | 28345 | 29636 | 31619 |
| | 14731 | 32944 | 5177 | 6298 | 4201 | 4738 | 5172 | 4526 | 5160 | 5418 | 6506 | 4755 |
| | 4709 | 4714 | 4525 | 4742 | 4567 | 5417 | 4467 | 6070 | 4710 | 6205 | 5303 | 4756 |
| | 8529 | 8443 | 8376 | 8378 | 8832 | 8375 | 8119 | 8377 | 8389 | 7609 | 8384 | 8392 |
| | 8386 | 8385 | 8886 | 8379 | 8380 | 9032 | 8381 | 8383 | 7697 | 6690 | 7310 | 7396 |
| | 8387 | 6563 | 7689 | 7930 | 7323 | 7941 | 7398 | 8001 | 8388 | 8079 | 7409 | 8382 |
| | 7664 | 7637 | 7983 | 7622 | 6695 | 7676 | 6674 | 8747 | 8391 | 7385 | 8177 | 8689 |
| | 8390 | 12490 | 20662 | 22159 | | | | | | | | |
| 798: | 21160 | 23464 | 24408 | 24537 | 24340 | 26791 | 26667 | 25617 | 25636 | 25632 | 22643 | 22765 |
| | 22766 | 32886 | 9795 | 23354 | 33524 | 28015 | 1127 | 31335 | 1979 | 1977 | 2465 | 3812 |
| | 2463 | 2751 | 3710 | 32423 | 32422 | 19902 | 32983 | 10176 | 20086 | 15242 | 15371 | 23679 |
| | 11429 | 23746 | 20853 | 5507 | 33095 | 33318 | 11328 | 20711 | 22972 | 9941 | 33059 | 10970 |
| | 10964 | 14417 | 32181 | | | | | | | | | |
| 799: | 10487 | 23509 | 24363 | 26688 | 22762 | 24127 | 1512 | 916 | 3735 | 3102 | 3800 | 31653 |
| | 5807 | 4781 | 6042 | 9980 | 20716 | 8548 | 7535 | | | | | |
| 800: | 954 | 970 | 913 | 1484 | 1974 | 3408 | 4335 | 5882 | 5356 | 5267 | 4399 | 6126 |
| | 4118 | 8918 | 8819 | 8818 | 13625 | | | | | | | |
| 801: | 31499 | 13975 | 4044 | 3481 | 29024 | 22504 | 29120 | 29028 | 28950 | 29119 | 7999 | 6757 |
| | 9796 | 15887 | 33562 | | | | | | | | | |
| 802: | 2819 | 2323 | 2096 | 3274 | 3456 | 29452 | 7682 | | | | | |
| 803: | 23407 | 17062 | 28074 | 23588 | 19495 | 24418 | 26769 | 25593 | 22668 | 23196 | 23210 | 24288 |
| | 24266 | 25274 | 1627 | 1342 | 15976 | 3193 | 3797 | 2525 | 2161 | 2228 | 21959 | 5602 |
| | 6501 | 5597 | 6500 | 8774 | 7650 | 7037 | 8645 | 8219 | 7038 | 8646 | 8535 | 22126 |
| | 28242 | 20635 | 20622 | 28054 | 20111 | 17874 | 31698 | | | | | |
| 804: | 24131 | 3008 | 17721 | | | | | | | | | |
| 805: | 23603 | 1701 | 1514 | 1569 | 3577 | 4090 | 3645 | 3370 | 2175 | 3210 | 3188 | 3371 |
| | 2974 | 3372 | 3646 | 6114 | 5811 | 8596 | 8255 | 8595 | 8566 | 24787 | | |
| 806: | 23574 | 31925 | 17683 | 15727 | 20147 | 1329 | 993 | 15426 | 18850 | 32010 | 31004 | 5731 |
| | 5951 | 6447 | 5413 | 6438 | 7307 | 6755 | 7303 | 8055 | 8361 | 7024 | 11226 | 3554 |

TABLE 2-continued

| SEQ ID NO: | homolog SEQ ID NOs | | | | | | | | | | |
|---|---|---|---|---|---|---|---|---|---|---|---|
| 807: | 33097 | 20849 | 27642 | 30282 | 30240 | 30224 | 13132 | 17606 | 26525 | 33232 | 33229 | 33222 |
| | 9939 | 10524 | 11177 | 11201 | 14858 | 31781 | 31783 | 33333 | 13412 | 12700 | 18337 | 13878 |
| | 11731 | 13896 | 32650 | 14210 | 23646 | 17743 | 17729 | 14617 | 14587 | 15152 | 14993 | 12916 |
| | 12880 | 17826 | 32618 | 15096 | 23893 | 15555 | 22898 | 15276 | 23774 | 27914 | 28072 | 28055 |
| | 16243 | 16297 | 28081 | 28102 | 28217 | 27150 | 29216 | 21896 | 31615 | 15634 | 26175 | 17151 |
| | 28535 | 18718 | 16370 | 24709 | 24747 | 18971 | 19079 | 12786 | 12823 | 12082 | 9905 | 18137 |
| | 18108 | 18209 | 18119 | 18157 | 18160 | 19374 | 19812 | 23468 | 19553 | 19534 | 19560 | 19549 |
| | 19545 | 19646 | 19605 | 22188 | 9824 | 24558 | 20546 | 20542 | 20543 | 25555 | 25525 | 23736 |
| | 22653 | 22743 | 22737 | 22647 | 23226 | 30353 | 33394 | 22078 | 23008 | 22224 | 22239 | 22238 |
| | 32033 | 21407 | 21476 | 21301 | 21369 | 21229 | 23251 | 23138 | 23156 | 28262 | 28259 | 27194 |
| | 23970 | 25180 | 26051 | 24657 | 25117 | 28291 | 28271 | 26963 | 25209 | 27685 | 27664 | 27677 |
| | 27687 | 27688 | 27733 | 27743 | 27770 | 25331 | 25476 | 13022 | 10762 | 10726 | 10692 | 10757 |
| | 27104 | 31045 | 26237 | 26284 | 26279 | 27977 | 27259 | 27274 | 29766 | 16472 | 29786 | 19904 |
| | 10414 | 13333 | 26096 | 26144 | 12512 | 12529 | 16057 | 16068 | 12606 | 12026 | 18640 | 12626 |
| | 12627 | 12625 | 12617 | 12243 | 14929 | 28199 | 27991 | 27373 | 27327 | 27342 | 28359 | 28431 |
| | 28475 | 28444 | 28295 | 28312 | 18445 | 9763 | 11089 | 30537 | 30536 | 33218 | 33197 | 33225 |
| | 33224 | 18434 | 29705 | 1260 | 1097 | 24955 | 11578 | 23112 | 3009 | 3906 | 2838 | 3702 |
| | 3151 | 11562 | 31475 | 29262 | 15349 | 23740 | 13454 | 6306 | 4114 | 5427 | 6307 | 6539 |
| | 4313 | 8373 | 8270 | 8374 | 7063 | 8642 | 20439 | 20690 | 13630 | 13668 | 24847 | 29502 |
| | 29501 | 29492 | 29494 | 29500 | 29499 | 29496 | 29495 | 29498 | 29497 | 29493 | 16573 | 12442 |
| | 33223 | 33230 | 33231 | 23763 | 31774 | 33508 | 31216 | 10127 | 33228 | 33226 | 33227 | 32314 |
| | 30896 | 30935 | 29978 | 12144 | 33221 | 33219 | 33220 | 9846 | 31448 | 31410 | 31428 | 28783 |
| 808: | 3618 | 2917 | 3062 | 2601 | 3633 | 3513 | 3635 | 3512 | 3958 | 3424 | 2929 | 3634 |
| | 2998 | 6118 | 5100 | 4556 | 4864 | 6308 | 4917 | 6174 | 5644 | 4373 | 4510 | 5062 |
| | 9081 | 9080 | 7986 | 7702 | 7984 | 8281 | 8223 | 7985 | 7130 | 8221 | 7268 | 6941 |
| | 8134 | 7091 | 8542 | 7090 | 8520 | 8222 | 7769 | | | | | |
| 809: | 13619 | 30218 | 28222 | 18224 | 25563 | 25824 | 25305 | 26105 | 27378 | 1248 | 968 | 1434 |
| | 1652 | 973 | 1470 | 1541 | 2818 | 3354 | 3422 | 29248 | 28939 | 29138 | 9366 | 16566 |
| 810: | 10126 | 1015 | 1634 | 2483 | 3784 | 3533 | 2066 | 3730 | 2544 | 3734 | 2070 | 3466 |
| | 3690 | 2788 | 2955 | 3302 | 3395 | 22493 | 29304 | 29303 | 29305 | 29299 | 29302 | 29300 |
| | 29301 | 21905 | 20580 | 20582 | 15331 | 30470 | 30476 | 30475 | 30474 | 30473 | 30469 | 30471 |
| | 30472 | 4990 | 8251 | 6784 | 6928 | 8953 | 6688 | 8551 | 8240 | 9104 | 9186 | 8980 |
| | 7279 | 8492 | 8891 | 7181 | 6664 | 7175 | 6752 | 6888 | 18524 | 21914 | 21909 | |
| 811: | 28661 | 22081 | 32388 | 1700 | 4042 | 2309 | 2163 | 4106 | 4602 | 4876 | 5579 | 5769 |
| | 5824 | 6940 | 8848 | 7991 | 24795 | 14778 | 20115 | 21697 | 15883 | | | |
| 812: | 10068 | 23518 | 24400 | 26713 | 25643 | 22795 | 10210 | 1519 | 1317 | 1279 | 2741 | 4094 |
| | 2870 | 2982 | 3121 | 3122 | 3168 | 4080 | 4079 | 29026 | 5646 | 5854 | 4839 | 5282 |
| | 4304 | 4829 | 16978 | 9173 | 8741 | 7070 | 8889 | 7088 | 9005 | 7634 | 22746 | 14258 |
| | 10069 | 10149 | 32837 | 32838 | | | | | | | | |
| 813: | 31895 | 31896 | 31897 | 12876 | 28112 | 15897 | 17447 | 18918 | 20560 | 12274 | 14918 | 16446 |
| | 1792 | 2349 | 2942 | 2647 | 3020 | 2666 | 1875 | 3079 | 2568 | 20257 | 29182 | 20258 |
| | 4187 | 4188 | 5991 | 6027 | 6454 | 4519 | 6832 | 8344 | 7362 | 8601 | 6726 | 18538 |
| | 31894 | | | | | | | | | | | |
| 814: | 33064 | 31460 | 13083 | 14736 | 15482 | 13829 | 33154 | 33160 | 33152 | 33578 | 33579 | 33582 |
| | 33583 | 33584 | 33585 | 33586 | 33587 | 33592 | 33590 | 33591 | 33593 | 33580 | 14177 | 10811 |
| | 10807 | 13080 | 14083 | 10074 | 10055 | 10057 | 15321 | 15316 | 10056 | 14783 | 13580 | 13582 |
| | 13587 | 13594 | 13588 | 13601 | 29353 | 15586 | 9927 | 9931 | 9935 | 9933 | 30720 | 15865 |
| | 11167 | 9794 | 33576 | 33575 | 10063 | 11880 | 10062 | 11879 | 10060 | 10061 | 11877 | 11878 |
| | 14337 | 25197 | 10237 | 10235 | 10234 | 10236 | 10231 | 10229 | 10230 | 31535 | 33542 | 33565 |
| | 33566 | 11697 | 11698 | 33535 | 33540 | 33543 | 33544 | 9765 | 9995 | 33538 | 33541 | 33539 |
| | 33548 | 33536 | 33546 | 33537 | 10438 | 33547 | 18251 | 18245 | 15486 | 19718 | 32105 | 10564 |
| | 14067 | 13443 | 33343 | 13445 | 9932 | 9928 | 9930 | 9934 | 14172 | 14173 | 14174 | 14175 |
| | 14178 | 14179 | 14180 | 14182 | 14183 | 14184 | 14186 | 14187 | 22043 | 9968 | 19140 | 22173 |
| | 21737 | 30480 | 32669 | 19143 | 22175 | 19172 | 19173 | 22168 | 19171 | 22176 | 23078 | 22169 |
| | 22177 | 10348 | 19282 | 22170 | 19175 | 22171 | 22812 | 31961 | 19184 | 22178 | 32784 | 19426 |
| | 19430 | 31995 | 22179 | 22172 | 19473 | 22180 | 17566 | 20201 | 9566 | 20202 | 20026 | 20082 |
| | 20192 | 31455 | 14068 | 14069 | 9828 | 9729 | 9728 | 9727 | 9726 | 15488 | 15490 | 31506 |
| | 10567 | 9829 | 9831 | 9833 | 9835 | 9836 | 9830 | 9838 | 11396 | 11821 | 14302 | 11397 |
| | 11398 | 11399 | 11400 | 11401 | 11403 | 11395 | 11404 | 11388 | 11390 | 11391 | 11392 | 11389 |
| | 11823 | 11824 | 11825 | 11826 | 22563 | 11827 | 22087 | 11828 | 11829 | 13612 | 21776 | 10571 |
| | 10568 | 10569 | 10570 | 19992 | 13603 | 20232 | 25369 | 20230 | 11334 | 11335 | 11336 | |
| | 11337 | 11338 | 11339 | 11340 | 11341 | 11342 | 11344 | 11345 | 11346 | 11348 | 11349 | 11350 |
| | 11351 | 11352 | 11353 | 11354 | 11355 | 11356 | 11357 | 11358 | 15327 | 11691 | 11699 | 11693 |
| | 11694 | 11688 | 11654 | 10648 | 10649 | 13084 | 15314 | 20844 | 20845 | 15982 | 15985 | 19437 |
| | 13212 | 13213 | 13214 | 11459 | 11460 | 11343 | 11347 | 14081 | 14082 | 19438 | 19445 | 13470 |
| | 25149 | 13593 | 14075 | 14078 | 14079 | 11652 | 11653 | 11655 | 15997 | 32764 | 32774 | 32776 |
| | 32780 | 32781 | 15322 | 15319 | 15320 | 16020 | 16016 | 16017 | 16018 | 16019 | 14784 | 15323 |
| | 15329 | 15312 | 15325 | 15313 | 15311 | 24164 | 15500 | 15501 | 15502 | 31994 | 15568 | 14098 |
| | 14102 | 13468 | 13471 | 13472 | 13473 | 14336 | 13502 | 13504 | 13507 | 13506 | 30739 | 13503 |
| | 13505 | 13508 | 13501 | 13497 | 13511 | 13509 | 13498 | 13499 | 13510 | 13512 | 13513 | 13500 |
| | 13827 | 13826 | 13828 | 13825 | 14113 | 23273 | 15310 | 15309 | 15324 | 15328 | 15318 | 15330 |
| | 15326 | 15315 | 19470 | 22808 | 14779 | 14781 | 14782 | 14786 | 14780 | 14785 | 19439 | 19440 |
| | 19447 | 32761 | 17259 | 20242 | 15799 | 15489 | 20904 | 20901 | 20905 | 20234 | 19510 | |
| | 23274 | 20899 | 20903 | 20898 | 20897 | 23115 | 31507 | 10658 | 30738 | 26168 | 30740 | 20900 |
| | 20603 | 20902 | 32325 | 20907 | 20908 | 20910 | 23833 | 23831 | 23832 | 22807 | 19711 | 32106 |
| | 13266 | 13442 | 13444 | 19993 | 32775 | 32769 | 32792 | 32789 | 32799 | 32768 | 32791 | 32788 |
| | 32796 | 20068 | 32770 | 32778 | 32782 | 32767 | 32787 | 20736 | 20740 | 20754 | 20755 | 20756 |
| | 20739 | 30481 | 20757 | 20741 | 20742 | 20758 | 20743 | 20744 | 20745 | 20746 | 20747 | 20760 |

TABLE 2-continued

| SEQ ID NO: | homolog SEQ ID NOs | | | | | | | | | | |
|---|---|---|---|---|---|---|---|---|---|---|---|
| | 20749 | 20750 | 20751 | 20752 | 20759 | 20753 | 20738 | 20737 | 20748 | 30129 | 23276 | 23275 |
| | 23272 | 13598 | 32785 | 32766 | 16736 | 22257 | 24163 | 24167 | 24168 | 31461 | 25510 | 25511 |
| | 25254 | 25253 | 31034 | 31390 | 15866 | 26169 | 26170 | 26165 | 26166 | 26167 | 9865 | 23345 |
| | 14101 | 30549 | 13081 | 28885 | 32786 | 28886 | 28887 | 28888 | 31550 | 28889 | 28890 | 23284 |
| | 32793 | 32795 | 32800 | 32120 | 24817 | 24819 | 24820 | 24818 | 32948 | 25409 | 25410 | 25411 |
| | 25412 | 25413 | 25414 | 25415 | 25416 | 25417 | 25418 | 25419 | 25420 | 25422 | 25423 | 23752 |
| | 13477 | 31807 | 31806 | 15752 | 10801 | 31627 | 13262 | 10804 | 9953 | 27523 | 20434 | 32121 |
| | 25509 | 29387 | 29648 | 29662 | 29642 | 29643 | 29644 | 29645 | 29646 | 29647 | 29649 | 29650 |
| | 29651 | 29653 | 29654 | 29656 | 29657 | 29659 | 29660 | 29661 | 29663 | 29664 | 29665 | 29658 |
| | 29666 | 29667 | 29668 | 29669 | 29670 | 29672 | 29673 | 25507 | 25508 | 29671 | 29388 | 10802 |
| | 25421 | 22574 | 12753 | 15298 | 18433 | 10170 | 11163 | 11144 | 20240 | 25373 | 10165 | 10167 |
| | 20239 | 10168 | 25370 | 10171 | 33041 | 10169 | 11219 | 23340 | 22811 | 20896 | 19174 | 20895 |
| | 17941 | 32658 | 32779 | 32797 | 28630 | 27137 | 13602 | 20150 | 10602 | 22174 | 28891 | 32773 |
| | 32803 | 17957 | 13590 | 19717 | 32657 | 25516 | 17942 | 19716 | 21508 | 33112 | 29652 | 29627 |
| | 29625 | 29626 | 29624 | 32760 | 17489 | 19289 | 13583 | 13584 | 31459 | 20909 | 32805 | 13599 |
| | 25405 | 20256 | 32783 | 29655 | 32823 | 20916 | 16731 | 16737 | 14076 | 20217 | 32552 | 31743 |
| | 25515 | 16758 | 31744 | 9912 | 32488 | 32489 | 32802 | 32947 | 11696 | 23733 | 13267 | 25512 |
| | 20906 | 32794 | 10533 | 31456 | 17279 | 33159 | 33158 | 26164 | 32771 | 32798 | 29371 | 10442 |
| | 10450 | 31566 | 23730 | 31569 | 31564 | 31565 | 11440 | 31567 | 31568 | 31571 | 31572 | 13951 |
| | 13633 | 13952 | 13953 | 13954 | 9565 | 32815 | 19449 | 13823 | 9921 | 9922 | 24160 | 31570 |
| | 10803 | 32772 | 32790 | 32762 | 32763 | 32989 | 32765 | 21586 | 22626 | 10446 | 28662 | 9445 |
| | 21505 | 32818 | 32819 | 32820 | 32821 | 32777 | 32822 | 32817 | 32659 | 17940 | 22905 | 10457 |
| | 18017 | 13595 | 11734 | 17491 | 19422 | 22573 | 10443 | 10444 | 10449 | 10445 | 10447 | 10448 |
| | 10451 | 10452 | 10454 | 10456 | 10455 | 10453 | 10458 | 10459 | 10863 | 15975 | 10810 | 16747 |
| | 10493 | 14074 | 13832 | 13831 | 13834 | 13835 | 13837 | 13839 | 13836 | 9832 | 13838 | 13833 |
| | 11051 | 18464 | 10809 | 11151 | 11152 | 10488 | 10489 | 10490 | 10491 | 9766 | 10492 | 15317 |
| | 10808 | 11448 | 10583 | 14317 | 14181 | 16754 | 22932 | 10563 | 33596 | 16729 | 16728 | 16732 |
| | 16730 | 16735 | 16733 | 16734 | 16738 | 16739 | 16740 | 16741 | 16742 | 16743 | 16744 | 16746 |
| | 16745 | 16748 | 16750 | 16751 | 16752 | 16749 | 16753 | 16755 | 16756 | 16757 | 16759 | 16760 |
| | 16761 | 16762 | 14419 | 16948 | 22903 | 23282 | 22902 | 23283 | 30479 | 14185 | 25377 | 23699 |
| | 23308 | 14253 | 19281 | 22386 | 14249 | 13613 | 13788 | 17958 | 17959 | 17960 | 17961 | 10166 |
| | 10532 | 9837 | 14418 | 25517 | 25513 | 23731 | 14321 | 19455 | 13600 | 13795 | 13794 | 14315 |
| | 14319 | 14865 | 14867 | 14866 | 14861 | 23706 | 32806 | 23705 | 23702 | 23703 | 23700 | 23704 |
| | 23701 | 23710 | 11695 | 11700 | 11692 | 11690 | 18447 | 32648 | 14848 | 14849 | 33153 | 33161 |
| | 33156 | 33155 | 23300 | 10233 | 30721 | 14176 | 14077 | 14084 | 23114 | 15755 | 25372 | 18018 |
| | 32801 | 32804 | 16526 | 24098 | 13589 | 32320 | 13581 | 23280 | 23281 | 13591 | 17267 | 17268 |
| | 17269 | 17270 | 17271 | 9764 | 17272 | 13597 | 17487 | 17488 | 17490 | 11393 | 17492 | 23307 |
| | 17493 | 17273 | 10562 | 9803 | 11820 | 22559 | 17686 | 17899 | 28646 | 25371 | 20238 | 25368 |
| | 20231 | 20241 | 25378 | 20235 | 25374 | 20237 | 25375 | 25367 | 20236 | 25376 | 19526 | 19525 |
| | 13790 | 13791 | 13596 | 25514 | 24097 | 24100 | 24099 | 25389 | 33545 | 25390 | 25392 | 25393 |
| | 25394 | 25395 | 32950 | 25396 | 25397 | 25398 | 25391 | 20215 | 20216 | 20218 | 20219 | 13634 |
| | 13592 | 13514 | 14080 | 28631 | 13824 | 28666 | 28667 | 24165 | 22131 | 28654 | 28648 | 11394 |
| | 11402 | 28651 | 28655 | 28649 | 28650 | 28652 | 28656 | 28657 | 28658 | 28647 | 22904 | 31745 |
| | 25400 | 30722 | 32949 | 32946 | 32951 | 32514 | 23301 | 9834 | 13585 | 10812 | 13586 | 24836 |
| | 24837 | 15487 | 33577 | 31968 | 11822 | 31962 | 31963 | 32467 | 32468 | 32479 | 32480 | 32481 |
| | 32482 | 32483 | 32484 | 32485 | 32486 | 25366 | 9929 | 10625 | 31512 | 31511 | 33567 | 27425 |
| | 22809 | 31971 | 24162 | 24166 | 28663 | 28665 | 28664 | 15873 | 11689 | 13082 | 31964 | 24161 |
| | 10240 | 10232 | 10238 | 10239 | 33157 | 31969 | 24169 | 31967 | 31966 | 32000 | 31970 | 31965 |
| | 31972 | 23732 | 20048 | | | | | | | | | |
| 815: | 32258 | 32318 | 13571 | 17631 | 17932 | 15884 | 759 | 10600 | 31135 | 11112 | 18499 | 18500 |
| | 31519 | 25401 | 17283 | 22611 | 19897 | 30308 | 31923 | 10250 | 10311 | 10322 | 27878 | 26917 |
| | 16138 | 16143 | 10891 | 25766 | 25165 | 25160 | 11861 | 21074 | 21056 | 12674 | 12712 | 31285 |
| | 12863 | 28227 | 31001 | 14215 | 14529 | 15670 | 15669 | 15715 | 17744 | 14500 | 15208 | 15131 |
| | 15101 | 19030 | 15560 | 22482 | 22445 | 15078 | 23778 | 23804 | 23787 | 23757 | 15290 | 14463 |
| | 15783 | 15802 | 23030 | 17031 | 30984 | 17761 | 17767 | 17850 | 17837 | 17848 | 27911 | 16239 |
| | 29828 | 16289 | 28087 | 18787 | 18777 | 18791 | 21183 | 26002 | 16859 | 16858 | 667 | 16824 |
| | 29840 | 15896 | 15911 | 19237 | 21892 | 17446 | 17475 | 17085 | 17154 | 12740 | 18076 | 18066 |
| | 18065 | 28595 | 28611 | 28511 | 19094 | 19109 | 19040 | 12065 | 9904 | 19330 | 19292 | 19308 |
| | 23718 | 23717 | 23615 | 19478 | 19695 | 31385 | 19574 | 19539 | 19594 | 9869 | 29924 | 25938 |
| | 29918 | 29910 | 25010 | 24504 | 9709 | 20993 | 20973 | 20424 | 20397 | 25045 | 25060 | 25046 |
| | 20811 | 23197 | 22363 | 22378 | 22302 | 10088 | 12282 | 22394 | 31108 | 22229 | 22273 | 24208 |
| | 24170 | 25915 | 24057 | 24047 | 27416 | 23951 | 23982 | 25178 | 26065 | 24645 | 24643 | 24674 |
| | 29993 | 26571 | 11677 | 10738 | 27048 | 27042 | 13770 | 31043 | 26481 | 26523 | 26368 | 26178 |
| | 26188 | 27946 | 27932 | 27953 | 16496 | 30670 | 12531 | 24584 | 10383 | 10390 | 16067 | 12634 |
| | 12633 | 12242 | 12258 | 10820 | 28194 | 28173 | 28156 | 28037 | 32498 | 32499 | 32497 | 28303 |
| | 33180 | 28669 | 28668 | 17245 | 9572 | 17680 | 29309 | 31487 | 14874 | 32812 | 30013 | 27405 |
| | 15274 | 28670 | 32512 | 11816 | 9753 | 13265 | 13264 | 31578 | 32974 | 17603 | 10474 | 33620 |
| | 14277 | 10539 | 17584 | 1210 | 871 | 907 | 906 | 905 | 1403 | 908 | 872 | 1825 |
| | 1398 | 1402 | 1126 | 1545 | 1401 | 1456 | 1251 | 1544 | 1376 | 1414 | 1527 | |
| | 1326 | 1382 | 1354 | 1494 | 1399 | 1361 | 1370 | 32976 | 25522 | 33052 | 10540 | 11571 |
| | 23063 | 9733 | 20083 | 18469 | 19522 | 32011 | 32013 | 32012 | 14473 | 17870 | 19901 | 13486 |
| | 18523 | 20075 | 20076 | 33453 | 33451 | 33450 | 33452 | 33456 | 33454 | 33455 | 32395 | 23029 |
| | 31809 | 24572 | 23027 | 23028 | 19519 | 19520 | 32550 | 19516 | 32551 | 19518 | 32549 | 14435 |
| | 19517 | 32975 | 11860 | 5875 | 21691 | 7095 | 15926 | 32496 | 11063 | 11062 | 11065 | 11066 |
| | 15273 | 33163 | 32475 | 14406 | 31124 | 30443 | 33113 | 18995 | 32546 | 15270 | 30654 | 24815 |
| | 14242 | 15061 | 33179 | 9800 | 25505 | 15341 | 23126 | 16519 | 29808 | 16569 | 12457 | 17866 |
| | 17865 | 17976 | 33060 | 17936 | 24811 | 22095 | 21497 | 30954 | 31602 | 11040 | 12095 | 31252 |
| | 12147 | 31271 | 12136 | 10621 | 15302 | 10484 | 26845 | 33466 | 28042 | 28039 | 13161 | |

TABLE 2-continued

| SEQ ID NO: | homolog SEQ ID NOs | | | | | | | | | | |
|---|---|---|---|---|---|---|---|---|---|---|---|
| 816: | 9778 | 19461 | 14276 | 3985 | 2460 | 28979 | 30205 | 30209 | 30206 | 22053 | 30210 | 29344 |
| | 29343 | 14571 | 5205 | 5791 | 9373 | 7915 | 7086 | 9416 | 28803 | 31935 | 33191 | |
| 817: | 22815 | 10867 | 29459 | 20918 | 1688 | 10511 | 11103 | 29077 | 22042 | 19356 | 24940 | 4252 |
| | 5545 | 4789 | 4121 | 4120 | 5631 | 4910 | 6541 | 6482 | 5855 | 5029 | 5750 | 31739 |
| 818: | 30499 | 13547 | 13527 | 17636 | 17211 | 27636 | 25062 | 23661 | 27848 | 23098 | 10323 | 9984 |
| | 11207 | 29938 | 17335 | 11852 | 24235 | 25163 | 30009 | 11709 | 13858 | 13941 | 13872 | 14218 |
| | 21528 | 22393 | 15695 | 19188 | 19187 | 15150 | 15187 | 14991 | 15027 | 14976 | 12936 | 12888 |
| | 32299 | 27147 | 14958 | 17499 | 14457 | 23772 | 30985 | 17802 | 17849 | 15644 | 27888 | 16232 |
| | 16245 | 31667 | 16708 | 16775 | 20203 | 25997 | 32360 | 27583 | 27586 | 16828 | 29892 | 25980 |
| | 11917 | 11963 | 19268 | 17181 | 17194 | 17089 | 12727 | 18671 | 20834 | 20835 | 18955 | 12794 |
| | 12072 | 18128 | 18155 | 13986 | 14049 | 19832 | 23493 | 19613 | 25969 | 20038 | 24329 | 20432 |
| | 20414 | 20409 | 20403 | 20530 | 26693 | 25540 | 25882 | 22672 | 22750 | 20796 | 20768 | 20814 |
| | 20812 | 32201 | 23224 | 30324 | 22343 | 21627 | 22269 | 22272 | 22251 | 22837 | 21376 | 21295 |
| | 21232 | 23134 | 23333 | 27432 | 27185 | 23912 | 26047 | 24649 | 25858 | 25113 | 24249 | 25783 |
| | 27710 | 27759 | 25327 | 25469 | 11676 | 13047 | 13020 | 11669 | 16523 | 11668 | 10709 | 27054 |
| | 31067 | 26418 | 26469 | 26212 | 26383 | 26191 | 27962 | 9456 | 9471 | 29761 | 30638 | 16207 |
| | 26129 | 12496 | 12530 | 12497 | 10412 | 26007 | 12630 | 12232 | 12268 | 21918 | 28172 | 28025 |
| | 27370 | 28484 | 28318 | 10576 | 32588 | 24568 | 20090 | 10788 | 14756 | 18013 | 13699 | 28509 |
| | 29600 | 29687 | 17080 | 32269 | 963 | 19459 | 12481 | 30012 | 30011 | 31575 | 11580 | 28505 |
| | 3830 | 3242 | 15216 | 28988 | 11868 | 23649 | 23648 | 23647 | 14467 | 11171 | 11301 | 5916 |
| | 5180 | 4902 | 5179 | 4295 | 8726 | 6988 | 7231 | 6899 | 6627 | 8021 | 7116 | 22558 |
| | 22926 | 29736 | 23650 | 9584 | 16934 | 19148 | 16633 | 24824 | 19081 | 33008 | 32518 | 33009 |
| | 32519 | 18399 | 22615 | 17265 | 28732 | 29807 | 16510 | 16523 | 31159 | 30912 | 30883 | 30940 |
| | 30846 | 31022 | 11038 | 12157 | 12140 | 12126 | 12115 | 19176 | 26871 | 31441 | 13204 | |
| 819: | 30246 | 25249 | 25240 | 27839 | 23239 | 14560 | 14558 | 14095 | 14724 | 16097 | 16123 | 25384 |
| | 11192 | 16135 | 10885 | 12548 | 20091 | 14810 | 13427 | 12681 | 12718 | 18318 | 14331 | 18546 |
| | 14523 | 16003 | 16004 | 16005 | 16008 | 16007 | 14483 | 15169 | 15013 | 32628 | 19003 |
| | 16261 | 25248 | 16667 | 16878 | 18624 | 21546 | 13636 | 21884 | 23695 | 17164 | 17456 | 18615 |
| | 18724 | 16371 | 31958 | 12825 | 25241 | 25242 | 25250 | 19393 | 19318 | 19882 | 20344 | 20552 |
| | 21721 | 12361 | 10085 | 12308 | 24198 | 30174 | 26085 | 23168 | 24255 | 28832 | 30146 | 24979 |
| | 27064 | 25300 | 27161 | 27248 | 9523 | 11510 | 30640 | 12415 | 13346 | 26158 | 24581 | 17916 |
| | 13279 | 14923 | 28204 | 18004 | 28456 | 25245 | 25246 | 25243 | 25244 | 735 | 1211 | 951 |
| | 1698 | 10478 | 3911 | 3297 | 2401 | 2057 | 3674 | 3401 | 3311 | 2847 | 2410 | 3675 |
| | 2380 | 2908 | 2849 | 3343 | 2403 | 4058 | 3455 | 3708 | 3050 | 2451 | 3583 | 2930 |
| | 10873 | 14816 | 14817 | 19358 | 17285 | 32471 | 5705 | 4400 | 4315 | 6432 | 4844 | 6110 |
| | 6331 | 5401 | 5501 | 5351 | 5402 | 6031 | 6032 | 7139 | 6981 | 8945 | 8705 | 9234 |
| | 8094 | 6980 | 7207 | 9233 | 8096 | 7598 | 6780 | 7835 | 8241 | 6790 | 6629 | 7571 |
| | 8668 | 21923 | 18426 | 33443 | 33438 | 33444 | 33442 | 33441 | 33439 | 33445 | 33440 | 33437 |
| | 31488 | 29411 | 29410 | 12454 | 16923 | 17679 | 17678 | 16921 | 16919 | 16920 | 16922 | 31202 |
| | 29166 | 29165 | 29164 | 29167 | 29163 | 21759 | 29155 | 26876 | | | | |
| 820: | 33138 | 17600 | 23295 | 31235 | 12431 | 30249 | 30285 | 30286 | 30229 | 13110 | 19705 | 20735 |
| | 21009 | 28880 | 28233 | 32870 | 14320 | 28877 | 28878 | 28879 | 31859 | 22093 | 18513 | 18512 |
| | 15641 | 22819 | 33474 | 32168 | 9847 | 33174 | 13257 | 15229 | 10066 | 11738 | 17379 | 30002 |
| | 13390 | 15135 | 14975 | 15563 | 33334 | 9761 | 25989 | 16819 | 16892 | 20510 | 11944 | 29595 |
| | 18675 | 16344 | 24710 | 18936 | 18116 | 18219 | 19815 | 23587 | 23545 | 19652 | 33347 |
| | 21543 | 21544 | 30110 | 32203 | 32210 | 23214 | 12280 | 12316 | 22206 | 22285 | 22839 | 21451 |
| | 21247 | 23157 | 27181 | 23943 | 30183 | 25102 | 30028 | 26945 | 25226 | 25474 | 27071 | 27041 |
| | 13744 | 13745 | 26514 | 26286 | 27963 | 27307 | 11511 | 29755 | 16475 | 13312 | 16186 | 26155 |
| | 26146 | 16185 | 24587 | 33061 | 27821 | 22818 | 31008 | 31010 | 28360 | 32879 | 21105 | 9956 |
| | 18629 | 11641 | 16433 | 29280 | 22816 | 28334 | 15264 | 6404 | 5723 | 28333 | 5072 | 6503 |
| | 5073 | 4461 | 6502 | 5020 | 4357 | 4401 | 7870 | 16952 | 21803 | 32264 | 16631 | 16630 |
| | 15606 | 16303 | 13255 | 23898 | 16555 | 9841 | 30956 | 25383 | 714 | | | |
| 821: | 22934 | 22928 | 24101 | 23343 | 33186 | 10437 | 11146 | 23481 | 23510 | 24503 | 26637 | 26763 |
| | 26716 | 25529 | 25533 | 25635 | 25585 | 22642 | 22791 | 16026 | 14572 | 22835 | 17718 | 17717 |
| | 19911 | 11812 | 18237 | 29308 | 18235 | 1238 | 29307 | 18234 | 18236 | 1082 | 984 | 1429 |
| | 1257 | 1533 | 1263 | 1493 | 1055 | 1172 | 1165 | 1493 | 1452 | 1568 | 1654 |
| | 18509 | 17705 | 11169 | 25386 | 3772 | 3393 | 3140 | 2512 | 32139 | 30702 | 21986 | 18394 |
| | 5690 | 5319 | 4887 | 5301 | 8153 | 9022 | 8825 | 8662 | 7508 | 6592 | 7866 | 7867 |
| | 24906 | 32750 | 32749 | 10080 | 19423 | 33034 | 23290 | 32111 | 15893 | 15266 | 33091 | 33533 |
| | 27009 | 27008 | 10638 | 10636 | 10637 | 13231 | 20661 | 20688 | 20692 | 20624 | 14259 | 22948 |
| | 10124 | 15499 | 15498 | 22167 | 31926 | 32895 | 23698 | 20933 | 10927 | 27461 | 31122 | 17045 |
| | 30830 | 29264 | 29263 | | | | | | | | | |
| 822: | 23513 | 24401 | 26743 | 26740 | 25534 | 22690 | 1337 | 1473 | 2845 | 2461 | 2868 | 30748 |
| | 20246 | 4318 | 4176 | 5968 | 6241 | 6256 | 6178 | 6378 | 9201 | 8195 | 10342 | 20639 |
| | 18467 | 17618 | 24625 | | | | | | | | | |
| 823: | 11555 | 11554 | 11553 | 22414 | 29412 | 14396 | 1045 | 979 | 24942 | 3435 | 29320 | 20304 |
| | 11556 | 32810 | 29207 | 18862 | 21913 | 14773 | | | | | | |
| 824: | 13539 | 23325 | 23313 | 9952 | 23316 | 13121 | 759 | 31135 | 17283 | 22061 | 26917 | 25765 |
| | 15782 | 23030 | 478 | 667 | 33625 | 30109 | 22279 | 31033 | 33180 | 28669 | 28668 | 17680 |
| | 29309 | 30013 | 30015 | 31392 | 14451 | 11816 | 13265 | 13264 | 31578 | 17603 | 10474 | 33620 |
| | 10561 | 10560 | 10559 | 14277 | 10539 | 16625 | 9971 | 24627 | 19515 | 13000 | 13001 | 14795 |
| | 871 | 907 | 906 | 905 | 1403 | 908 | 872 | 1825 | 1398 | 1402 | 1126 | 1545 |
| | 1401 | 1153 | 1456 | 1527 | 1251 | 1544 | 1376 | 1414 | 1527 | 1326 | 1354 | 1494 |
| | 1399 | 1370 | 1361 | 1341 | 1476 | 1587 | 1504 | 1817 | 1623 | 1264 | 1639 | 1417 |
| | 1653 | 1543 | 1651 | 1590 | 862 | 1233 | 1377 | 1715 | 1400 | 33052 | 10540 | 23323 |
| | 477 | 23063 | 2641 | 3109 | 3386 | 3273 | 2964 | 9770 | 2014 | 2319 | 2635 | 3299 |
| | 2144 | 2961 | 2963 | 2013 | 2015 | 2898 | 10538 | 2993 | 1853 | 2061 | 2105 | 9769 |
| | 3272 | 2485 | 2214 | 2718 | 2135 | 2962 | 2142 | 2617 | 2139 | 2676 | 2490 | 2257 |

TABLE 2-continued

| SEQ ID NO: | homolog SEQ ID NOs | | | | | | | | | | |
|---|---|---|---|---|---|---|---|---|---|---|---|
| | 2965 | 2543 | 2966 | 2289 | 2277 | 3328 | 2134 | 2143 | 1928 | 2724 | 1939 | 2130 |
| | 2491 | 2967 | 1965 | 2140 | 2308 | 2313 | 2310 | 2128 | 2193 | 1998 | 1850 | 2480 |
| | 2131 | 1912 | 2192 | 1851 | 2592 | 2241 | 2212 | 4052 | 1849 | 2316 | 2245 | 1996 |
| | 4048 | 2997 | 2968 | 2118 | 3086 | 2133 | 1839 | 2129 | 2297 | 2486 | 2176 | 4047 |
| | 1894 | 2479 | 2172 | 2076 | 2727 | 1947 | 4046 | 2208 | 4050 | 3066 | 2141 | 1892 |
| | 1843 | 1913 | 2242 | 2179 | 1937 | 2655 | 2251 | 2290 | 2749 | 2132 | 3023 | 4032 |
| | 2373 | 4069 | 1896 | 2492 | 2075 | 2279 | 2299 | 2171 | 2577 | 2320 | 2200 | 2155 |
| | 2258 | 2180 | 4056 | 2174 | 1891 | 1966 | 4071 | 4057 | 1865 | 4037 | 4033 | 1842 |
| | 2000 | 3073 | 1863 | 4049 | 2191 | 1899 | 2779 | 1943 | 2712 | 2234 | 2383 | 1841 |
| | 2680 | 2164 | 9733 | 32132 | 23108 | 20083 | 18469 | 33178 | 14945 | 10076 | 13455 | 19522 |
| | 32011 | 32013 | 32012 | 16981 | 20107 | 20325 | 23293 | 13487 | 23019 | 14473 | 19901 | 13486 |
| | 15423 | 18523 | 10558 | 10557 | 20075 | 20076 | 33453 | 33451 | 33450 | 33452 | 33456 | 33454 |
| | 33455 | 32395 | 23029 | 31809 | 23027 | 23028 | 19519 | 19520 | 32550 | 19516 | 32551 | 19518 |
| | 32549 | 14435 | 19517 | 23322 | 23317 | 10537 | 21855 | 10535 | 23677 | 23329 | 23676 | 23315 |
| | 6270 | 6332 | 6418 | 4324 | 4328 | 4354 | 5153 | 6314 | 6490 | 4301 | 4783 | 6465 |
| | 4472 | 4342 | 4859 | 10003 | 4218 | 4726 | 4863 | 4216 | 4230 | 4448 | 4741 | 4325 |
| | 4337 | 4219 | 4573 | 4329 | 4411 | 4473 | 4330 | 4338 | 4213 | 4720 | 4513 | 4511 |
| | 5389 | 5388 | 5165 | 4341 | 4351 | 4214 | 4514 | 5244 | 4232 | 5219 | 4451 | 4347 |
| | 5218 | 5217 | 5216 | 4542 | 4231 | 4215 | 4343 | 4607 | 4340 | 5265 | 5148 | 4487 |
| | 4217 | 4221 | 5146 | 5145 | 4452 | 5138 | 4353 | 5523 | 4483 | 4446 | 4574 | 5251 |
| | 5252 | 5250 | 5247 | 5516 | 4786 | 4334 | 4333 | 4785 | 6464 | 6475 | 4705 | 5135 |
| | 10005 | 4449 | 4947 | 6498 | 4925 | 4469 | 4413 | 4949 | 5997 | 4946 | 4944 | 4941 |
| | 4939 | 4929 | 4930 | 4928 | 4194 | 4919 | 4918 | 4466 | 5144 | 32548 | 10534 | 23327 |
| | 6476 | 4936 | 4934 | 4932 | 5478 | 4327 | 5143 | 4223 | 4943 | 4923 | 4484 | 23328 |
| | 4727 | 4572 | 4150 | 5573 | 4942 | 4922 | 4339 | 4886 | 4455 | 4453 | 5248 | 4323 |
| | 6392 | 4512 | 4445 | 5595 | 4945 | 4938 | 4415 | 4924 | 4352 | 4901 | 6093 | 23314 |
| | 33053 | 33203 | 4822 | 5553 | 6480 | 4427 | 4395 | 10534 | 5537 | 4608 | 4447 |
| | 10002 | 5524 | 5482 | 5783 | 5156 | 5162 | 5155 | 5139 | 4900 | 5246 | 4920 | 4716 |
| | 5140 | 4857 | 4719 | 4948 | 4940 | 4921 | 5480 | 5137 | 4926 | 5142 | 6462 | 5463 |
| | 5141 | 5249 | 4937 | 5163 | 5479 | 4718 | 5452 | 4220 | 4412 | 6043 | 4419 | 10004 |
| | 4931 | 4486 | 4474 | 4530 | 4478 | 4454 | 4485 | 4565 | 4935 | 5173 | 4731 | 4717 |
| | 5136 | 4933 | 4326 | 5154 | 5171 | 5164 | 5888 | 4605 | 4927 | 4737 | 6009 | 6451 |
| | 5152 | 5477 | 4787 | 4784 | 4229 | 4450 | 4376 | 5476 | 5170 | 6466 | 6218 | 4703 |
| | 4410 | 5558 | 6463 | 6235 | 5310 | 4704 | 4222 | 6003 | 6446 | 31946 | 23324 | 23318 |
| | 23320 | 23319 | 23312 | 23311 | 23310 | 23309 | 8162 | 8699 | 8482 | 8879 | 8875 | 8872 |
| | 8877 | 8873 | 8971 | 8874 | 8161 | 8605 | 8876 | 8878 | 8917 | 8958 | 8970 | 7480 |
| | 7795 | 7447 | 8208 | 7210 | 8349 | 8842 | 7415 | 8445 | 7414 | 8159 | 7417 | 8841 |
| | 8511 | 8867 | 8157 | 8928 | 8916 | 8843 | 6730 | 6710 | 6594 | 15926 | 9585 | 32546 |
| | 23330 | 23321 | 33630 | 713 | 16527 | 17866 | 17865 | 17714 | 17713 | 18410 | 18409 | 18408 |
| | 18412 | 18411 | 18407 | 17936 | 32134 | 22556 | 32131 | 23107 | 32321 | 32322 | 23109 | 32133 |
| | 32137 | 32323 | 32136 | 32135 | 23326 | | | | | | | |
| 825: | 9867 | 15214 | 32508 | 32541 | 31396 | 31395 | 33085 | 31631 | 13537 | 30220 | 14393 | 25814 |
| | 13139 | 9806 | 14111 | 33353 | 10943 | 12589 | 25146 | 21079 | 12856 | 13949 | 12872 | 17253 |
| | 18996 | 10855 | 22551 | 17500 | 15777 | 28210 | 27578 | 25985 | 29874 | 12002 | 18740 | 16356 |
| | 20244 | 18122 | 18168 | 19316 | 23542 | 23536 | 23539 | 23478 | 23530 | 23435 | 23501 | 23477 |
| | 23553 | 23415 | 19696 | 19626 | 19642 | 19542 | 20041 | 24423 | 24512 | 24424 | 24367 | 24428 |
| | 24514 | 24331 | 24540 | 24515 | 24556 | 24457 | 24492 | 24446 | 24442 | 20387 | 26753 | 26781 |
| | 26648 | 26789 | 26783 | 26759 | 26762 | 25566 | 25542 | 25040 | 22785 | 22786 | 22638 | 22735 |
| | 22801 | 22680 | 22736 | 22666 | 22803 | 22687 | 22663 | 22800 | 22733 | 22744 | 22715 | 22664 |
| | 20600 | 20797 | 32231 | 32216 | 22244 | 23242 | 24027 | 23133 | 23997 | 23921 | 23980 | 23938 |
| | 23976 | 25748 | 24292 | 30154 | 27719 | 10687 | 13762 | 31074 | 26285 | 26259 | 9455 | 11537 |
| | 30621 | 30674 | 12421 | 16179 | 12500 | 14922 | 28006 | 10941 | 10940 | 17689 | 853 | 2341 |
| | 3487 | 2372 | 3917 | 3602 | 3268 | 3340 | 3662 | 21932 | 24676 | 29351 | 32409 | 14110 |
| | 9949 | 4209 | 5848 | 9245 | 31496 | 20359 | 16951 | 11164 | 20700 | 14256 | 20695 | 20684 |
| | 20719 | 33346 | 21091 | 16560 | 16518 | 12434 | 31215 | 20612 | 11014 | 12085 | 12093 | 12131 |
| | 20122 | 15454 | | | | | | | | | | |
| 826: | 24101 | 23343 | 33186 | 10437 | 23481 | 23510 | 24503 | 26637 | 26763 | 26716 | 25529 | 25533 |
| | 25635 | 25585 | 22642 | 22791 | 16026 | 14572 | 22835 | 30667 | 32807 | 32808 | 19731 | 17718 |
| | 17717 | 19911 | 11812 | 20328 | 21730 | 18237 | 18235 | 1238 | 29307 | 18234 | 1082 | 29308 |
| | 18236 | 984 | 1429 | 1533 | 1263 | 1055 | 18509 | 17705 | 11169 | 3112 | 27404 | 32277 |
| | 14800 | 14801 | 10008 | 31020 | 11121 | 4696 | 24906 | 32750 | 32749 | 10080 | 33034 | 23290 |
| | 19423 | 32111 | 15893 | 15266 | 33091 | 33533 | 27009 | 27008 | 10638 | 10636 | 10637 | 13231 |
| | 20661 | 20688 | 20624 | 14259 | 20692 | 22948 | 10124 | 15499 | 15498 | 22167 | 31926 | 32895 |
| | 23698 | 20933 | 10927 | 31122 | 17045 | 30830 | 29264 | 29263 | 14745 | 17895 | 32510 | 23697 |
| 827: | 33464 | 13219 | 27846 | 14423 | 16009 | 14332 | 10304 | 10246 | 19158 | 31629 | 19719 | 18304 |
| | 11718 | 13892 | 12860 | 15168 | 15012 | 23770 | 30977 | 30975 | 17038 | 16988 | 17018 | 17825 |
| | 17758 | 17819 | 27922 | 16280 | 16259 | 16258 | 16260 | 29824 | 28083 | 28106 | 28107 | 28111 |
| | 28116 | 32355 | 20498 | 11985 | 19198 | 33211 | 18754 | 18752 | 18755 | 16383 | 18900 | 12836 |
| | 12843 | 12777 | 12833 | 12783 | 12792 | 18111 | 18194 | 19293 | 19349 | 19334 | 19300 | 23505 |
| | 23564 | 23491 | 19587 | 24452 | 24334 | 24337 | 24375 | 9684 | 9693 | 9710 |
| | 9686 | 20426 | 26774 | 26704 | 26652 | 26643 | 26813 | 26786 | 26773 | 26639 | 26718 | 25557 |
| | 22758 | 22681 | 22705 | 22767 | 20804 | 21652 | 22881 | 23984 | 23994 | 27504 | 27503 | 27680 |
| | 25664 | 26485 | 26311 | 26378 | 11492 | 11491 | 30671 | 12397 | 16163 | 12267 | 12240 | 11251 |
| | 10850 | 11245 | 10825 | 28192 | 28188 | 28012 | 21206 | 19766 | 13702 | 15924 | 19765 | 29735 |
| | 29729 | 29680 | 19469 | 19767 | 19768 | 1246 | 1007 | 957 | 1775 | 1132 | 1575 | 1135 |
| | 861 | 1561 | 921 | 1318 | 19710 | 29281 | 26915 | 19709 | 11607 | 3846 | 3314 | 20052 |

TABLE 2-continued

| SEQ ID NO: | homolog SEQ ID NOs | | | | | | | | | | |
|---|---|---|---|---|---|---|---|---|---|---|---|
| | 26884 | 29038 | 13476 | 20205 | 14633 | 4916 | 6021 | 7223 | 7724 | 6560 | 9820 | 32249 |
| | 9819 | 9919 | 31703 | 29741 | 29170 | 18525 | 20664 | 21165 | 28812 | 33551 | 33278 | 28752 |
| | 16506 | 29160 | 29159 | 29158 | 29162 | 29161 | 11042 | 12149 | 12984 | 12947 | 13215 | 28041 |
| | 13187 | 13208 | | | | | | | | | | |
| 828: | 17226 | 20243 | 13103 | 13092 | 23015 | 30695 | 32962 | 27016 | 29954 | 17395 | 17344 | 10911 |
| | 21088 | 13864 | 11733 | 11724 | 13921 | 14205 | 14551 | 14382 | 17732 | 14621 | 23082 | 22576 |
| | 15047 | 15102 | 19037 | 14128 | 15267 | 17824 | 27887 | 21186 | 16713 | 16690 | 27554 | 16898 |
| | 29897 | 20519 | 11923 | 11894 | 18088 | 11131 | 16378 | 24755 | 24686 | 19113 | 12838 | 9881 |
| | 13981 | 14002 | 14031 | 19887 | 19787 | 23431 | 23511 | 19483 | 19633 | 24502 | 24354 | 9701 |
| | 26733 | 26730 | 26816 | 25630 | 22634 | 12475 | 12337 | 22364 | 33429 | 21596 | 22950 | 32032 |
| | 21311 | 21355 | 21224 | 24066 | 25172 | 26064 | 26075 | 27487 | 27473 | 24290 | 24251 | 28286 |
| | 25679 | 25210 | 27698 | 27760 | 25320 | 25316 | 10727 | 10786 | 10668 | 10758 | 24985 | 13773 |
| | 26484 | 26483 | 26374 | 26249 | 26351 | 26240 | 27264 | 27302 | 11361 | 11370 | 9491 | 9539 |
| | 9514 | 16463 | 30673 | 30617 | 30603 | 16193 | 10396 | 30504 | 16047 | 16073 | 16084 | 12637 |
| | 12231 | 14913 | 10828 | 27387 | 28373 | 28387 | 28483 | 28317 | 10430 | 15372 | 9715 | 11618 |
| | 11582 | 11633 | 22149 | 22147 | 5798 | 5280 | 5185 | 4523 | 4648 | 6159 | 9131 | 8618 |
| | 7105 | 10915 | 9783 | 18858 | 13462 | 20686 | 20353 | 27469 | 28712 | 12451 | 31224 | 31153 |
| | 31166 | 31296 | 31309 | 20858 | 25015 | 26835 | 31440 | 17929 | | | | |
| 829: | 3442 | 4083 | 3365 | 5048 | 8485 | 7566 | 8135 | 8611 | 8670 | 7232 | | |
| 830: | 21172 | 32522 | 28785 | 21173 | 2511 | 4084 | 29313 | 29368 | 29369 | 5363 | 5748 | 6247 |
| 831: | 24553 | 22662 | 1148 | 967 | 3535 | 3536 | 3072 | 3520 | 3521 | 2593 | 32089 | 29191 |
| | 4236 | 5923 | 5942 | 5821 | 8249 | 7729 | 7956 | 7420 | 20631 | 16624 | 14959 | |
| 832: | 18242 | 33208 | 18244 | 1195 | 1387 | 3283 | 18241 | 18243 | | | | |
| 833: | 23508 | 24493 | 24364 | 26817 | 25581 | 15308 | 15306 | 15757 | 1464 | 10654 | 10655 | 32020 |
| | 13804 | 14099 | 14106 | 16039 | 15954 | 29103 | 14250 | 32577 | 32579 | 32578 | 33030 | 32993 |
| | 14433 | 21931 | 15481 | 8420 | 9181 | 8553 | 8287 | 8932 | 9132 | 7992 | 7488 | 9164 |
| | 7016 | 23337 | 9940 | 32666 | | | | | | | | |
| 834: | 22392 | 27515 | 1425 | 1436 | 2528 | 2186 | 3164 | 2783 | 3979 | 3980 | 2780 | 3088 |
| | 3416 | 2431 | 3119 | 3415 | 2781 | 10950 | 29397 | 31772 | 6202 | 5229 | 5955 | 4125 |
| | 4559 | 6414 | 4560 | 4558 | 6354 | 5956 | 5183 | 4627 | 4423 | 5184 | 4615 | 4471 |
| | 8870 | 8120 | 7751 | 9121 | 8635 | 8636 | 8637 | 9092 | 15376 | | | |
| 835: | 26624 | 25526 | 22708 | 1510 | 2259 | 2626 | 3809 | 3745 | 2560 | 3092 | 3808 | 2629 |
| | 28961 | 21960 | 5976 | 5967 | 5122 | 5998 | 5124 | 5125 | 5123 | 6461 | 4868 | 7863 |
| | 7059 | 9108 | 8354 | 7880 | 7194 | 7882 | 7881 | 6739 | 20681 | 30212 | 15296 | 10919 |
| | 30208 | | | | | | | | | | | |
| 836: | 23512 | 24443 | 26761 | 26766 | 25567 | 22771 | 22777 | 26910 | 1594 | 1083 | 3827 | 3238 |
| | 3278 | 3355 | 1861 | 4025 | 28970 | 29044 | 29055 | 11140 | 4250 | 6092 | 5911 | 5466 |
| | 5128 | 6468 | 6439 | 4508 | 7251 | 8035 | 8273 | 8644 | 7963 | 7823 | 8173 | 6939 |
| | 6998 | 7089 | 8440 | 7492 | 6979 | 7020 | 9977 | 31536 | 9446 | 20657 | | |
| 837: | 3462 | | | | | | | | | | | |
| 838: | 24435 | 26807 | 25569 | 22665 | 878 | 1230 | 1567 | 2386 | 4063 | 3236 | 1953 | 6005 |
| | 4251 | 4369 | 6646 | 6869 | 9419 | 8994 | 6970 | 8853 | 8852 | 23080 | 10428 | 20650 |
| | 15385 | 14776 | | | | | | | | | | |
| 839: | 20536 | 17641 | 17639 | 23484 | 24336 | 24495 | 26738 | 26742 | 25554 | 25621 | 22674 | 19998 |
| | 1525 | 3617 | 3598 | 3581 | 17684 | 9785 | 16937 | 23348 | 23347 | 5374 | 5889 | 6437 |
| | 5527 | 6505 | 5785 | 7354 | 6647 | 7695 | 6786 | 7705 | 7787 | 33089 | 10329 | 16944 |
| | 14868 | 11792 | 22094 | 20706 | 18533 | 14316 | 17263 | 33329 | 32278 | 15415 | 14833 | |
| 840: | 1276 | 1750 | 2527 | 2691 | 2396 | 3545 | 2243 | 3698 | 2526 | 3766 | 2685 | 1858 |
| | 3464 | 3217 | 1987 | 2092 | 4422 | 4598 | 8054 | 7160 | 8736 | 7377 | 7919 | 8826 |
| | 7667 | | | | | | | | | | | |
| 841: | 1265 | 1303 | 3402 | 2876 | 3505 | 2669 | 3611 | 3610 | 28920 | 23341 | 29085 | 6369 |
| | 6296 | 4970 | 6155 | 5847 | 6053 | 7214 | 6724 | 6766 | 8833 | 9018 | 15416 | 15404 |
| | 14163 | 29326 | | | | | | | | | | |
| 842: | 23429 | 24531 | 25641 | 22671 | 19739 | 32832 | 1439 | 2759 | 3653 | 3137 | 2252 | 4061 |
| | 2160 | 28791 | 28948 | 5768 | 5088 | 32712 | | | | | | |
| 843: | 24760 | 12788 | 19866 | 23630 | 24333 | 26671 | 22782 | 25741 | 28378 | 15419 | 19164 | 21695 |
| | 9562 | 15417 | 16642 | 22552 | 1770 | 1335 | 3198 | 3856 | 2352 | 2638 | 2956 | 2363 |
| | 3751 | 2553 | 2552 | 3301 | 31927 | 20301 | 29029 | 11295 | 20449 | 22927 | 32869 | 20615 |
| | 6654 | 6672 | 7315 | 7990 | | | | | | | | |
| 844: | 25494 | 19361 | 22908 | 5607 | 4991 | 4204 | 5766 | 7666 | | | | |
| 845: | 33086 | 13219 | 20847 | 18516 | 18767 | 10059 | 10799 | 27846 | 27836 | 18656 | 14423 | 10277 |
| | 10285 | 12465 | 29593 | 17361 | 17373 | 17324 | 17398 | 17371 | 17333 | 10898 | 11233 | 13622 |
| | 13890 | 12860 | 11718 | 13892 | 14206 | 14537 | 23645 | 15694 | 15700 | 15168 | 15166 | 14979 |
| | 15012 | 19021 | 17558 | 17544 | 17556 | 17512 | 15289 | 23755 | 23791 | 15284 | 23812 | 30966 |
| | 17797 | 16280 | 16781 | 16770 | 16660 | 32355 | 27596 | 27577 | 16836 | 20492 | 29871 | 20486 |
| | 11966 | 11999 | 11951 | 19216 | 19242 | 17485 | 20263 | 33211 | 18725 | 16383 | 24780 | 24692 |
| | 24781 | 18929 | 18925 | 12769 | 9907 | 18197 | 14043 | 14056 | 19889 | 19794 | 19890 | 23507 |
| | 19576 | 19630 | 19679 | 25002 | 22977 | 20426 | 20804 | 12477 | 22356 | 12311 | 21600 | 21652 |
| | 21634 | 22234 | 22881 | 24191 | 23164 | 28253 | 27201 | 27419 | 23935 | 23946 | 23984 | 23994 |
| | 26050 | 25796 | 24667 | 25093 | 25838 | 30080 | 25074 | 30083 | 25073 | 30063 | 25114 | 30065 |
| | 25091 | 25112 | 30142 | 25206 | 27680 | 27708 | 27785 | 27820 | 27819 | 27723 | 27742 | 27741 |
| | 27804 | 27744 | 27727 | 27793 | 27772 | 25467 | 13034 | 26529 | 13737 | 13757 | 13743 | 13753 |
| | 26415 | 26452 | 26460 | 26281 | 26370 | 26254 | 26215 | 26281 | 27275 | 27292 | 27276 | |
| | 29775 | 16474 | 16461 | 29790 | 29788 | 29779 | 30671 | 12397 | 16177 | 31811 | 10382 | 12246 |
| | 12221 | 12263 | 28170 | 28012 | 28403 | 11435 | 11545 | 33047 | 13259 | 9866 | 13674 | 24915 |
| | 14392 | 15924 | 32274 | 16452 | 16415 | 16402 | 19469 | 17975 | 17582 | 4055 | 2873 | 14286 |
| | 29349 | 22503 | 29101 | 22502 | 4878 | 6248 | 6186 | 5011 | 6477 | 5649 | 4552 | 5092 |
| | 5449 | 5010 | 6424 | 6122 | 6054 | 4549 | 4496 | 5428 | 6420 | 4105 | 6315 | 4358 |

TABLE 2-continued

| SEQ ID NO: | homolog SEQ ID NOs | | | | | | | | | | |
|---|---|---|---|---|---|---|---|---|---|---|---|
| | 4753 | 4285 | 4524 | 4553 | 6516 | 5657 | 7237 | 7301 | 8904 | 7294 | 9067 | 9385 |
| | 7586 | 7574 | 6803 | 9398 | 6930 | 7824 | 7615 | 8685 | 8448 | 8536 | 8777 | 8447 |
| | 7425 | 7302 | 8191 | 10465 | 32249 | 20664 | 33551 | 13696 | 17439 | 31378 | 9964 | 31503 |
| | 20262 | 28681 | 28735 | 28730 | 20367 | 28694 | 28729 | 16506 | 25359 | 33257 | 30934 | 30930 |
| | 24911 | 15588 | 20917 | 11031 | 12125 | 12967 | 12981 | 10614 | 22996 | 13215 | 28041 | 13157 |
| | 12464 | | | | | | | | | | | |
| 846: | 27631 | 27617 | 30263 | 30275 | 27471 | 9768 | 32586 | 15944 | 21775 | 32270 | 25905 | 25906 |
| | 10908 | 24239 | 19444 | 19442 | 15268 | 19443 | 19446 | 19451 | 13408 | 13230 | 18336 | 13910 |
| | 11728 | 14875 | 24987 | 21025 | 23642 | 31931 | 14490 | 15203 | 14985 | 12900 | 19436 | 19441 |
| | 19448 | 31018 | 31017 | 31016 | 19010 | 15539 | 32123 | 14135 | 15803 | 30971 | 17809 | 27882 |
| | 16717 | 32358 | 27570 | 19210 | 21856 | 17454 | 20604 | 16359 | 16353 | 18978 | 12808 | 12057 |
| | 18195 | 13992 | 19314 | 19843 | 19880 | 19753 | 17982 | 20568 | 20818 | 23216 | 21620 | 21446 |
| | 21336 | 23153 | 29486 | 23954 | 23963 | 26959 | 25701 | 25313 | 25447 | 11684 | 10733 | 30162 |
| | 27105 | 27061 | 26438 | 26350 | 26186 | 27951 | 27220 | 9480 | 9517 | 12034 | 11540 | 29762 |
| | 30592 | 13329 | 16204 | 16176 | 16173 | 26120 | 12521 | 26034 | 13485 | 28031 | 27987 | 28018 |
| | 27328 | 27354 | 18010 | 20073 | 28356 | 28474 | 28310 | 11543 | 19454 | 19453 | 23353 | 9954 |
| | 32122 | 9723 | 14335 | 14636 | 33040 | 28789 | 16404 | 32661 | 1010 | 31734 | 3348 | 3763 |
| | 2700 | 2047 | 29372 | 9985 | 20726 | 23289 | 21530 | 19450 | 4978 | 4625 | 4171 | 5717 |
| | 5235 | 5169 | 9204 | 7768 | 8465 | 9420 | 7557 | 18511 | 18465 | 14864 | 15872 | 19452 |
| | 28733 | 31197 | 31176 | 31199 | 30907 | 31599 | 31023 | 26549 | 26548 | 26550 | 12129 | 12975 |
| | 21745 | 16597 | 12178 | 22530 | | | | | | | | |
| 847: | 12213 | 12204 | 27624 | 18668 | 10626 | 21672 | 33598 | 19274 | 14517 | 33505 | 15594 | 17608 |
| | 10227 | 10241 | 10339 | 23097 | 30302 | 29568 | 11212 | 14422 | 24084 | 17354 | 17391 | 12546 |
| | 24838 | 24227 | 24243 | 21075 | 21080 | 26552 | 13409 | 19744 | 18302 | 13900 | 13936 | 11710 |
| | 13860 | 13901 | 13906 | 26882 | 13228 | 21039 | 18544 | 27120 | 17059 | 32887 | 27459 | 14504 |
| | 15177 | 15179 | 15189 | 15018 | 15020 | 15029 | 12927 | 12932 | 32307 | 32298 | 32603 | 32601 |
| | 15526 | 20106 | 15084 | 15285 | 32417 | 15770 | 15523 | 15514 | 16679 | 16799 | 16790 | 32374 |
| | 27544 | 16823 | 16886 | 29867 | 20516 | 29884 | 20523 | 29887 | 11896 | 11996 | 11890 | 11887 |
| | 12011 | 11900 | 21889 | 17182 | 17139 | 12725 | 16320 | 24765 | 24716 | 19054 | 12784 | 12821 |
| | 12800 | 12053 | 18176 | 18131 | 18170 | 18135 | 18151 | 18134 | 14021 | 14045 | 14029 | 14033 |
| | 18489 | 19871 | 19824 | 19838 | 23606 | 23414 | 19489 | 20475 | 20007 | 15746 | 24387 | 24373 |
| | 24463 | 24539 | 20567 | 20563 | 26700 | 22716 | 21728 | 20767 | 12473 | 23203 | 12353 | 30319 |
| | 22340 | 33383 | 21625 | 21611 | 21667 | 21806 | 22290 | 22227 | 22857 | 21430 | 21344 | 21266 |
| | 23257 | 23260 | 25911 | 28261 | 27417 | 25170 | 25739 | 29984 | 24672 | 25119 | 25842 | 25862 |
| | 25127 | 26960 | 27666 | 27691 | 27735 | 27781 | 25460 | 25425 | 25333 | 25436 | 11667 | 11670 |
| | 13041 | 11665 | 10753 | 10766 | 10684 | 10750 | 10760 | 10705 | 10686 | 10659 | 10751 | |
| | 10748 | 10789 | 24968 | 13759 | 25278 | 26435 | 26424 | 26510 | 26429 | 26518 | 26463 | 26461 |
| | 26475 | 26214 | 26229 | 26270 | 26290 | 26338 | 26319 | 26250 | 26181 | 27271 | 27234 | 27228 |
| | 9477 | 9465 | 9499 | 11493 | 12384 | 13330 | 16224 | 26092 | 10411 | 26024 | 26036 | 16043 |
| | 16042 | 26041 | 26014 | 12635 | 12238 | 12244 | 28009 | 28016 | 27384 | 27358 | 27386 | 27362 |
| | 28407 | 28422 | 28127 | 28493 | 28323 | 17248 | 17574 | 33495 | 33561 | 30395 | 13650 | 13688 |
| | 30766 | 18504 | 24025 | 29725 | 29688 | 29703 | 10205 | 17586 | 11119 | 16638 | 10048 | 890 |
| | 1506 | 32038 | 27443 | 18540 | 32399 | 14877 | 14883 | 11614 | 11637 | 3831 | 2926 | 18393 |
| | 22153 | 22142 | 14412 | 19769 | 10463 | 5576 | 5577 | 9811 | 22924 | 31711 | 31710 | 31913 |
| | 23177 | 23708 | 21004 | 30746 | 21553 | 30485 | 31875 | 28693 | 12864 | 31220 | 27143 | 21496 |
| | 30941 | 22109 | 21747 | 21512 | 16599 | 12180 | 26863 | 31421 | 29374 | 8271 | 6929 | 7057 |
| | 7134 | 9250 | 8046 | 8817 | 7010 | | | | | | | |
| 848: | 23424 | 23631 | 24458 | 24365 | 24542 | 26725 | 25648 | 25658 | 25561 | 22790 | 22732 | 11332 |
| | 13079 | 15861 | 22122 | 32162 | 1121 | 1516 | 883 | 25335 | 26913 | 3890 | 26914 | 2270 |
| | 2975 | 3467 | 2976 | 2574 | 3889 | 2114 | 2196 | 10573 | 5525 | 4862 | 33119 | 31695 |
| | 18468 | 10548 | 14255 | 13463 | 30559 | 7333 | 22136 | 8673 | | | | |
| 849: | 30228 | 30223 | 14367 | 14626 | 19301 | 29967 | 26073 | 25482 | 27924 | 9518 | 14925 | |
| 850: | 1133 | 1447 | 2484 | 3027 | 2104 | 1902 | 3091 | 3191 | 3156 | 2253 | 3451 | 3460 |
| | 2436 | 2684 | 3469 | 2274 | 3465 | 1975 | 3423 | 2124 | 3656 | 2273 | 2169 | 2594 |
| | 2756 | 2240 | 2437 | 3657 | 1883 | 2101 | 2595 | 2745 | 5859 | 5497 | 5187 | 5032 |
| | 6150 | 6109 | 5454 | 6429 | 6374 | 5708 | 5517 | 5019 | 4577 | 8047 | 7281 | 7161 |
| | 8192 | 7112 | 8830 | 7500 | 7686 | | | | | | | |

SEQUENCE LISTING (33637 sequences)

SEQ ID NO: 1 - DNA, 582 bp, Arabidopsis thaliana
cggtcagatcaaaatcagaatcagaatcaaatttctcgtcgtgtcggagtaaatcaagccatggattccggaaccaaagtgaagaaaggagccgctggaagaagaagtggtggaggtcctaagaagaaaccggtttcccgttcggttaaatccggtctacagtttcctgtcggtaggatcggtcggtatcttaagaaaggtcgttattcgaagcgtgtcggaaccggagctccggtctatctcgccgccgtcctcgagtatcttgctgctgaggttctcgagcttgctggtaacgctgcaagagataacaaaaagaaccgtattataccacgccatgttctattagcggtgaggaacgacgaggagctagggacactactcaaaggcgtaaccattgcacacggcggtgttttaccaaacataaacccaatactcctcccaaagaagtctgagaaagcagcttcaactacaaaaacacccaaatcaccatcaaaggcaaccaaatcccctaagaaatcttagtacttctttcttcattcctctgtataacctactgtttctatctctctgtacgtttctctg

SEQ ID NO: 2 - DNA, 348 bp, Arabidopsis thaliana
atgccgtgcctcaacctctccaccaacgttaaccttgacggcgtcgatacatcttccattctctcggaagcttcctccaccgtcgcgaaaatcatcggcaagcctgagaactatgtgatgattgtcttgaaaggctcagtgcctatgtcatttggcgggaccgaggatcctgcagcttatggtgaattagtttctatcggtggccttaatgcggatgtgaacaagaagctaagcgctgctgtttccgccattcttgagactaagctatcggtgcccaagtctcgattcttcctcaagttttatgacaccaagggatccttctttggttggaacggggcgactctttaa

SEQ ID NO: 3 - DNA, 1190 bp, Arabidopsis thaliana
ttaattaaatttgggacaacaaggatcactcatggcagtggtggatgttcatcgtttcgctgagtcaatcacttgccatgcttggagtcctgatctctccatggttgctctctgtcctaacaacactgaagttcatatctataaatcattgtctcaaggccactgggagaggttacatgtcctccaaaagcatgaccaaattgtttctggaatagattggagctcaaagtccaacaaaatcgtcactgtttctcatgacaggaactcgtacgtctggagcctggaaggagctgaatgggtaccaactctcgttattcttagactaaatcgtgctgcactttgtgtccaatggagccccaaagagaacaagtttgctgttggaagtggtgctaaaactgtttgtatttgctattatgagcaagagaataactggtgggtcagtaagctaatccggaaaaggcacgaatcttcagtcacatctgttgcttggcatcctaataatgttcttctggcaacgacatcaacagatggaaaatgtcgggtattttcaacatttatcaaaggagttgacacaaaggattcaaaagcaggctcaccagcggaaacgaaatttggggagcaaattcttcagcttgatctctcatattcttgggcatttggtgttaaatggtctccaagtggaaacaccttagcttatgtaggtcatagctccatgatttactttgttgatgatgttggtccttctcctttagcccaaagcgttgcatttcgagatttgcctcttcgtgatgtcctgtttatttctgagaaaatggtgataggcgtgggatatgacagcaacccgatggtatttgcctcagatgatactggaatatggagctttatcagatacatcggagagaagaaagcagcatcttcaaattccagttacagttcgcagttttctgaagcatttggaaaattctacggcagtcaatcaaagtccacaacagccaacgatgctcctgaatcacgtggaggtgttcatgataactgcataaattccattgtgtctctgagcaaagcagggagtcctaaagtaatgcgattcagcacttcaggattggatggcaaagttgccatatgggatctggagaacatggaacaagaacttggcaatcagttttaataaacacacaaataatttaaat

SEQ ID NO: 4 - DNA, 432 bp, Arabidopsis thaliana
atgaacgctgagaataatcagactactactactcactcgaaagtgatctcacatgtattctgcactggtactgctaagctaggctctgttgggccacccattggtcttgttgatattggcgtcagcgaagttgcttacatcttccgagtctctcttcctggcattgagaaaaatcaagataagatcaaatgtgaaattcagagggaggggagagtttgcatccaaggagttatacctgagattgcgattccaagtgacacgggatgcttatacagaatgcaagtgcaacagctctgtccgcctggtccattctcaatcacgtttaatcttccgggacaagtggatcctcgcttgttttctcctaattttagatctgatgggatctttgaagtcgtcgtagtcaagctcggagtgcgcatcccaacttcatag

SEQ ID NO: 5 - DNA, 1773 bp, Arabidopsis thaliana
gtttcttgtttgttgattaacccttaattaagatgaagttcatgaagctagggtctaagcccgatacatttgaatctgatggcaaattcgtcaagtacgccgtttcagatcttgacagcgatgttactattcatgttggcgaggtcacatttcacctccataagttcccgctgctatcgaagagcaatcggatgcagcgactggtttttgaggcgagtgaggaaaaaaccgatgagatcactatactagacatgccaggaggatacaaagcgtttgagatctgtgccaagttttgctatgggatgactgttacgctcaatgcttacaacataaccgcggtgcgatgtgcagctgagtatcttgaaatgactgaagatgctgaccgcggtaacctcatatacaagatcgaagttttcctcaactcaggcatattcagaagctggaaagactcaatcattgtgcttcagacaacaagatctcttcttccttggtctgaagatctgaagcttgttggtagatgcatagattctgtttcagctaagatcttggtgaaccctgagactatcacttggtcttatacattcaacaggaagttatctggacctgataagatagtcgaatatcatcgggagaagagagaagagaatgtgattccgaaagattggtgggtcgaagatgtatgtgagctagagattgatatgttcaagagggtgataagtgttgtgaaatctagtggaaggatgaataatggcgtaattgctgaagctcttagatactatgttgcaaggtggttaccagaatctatggagtctttgacatcagaagcttcttcaaacaaagatctcgttgagacggttgttttcttgttgccgaaggtaaacagagcaatgagctactcttcttgcagcttcttgctaaaactccttaaagtttcgatcttggttggagctgatgagacggtgagagaagatttggttgagaacgtgagtttgaagcttcatgaagcgtccgttaaagatttgctgatccatgaagtcgaattagtccatcggattgttgatcagttcatggcggatgagaaacgtgtatctgaagatgaccggtacaaggagtttgttttaggaaatggaattttgttgagtgtaggaagattgattgatgcttatctcgctcttaactctgaacttacactctctagctttgttgagttatctgagttagtcccggaatcagctaggccgatacacgacggtctctacaaagccattgacactttcatgaaggaacatcccgaactaacaaaatccgaaaagaagaggctttgtgggttaatggacgtgaggaaactgacaaatgaagcatcaacgcacgctgcacagaacgagagacttccactacgagtggtggtgcaagttctctactttgagcagctccgagcaaatcacagccccgtggcgtctgttgcggcttcgtcacactcgccggttgagaagacggaggagaacaaaggagaagaagcgacgaagaaggtggagctgagcaagaaaagcagaggaagcaagagcacgaggagtggtggtggtgcacagctgatgccgtcgaggtcaaggaggatctttgagaagatatggcctgggaaaggagagattagcaacaagagctctgaggtttcttctggaagctcacaaagtccgccagccaagtcttctagctcgtcttcccgacgccgcagacattcgatatcgtgaatttaaatacccagcaaattggagc

SEQ ID NO: 6 - DNA, 294 bp, Arabidopsis thaliana
atgtcagtcgaggaagacgccaccgttagagagccactcgatctgattcggttgagtatcgaagagaggatctatgtcaagctccgatctgaccgtgaactccgcggcaagcttcacgcttttgatcagcatttgaatatgattctgggtgatgttgaagaggttattacgactatagaaatcgacgacgagacatatgaagagattgttcggacaacgaagcgaacggtaccgtttctattcgtgagaggagatggagtgatattggtgtcaccgcctttgaggacgacctaa

SEQ ID NO: 7 - DNA, 651 bp, Arabidopsis thaliana
atggcactgtaccgaccccttctcttgcatcatccaacttctccgtctgtaactacgtttctacgaaattacccctcgaaaccgatcaaattctccagcctgcccttccttcatcgctgccgtaagtctcgggtctcctcctcctccgctcggtgttgttcttccatggaatctcctcctgaaggatacagaagaaatgtcggcgtctgcctcatgaattcttccaaaaagattttcactgcctcgaggttggatattcccagtgcttggcaaatgcctcagggtggaatcgacgaaggtgaagatccaagagttgcagtcatgagagagcttaaagaagagactggagttcactctgctgagattctcgctgaggcacctcactggataacctatgacttccctcctgatgttagggagaagcttaaggtccgatggggatccgattggaagggtcaagcacagaaatggtttcttctgaaatttactgggaaagatgaagaaatcaatcttcttggcgatggtactgagaaacctgagtttggtgaatggtcctggacttctcctgatcaagtcgttgaaaatgcagtggagttcaagaagccagtgtacaaggaagtcatgtcagctttcgcttctcatctccagtag

SEQ ID NO: 8 - DNA, 2301 bp, Arabidopsis thaliana
atggcttcggagcctgttaacggaggagaaggtatcgatggagctagagagaagcaaatcatcaaagtttataagaggaaaggcaaaggtcaaagaaaacagtcatctttctttgcccttgaggctgccatcgagaaacctgaggggctattagaaaacgagaatgataacaatgatgtgagtcctgccgaaactctagctccagagtttgaggatcctatagttgtggtgaagaattctatcgaagaggctgctcttgggactaattctcatggagacaaaaacttaactgaagcgccttctgaaaacctgcctggtgatgattcagacaaagtcattgacaagcctcttgtcgaagcattttctcaagctcaaccacaggatgatgccagtttggccgctatggacaagtctgaagaagtaccttctcagatccccaaagctcaagatgatgtcaatacagtggttgttgatgaaaactctatcaaggaacctcctaaaagccttgcccaagaagatgttaccactgtgattgttgacaagaaccctatcgaagcaccttctcaaaccctatccctggaagatggtgatactcttgttgttgacaagaatcccattgaagtgtcttctgaggaagatgtccacgtgatagatgcagataatctaataaaagaagctcatcctgaaaactttgtggaaagagataccactgatgcccaacagcccgctgggcttacctctgattctgctcatgctactgctgctggaagcatgccaatggaggaggacgcagatggacgtattaggatacatgtagcctccacaacgaagcaacagaaagaggagatcaggaagaagcttgaagatcagcttaacgtagtcagaggaatggtaaagaagatagaggataaagagggcgagattggtgcatataacgattctcgtgttttgattaacactggtattaataatggaggagggaggattctgtcagggtttgcatcagctggacttcctcgtgaggtcattagagcaccaaggcctgtaaatcaactaagtatatcagtgttggagaatactcagggagtcaatgagcatgtggaaaaggagaaaagaacacccaaggcaaatcagttttatagaaattcagagtttttacttggtgacaagttaccacctgcagagagtaacaagaaatcaaaatcgagttcaaagaagcaaggaggggacgttgggcatggttttggtgcagggactaaagttttcaagaattgcagtgctctgcttgaaaggctgatgaagcataagcatggttgggtgttcaatgctccagtagacgtgaagggtctaggtttacttgattattacaccattatcgagcaccctatggatttgggaactatcaagtctgcgttaatgaagaatttgtacaagtcaccaagagaatttgcagaggatgttagacttactttccacaatgctatgacttacaacccagaaggacaagatgtccatctcatggcggttacgctattacagatctttgaggaaagatgggctgtaatagaggcagattataatcgtgaaatgagatttgtcactggttatgaaatgaaccttccaactcctacaatgaggtctagactgggtcctacaatgccaccaccacctatcaatgtgaggaatacgatagaccgggcagactggagtaatcgccaaccaactacaacacctggaagaacaccgaccagtgcaacaccttctggaaggacacctgctctgaagaagccaaaggcaaacgaaccaaataaaagagatatgacgtatgaggagaagcagaagcttagtggccatttgcagaacttgcctccagataaactagatgcaattgtacaaatcgttaacaagaggaatactgcggtgaagctacgggatgaagaaattgaagttgatattgatagtgttgatccagagaccctgtgggagttggacagatttgtaaccaactataaaaagggcttgagcaagaaaaagagaaaagctgagctagctattcaagctagagcagaagccgagaggaatagccaacaacagatggctccagcaccagcggcacatgagttttctagagagggtggcaacacagctaaaaagacactacctacgccattaccttctcaagtggagaagcaaaacaatgagacaagcagatcaagtagttcaagcagctcttccagttccagctcgtctagtgattcagacagcgacagctcttcatcatctggatcagatcagacctag

SEQ ID NO: 9 - DNA, 279 bp, Arabidopsis thaliana
atggaggatcagaaaaagccaccaacgaccgagcaagaagtgaaagaagttaaaaacgacgacctcgagtctatcaagaccccatacttggactatgataacttggaagattacaagatgaaaggttacggagcacaaggccaccaagagcctaaactcggtatgggaggtggagccaccgatgctcccactccttcaggcggtcttggacgcggtggaggcgctgcatcgacggatctttcttctaccgatgcgattaaccgtcagggcgttccgtga

SEQ ID NO: 10 - DNA, 1758 bp, Arabidopsis thaliana
atgagattcagatctctcatctctctcctcttccttctcttcttcacttcatctgcttacgctcgattcgtctccctaaacccatcttcaacgagtctaatctccgatggaatcgacggtggttcaaatctcgccggttccggatcggttatcaagtcggttgtttcggctccggctgaggaaaaggaggaagcttgtgagcagacatacgggtttatgccgtgtactaagaccgctcttggaaacgtgtttctgattttggtttatggatttctcatgtttacggctgcgacgtatctctctgctggaagtgagcttcttcttgagatccttggacctggaattgtcggtggtttgtttcttccgatgcttggtgctcttcctgacgctatgcttatcatggtgtctggactatctggagatgcagcaactgctcaaagccaagtctctgtgggaatgggtttgcttgctggttccactgttatgcttctcactgttatctggggaacttgtactgtggttggcaagtgtgatcttcgtgattcaattgctgtaaacaaccaagacaccaaaggctttcacctaaaagattctggtgtaactgttgatatttggaccagctatgctgcaagaataatggctatatcagttattccgttcgtcattgtccagcttccgcagatgttgggctcaacctctggaagacaattgtccgtgttgattgctctaatcctttcagttcttatgttgatctcttactgtgtatatcaggtattccaaccatggatccaaaggagacggcttgcttttgcaaaacacaagcatgttatatcaggaatactaaggcacttgaaacaacatgctctgggaaggcttcttgatgatgaaggtcagcctgatgaacatgtcattcgaaagttgtttttgacaattgatgcaaacaatgacggacacttgtcagcggctgaactaaaggcgcttatcattgggatcagctttgaggatatagattttgacaaggatgatgctgtgggaaaagttctccaagattttgataagactcttgatgagcaagttgatcaagaagagtttgtccgtggaattaagcaatggcttatccaggcaatgggaggtgctccatctggtcctgaagctggccctcgaacaatgaaattccttgacaatttccatgtgcaaacaaagagagagcatgctttgttgggagataacgagaatggtgagaatgatgaggaaggcggtgaggttgcagacccaaaatggatcaccattaaagcagctctgctgctactgttaggagctgccattgcagctgcatttgctgatcctttagtcgacactgttaacaacttctccgcagccacagggattccgtctttcttcatttccttcatcgctttgcctttggccaccaattcaagtgaagccgtgtctgccatcatcttcgcatcccgcaaaaagatcagaaccgcctctttaactttctccgagctatgtggtggagtgacaatgaacaacattctgtgtctctcggtgttcttagcaatcgtctacgttcgaggactgacatggaacttctcatcagaagtgttggtgattctcatcgtttgtctggtgatgggcggtttcgcgagtttccgcacaacttatcctctttggacatgtttcatagcttacttgctttacccattctccttgggtctggtctatattcttgattactggtttggctggtcgtag

SEQ ID NO: 11 - DNA, 504 bp, Arabidopsis thaliana
atggcagaagacaagatcttaaagaagactccggcggcgaagaagccgcgaaaaccgaaaaccaccactcatcctccatactttcagatgataaaagaggctttgatggtcctgaaagagaagaacggatcaagcccttatgctatagctaagaagatagaggagaaacacaagtctttacttccagagagtttccgtaaaacactttctctacagcttaaaaactctgttgctaaaggtaagctcgtgaagatcagagcctcttacaagctctcagataccaccaagatgataacgaggcagcaggacaagaagaataagaagaatatgaagcaagaagataaagagatcacaaagaggactaggtcttcttcgacaaggcctaagaagactgtgtctgtgaacaaacaagaaaagaagaggaaagtgaagaaggcgagacagcctaagtctatcaaatcttcagttggtaagaagaaggccatgaaagcttccgctgcttga

SEQ ID NO: 12 - DNA, 525 bp, Arabidopsis thaliana
atgaaggaagacgcaggaaaccctttgcatctcacgtcactgaaccatgtctctgtcttgtgccgatccgtcgacgaatctatgaatttttaccaaaaggtgttagggttcatcccgatacgaagacctgaatccttaaattttgaaggcgcttggttgtttggtcacgggattggaatacacctcctgtgtgccccagaaccagagaaacttcccaagaaaactgcgattaatcccaaggataatcacatctctttccagtgtgagagtatgggagtagtggagaagaagctggaggaaatggggatagattatgtaagggcattagtagaagaaggagggatccaagtggaccagctcttcttccatgaccctgatggcttcatgatcgagatttgcaactgcgatagcctccccgtagtccccctcgtaggagaaatggctcggtcctgctcaagagtcaaactccaccagatggtgcagccacaaccgcagactcagatccaccaagtggtctacccttaa

SEQ ID NO: 13 - DNA, 1419 bp, Glycine max
ttaattaatctgttaaacttgttttattatactgctactatggagcaccttcctgttgaagtgattggtaacacattatctcttctcggttctgcccgagatgttgtggttgcttctgtaacttgtaaaaaatggagggaagcatggcgcaatcacctccacagtctttcattcaactactgtgattggcccctctttcatgactttacctctgctaggttggaaatactcatcactcagacaatcttccaaaccaaggcactgcaatccctgaccatattcttggatgacgagcacaagttctcggctgccccggtcattgcttggcttatgtatactagggattcgttgcgccaattgctttacaatgtgaggacaaccccttgtttcaacatcattgagaaatgcagcaggcagaggttggaggtgttggccttggctcgcaatccgatcaccggtgttgacccaagctacttgaagtttccttgcttgaagtcgctttcgttgagttttattagcatctcggcgttggatttgacccttcttctctctgcgtgtccgaagcttgaaaccttggctatggttggtgtggagattgcaatgtcagattcgcaggcttccgtggagcttagcagcgtttctttgaagttttttgaccttgaattgtttagttcggataagtttatattggaggcggatttacttgagaagcttcatttgaaagattgtagctttgaggcttttgagctgattggaaaggggacattgaaggttttgaaaattgatgatgtgaatattatccatcttgatattggggatagtacagaaaaccttgagattatagatgtctgtaacttcacagtcatgtggccaaaattttatcatatgatctcaaaagcatcaaagttatataagcttcggctgtggggtgttgtttttgatgatgaggacgaggttgttgatatagagacaatttctgtttgctttcctcagttgacacatttgtccttaagttatgatttaagagatggagttcttcattatggtttgcagggtttgtcttgtttgatgaatgtggtggtgctggaacttggatggactgtaattagtgatctcttctcagtatgggtagctggacttttggaaggttgtcccaatttgaaaaaattggtcatttatggttttgtttcagaggtcaaaacacatgaagagtgtcaaattcttgccagattctcagaattcattcttcaacttggaagaaaatatgggcatgtaaagtttgagtttgaatatgagtagtgggttctgtcgtgctcatctaatccttgcatttaaataagaagatacttgcatgccccatgagtttcttttgtccatttcttctgtcgtgaatcacaagaattcttcaaatgtaaagtt

SEQ ID NO: 14 - DNA, 1409 bp, Glycine max
ttaattaactgaagctgaaaacgccgacgcccgacggtgatgatgaagatggggtcctcaccttcacgttgctccttcttcctattcctcctcctcctagtggcgctcttcccctcgtcgctctccgagatccggttctccgagatccgaaacgacgatcgctccatcgttcccttcgatcagtttggattcacccacaagggtcgccttgagctcagcgtttccaaaatatcactctccaattccaatttggacctctccaaggtgggattcttcctctgcaccctggattcctggcttcatgtcttccagcaactggaggatggcgagattcggtgcgcccttcaatccgatctggtcaagtccgtctacaccttcaattctctcaacggcaaggactctttcagcacgctctacaaagaagaaaccgacgccgatcagtacaacctcgtctttgccaactgccactcgccgcaactcaaagtgaccatggacgttaaatctgccatgtataatctcgacggaaagagcgacgtccgcgactacctctctgccggcagaaccatccttccgagggtttatttcctcttctcgcttgtgtatttcaccctcgcagctctctggatcagcgtcctctacaagaagcgcttgaccgccttccgcatccattacttcatgctagccgtggttatcttgaaagccctgaatctcttgtgcgaggccgaggacaaatcctacatcaagcgcaccggaagcgcccacggttgggatatcatcttttacattttcagcttcctcaagggcatctcgctcttcactctcattgtcttgattggcactggctggtccttcctcaaacccttccttcaggataaggaaaaaaaggttctcatcgttgtcatcccccttcaagtcattgccaacattgctcaggtcgttattgacgagaatgggccctacggccatgactgggctacctggaaacaggtcttcctccttgttgacgtcgtctgttgctgcgctgtgcttttccccattgtctggtccatcaagaacctccgtgaggccgctaggaccgacggcaaggccgctgttaatttgatgaagcttactctcttcaggcactactatgtcgtcgttatctgttacatttacttcaccagggttgtcgtttatgccttggagactattacctcctatcgttattcttggaccagtgtggttgctgctgagttggccacccttgctttctatttctttactggctacaagttcaagccagaggctcacaatccgtattttgtcatcgatgacgaagaggaagaggctgccgcagaggccttgaagcttgaagatgaatttgaattgtaatttctttcaaaatacaaaattagttgttgaatttaaat

SEQ ID NO: 15 - DNA, 1195 bp, Arabidopsis thaliana
atggtttgcgataagtgtaagtccatcaataatcttctctttgaattccatattctaattgaatcaatctatacttggatcggttttaattctaattgaatctatactattggcgttaggatttgtgattcgtttcgtttctagcttaatcgattacatgtttcaggaagaaatttaatgatctctgattcgattttggtttcttagatcgaaaccctagttgtaggatctctaatttagttcaaagtatgaaccttttgactcaatttgtttttatcttttaattttaggtgagaagaagttatcgaaagtgatagttcctgataagtggaaggatggtgctcgtaatgtaactgaaggtggtggtcgtaaaatcaatgagaataagcttctctccaagaagaataggtatgcatttcttatgtttatccatcttcattttactacttttcattatttgaattgcaatatggaaatagtgattaatttgtagctttggggatgtttgtatcgtctagtttggtattggttttgtttcctgtagtttcttctaagaaatattggtattgtagtttcgtgtagtgtcttttttgagttgatccctccaggttcttctaaaaatcattagtaattatagaatttctcatggaaatagcgataaattttttaagtttgggatgtttgtattatctgttgagttgattagactactggactcttgccatctagggtgtagaactccaccgcttcgctagtcctctaggttttaataagaatcattagtaaatgtacaacttctcatggaactagcgatatttgtaactgtgaatgtttgtgttgtcttttttgagttgagttattagttttgtttactcttgttctgcttctaattttctattgtgatatttctttgccttgtagatggtcaccttacagtacctgtaccacaaaatgtatgatctgcaagcagcaagtgcatcaagatggtaaatactgtcacacatgtgcctatagcaaaggtaaatagttaatacatctgttttactctactaaattcttacctctggttggatagtgatattatagagtaacttaacaactgatggaattacctcttcgtggttgtgcaggagtgtgcgcaatgtgcgggaagcaagtgttggacaccaagatgtacaagcaaagcaatgtataa

SEQ ID NO: 16 - DNA, 2072 bp, Arabidopsis thaliana
ttaattaagcgatctacttgaaagagagattcagaaatttccaagtaataataatgtttgcgcctgcgactcaaccgcaacagcaacatgagcagaagaagcaatcagagactgtttcatctgctgaagaagatgctttgaagtggaacaccgattgcgtttactttctcgcttctcctttaacctgcaagaagggacctgaatgcgagtatcgccacagtgagtatgcgcgtatgaacccgagggattgctattattggttgaatggaaactgtttgaatcccaaatgtggatttcggcatcctcctttggagggattgttgggaaatcaaggaggtgctcctgctgtttctgtacagccaatacatgcaaccgcgcagcatcctagtgttgcaaaacagcctgttccatgtctgttctttcaaaaaggcatgtgtatgaaaggagatatgtgttcgttcttgcacacgccgaatcctgctgcgtataaaaaacagcatcctgtagaagctaagcctgctactgatcctcagtgttctaaaaagccaattgaaaataacactgaggagaagaaacttcctgatgttaatctctcaaaggtggttaaaggacatactgacatatcggctgcaccaagagtcgcttctactggactaagggatagtagaagtgtagagggatacattccaaaccatgtgggatatgagcctgttgtgcagagaaagggtccaggattcccttcttttactgaaggaggccattctactcagttgcttcagaaatatggatctgatgataataacagtttccacaatggtaaggatgcagatgacgttttaagagagtcgtctcctgggtttgatgttcttgtggataatgaggctggagattctgagtattatcatgttgaagatcgatatggacgtagaagtcaggagagagggaactcagagtatgaccctgatttcagtgcaattgctgatggtgataaagaagcattacgtgaacaacgttttgattcatatgatcggagggaagacaggggatggggccatcgtcgagtttcttctgagagagaggatcgtttggacagaagggtttacgcagaagatgagagatcagagaacatactggaatcggatctgagatatcgtttggctaagcagagaaaaggcaatggtatgagattatcagtaggaggccatgactatgctgctcctgactcttcgatggacagaggatatagagagtctcgtagggatacaccgagggaaaactccattagcagtagtcgtcttcagggtagaattaagcttcgtgagagaagcaatggcgaagagggtcaccactttgacaggagaagtgagaggggaagggacagaagcgagttaccttctcagggtagactccgagatagaattaagggtaggttagaggaaaaccatagtggtaatcaggaaagaggtttcggggctccatgggcgagaagaagagaaatggaagacgaaagaaaatcagctcctaaaagcagcagagaggaaagtaagccagagccatctcttgggaagaggaaaagctttgaagaggatcatcatagtcataagcgatcaagggattcatttgcagctccattgcctttcagtgagattctcaagagaaaaaaagcggccgcatctggtggtagcagaaacaacaacaaggacgagacgatatcgaaagaggaagctggagatgagatcaaactcataaccgaagagaaaaccgaggttgtctctgaacccaaagctgaagtagaagaagaaggaacggttatggaggaagaagaaattgttggggaggaagtgtatgaaggaaatgaagacgagcaagcttatgaaggcgatgagctaaacggagagtactattacgaagaaggatatgaagaagagggaggagaatacgcttacgaagaaggtgaagaagtagtttacgcggctgaggaaggagaagaagaagcaacagaaggaggtgaaggtgagggtgaagaagacattgagaagaagaccgttgagatgttgtcataaaggcgcgcc

SEQ ID NO: 17 - DNA, 1246 bp, Arabidopsis thaliana
ttaattaaatgagcgtgatcacaactccaatagagaccctgcacctaaagtcaacacttcgtcttctaccacgagctgtttatcgcagtcaacggattcaagttttcccgcccaacatcttctcgaacacttctctgagttctccacttcgcatcgacccaatctctcaagttggcggatcgaggaatttgtggcgtagatatgcatctgataatttctcggagatgggtttggatcctggagctgatccattcaaggttattgagaagccttctatagtggatagaatgaagaaagcaaactcaattcttcctcatgtagtgttggcgagtacaatattagctcttatctatcctccttctttcacttggtttacgtcgaggtactttgtgcccgctttaggttttttgatgtttgcggttggtatcaattcaaacgagaaagactttcttgaagctttcaaaagaccaaaagctatcctcctcggttatgttggacaatatctcgtaaagcctgtcctaggtttcatctttggcctagctgctgtttctcttttccaactcccaactccaattggtgctggaatcatgttggtatcatgtgttagtggagctcagttgtcaaactatgcgacattcctaactgatccagcattggcacctcttagcatcgtcatgacatctctatcaaccgctactgcggttcttgtcacaccgatgctatcactcctgctcattgggaagaaactacccgttgatgtaaaaggaatgatatccagcattcttcaggttgtaatcgcaccaatcgctgcaggattgctactaaacaagttgttcccaaaagtatcaaatgcaatccgaccatttctcccgattctatcggttctcgacacagcttgctgcgttggagcaccactcgcattgaacataaactcggtcatgtctccatttggagccaccatattgttactagtaacaatgtttcatctctcagctttcctcgctggatacttccttaccggttctgtctttagaaacgctccagacgctaaagccatgcaaagaacattgtcctatgaaactggaatgcagagtagccttttggctctagcgcttgctactaagttctttcaagatcctcttgtggggattcctcctgctatatctacggtggtaatgtcattgatggggttcactctcgttttgatctggtctaaggaaaagagtaacacattttaaggcgcgcc

SEQ ID NO: 18 - DNA, 904 bp, Arabidopsis thaliana
ttaattaaatggaagctaattcaggcggaggaggaggagctgaaggcggaagagcggtaaccggaggaggaggaggaggaggagggagcgatgtggaattggtgagcaagacgttgcaagtggagcataagctattctattttgatcttaaggagaatcctcgtggaaggtatctaaagatatcggagaagacgtcggcgacgaggtcaaccatcattgttccttcctccggcatctcttggttccttgatctcttcaactactatgtcaattctgaggaacacgagctttttagcaaagaattgcagcttgattccaaggtgttttacttcgatatcggtgagaacagaagaggacgcttcttgaaggtgtcagaagcatcggttagtagaaatcgaagtaccattattgttccagctggaagctctcctgatgaaggatgggcagctttcaggaatatattggctgagatacatgaagcatcaggactttttgtgatgccaaatcagaaaccttctgatggacaggaacacttggttgatgatgttggagctggttttatacctggacatggtagtcagcagccatcttcttcagaacataatgtggatcgaacaattgactcgccaggccaggaagaaaccggaatgactggtgtttctaaagtaatcagagctgaccagaaacggttcttctttgatcttgggaacaataacaggggccatttcttaaggatatctgaggtggcaggttctgacaggtcttccatcattctaccgttatcgggtcttaagcagtttcacgaagtaattggtcactttgtggagatcaccaaagataaaattgaaggtatgacaggcgcaaatgtcaggacagttgatcctcctcagagataaatttaaat

SEQ ID NO: 19 - DNA, 1301 bp, Glycine max
ttaattaattttgttggaaggaggtaaaggaagttcgtgacaaaagcggcaatggaaggagaagagggttcccagcagccacagttggtgctcggggacaagctattccttcttcgacaacccgatgttcaagacattgacaaggttcgctacaaggaggatgttttcactcacatcaaccaaaacgatatggtccccttgtatgaaaccctagtggccgattccgtgttggacttggatcgtgccctcttggactctatgcgcgctaaaattcacgatgagctcgccaacctcgacgaaaagattgctgatgctgaggaaaacttaggagagagtgaagttcgtgaggctcacttggcaaaatccttgtttttcatccggattatggacaaggagaaagccttggaacatctcaaggtaacagaaaccaagacagttgctgttggccagaaaatggacttggtgttttatacattgcagcttggtttctttgacatggattttgatctcatttccaagagcattgacaaagccaaaaacttgtttgaagaaggtggtgattgggaaaggaagaataggctgaaagtgtacgaaggactgtactgcatgtccactcgaaatttcgagaaggctgccaagttgtttttggattccatttcaacctttaccacctatgaactttttccctatgacacctttatattttatacagttttgaccagcattatatcattggatagagtttccctaaagcaaaaggtagtggatgctccagagatcttgacagtgattggcaaaatcccttatctttcagagtttttgaactccttatatgattgtcaatacaagtcttttttctcagcatttgctggcctgacggagcaaattaagttggaccgctatctgcatccacacttccgatattacatgagggaggtcagaaccgttgtttattcccaatttttggaatcttacaagagtgtgacaattgaagccatggcaaaagcctttggagtgacagaggatttcattgatgtggagctatcacgctttattgcagcagggaagcttcattgtaagattgataaagttgaaggtgttcttgaaactaatcgccctgatgctaagaatgctctttaccaagcaactattaagcaaggggacttcctattgaatcggatccagaaattgtcacgtgtgatagatctttaggtcattttttgcattttagactaaaagtttattggaaaggcagagataacgacaatttcacggtattttactacgagggtgatttaaat

SEQ ID NO: 20 - DNA, 1488 bp, Glycine max
ttaattaactcggttccactgcagaatttcagtttattcttatctaggtagactccttataagtgcgcagaagttcaagtgtagagaatgagtcagcctaagattaaacgccgagttggtaaatacgaggtggggaggaccattggtgaaggtacatttgcaaaggtgaaatttgcaaggaactctgagacaggagagcccgtggctcttaaaattcttgacaaggagaaggtgctaaagcacaagatggctgagcagatcaggagagaagtagctacaatgaaactaatcaagcatccaaatgttgttcgattgtatgaggtcatgggaagcaagaccaaaatatatattgttttggagtttgtaactgggggggaactctttgacaaaattgtaaaccatggaaggatgagtgaaaatgaagcacgtagatatttccagcagcttataaatgctgttgattattgccatagcaggggtgtctaccacagagacctgaagccagaaaatttgctattagatacttatgggaaccttaaagtttctgattttggtttgagtgccctctcccagcaagttagggatgatggacttcttcatactacatgtggcactccaaattatgttgctcctgaggtccttaacgatagaggctatgatggggcaactgcagacttgtggtcatgtggggttattctctttgtattggttgcaggttacttgcctttcgacgaccctaatcttatgaacctgtataaaaagatctcagctgctgaatttacttgccccccatggctttctttcactgccaggaaattgattacacgaatcttggatccagatcccaccactcgtatcactatacctgagattttggatgatgaatggtttaagaaagaatataagcctcccatttttgaggagaatggggaaatcaacctcgatgatgttgaagctgtctttaaagactctgaagagcaccatgtgacagagaaaaaagaagagcagcctacagccatgaatgcatttgagttaatctccatgtccaaaggactgaaccttgaaaacttgtttgatactgagcagggatttaaaagggaaacaagattcacctcaaaatcccctgcggatgagataatcaacaagattgaggaagccgcaaaacctcttggctttgatgtgcagaagaaaaattacaagatgaggcttgcaaatgtgaaagctggaaggaagggaaaccttaatgttgccacagagatatttcaagtggcaccttctcttcacatggtagaggtacggaaggcaaaaggagatacattggagttccataagttctacaagaaactttcaacaagcctggatgatgttgtttggaaaacagaagatgatatgcaaatgcgagaaacaaagtgatgtggatattattatcattgtctattaagtgtaattttcttcgtgtctgaggttgtactatttaccaatttaaat

SEQ ID NO: 21 - DNA, 1680 bp, Arabidopsis thaliana
ttaattaaatggctactatttggtttctcccacttctctttctctcttgtcttcttcttgccgctttaagactcaagaagcggcggcaacatcaacggaaaccaccgtctccaccgggctttccgatcatcggaaacttgcatcagcttggggagctaccacatcaatctctatggagtctctccaaaaaatatggtcctgtaatgcttttgaagtttggaagtatcccaacggttgttgtctcttcttctgaaacagcaaagcaagctctgaaaatccatgacctcaattgttgtagccgtccaagcttagcaggtaccgtaactctcacttaacacttactattttttttatatattttgtttgtgtgcgtaggattaaaacaaaagtcatatgattatttaggaccaagagcgctctcttacaactacttggacatagttttctctccttttaatgattactggaaagaattgaggaggatgtgtgtgcaagagcttttcagtcctaaacaagttcatttgattcaacccatcagggaagaggaagtcaagaaactgatgaattcattctcggaatcagctgctcagaaaactccggttaacttgagcgagaagttagcttctttaactgttggcgtgatatgcaaggcagcatttggtgtgagtttccaaggaactgtgcttaatagtgacaacttcgacaagttaatccatgatgcatttttgttcttggggagcttctctgcctcggattattttccaaatgtcggctggatcatcgactggctcacggggttacaagggcagagagagagaagtgtgagaggtcttgacgcattctatgaacaaatgtttgatctacataaacaggggaacaaagaaggagttgaggattttgtggacttgctcttgaagttggagaaagaagaaactgttcttggatatggcaagctcacaagaaaccatatcaaagcagtcttaatggtaactatacaaagctttgctttccaattgtaggattataatacctaaagattataatggtcttattacagaatgttcttcttggaggcattggaacttcggctataacaatgacatgggcaatgacagaacttatgagaaacccgcgagtaatgaagaaagttcaatccgaaatcagaaatcaaattgggggcaagtcaatgatctgcttggatgacatagaccaactccattacctgaaaatggtgatcaatgaaacatggaggctacatcctccagcaccacttctagttccaagagaagtaatgtctgaatttgaaatcaacggctacacgattccagccaagacaagactttatgtgaatgtatggggtatcgggcgtgatccagatacttggaaagatccagaggagtttcttccagagagatttgttaacagtaacattgatgcaaaaggacaaaactttgagctgttaccatttggaagtggtaggagaatgtgtcctgccatgtacatggggacaacaatggtggagtttggtctagccaatctcttgtaccattttgactggaaattaccagaaggcatggtggtcgaagacattgacatggaagaatctcctggactcaatgccagcaagaaaaatgagcttgtacttgttcctaggaagtatttaaatctgtaaggcgcgcc

SEQ ID NO: 22 - DNA, 1147 bp, Arabidopsis thaliana
ttaattaaatggcgattcggaaggaggaagaaagtagagaagaacagagcaattcgtttcttcttgatgctctctactgcgaagaagagaaatgggacgatgaaggagaagaagttgaagaaaactcttccttgtcttcttcttcttctccattcgttgttttgcaacaagatttgttctgggaagatgaagatctggttacactcttctccaaagaagaagaacaaggactcagctgtctcgatgatgtttatctttccacggatcgaaaagaagctgttggttggattctgagagtcaacgctcattatggcttctctactttagcagctgttttagccataacttatctcgataagttcatctgtagctacagcttacagagagacaaaccatggatgcttcagctcgtttctgtcgcgtgtctctcattagctgctaaagtcgaagaaacccaagtccctcttcttctagactttcaagtggaggagacaaagtatgtgtttgaagcaaaaaccatacagagaatggagctactgattctgtctactctcgagtggaagatgcatctcattactccaatttcgttcgtagaccacattatcaggagattgggacttaagaacaatgctcactgggatttcctcaacaaatgccaccgtctcctcctctctgtaatctccgattcaagatttgtcgggtacctcccatcagtagttgccgcagctaccatgatgcgaattatagagcaagttgatccctttgaccctctttcataccaaactaatctcctcggtgtccttaacttaaccaaggaaaaggtgaaaacttgctacgatctaatcctccaactaccagtggaccgcatcggtttacagatccaaatccaatcttccaagaaacgcaagagtcacgattcatcatcatcgttgaacagtccaagctgcgtgattgatgcaaaccctttcaatagcgacgaaagctcaaacgattcgtggtcagcgagttcgtgcaacccaccaacgtcgtcgtcgtccccgcagcaacaacctccattgaagaagatgagaggagctgaagagaatgagaagaagaagccgattttgcatctgccatgggcaatcgtagccactccataaatttaaat

SEQ ID NO: 23 - DNA, 2230 bp, Arabidopsis thaliana
ttcttgtttgttgattaacccttaattaaatggagatcgaaaaaagcaataacggtggttcgaacccatctgcaggagaagaatttaaggatatgattaagggagtgactaagttcttgatgatggtgattttccttggaaccatcatgctttggatcatgatgccaacactaacctatcgaaccaagtggttgccacatctgcgtatcaagtttggaacatccacttattttggtgccacagggacgacgcttttcatgtatatgttcccaatgatggtcgtagcttgtttgggatgtgtctatcttcacttcaagaatcgaaagtcgccacaccatatcgatagggagacgaagggaggagtgtggagtaaactaagaaagccaatgttagtgaaggggccattaggaatagtctcagtgactgagatcaccttcttggcgatgtttgtggctcttcttctctggtgctttatcacttatttgcgcaatagcttcgccactatcactcctaaatcagctgccgcacatgacgaatctttgtggcaagcgaagctggaatcagcggcgctaaggttaggactgatcggaaacatatgtttggcgttcttgttcttaccggtggctcgtgggtcatcgttgctaccggcaatgggattaacctcggagtcaagcatcaaataccatatatggctcggccacatggtcatggcccttttcaccgttcatggtctttgttacataatttactgggcctcaatgcatgaaatctcccagatgatcatgtgggatacgaaaggtgtctcaaatttggccggagagatagctctggcggccggacttgtgatgtgggccaccacatatccgaagataaggagaagattcttcgaagtcttcttctacactcactatctctacatcgtcttcatgctcttcttcgtcctccacgtcggcataagtttctccttcatcgctctccctggtttctacatcttcttagtcgatcgtttccttcggtttcttcagtcacgtgaaaatgttcgcttgctcgctgctcggattcttccttccgacactatggagctcactttctccaaaaactctaagttggtttatagcccgacgagcataatgtttgtgaacataccgagcatttcaaagctgcaatggcatccgtttacgataacttctagtagcaaactcgaaccagagaagctaagtattgttatcaagaaagaaggcaaatggtcaactaagcttcaccagaggctttcttcttctgatcagatcgaccgacttgctgtttctgtagaaggtccttacggccctgcttccgccgatttcttaaggcatgaagctttggttatggtgtgcggaggaagcgggataactccgtttatctctgttattcgtgatttgatcgccacaagccaaaaggaaacatgcaaaatcccaaaaataactctcatttgtgcgtttaagaagtcttcagagatctccatgctcgatcttgtcttgccattatccggtcttgagactgaactatcctccgacattaacatcaaaatcgaagccttcataacccgagataatgatgcaggagatgaagcaaaagctgggaaaatcaaaactctctggttcaaaccaagtctttcagaccaatccatctcatcaatcctcggaccaaactcatggctttggctcggtgcaattctcgcatcttcgttcttgatcttcatgataattattggtatcatcactaggtattacatttacccgatcgaccacaacaccaacaagatctattctttgacttcaaaaaccatcatatatatcttggtcatctccgtgagcataatggcgacttgtagtgcggctatgttgtggaacaagaagaagtatggtaaagttgaaagtaaacaggtccaaaacgtcgaccgtccatctccaacatcttctcctacctcatcatggggttacaattccttgagagaaatcgaaagtacgccacaagaatcgctcgtgcaacgcaccaatctgcattttggagaaagacctaatctcaagaaacttctacttgatgtggaaggttcgagtgtgggagttcttgtttgtggtcctaagaagatgagacaaaaggttgcggaaatatgttcctctggtttggctgagaatcttcattttgaatctatcagtttcagctggtgaggcgcgccaaaaattggagctct

SEQ ID NO: 24 - DNA, 2107 bp, Arabidopsis thaliana
attcatttatttgtcagctttcaaactctttgtttcttgtttgttgattaacccttaattaatttttgatgggtaacggagtaacaaaactgagtatatgtttcacaggcggtggaggagaacgtctccggccaaaagacatctccgttcttcttccggatcctttagacgaaggtttaggtcactccttctgctacgtccgaccagacccgactctaatcagttcctcaaaagtccattcagaggaagacacaacgacgacaacgttccgtacaatctccggcgcttccgttagcgccaacacagctactcctctctcaacttctctctacgatccctacggtcacatcgaccgcgccgccgcattcgaaagcacgacttcattttcgtcaatccctcttcaaccgatccccaaaagctccggtccgatcgttttaggctcgggtccgatcgaaagagggttcctttcaggtccgatcgaaaaaggattcatgtcgggtcctcttgatcgggtcgggttattctcaggtccgcttgataagccaaactcagatcatcatcatcagttccaacgtagcttctctcatggtttagctttacgggtcgggtcaagaaaacgatctttggttcggatcctccgtagagcaatctcgaaaacgatgtcaagagggcaaaactcgatcgttgctccgatcaaatccgttaaagattccgataactggggaattaggtcagaaaagagccggaatttgcacaacgagaatctcacagtgaatagcttgaactttagcagcgaagttagcttagacgacgacgtttcactcgaaaaccagaatcttcagtgggctcggggaaaagccggtgaggatcgagtacacgtggttgtatcggaggagcacgggtggctcttcgtcggaatatacgacggattcaacggtccagatgcgccggattatcttctctctcatctctatcctgtcgttcatcgagagctcaaaggattgttatgggacgattcaaatgtcgaatccaaatctcaggatttagaaaggtctaacggagacgaatcttgttcaaatcaggaaaaggatgagacttgtgagcgatggtggagatgtgaatgggatcgtgaaagtcaagatcttgaccgtcgattaaaggaacagattagtcggagaagtgggtcggatcggttaacgaatcattcggaagtattagaggctctgtcacaagctctgaggaaaacagaggaagcgtatttagatactgcagataagatgctcgacgaaaatcctgaactagctttgatgggttcttgtgttttggtcatgttaatgaaaggtgaagatatttatgtgatgaatgttggtgatagtagagctgtgcttggtcagaaatcagaaccggattactggttagctaagattagacaggatttggaacggattaacgaggaaacgatgatgaatgatttggaaggttgtgaaggagatcaatcatctttagtcccgaatttatcggcttttcagctcactgttgatcacagcacaaatatagaagaagaagttgagagaatcagaaacgagcatcccgatgatgttaccgcggtaacgaatgaacgggttaaaggctccttaaaggtcacaagagcgtttggtgctggtttccttaagcagcctaaatggaacaatgcacttcttgagatgttccaaattgattacgttgggaagtctccatacatcaactgcttaccgtctctctaccaccacagattagggtccaaggaccggtttctaatactatcatcggatggtctctaccaatacttcacaaacgaagaagctgtttcagaggttgagctcttcatcacattacaacctgaaggggatccagctcaacaccttgtgcaagagcttttgtttagagctgctaagaaagctggtatggatttccatgaattgctagagataccacaaggtgaacgaagacggtatcacgatgatgtttcaatagtagtgatctctttagaaggaagaatgtggaaatcttgtgtataaacaggcgcgccaaaaattggagctctgcagagctttcgttcgtatcatcg

SEQ ID NO: 25 - DNA, 1598 bp, Arabidopsis thaliana
ttaattaaatgagtttgtggtatatcattgttgcattcgtcttcttttcaactataatcattgtaaggaacactagaaagacaaagaagaatctacctcccggacccccaagacttcctattattggaaacttgcaccaattgggatctaaacctcatagttcaatgttcaaattatccgaaaaatatggacctctaatggctctaaggtttggaagtgtgtctactgttgtggcttctacaccagagacagtaaaggaagttttaaaaacatttgacgcagaatgttgttcgcggccttatatgacttatcctgcaagacttacatacaatttaaaagatattggcttttgtccctacaccaaatattggagggaggtacgaaagatgacagttgttgaactctacactgcaaaaagggtacaatcatttcaacatacaagaaaagaagaagttgcatcactcgttgatttcatcacacaagctgcgtcattggagaaaccggttaacttgaacacgaagttaatgaaactatcaggaagtgtgatttgtagagttgtatttggtatcaatcttaaaggaagtaaacttgagaatctttatgaggaagttattcaaggaaccatggaggtggtggggagttttgcagcagcagattacttcccgatcattggtagaatcatcgataggatcacagggttacatagcaaatgtgagaagattttcaaggcaatggatgcattttttgatcaatctataaagcatcatctagaagatgagagtattaaggatgatatcattgacttgctcctcaagatggaaaggggagagattgaacttggggagtttcaacttactcgagacaacaccaaaggaattcttttcgtaagtaatatgaacctctcactttgtaatatactttcattcttcacatgttgcataaattttaaaaatatgtactctttgattattacagaatattcttaacgctggaatagacacttctgcacaagttatgacatgggtgatgacatatttgatttcaaacccaagagttatgaagaaagcgcaagccgaggtgagagaagttataaaaaacaaagacgatatcattgaggaagatatagaacgactcgaatatctgaaaatggtagttaaagaaacgtttagggtattaccgctcgttccacttctaattccaagagaggcttcaaaagatgtaaagattggaggttatgacattccaaagaaaacatggatccatgtcaacatatgggctattcataggaatccaaacgtttggaaagatccagaagctttcatccccgagaggtttatggataaccagattgattataagggtttgaactttgagtttttgccgtttggtagcggaaggagaatgtgccctggtatagggatgggtatggctttggtacacttgactcttatcaatcttctttaccgatttgattggaagcttccggaaggaatggaggtagaagatgttgatcttgaagaatcatatggacttgtctgtcctaagaaagttccacttcagcttatcccggtccttacccaatggagttgaggcgcgcc

SEQ ID NO: 26 - DNA, 1063 bp, Arabidopsis thaliana
ttaattaagttcttctccgatgcaaacctcattccaaagaaacaaaccatggatctccaaccagaagagcttcaattcttgacaatacctcaactacttcaagaatcaatctcaatcaagaaacgatctccaagaaccttctacctcataaccctctccttcatcttccctctctccttcgctatcctcgctcactcactcttcactcaaccaatcttagccaaactcgacaaatccgacccaccaaactcagatcgttcacgtcatgattggactgttcttctaatcttccagttcagttacttgatcttcctctttgccttctctcttctctcaaccgctgctgttgtcttcaccgtcgcttctctttacaccggaaagcctgtttctttctcgtcaactctctctgcgattcccaaagtctttaaacgactctttataactttcctttgggttgctctgttgatgtttgcttataacgcagtcttctttgtcttcctcgtgatgcttctcgtagctcttgatttgaatagtttaggtttagctattgtagccggggttataatctctgttctatactttggtgttcatgtttatttcactgctttatggcatttaggtagtgtaatctctgttcttgaaccggtttacggaatcgccgctatgagaaaagcttatgagttgcttaaagggaagactaagatggctatggggttaatctttgtttatcttttcctctgtggattgattggagttgtttttggtgctgttgtggttcatggtggtgggaagtatggaacttttactaggactttggttggtggattgttagttggtgttcttgtgatggttaatcttgtgggtttgttggttcagagtgtgttttactatgtttgtaagagttatcatcatcagactattgataagaccgctttgtatgatcaacttggtgggtatcttggagattatgtgcctcttaagagcaacattcagttggaggatttagatatttgaagatttgtcaagatgatgattctcttgtactgtttttcttcggcgcgcc

SEQ ID NO: 27 - DNA, 1529 bp, Arabidopsis thaliana
ttaattaagagagagaatggcaaccgaaaccgtattagccacggcggtgagcaatggcaaaagcaaaggatgttgcaagtccggtccaggttacgcgacgcctctcgccgccatggccggtccacgggaaaagctcatctatgtcactgccctttactccggaacggggcgagacaaaccggactacttggcaacggtggatgtggatccaagctcacccacattttcaagcgtcattcacagactaaaaatgccatatataggagatgagcttcaccacactggttggaactcttgcagctcttgccatggtgatgcttctgctgatagacgttaccttgtcttaccaggcttaatttctggtcgcatctatgcaatcgacacaaagaccgacccaaaggctccgtctttgtacaaggttgtagagcctaaggagattgctgaaaagacaggattagcatttccacatacatctcattgcctagcttcaggggatatgttggtgtcatgccttggggacaaagaaggaaacgccaaagggaacgggtttcttttgctagactctgacttcaatgtcaaaagcaggtgggacaaaccaggacatggtcctttgtttggttatgatttttggtaccaacctcggttcaagaccatgatcagcacttcttggggtgcacctaaagccttctccaaaggtttcaatctccagcatgttgcggatggcttgtatggaagtcatttgcatatttatcaatggcctgaaggtgaaatgaaacagataattgaccttggaaataccggtctcttacctcttgagatcagattcttgcatgatccttctaaagatacagggtatgttgggagtgctttgtctagtaatatgataaggtttttcaagaacagtgatgacacgtggagccatgaggttgttatatcggttaaaccgttgaaagtcgaaaactggatacttccagaaatgccggggcttatcaccgacttcttgatctccctcgatgaccggtttttctactttgtgaactggcttcatggagacattcgtcagtacaacatcgaagaccctaaaaacccggtcttaaccggacaaatatgggtcggaggattactacaaaagggtagtccttataaggctgttggagaagatggtaatacttaccaattcgatgttcctcagatcaaggggaagtctctaagagcaggacctcagatgatccaactaagcctagatgggaaaagattatatgcgacaaactcgctatttagcgcatgggaccgtcagttttacccggaaatcatggagaaaggctcacacataattcaaatcgatgttgatacagacaaaggtggtctcactctaaaccctgacttctttgtggactttggtgatgaaccagacggtcctgcactagctcacgagatgagatatcccggcggagactgcacttccgatatctggatctgattttggctccctaagagtgtaagctggatttgtggctagacatttaaat

SEQ ID NO: 28 - DNA, 1751 bp, Arabidopsis thaliana
ttcaaatattattcatttatttgtcagctttcaaactctttgtttcttgtttgttgattaacccttaattaaatgggcaattcatgtcgtggttcttttaaggacaaaatctacgagggcaatcatagtaggcccgaggagaattccaaatccaccaccactactgtttcctctgttcattctcctactacagaccaagatttctccaaacagaacaccaatccagctcttgtgattcctgttaaagaacccattatgcggcgtaacgttgacaatcaatcttactatgttcttggtcacaagactcctaacattcgtgatctttacacgttgagtcgtaagttaggacaaggacaattcgggacgacgtatttgtgtactgatattgccacaggtgttgactatgcttgtaagtctatatccaagaggaaattgatatctaaagaagatgttgaggatgttaggagggagattcagattatgcatcatttagctggtcacaagaatattgttactattaaaggagcttatgaggatcctttgtatgttcacattgtgatggagctttgtgctggtggtgagttgtttgataggattattcatagaggtcattacagcgagaggaaagctgctgagttgaccaagatcattgtcggtgttgttgaggcgtgtcattctcttggtgttatgcatagagatttaaagcctgagaatttcttgttggttaataaggatgatgatttctctcttaaggccattgattttggtctctctgttttcttcaaaccaggccaaatattcaaggatgttgttggaagtccatactatgttgctcctgaggttcttctaaaacactatggtccagaagctgatgtgtggactgctggtgttatactctatatcttactaagtggtgtcccgcctttctgggcagaaacacagcaaggaatatttgatgctgtgttgaagggatatattgactttgatacagacccgtggcctgtcatatccgacagtgctaaagatctgatccggaagatgttatgctctagtccttctgaacgtttgactgctcatgaagtcttgcgtcatccatggatctgtgagaatggagttgcaccggatagagcacttgacccggctgttttgtctcgtctaaaacagttttctgcaatgaataaattaaagaagatggctttaaaggtgatagctgagagcctctcagaagaagagattgcgggtttaagagcaatgtttgaggcaatggatactgataacagcggtgcaatcacttttgatgaactcaaagctggcttgagaagatatggatcaaccttgaaagacaccgagatccgagatcttatggaagcggctgatgtggacaacagcggtacaatagattacagcgagtttattgcagcgacgatccatctgaataaactagagagagaagagcatcttgtctctgcatttcagtactttgacaaagatggaagtggttacatcaccattgatgagctgcaacaatcttgcattgaacatgggatgaccgatgtttttcttgaagacataatcaaagaagtagatcaagacaacgatggacggattgattacgaagaatttgttgcgatgatgcaaaagggaaatgctggtgtagggagaagaacaatgaaaaatagtctaaacatcagcatgagagatgtgtagatttaaatacccagcaaattggagctctgcagagctttcgttcg

SEQ ID NO: 29 - DNA, 502 bp, Arabidopsis thaliana
ttaattaatttatcagatcacaggaataagatggaggtatttggaaaatctcccatggttgttacatctgccaatgttatttacttgtctgcaattctgggtcgcgattgcgatggacacaaatgtgattggaaatgtgagaatgaaaatgtttgtgggaatatgtatcgctgcaaactaactggactaactcatgtctgcgacaagaactgtaaccagcggattctctatgataaccatagctctttgtgccgagccagtgggaggattttccctctctcgtccgtcgaggagcaggcggttaaaggtgttcggaggaagcttgacgccgctgagagtcatccttctgagagctgttcgtttaagcgtcgtcgtcgtgatgctcagttccatgcttctcctttcgagaggtcttttactgctgtgagccctatctgcagcccggctggagacggaatggagttggtttagattccatgttgatctccgcaaatggcgcgcc

SEQ ID NO: 30 - DNA, 741 bp, Arabidopsis thaliana
ttaattaaaaatctccaaagaacccgacaaagcgccatgtcgctcactatcccggcgaatctcgttctcaacccgagatctaacaaatctctcactcaatccgtacctaaatcctccgcaagattcgtctgctccgatgacaaatcctcctcctccacacctcaatccatgaaagctttctccgccgccgtcgccctctcttccatcctcctctctgctcctatgccagctgtcgctgatatctcaggtttgactccttgcaaggactcaaaacagttcgctaaaagagagaagcaacagatcaagaagcttgaatcttctcttaagctctacgctcctgaatctgcccctgctcttgctctcaatgctcagatcgagaaaaccaaacgcaggttcgacaactacgggaagtacggattgttatgcgggtcagacggtttaccgcacttgatagtgaacggagaccagcggcattggggagagttcattactccagggattcttttcctctacattgctggatggatcgggtgggttggaagaagctacttaatagctattagtggtgagaagaaacccgcgatgaaagagatcatcatcgatgttcctttggctagtcggatcatcttccgtggtttcatttggcccgttgctgcctacagagagtttctcaatggtgatctcattgctaaggatgtttaaaaagggaacttgttttctgcttttgtgttacggcgcgcc

SEQ ID NO: 31 - DNA, 1341 bp, Arabidopsis thaliana
aactctttgtttcttgtttgttgattaacccttaattaaaaatggctaattcatgggatcagttaggagaaattgcgtcagtggctcagcttacaggcatagacgctctgaaactgattggaatgatagtaaacgctgcgaatacagctcgaatgcacaagaagaattgtcgtcaattcgctcaccatcttaagctcatccgtaatttgctagagcagattaaaaactctgagatgaatcaacgttcagagattcttgagccgcttcaaggacttgatgatgctcttagaagatcttacattttagtcaaaagttgtcaagaaaaaagttatctttacttgttggctatgggctggaacattgttaaccagtttgaaaaagctcagaatgagattgatctgtttctcaagatcgttccactaataaatatggcggataatgctcggattcgggagaggctagaagctattgaacgtgatcagcgtgagtatactcttgatgaagaggatagaaaggtgcaagatgttattttgaaacaagaatctactagagaagctgctacatcggttttaaagaagacgctctctcgttcatacccgaacatggggttttgcgaagcgcttaaaaccgaggaggagaaactgcaacttgagttgcaacgttcgcgggcgcggtatgatgctgatcaatgtgaagttatacaacgtttgattgatgttacacaaactgctgctactgttgaacctaatcttgaaaaggtgttgactaagaaagaagagcttacctctagcaagaagagagatgatttgtatgacacggatagtagtagtattcgagcagattcaagatcaacgtcttatgtttcatccggacatgaactactttcgggaagatcattgcaacaccgtggaaattggcacgccgacttgctggattgttgttcagaaccttgtctttgcttgaagacactctttttcccctgtggtacattggcaaagatttccactgtggcaactagtaggcaaatctcttcaactgaagtgtgtaagaacctaatcgtgtattctttgatactctcatgctgttgctatacttgctgcataaggaagaagcttcgaaagacactgaacataacgggagggtgcattgacgactttttgtcacatctaatgtgttgttgttgtgcccttgtccaagaactgagagaagtcgagattcatcgagcttcttacggtacagagaagagtaataaggaaatgagtccaccaacacctcagtttatggaagaatgagggcgcgccaaaaattggagctctgcagagctttcgttcgtatcatcgg

SEQ ID NO: 32 - DNA, 1122 bp, Arabidopsis thaliana
aactctctgtttcttgtttgttgattaacccttaattaattgattttgttgttgctttggaatcatctgcaaccaccatgatttctgattcgatcaccaacgcttctgctacttcagctccaaccgccagggatttcggaaaaaagaaaaggacgaacaggtcggccaaattgaaacagagcaagctaggtcttcgtcgtgaacaatggctttctcaagttgcgatgattaacaaaggggataaggaggaaatggaatccaatcgaagaattgggagtgaaaagcctgatcagagagatcttccgcgtccggtggagaatttagatgaggataacaatggaacacatcgtcatgagagctttattgagtcactttctaatagccctaacagtattcttagtggcatgaattcaattcctaattttagcagcagcagtagcagtggaagtggtggctcttgctctggtaatataacagaggaggaagatgctgatgatgatggttgtttggatgattgggaagctattgctgatgctttagctgctgatgatgaaaagcatgagaaagagaatcctcctgagtcttgccaagagcatgaggatatcaagcaatcagctttaatcggtggagctgatgtggttttaagggatgcaaaggcggattctcagagaaggaagcaaaagagtaaccaggcgtggaggccagacgataagctccgtcctcagggtctgcctaatttggaaaagcagcgtagttttccggtcatgaatttgcattttagttctgtgactgtggtgccatcttcgtgccctatttgctacgaagatcttgacttaacagactcaaatttcttgccatgtccttgtggattccggctttgccttttctgccacaagacgatatgcgatggagatgggcgttgtcctggttgcagaaagccttatgaaaggaacacaatcaagtttgaagctagtgttcaaggtggtggtctgactattcggcttgctcgttcgtctagcatgttttgcaggtcatgaagaaaggatgtgtggcttttctcggcctgtgtctgttggcgcgccaaaaattggagctctgcagagctttcgttcgtatcatcgg

SEQ ID NO: 33 - DNA, 1399 bp, Arabidopsis thaliana
gctttcaaactctttgtttcttgtttgttgattaacccttaattaagatggccttaaggccttgtactggattcacaatctcctctcttcgcaacgcttccgccgccaacaacaatctcttctctctcctctccttctcttcgtcgtctccggcgaagaggaatcttcttctctcttcgctccaggacaatctccgtcgtttcgcatccagcgcttctctttaccgtcaacatctccggaatcaacaacaacaacatcagcaacaacagcaatcgcgcgtgaaagaaaaatcagaaacgctggctcagaagatcggtaaatctatccggcgtgccggtgcgccgtcgaaagctagggtttacgctgatgtcaacgttgttagacctaaggactattgggattacgagtcccttgctgttcaatggggtgtacaggatgattatgaggtggtgaggaaggtaggaaggggaaaatacagtgaggtctttgaaggcattcatgctactgataacgagaaatgtgttatcaagattttgaagcctgtgaagaagaagaagattaagagagagattaagattctgcagaacctctgcggtgggcctaatattgtaaaattgctcgacattgttagagatcagcagtctaagacgcccagcttgatatttgaacatgtgaacaataaagatttcaaagttctctatccaactctctcagactatgatgttcgatattacatttttgaacttctaaaggcgttggatttctgccattcacgtggaatcatgcacagagatgtgaaaccacataatgtcatgattgatcacgagcagcgaaaacttcgtttaattgactggggtttggcagaattctatcatcctgggaaagaatacaatgtccgtgttgcttcaaggtactttaagggtccagagctgctggtggatttacaggactatgattattccttagacctatggagtcttgggtgtatgtttgctggaatgatattccgcaaggagccgttcttttatggccatgacaactatgatcaattggtcaaaattgcgaaggtgcttggcacagatgaactcaacgcctacctaaacaaataccgtatagagttggaccctaatctaacatccctcgtgggcagacatagccggaagccatggacaaagttcatcaattctgaaaaccagcacttagcagttcctgaggctgttgattttgtggacaagttgctgagatatgatcaccaagaaaggccaacagctaaagaagcaatggcgcatccatatttctatccgattagaaatgcagagagcagccgtacgccgcgcagccagtgaatttaaatacccagcaaatacccagcaaattggagctctgcagagctttcgtt

SEQ ID NO: 34 - DNA, 2121 bp, Arabidopsis thaliana
tgtcagctttcaaactctttgtttcttgtttgttgattaacccttaattaagatggcactttgtggtgtttgttcgactccaaatctgccgaatttacaagtgtttcgttctgttaggaactcgagcattggttataaacgaaaccatagtctatggcagctcagaagttcatcatttcgtgctaaatctgtgatatttcattgttcatcgtccttaagacagtcaccatctaatgtggaggagatagatgataatccttcggtatcattagaggatgaatcagcacatgtgatgcagttcaagtggtctgattttaggattcttgatcgtgttagcattggtcatggcggcagggctgatgagcttgtgtttgaagctatagttcaggttccagatagccctttgtttaaccaaggagttgttcttcggaaattgaataccactcgagctcaaagacgaggaagaagagctatagaagtttttaagaagctagttcgtcggagacttctctaccattcttactcaatgcaagttcacggttatatcaccaataacttaagcgatgatcagtactcatttacccttgtacatgggtgccatggaagtttctcgattaggcactggcttcaacaatctgattggattccaacattagaagctactcttgcattagatgaagaatcctttcgaagggtgggtgatgatactactggagggcctgcagtttcaaggcagttaagactaatccgtacactaatgagggatattttgatcggagtcaattacttgcacagccatggtctggctcacacagaactgagattggaaaatgtgcatattagccctgtggatagacatatcaaagtagggattctcggaaatgctgctgactttaacggggatgttccaagtactagcaacgcttacagtaccatggacagacgacaaatgatgatagcatttgacatgagatgtgttggattcatgatggcaaaaatggtacttcaagaattgatggatccattaatctttgcgaaattgaagtctttcctggcaaaggggaatgatccttcctcgctgcgggagttttttgtgacgacgctcaatacaaactctgaatctggaaataccggagtgcaaatacttgatagaaactggggagcaggttggcaccttttatctttgttaattgctaccagaccttctgaaagaataagttgcttggatgctcttaagcatccctttctatgtggaccaagatggcgtgttgccccatcaatggatatcatcagatggggtcttggatcaaccgcagtaaagatttcagaagaatacatttaccgcatgcctcagcgccaaagacttgcccacttcattggactgatggagatgctaaatccttatccaaagccaaactgttggttggagcttttaccgggaagatggcgtcttttatactcaactggaaagcacataggtctaactctgcgtcagccttccacacgtgccttaataggcaacgttcacttaacgataactcgagcttcagaatccataaacaacacttcactttcctttacctctgatatacgcttcactgccataaccagcaaagactggccacacaacaaaatcggagctgctgggaaattacaaacgctctctcaattcagactaatagctggaaaaagactttacctcaaagaagagaaaaagaacattggtaagttctcaatgggtgaaccagatgctgaagaaggtttagccgagaagcttgaaaccgagaaatggaaaaaagtcgtgcccttcaaggagtttccgtcgagtcttcctgtagcaaaactcgtctctggagaaatcgaagtgacgatgaacatgaatgatcatatagattcacctgggagtgtgattggagaagttagaaagcaaattccgccggaaatgttcgatctttctaagcttgtgtgtgggacttatatagacagtaggttacttgtacttaggtgtgtaaatggttcagcattgttgttcacaaggtccagcttggaccataagtctatgtagatttaaataaaatacccagcaaattggagctctgcagagctttcgttcgtatcatc

SEQ ID NO: 35 - DNA, 1448 bp, Pseudomonas putida
aactctttgtttcttgtttgttgattaacccttaattaatccgggcgcgcctgatttatcacaagtttgtacaaaaaagcaggctcctgcaggaccatgagcaaaaccaacgaatccttgatgcaacgtcgtgtagctgccgtcccacgtggcgtcggccagatccacccgatcttcgtcgacaccgcgaagaactcgaccgtgatcgacgttgaaggccgcgaactgatcgacttcgccggcggcatcgcagtactgaacaccggccacctgcacccgaaagtagttgcagccgtgcaagagcagctgaccaaggtcagccacacctgcttccaggtgctggcttacgagccctatgtagagctgtgcgaaaagatcaacaagctggtcccaggcgacttcgacaagaagaccctgctggtcaccaccggctccgaagccgttgaaaacgccgtcaagatcgcccgtgctgccactggccgcgctggcgtcatcgccttcaccggcggttatcacggccgtaccatgatgaccctgggcctgaccggcaaggtcgtgccgtactccgctggcatgggcctgatgccaggcggcatcttccgcgccctgttcccgagcgaactgcacggtatcagcgttgacgacgccatcgcctcggtcgagcgcatcttcaagaacgacgccgagccgcgcgacatcgccgcaatcatcctcgagccagtacaaggcgaaggcggcttcctgccagcgccgaaagagctgatgaagcgcctgcgcgccctgtgcgaccagcacggcatcctgctgatcgccgacgaagtacaaactggcgctggccgtaccggcaccttcttcgccatggaacagatgggcgttgcgcctgacctgaccaccttcgccaaatccatcgctggcggcttcccgctggccggtgtgtgcggcaaggccgaatacatggacgccatcgcgcctggcggcctgggcggtacctacgccggttcgccgatcgcttgcgccgcggccctggccgtgatcgaagtgttcgaagaagaaaaactgctggaccgcagcaaggctgtgggtgagcgcctgaccgccggcctgcgcgaaatccagaagaagtacccgatcatcggcgacgtccgtggtctgggctcgatgattgccgtcgaagtcttcgagaagggcactcacaccccgaacgctgctgctgttggccaggttgtcgccaaggctcgtgaaaagggtctgatcctgctgtcttgcggcacctacggcaacgtcctgcgtatcctggttccgctgaccgccgaagacgcgctgctggacaaaggcctggccatcatcgaagagtgcttcgctgaaatcgcctgactcgagacccagctttcttgtacaaagtggtgataaattggagctctgcagagctttcgttcgtatcatcggtt

SEQ ID NO: 36 - DNA, 1454 bp, Xenorhabdus nematophila
aactctttgtttcttgtttgttgattaacccttaattaatccgggcgcgcctgatttatcacaagtttgtacaaaaaagcaggctcctgcaggaccatggctgaatctatgttagctaaaaggcgcagcgcggctatcgcaaaaggcgtcggcgtgacgacacaagtctatgttgaacgtgcggaaaatgctgaaatctgggatgctcaggggcaacgctatattgattttgccgcaggtatcgctgtggtgaataccggccaccgccacccgcgcgtcattgccgcagccagagagcagctggaacaatttatccatacctgtcatcaggtcgtgccttatgaaaattatgtagcgttagccgaacgactgaaccgtctggtgccgggtaatttcgtgaagaagaccgtttttgttaccaccggggctgaggcggtagaaaatgctgtgaagatcgcgcgtgccgcaaccgggcgcagcggcgtagtggctttcagtggcgcttttcatggccgtactttcctcggtatgtcattaaccggcaaagtcgtgccgtacaaaatggggttcggctcgctggttagcgacgtttatcgtgttccgtttccggtagcgctgcacggtatcagcgtggaacagacgctgaacgcgctggataatctcttcaaaaccgatattgagccgacgcgtgtcgctgccatcatcattgagccggtacagggagaaggcggtttctatcctgcgcctcccgaactgctcaaatccctgcgcgaaattgctgatcgctacggtattgtccttattgccgatgaaattcagaccggtttcgcgcgtaccggcaaactgtttgctatggaacatcatgaggttgcagccgatctgaccacgatggcaaaaggtctggcagggggatttccgctggcggctgtaacggggcgagcagagctgatggatgcggtagcaccgggtggcttggggggaacctatggaggtaatccggtggcgattgcggctggccatgcggtgctggatgtgatcgaagaagagaagctggctgcgcgtgcgacgcagctgggagagcggctaaaacaatgtctgaatgaactgcggccgcgtgtcccgcagatcgccgacgtgcgtgggcttgggctgatgattgctgtggaatttaaccgtgcggacagtcaggaacccgatgccggctttaccaacgccgtgcgtcagaaagcgctggagcggggtctgattctgttggcgtgcggtatacacggtaacgtgatccgttttcttccaccgctgactatacaaaatgatgtttttgacgaggcgctcaacgttctggagtctgtactgctcgatctgaaccgtaccgccgtttaactcgagacccagctttcttgtacaaagtggtgataaattggagctctgcagagctttcgttcgtatcatcggtt

SEQ ID NO: 37 - DNA, 1643 bp, Xenorhabdus nematophila
aactctttgtttcttgtttgttgattaacccttaattaatccgggcgcgcctgatttatcacaagtttgtacaaaaaagcaggctcctgcaggaccatgggtcagaacgtttatcaatttatcgacttacagcgtgtcgatcctccgaaaaagccgttgaaaatccgcaaaatagaatttgtggaaatttatgaacctttttctgaaatgcaggttgaggcacaggcagatcgctgcctttcatgtgggaatccctattgtgagtggaaatgccctgtgcacaactatattccgaactggctgaaactcgcgaatgaaggccggattattgaagcggcggaactctcccaccggacgaatagcctgccagaagtctgcggacgagtctgtccgcaagatcgcctgtgtgaaggtgcctgtacgctgaatgatgactttggtgctgttaccatcggcaatattgaacgttacattaacgacaccgccattgcgatgggctggaagccggatatgtcagacgtgatcccgacaggcaaacgtgtggcagtgattggagccggccctgcggggctggcctgtgcagatgtcctaacccgcaacggcgtacaagcggtagtttacgatcgccaccctgaaattggcggcttgctcacgtttggcattcctgctttcaaactggaaaaagacgtgatgatccgccgccgtgaaattttctccgacatgggtatcgaattccgcttaaacacggaaataggcaaagacattacgcttgctgaactcaccgagcaatttgatgctgtatttctgggcgtgggtacttatcagtctattcatggcggacttgaaaacgaaggtgctgacggagtctatgatgccctgcccttcttaattgccaatacccgtcatttaatgggctaccccgctttaccggaacaaccttatgttgatatgaaaggtcagcgtgttctggtactcggaggcggtgatacagcaatggattgcctgcgcacttctgttcgccaaggcgcaacccatgttatctgtgcttatcggcgggatgaaggcaatatgccaggttctcgtcgagaagtgaaaaatgccaaggaagaaggtgtggattttcagtttaaccttcagccgctcagtattgagatcaatagcgcaggtcaagtttgcggcgtcaaagtcgcgaaaacacaacttggcgaaatggatgaaaaaggccgccgtcgagctgaaatcattcagggctccgaatttcggatcgaaaccgatgctgttatcacggcgtttggtttcaaacctcacaacctgcactggctgaatgcgcatcagatcaatctcgatcagcagggacgtattgttgctcctgaagccagcaacctgcccttccaaaccagtaatcctaaaatattcgcaggcggggacgctgttcgtggttctgatttagtggttactgcgattgcggaaggtagaaaggcggcatccggtattctcgactatctcgaggtttaatccctattcactgtttcttcaattacttctccggtcttttgacctcgagacccagctttcttgtacaaagtggtgataaattggagctctgcagagctttcgttcgtatcatcggtttcgacaacgtt

SEQ ID NO: 38 - DNA, 1603 bp, Arabidopsis thaliana
ttaattaaatggtgaggttcgagaaggttcatttagtgttagggttagctctggttctaactctggtcggagctccgaccaaagcccaaggacctgtttgcggtgcaggcctgcctgacaaatttagcagattaaacttccctgaaggcttcatttggggaaccgcaacagcagcatttcaggttgaaggagctgttaatgaaggttgcagaggtccaagcatgtgggatactttcactaagaagttcccacatagatgtgaaaatcataacgctgatgttgctgtggatttctatcatcgttacaaggaagatatccagttgatgaaagaccttaacactgatgcttttagactttctattgcgtggcccagaatattcccccatggaaggatgtctaagggaataagcaaagtgggagtccaattctaccacgacctcatcgatgagcttctcaaaaacaatataataccattagttacagtctttcattgggatactccccaagacttggaagatgaatatggtggtttcttaagtggtcgcatcgtgcaagattttaccgaatatgcgaatttcactttccacgaatatggacacaaagtgaaacattggatcacatttaacgagccatgggtgtttagtcgtgccggttacgacaacggaaagaaagctccgggacgttgttcgccgtacatccccggttatggacagcattgtcaggatgggcggtctggatacgaagcttatcaagtcagtcacaacttactcttgtcgcatgcttacgctgttgacgcattcagaaactgcaaacagtgtgctggaggtaaaattggaattgcacacagtccagcttggttcgaaccacaagaccttgagcatgttggaggttccattgaacgtgtgcttgatttcatcctaggatggcatttggctccaacaacttatggagattatccacaatcgatgaaggatcgtgtcggtcatagattgccaaaattcacagaagctgagaagaagttgctaaagggttctacagattacgtaggaatgaattactatacttcagtgtttgcaaaagaaattagccctgatcctaagagtccgagttggacgactgattctcttgttgattgggatagcaagagtgtggatggatacaaaattggtagcaagccgtttaatggtaaactggatgtgtattcaaaaggtttgagataccttttgaagtatattaaggataactatggcgacccagaagttatcattgccgagaatggatacggagaagaccttggagagaagcacaatgacgtaaactttgggacacaagatcacaacagaaaatattatatccaaaggcatctcttgagtatgcacgacgccatttgcaaggacaaagtgaacgttacgggatactttgtgtggtctttgatggacaactttgagtggcaagatgggtacaaggcgaggttcggactttactacatcgatttccagaacaacttgacccgtcaccaaaaagtttcgggcaaatggtattccgaattcctcaaaccacagtttccaacctccaagctgagggaagaactctagggcgcgcc

SEQ ID NO: 39 - DNA, 1580 bp, Arabidopsis thaliana
ttaattaagattatctaacccaaaagccaaaaaaaaaaaaaatgaacggtggtgacgatgccgctactagtggtcctcctccgtctttagagtggagattctctcaggtcttcggtgagcgaaccgccggagaagaagttcaggaagttgacatcatttcagccatcgaatttgataaaagtggagaccatctcgcaactggtgaccgtgggggccgagtagttctttttgaaaggacagatactaaagatcatggagggtccaggaaggatcttgagcagacggattacccagttaggcatcctgagtttcgatataaaacagaatttcagagtcatgaaccagagtttgactatctcaagagtttggagatagaggagaaaatcaacaaaatcagatggtgtcagccagctaatggtgcattgtttctgctttctacaaacgataaaaccatcaaatattggaaggtacaagagaagaagatcaagaaaattagtgaaatgaatattgatccgtcagaaagttcaaatatccctcctcaattagttactaatggattacctgctgataaagggcatgactacctgagcaaggacttttctttcccgccaggaggcattccatctctgcgtttgcctgtggttaccagccaggagactaaccttgtggctagatgccgaagagtgtatgcccatgctcatgattaccatattaattcaatctccaatagcagtgacggagaaacctttatttcggctgatgatctgcgagtaaatctctggaatttggaaattagcaaccagagtttcaatattgttgatgttaagcccacaaacatggaggacttaactgaggttattacatcagctgagtttcatcctatccattgtaatatgctcgcatatagtagttcaaaaggctccattcgtttgattgatatgcgtcaatcagctctgtgtgattctcatacgaaattatttgaagaaccggaagcacctggttcaagatcatttttcacagagataattgcctcaatttcagatattaaattctcaaaggatgggagatacatacttagtcgcgattacatgacgctcaagctgtgggacataaacatggattctggtccggtcgcatcttaccaggttcatgaacatctgagacccaggctatgcgatctatatgaaaatgactccatctttgataaatttgagtgttgtctgagtggcgatggattgagggtagcaacaggttcttacagcaatctattccgcgtatttggagcgtctcaaggaagtactgaagctgcgactttggaagctagcaaaaacccgatgaggaggcaaatccagacacctgcaagaccatccagatctataggcagtatgacacgcgtggttagacgaggatcagagagtcccggaacagaggcaaatgggaacgcctacgatttcacaacaaagttgctgcatatggcttggcacccaacagagaactcaattgcttgtgcagcagcaaacagcttgtacatgtactatgcatgagttgggaagagagagagaagacataaacggcgcgcc

SEQ ID NO: 40 - DNA, 1585 bp, Bacillus subtilis subsp. subtilis str. 168
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggataaaaaaactctcaaagacatcgacgtaaaaggcaaagttgtattctgccgcgttgactttaacgttccaatgaaagacggggaagtaacagacgatacacgtatccgtgctgcgcttccaacaatcaaacaccttgcagaccaaggcgcaaaagtccttcttgcgagccacttaggccgcccgaaaggcgaagtggttgaggagcttcgtttaactcctgtcgctgcacgtctcggcgaactgcttggcaaagaagtgaaaaaagcggatgaagcatacggcgatgctgtaaaagcacaaatttctgagatgaaggacggagacgttcttgtattggaaaacgtacgtttctatcctggtgaagagaaaaatgatcctgagcttgcaaaagcatttgctgagcttgcagatgtatatgtaaatgacgcattcggtgctgcccaccgtgctcacgcatctacagctggaattgccgagcatctgccagcagttgcaggtttcttaatggaaaaagagcttgatgtacttggaaaagcggtttccaatcctgaccgcccgttcacagcgatcatcggcggagcgaaagtaaaagacaaaatcggtgtaatcgaaagtcttcttgataaagtagacaacctgatcatcggcggaggtcttgcttatactttcgtaaaagcgcttggctatgaagtcgggaaatctcttcttgaagaggataaaatcgagcttgcgaaatcatttatggaccgcgctaaagaaaaaggcgttaacttctacatgcctgaagatgtactcgttgcagatgatttctctaacgatgcaaacgtgaaaattgtgccgatctctgaaatccctagtgatttagaagcaatcgacattggtacgaaaacacgcgaaacgtatgctgacgtcatcaaaaacagcaaacttgtcgtgtggaacggaccaatgggcgtattcgaaatcgacttgttcgctcaaggaacaaaagcggttgcggaagcattggcagaggcgaaagatacatactctgtcatcggcggaggagactctgcggcagcggttgaaaaattcggccttgctgacaaaatgagccacatctcaacaggcggcggcgcatcccttgagtttatggaaggcaaagagcttccaggggtagctgcactgaacgataaataactcgagacccagctttcttgtacaaagttggcattataagaaagcattgcttatcccaaatacccagcaaattggagctctgcagagctttcgttcgtatcatc

SEQ ID NO: 41 - DNA, 2407 bp, Arabidopsis thaliana
ttaattaaatggtcttagtgctatacgagacagcggcggggtttgccctctttaaagttaaagatgaaggaaagatggctaacgtcgaggtgagttctcttcattcttttgtactctctttgcttatccttaaggctctaaaagtattcatggattattttttatttttttttgcaggatttgtgtaaagagttcgacactccagactcagcacgaaaggtaatttttttgcttcttcatcaagtgtggtttcagaacatctaaaattagatttagtgttgagtttctcatatgtttttattggtgtaccagatggttaagctaaaagcttttgagaagtttgacaatacatctgaagctctcgaagctgtggctaaattgctggagggagctccaagcaaaggtctgcgcaagtttttgaaagctaattgtcaaggtgaaaccttggctgtggctgattcaaagcttgggaatgttatcaaggagaaactggtttgtaattcccatcattacacccatattcctgtctgctctgtgttttgtttctaatgaaagttcttaatttcatacagaaaattgattgcattcacaacaatgctgttatggagcttctacgtggtgttagaagtcagtttactgaactcatatctgggttgggtgatcaagacttggctcctatgagcttgggtctgtctcacagtctcgccagatataagctaaagtttagttctgacaaggtatcttcggttcctgactaattgtattggtctttttatttggtgatatgatatgtgaagtatatgaatttgttaattgatcgaagctaacttgtgttaaattatggaacttctgtattgaactagcctttgattgtccgacattaaacgtttcctgtgtttgtttttgcttctcttgcatctcctaactgtttagtttttgtcaggtggataccatgattatccaagctattggtctgcttgatgatcttgacaaagagctgaacacatacgccatgagggttagagaatggtatggatggcattttcccgagcttgctaagatcatatcagacaatatcctatatgccaaatctgttaaattgatgggaaaccgagttaatgctgctaagctagacttctccgaggtaactttcaattttgtaaactgtgtagaggcttccatgaacaaacgccttgattaacgacctaatattctcctgtttctggtttcattgtagatcttagcagatgaaattgaggcagatcttaaggacgcagctgtgatatccatgggaacagaagtcagtgacttagacttgttgcacatccgtgaactctgtgaccaggttctctctctttctgagtacagagctcagctttacgattacctaaagagcagaatgaacactattgctcccaatctgactgccctggtaggagagcttgttggtgctcgtcttatttcccatggaggtagtttattgaacctctccaagcaacctgggagcacggttcagatactcggagccgaaaaagctctctttagagctcttaagacaaaacacgccacacccaagtacggtttgatttttcacgcatctctggttggtcaagcagcaccaaagcacaagggaaagatctcgcggtctttagctgctaaaactgttcttgctattagggttgatgctcttggtgatagccaagataacactatgggccttgaaaaccgagctaaggtaacaaaattcttcaatagctttcctcttgttggtatctctctgaacaatcttttttcctccttcttaactgatgatgtttctgatatgtgttaaaaactcacagcttgaagcgcggttgagaaatcttgaaggaaaagatttaggtcgtctgtctggttcatctaaaggcaaacctaagattgaagtctataacaaggataaaaagatgggatcaggcggtcttatcactcctgctaaggtcacgatcattctctctgtttttgattcatcatcttttcttctaattttggatgtgtgtacatattgtctttgttcttgggattatgatgaagtgatcttgactgttttttgttatgtgcagacttacaacactgctgcagattctcttcttggggaaacctcagctaaatctgaggagccatcaaagaagaaagataagaaaaagaagaagaaggtagaagaagagaaacccgaagaggaagagccatcagagaaaaagaagaagaagaaagctgaagcagaaactgaagccgtagtagaggttgcaaaggaggagaagaagaagaataagaagaagagaaagcatgaggaagaagaaacaacggagacaccagccaagaagaaggataagaaagagaagaaaaagaagagtaaggactgaggcgcgcc

SEQ ID NO: 42 - DNA, 1650 bp, Arabidopsis thaliana
ttaattaaatgatgaacacttcgaatgggatgatctctgggccttcttcttcgtcagcttcggcggcgaatcctcagtctccgggaatcaaaacgtatttcaagacgcctgaaggaaagtacaagctccactacgagaagacgcatccctctgggcttcttcactacactcatggcaaaaccgttactcaggttactctagctcaccttaaggataaacctgctccatcgacaccaactgggacctcgtcaagttccacagctagtagcggtttccggtcagcaacagcaaggttattgggtggtgggaatggtaaccgtgcgcttagttttgttggaggtaatggaggggctaaaaatgtgggtgcaagttcaaggattggggcctcattcgctgcttctagttctaatacctcagctactaatacaaatttcgatgggaaaggaacttacttagtcttcaatgttggtgatgctatttttattagtgacttgaactcgcaggacaaggatccagtaaagtctatacatatcagcaattcaaaccctatgtgccatgcatttcatccagatgctaaggatggacatgatctacttattgggctgaactctggggatgtctacaccgtatcactaagacagcagttgcaggatgttggtaagaagcttgttagtgctcagcattataacaaagatggttctgtaaataacagccgctgtactagtatagcttgggtgcctggaggtgatggatcctttgttgctgctcatgccgatggaaatctgtacgtatatgaaaagaataaagaaggtgcaactgattcttcattttctgctataagggatcctacacagttttcagttgacaaagcaaaatatagcaagagtaatccagtagcgagatggcatattgggcaaggtgcgattaatagcattgcattttcaaatgatggagcgtacttggcaactgttggaagagatggttatcttcgaatttttgatttttcaacccaaaagctagtgtgtggtgtaaaaagttattatggtgctctattgtgttgtgcttggagtatggatggaaagtaccttttgactggaggtgaagatgacttggttcaagtgtggagtatggaagatcgaaaggttgtggcatggggtgagggacacaattcgtgggtaagtggtgtggcgtttgattcgtattggtcgtcaccaaattcagaggggtctggcgagaatgtcatgtatcggtttggttctgttggtcaggacacacagttactgctatgggacctagaaatggatgagattgttgttcccctacggcgacctccaggaggatcacccacttacagcacagggagtcagtccgctcactgggacaacattgttccaatgggcactcttcagccagcgccgtgcatgcgcgatgtcccaaagctctcaccagtagtggctcaccgtgttcacaccgagcccctctcgggcttgatcttcacccaagaatcattgataacagcttgcagagaaggccatttaaagatctggacacgacctgacacccagcccagcagcagctcagaagcaacaaatccaaccacaagcaaaccctcgctgaccagcaaggttggtggttccagttaaggcgcgc

SEQ ID NO: 43 - DNA, 542 bp, Arabidopsis thaliana
ttaattaaatggagaaaacagaggaagaggttgagatgaaggaactggtagggcttgtgagaatcctagtgaagagagggatcgatcttgctcgtcgagacgctctaagcagcgacccttttgtcgtcataaccatgggtccacagaagctgaaatcttttactgtgaagaataactgcaacccagagtggaacgaagagttgactcttgcgatcgaagatcccaatgaacctgtgaagctgatggtgtatgataaagatacatttacagcggacgacaagatgggagatgcgcagatagatatgaaaccgttcctagacgttcacaaactcggtttgaaagaacttccacatggaaaagagctcaagagaattgtgcccaccagagataactgcttgtctgaagatagcataatcgtctccgataatggcaagatcgttcaggacatgattcttctgttgaagaatgtcgaatgcggcaaggtcgagatccagcttgaatggcttaaaaatccaggtggtagtggactctgaggcgcgccc

SEQ ID NO: 44 - DNA, 1654 bp, Arabidopsis thaliana
ttaattaagagcaattatggcagcaatgaacatgattgactttcaaaactgcttcatctttatcctcctatgtctcttctcacgactctgttattctcacttcttcaagaaaccaaaggaccctcgccttcactttgatttacctccgagccctccgtctcttcccatcatcggtcatctgcaccttcttctctctgttctactccacagatctttacaaaaactctccaccaagtacggatctattctctatctccgagtctttaggttccctgtagtcctcatctcgtcagcctcaattgcatatgagatcttcagggcacacgacctgaacatctcgtaccgcggtttcactccgaccgatgattcactttttgccggatctttcagctttatctctgctccctatggagattattggaagttcatgaagaaggtcctagttacaaacgtttttgggccccaagcacacgagcagtcacgaggtgtccgtgcagatgtgctagagcggttttatgggaatctgttcgataaagcgataaagaagcagagcgtggagatatgtgctgaagcgttgaagttatctaactccagcatctgcaagatgatcatggggaggagttgttcagaggagagattcagggctttggctaccgagttagatgttttgacaaagaagctcttctttgcaaacatgttgcgagcatggtttaagaagcttgttgtctctctgtttaaaaaagaaactacagttatttcctacagattcgatgagctgctcgaaagcattcttgtggaacacgaaaagaaactggacgtgcatcatcaacgtacggacttgatggacgcattgttggcagcttatcgggatgaaaatgcagagtataagatcacaaggaaccatatcaagtcaattattgcggtaaatgtttctcccatcagtttgtttcattgagattaaaatctgatccgcctaagataacgttttgcaattgcaggatcttttatttgcaggcactgaaaaccaagtgcagacaatacaatgggcaatggcagagatcattaacaaccctaacgttcttgagagactgagaggagaaatcgatagcgtggtaggaaagtcaaggttgattcaagaaacggatttaccaaagctcccttatttgcaagctgtggttaaggaaacgataagactgcacccgccggggcctttcttcttaaggttcacaaaagaagggtgtaggatcagagggttctatgtaccagagaacacgtcagtcgttgttaacgtttatgctgtgatgagggatcctgatgcttgggaggatcctcttgtgtttaagccagagaggttcttagcttcttcaagagcagaacaagaggaggagagaagagagaaagaaattaagtaccttccttttggaagcggaagaagaagttgtcccggagaaaatctagcttatgtcattatgggaactgcaattggagtgatggtgcagggttttgagtggagaaccacagaagagaaaattaacatggacgaggctgttgtaggactgagcttgaccatggctcatcctcttaagatcattcctgttgctcgaacctcaaactctttaacttcgagtttgcaaaaatgtttgtgaggcgcgcc

SEQ ID NO: 45 - DNA, 2372 bp, Arabidopsis thaliana
ttaattaaatggggagaacagagaccggcgacgaatcgtcggcgagaaagatgcgacgtaaagtacccacgtcgatcgaatctctagacgccgatatactgtgcatcatcttctcttttcttgatttgttcgacctcgttcattgtaccgtcgtctgcaattcctggtactcccttcaatccaaatccctagcttcttttttctcatggttgcgaatcccgtgttgaccttattcgaacttttttcttattgaggaatgctgttatcaaaaggctgaagctgctacaagcttcttgccggaagatgcaccatctcggttccgactctcccagtagctccacgtcacttgatcgtccagctgagatagatgtggaggattttgcgatgaagcatcacaagatggcattgttaaggggtcgaatcgaaattgagcgatgggaagctcattctcaccggtgaggcaatttttccattgggattgtttttcaatgttccagagattttgtttactcttgccatgtttctaatgttctctatgtcagggtttctcagtgtcgaatgaagaaaggtttgcttcttactggtgtcggtgataaggttaggattttttttagtatacaattcgattaggtattgtatgtgttatctaagtagcactggctaagttaatctgactactttgatcaggttatgcgcctctggtcattaaaaagctacaaatgcatggaagaatactcccttcctgatgcttcttccttgattgacttcgattttgatgagagtaaggtaaaccttctctaaaggtcatggatattacttaaactgggaatgagctaaaaatggatttaatgatcaatgatgatacagaaacctcagtcaagtcactgacatgaatttctgaaaccaccagtatagcagtataatctgtttccatgtcacagtttgcctcacctgttgtagctgaatatttccttttggctaaatcttgctattttctatagaaattggaagttgtatctctagcatgggagtattttgattctgttgttgttgttgttgttgagattgttggcttggttggtacccgcattagcatatggaggagaaatggacaaagaagcatttttccatctcgtgcaggcacctttcctaaaggcctttgtatgcggtatgtcagaagatactctcctgatatcaagttcctgagaacctatctgtttctatagaaagatcaactgatattccatgttactgacaaaagtcggtgtgatacttcaacatggctacctagcccctctgcccctgtaaggttgttggcttctctatccacactgataagttgtatgttttctttttcaaccagttacattgacccagaagctgtagttggatgcgaggatggaacagctcgtgtatttgatatgtacagtaagacatgttcacagatcattaggtaagctatgtattatgtgtctgttgtgttatggaacaacacagtgaaactggaaaagaacggtttttcattatcaaaattgtttacaatttcttttgagaaagctaaatcacaattttcctatcagattggttaataactatgtatgtaattgcaggactcagggtgggccaataacatgcttatctctaagcgataatcaactatttcttagtgggtcgtcactcgggagagtaacagtatctgaccctttgatggatcaaccagtggccactcttaaatccacgataactgcaggaggtaaactcaaactcaatgtcagattgcatctccagtgacatttcttaaagcaacctccattctctacaggtatacagacaatctgttttaaccaaggcactaatctcgccttcattggaacaactggtggatatgtttcatgctgggacctcaggtatgttaaaatagtcgtctaaggtttttttcaaagatgcaagttttaattcactatcttaagacgttataaccaactattatctaacaggaaaatggatagattgtgggaaaaacgagtgagtcctaatgtcgtgtactcaatacaacagctaaggaatgacacatcggttatggtagctggtggaatagacggtgtgctgcgtatgattgatcagaagagtggaagggttttatctagagttataatggacgataaattctccacaacatcaacaaggaacaaccaagtggtgatagagaaaagaagaggaaaaagagtttctcaagacatggagattgataaaatcgaaaggaaagttcggcctcaaatcagttgcatagcaatggggatgaagaagatggtaacggctcacaatggtaaatgcataagtgtatggaagttcaatctctcgtaaggcgcgcc

SEQ ID NO: 46 - DNA, 939 bp, Arabidopsis thaliana
ttaattaatcggaatctaatgggtaaaaccaccgggaacagagattggactcagatctacgctatttacggaatcgaacaatggcagacactcgtcttccttctcttccatgctttcttcttctctcttctctctcttctcttcctcatctacttcgatcagatttgcttcttcctcgattccttcttcctctccggcgccgccagattagccgcgggtttcaccggtgctgtaaccgctctctccgcggtttgtctactcttcgccgcagctaatttcgtttactcagatgttccgcttcagtacgagatggctcaacgcatggttagctccgtcggtgactggtcttgtgtcaaaactgctctcgatctcggttgtggccgtggtatcctcctcaatgccgtcgctacacagcttaagaaaaccggtagctccggtcgggtcgtcgggttagaccgctctaaacgcaccactctctccactctccgcaccgctaaactcgaaggtgtgcaagagtatgtgacatgccgtgaaggagatgtgaagacgttgccgtttggcgataattacttcgacgtggtggtctcgtcggtgttcgttcacacggtggggaaagagcatggtcagaagtcggtggaagctgcggcggagagaatgagagtgctcggagagattgtgagagttgtgaagccaggaggtttgtgtgtggtttgggatctcttacacgtgccggagtacgtgcgtcgtcttcaagagctaaagatggaagatatacgagtctcggagcgagtcacggcgtttatggccggaagtcacatcgtttcgttccggaaacccagtgaactcgtcgccgggccccgtgaagtccgcctcgattggagatgatgacgtggtgttcaaaacgacagtgatgtgtgtcggttcgttatatggcgcgcc

SEQ ID NO: 47 - DNA, 2018 bp, Arabidopsis thaliana
ttaattaaccattagaagatttcgaaaaagaaaaaaaaacacctccacaaacaaaacaatggcggtgaagaagaaatcatcttggagatcattgatggttttgtgtttccaagatccagacaacatatattctcccaagaagacaaagaaagatgatggtgaacgtgtgattaccaaacagaaatcgtttcttggattgtcgattctagacataagtaatccaagttccactaccttgtccgaagatctctcaatctccctcgccggctcggatctccacgtgttcacacaagcagagcttagagtcataacacaaagcttctcttctagcaactttcttggtgaaggagggtttggtccggttcataaagggttcatcgatgacaagctccgtcctggtcttaaggctcagcccgttgccgttaaacttcttgatcttgatggtcttcaaggtcaccgtgagtttatggttcgtacattcatttcattagtcctctgtttaagatacaaaaatattgagtctaaatgtctaactaatattatttttggggtgatttttttcagacggaggttatgtgtttgggaaaactaaagcatccgaatctggtgaagctgatcggatattgctgcgaggaagcacatagacttcttgtttatgagttcatgcctcgtggaagtttggagtctcaactcttcagaagtgagttgacttttttttattgtaaccatcaaatagaaatgatcatttcattttaagaaccagaactgatgaaattgtttcagggtgctccctaccgctgccatggacaacgaggttgaacatcgcttatgaagctgcaaagggtctacagtttctacatgaagccgagaagcccatcatctatcgcgatttcaaggcctctaatatcttgttagattctgtaagcaagcattcttcttttttgatcttaagggttacaccaaactagaccattttagttttagagcggacaataacctaaaatggacatatttgtttctttctattcaaattatggtggaaccgcaaattacatccatggtcaccattcaaaattataattgcttttggatttgaatagacttttgatgttttgatttcttttttcaggattatacagcgaaactctcggacttcgggctagcaaaagacggaccacaaggcgatgatacacatgtgtcgactcgcgtgatgggcacacaagggtacgcggcgccagagtacataatgacaggtcatttaacggctaagagtgatgtgtacagctttggagtggtgttgcttgagctgttgacaggtcggaaatcggtggacatagcgagatcatcaagaaaagaaaccctcgttgagtgggctcgtccaatgctcaacgacgcacgtaaactcgggagaataatggacccgaggcttgaagatcagtactcagagaccggagcacgaaaggcagcaactctagcttatcaatgcctaaggtaccgaccaaagacaaggccagacattagcactgttgtctccgttctccaagacatcaaagattacaaagatgatattcccattgggatattcacttacaccgttcctaccaagccacgccgggaagttaaagagacaagtcttcaaaactttgacaagccacgccgtgaaactaaagtgacaagtcttcaaaacttcgacaaaacacgccgtgaagttaaagatacaagtcttcaaaacttcgacaaaacacgccgtgaagttaaagagacaagtcttcaaaacttcgacaaaacacgccgtgaagttaaagagacaagtcttcaaaacttcgacaagcctcgcaacgtttccacgactgataaccatcaaaagttccggtcgcccgcacacacggcaagaaaccaccggataactttgagaaacggatataattcaccaatgcgtaacgaggccggaggggaacggtactgactactgagttctcttctatcctcaattcgtaatcttttcattttggcgcgcc

SEQ ID NO: 48 - DNA, 2568 bp, Arabidopsis thaliana
ttaattaagagaaattaagctgaaatctgataaatgggtttgtttaaattcatcttcttgttatctcttctatggagtttctacagtttaggctcatctcagctacaagcttcacaagcacaagttcttcttcagctgaaaaaacacttagaatatccacaacagctagaatcttggtatgatcacagaaccaatttctgctacttacaagcaacaccatcgatgaacatcacttgtttctctaattcagtctcagagctaaacatcttcggtgataagtcatcagaaaaagccaaaagctttgatggttttgctatctctaatgttactttatctgatggattctccattgaatcatttgtcactacactgtcaaggctaaaatctcttagggttcttactctggcttctctagggatttggggtcgtctccctgagaaacttcatcgtttatcttcacttgagtatttggatttgagcaataactttctgtttggttcagtaccacctaagttgtctacaatggtaaagcttgaaactttcagatttgatcataacttcttcaatggcacattacctagctggtttgattcgtattggtatctcaaagttcttagctttaaaagtaataagctatcaggagagctacattcttcattactctcgttgtcaacaatcgagtatatcgatttgagagcgaattctctgagtggttcacttccggatgatctgaaatgtggaagcaaactctggtttatcgacatttccgacaataagttaaccggaaaacttcctcgttgcttaagcagcaagcaagatattgcgttgagattcaatggaaactgtttatctctagagaaacagcaacatccagaatctttttgtgttaaagaagttcgcgctgcggctaaagctgaagcaaaagcagaagcagaggctgcaaatgaatcaggaaaaagaaaatggaagaaaggagctttaatcggcttaatcgttggtatatcaatgtcggtattggttttagtctgctgtgtatttatcttgctcagaagaaaaggagtaacaaagaagcatgtccaccataatactgtccaagataatcatccaactactggattttcttccgagatactctcaaacgcaagtaagacttttttcctaaaaaaaccgcaagtcttaaatattgtgaaaaagatcgacttactattatcctttttttgtgtgattgtgatttagggtacatttctgaaacatccaagtttggttcagaggatttaccggtatgtagacagtttagcttagaagagatagttaaagctacaaagaacttcgataagactatgatactcggtgaaagctccttatatggcacggtaaagttcatgaaaaccatttgtgttttcacttttcagcatcatcatctcctttaaagagattctgacatttgcttaacatctttcagctttacaaaggaaatcttgagaatggaacaaaagtggcaataagatgcttaccttcatcgaagaaatactcgataaggaatcttaaactgcggttggatttgctcgcaaagcttagacacccgaatcttgtctgcttgttgggtcattgcatagattgtggaggaaaagatgattacagcgttgagaaagtctttttgatttatgagtacattccaaatggaaacttccaatcttgtctctcaggttaaatcttgtttaaagctcaaatctttgcagttttttctacaaaatatatctgaagaatactaaaatccttctttcgtgcggtttttggttttgcgcagataatagttcaggtaagggtatgaattggtcagagaggcttaatgttctcacaggtgttgcaaaagctgttcattttcttcacactggagttattcctggattcttcagcaatagactcaagactaacaacgttttgcttaaccaacatcggtttgcgaagctgagtgattatggtttgtccattgtctctgaagcaaccagacataacacagttaagctcgtttctttaatgttctgtttctgtttcacatgatatagcattgttttcataaacgtttttaaagtgcttagacagaaacatagacttatagctacattgtgtgtgtccgatgattctgatcctaacattgactaacaatgtcaaagccagctcaaacactcatagttacacttttgtatcaggaaatcgcaaaatcatggcaaatgtcaaggctagaagacgatgtttacagctttggattgattcttctacaatcaatcgttggaccatctgtatccgcaagagaagaagcatttctacgagacgaactggtacggctttggcaatatcacattcacaaaccagagttaaatcattgtacttattaaaagtgtttttcttatataatcaggcatcgttggagagcgaagaagggaggagaagaatggtgaatccgacagtacaagccacttgtcgaaacggatcactgataagagtgataactctgatgaacaaatgtgtttcacctgaatctttaagccgaccgtccttcggcgcgcc

SEQ ID NO: 49 - DNA, 1038 bp, Arabidopsis thaliana
ttaattaagcgatgacagaagcgacaggcctgaggcgtttcttttctaagttcatttgctgtgatgcagacgattcgactattgaatatgaaccatatgtgtacattccagcgaatagttactcgtatgccgaggttacgaaaattacaaacaagtttaatagagttcatggcaaaggagggtttggtgtagtttatcgtggagttttaaacaagcaacaagtagcagtaaagatgctaaaccgagcttccatctacaatattgtacagtttaccaaagaggttcacgactttgtaaaagttcgtcacaaaaacttggtgagcctcattggatattgcgatgatggtgagcacttggccctaatctacgaattcgtggcaaatggtgacttgaatgatcaactatctgggaagtttggtaatgtcccgagctgggaaaccaggttgaaaatcatcataggagtagcacaaggtctggagtatttgcatagcgagttgcgaatccttcaccgatatgttaagccgacaaatatcctactaggcgaaaactttgaagcgaaactggctgatttcgggctgtctagatcctctccaaccaaccctgacatacaagcgtcaaataagatttatgtcaagcctggaagagatccatatctgcatcaccaatacttcaactcgaaccggttaaaccaaacgagcgacatttatagctttggcattgttatgttggagatgataaccaaccagcctgtagttgacaacaagcgtgagagtcctcacatttcaaagtgggtcgatttaaaggtcgcgaaaggcgatactctagagattgttgatctcaggctaaacaatgactttgagcgcgactcggtcaggaaagctatggatatagcatgcagttgtgcagctcgtgctcataataggccaagcatgagccaggttgttatagagctcaatgagtgtctagccttagagatggctcgaagtaatggaagaactggggagacaactcagactcagtgaacaacagaggcgcgcc

SEQ ID NO: 50 - DNA, 994 bp, Arabidopsis thaliana
ttaattaatcatcatcactatggagattatcgaagatctaaaagagtcttcattggagactgtcagtgttcttggcaaattaggtaccttcggctttgtgtctctccagagtgattcaaacttagggaaatcatacgtcaagaagacaagtactctcgaacagtccaagaatctcgagaaggagctcaggatcatgcttcgtttccacaacaatcccttcatagtccgagcttcaagcgatcatcttcactttgcgactaacaccaaaagcatgagtttgtgttacatctacatggagtatgcttccttagggaatctcaacaagatgatctctgatgccggagggagattgtctgaagatagtgtcagacgtgccactcgtatgatcctacaaggactcaaggctcttcactctgaaggttttgtccactgcgacctcaagccatcaaatgtacttgtcttcccttccaacacacgtggagagccatgggatctcaagcttgctggtttcggtttatccaaagagcctactatggactctagcttgttgtttcctggaacccttgaggagtacatgtcgcctgaggccattgagcgggacaggtttgttgggaaggacaaactgatcggaccagcccgtgatatatggtctctaggacgtattgttcttaggatgtttgggggtattcctgttgaggtgagaggctctaacacatggaggctgtacgaagatatctctccggaggccacagactttgttaggcggtgcttggcatggcgcccttcgaatcgggccaccgtggatgagctcttagaccatccttttgctgctgaaaaacttccattgcttctttctttcttaagggttccttctttcgtaagaaggaatgtcaatgaaaaattgaatgttagacaagaagaactgattccaaagcctcaaggcttgctctggtgacaagaaaatgaagacagaaattatgaaccgaggcgcgcc

SEQ ID NO: 51 - DNA, 1021 bp, Arabidopsis thaliana
ttaattaagatggctactgctacgtctcaccaatcagtcgtttcatttgcttctctccggtcttctccttcttctacaatctctcaatgtggattcaagatcgattcttcactgagctttacatcgaaaaagacaaacttttgcaagattaaagcaatggcatcatcagtttcttatgacaacactctcttgtctccttccaagacaatccctgacaattctcaaaagaaatcaaatgaagcagctttgatattgattaggcatggagaatctttatggaacgagaagaatctttttactggttgtgttgatgtgccattgactgagaaaggtgttgaagaagctattgaagcagggaagaggattagtaacattcctgttgatgttatctttacatcttctttgattcgtgctcagatgactgcaatgcttgctatgattcaacaccgtcgtaagaaggtaccgatcatcttgcacgatgaaagcgaacaggcgaaaacttggagtcaagtttttagtgatgagactaaaaaccaatccattcctgtcatacctgcttggcagctcaatgaaagaatgtatggagaattacaaggtcttaacaagcaagaaacagccgagagatatgggaaagagcaagttcacgaatggcgtaggagttatgatattcctcctcccaaaggagagagtttggagatgtgtgctgagagagcagtagcttattttcaggacaatatcgaaccgaagcttgcagctggaaagaacgtaatgatagctgctcacgggaactcgctgcggtctatcattatgtatcttgacaaattgacttgccaggaggtgataagtctagagctatcgacaggtatacctcttctctacatattcaaagaaggcaaattcatgaagcggggaagcccggttggtccaacagaagctggtgtttatgcttataccaagagattggctcaatacagacagaagctagaggacgatagtgaagtactctgtgcctgaagtaaac

SEQ ID NO: 52 - DNA, 1560 bp, Sinorhizobium meliloti
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgactttcaagactctcgacgatctgaccgacatcgccggcaagcgcgttctcgtgcgcgtcgatctgaacgtgcctgtcaaggacggccaggtgaccgacaccacccgcatcgagcgcgtggcgccgaccattcgcgaactctccgagaagggcgcgaaagtcgttctgctcgcgcatttcggccggccgaagggcgagcccgtcgccgacatgtcgctgaaggcgatcgcctccgccgtcgaggagatcctcgaccagcgcgtctatttcgctgccgactgcatcggcgacaaggccgccaacgccattgccgaattgaacgacggcgaagtgctgctgctcgagaatacccgcttccacaagggcgaggagaagaacgattcggacttcgtgacggcgctcgccgccaatggcgacatctatgtcaacgacgccttctccgccgcccatcgcgcccacgcctcgaccgaggggcttgcccatcaccttcccgcctatgccggccgcaccatgcaggcggagctcgaagcgcttgaaaaggggctcggcaatccgaagcgcccggtcgtcgcgatcgtcggcggcgccaaggtctcgaccaagatcgaccttctgcagaacctcgtgaagaaggtcgacgcgctggtcatcggcggcggcatggccaacaccttcctcgcggcgcaaggcgtcgatgtcggaaagtcgctctgcgagcacgatcttgcggagaccgccaaggccatcctcgcggccgcctcggaagcgggatgcgcaatcgtgcttccggtcgacggcgtcgttgcccgtgagttcaaggccggtgccgacaacgaggtcgtcgatatcaaggccatccctgccgacgccatggtgcttgacgtcgggccgaaatcgatcgaggccatcaacgaatggatctcgcgcgccgaaaccctcgtgtggaatggcccgctcggcgcgttcgagatcgcgcccttcgacagggcgaccgtggcggcggcgaaacacgcggcagcccgcacccgcgccggctcgctcgtctccgtcgccggcggcggcgacacggtcgcagcactcaaccatgccgaggtcgcggacgatttcacctatgtctcgaccgccggcggcgccttcctcgaatggatggaaggcaagcccttgccgggcgtagatgttctccggcagcggaactgactcgagacccagctttcaaatacccagcaaattggagctctgcagagctttcgttcgtatcatc

SEQ ID NO: 53 - DNA, 1737 bp, Pseudomonas fluorescens PfO-1
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgacggtacccccgcgtgccgttcagcttaacgaagcgaacgcgttccttaaggaacatcctgaggttctgtacgttgaccttctgattgcggatatgaatggtgtggtgcgcggcaagcgcatcgaacgcaccagcctccacaaggtttacgagaaaggcatcaacctgccggcctctctatttgctctggatatcaatggttcgacggtggaaagcaccggcctgggcctggacatcggcgacgccgaccgtatctgctatccaatccccgataccctgtgcaacgagccatggcagaagcgcccgaccgcgcaactgttgatgaccatgcacgaactcgaaggtgaccctttcttcgccgacccgcgcgaagtgctccgtcaagttgttgcaaagtttgacgagcttggcttgaccatctgcgccgcgttcgaactcgagttttacctgatcgaccaggaaaacgtgaacggccgccctcagccgccacgctcgccgatctccggcaaacgcccgcattcgactcaggtttacctgatcgacgacctcgacgaatacgtcgactgcctccaggacattctggaaggcgccaaagagcaaggtattccggccgacgccatcgtcaaggaaagtgccccggcgcagttcgaagtgaacctgcaccacgtcgccgacccgatcaaggcatgcgactacgcggtcctgctcaagcgtctgatcaagaacatcgcctacgaccatgaaatggacaccactttcatggccaagccgtacccgggccaggcaggcaacggtctgcacgtccacatttcggttctcgacaaagaaggcaaaaacatttttgccagcgaggatcccgagcagaacgccgcgctgcgtcacgcgatcggcggtgtgctcgagaccctgcccgcgcagatggctttcctctgcccgaacgtcaactcctaccgtcgtttcggcgcacagttctacgtgccgaactcgccgagctggggcctggacaaccgcaccgtggccctgcgcgtaccgaccggctccgccgacgcggtccgtctggaacaccgcgttgccggcgccgacgccaacccgtacctgctgatggcttcggtgctggcgggcgtgcaccacggtctgaccaacaagatcgagccaccggctccgaccgaaggcaacagctacgagcagaacgagcagagcctgccgaacaacttgcgcgatgccctgcgcgagctggacgacagcgaggtgatggccaagtacatcgatccgaaatacatcgatatcttcgtcgcctgcaaagagagcgaactggaggagttcgaacactccatctccgacctcgagtacaactggtacctgcacaccgtttaactcgagacccagctttcaaatacccagcaaattggagctctgcagagctttcgttcgtatcatc

SEQ ID NO: 54 - DNA, 1147 bp, Arabidopsis thaliana
ttaattaaatgtcggcggagagttgtttcggaagctcgggtgatcaaagcagcagcaaaggagtggctactcatggtggtagctatgttcagtataatgtctatggcaatctcttcgaagtttctagaaagtatgttcctcctcttcgtcctatcggtagaggcgcttatggaattgtctgtgctgctacaaactcagagactggagaggaggtagctatcaagaagattggtaatgcttttgacaatattatcgatgctaaaaggactttgagagagattaagcttctcaagcatatggatcatgaaaatgtgattgctgtaaaggatataataaaaccaccgcagagagagaacttcaatgatgtttacattgtttatgagcttatggacactgatctccaccaaattattcgctctaaccaacccttaactgatgatcattgtcggttttttctgtatcagttgttgcgtgggctcaaatatgttcattcagctaatgtattgcatcgagatttgaaacctagcaatttgctcctgaatgcaaattgtgatctaaagcttggggatttcgggcttgcgaggaccaaatccgagactgactttatgactgaatatgttgttacacgttggtatcgagctccagagctgctacttaattgctctgaatacacagcagcaattgatatttggtctgtcggttgtatactcggtgaaacaatgacacgagagcccttgtttcccggtaaagattatgttcatcagcttagactcatcactgagcttataggatctcctgatgactcaagcttgggattcttaagaagtgacaatgcaagaagatacgttagacagcttccacagtaccctagacagaactttgctgctagattcccaaacatgtcggctggtgcagtcgatttgctggagaaaatgcttgtttttgatccaagcagacgcatcacagttgatgaggcgttgtgccacccatatttggcgccgctgcatgatatcaacgaagaaccggtatgtgtgaggccgttcaattttgatttcgagcaacctactttgacagaagagaacattaaggagcttatataccgtgaaacagtcaagttcaatcctcaagactcagtgtgaatttaaat

SEQ ID NO: 55 - DNA, 1538 bp, Bacillus halodurans
aaaaaagcaggctcctgcaggaccatggggaaaccaacaggatttatggaatataagcgggaaacacctccaaagaaagacccctttgaacgctcaaaaaactggcaagagtttacccttcttatgccggagagtgcattgagacaacaaggggcacgatgtatggattgtggtgttccattttgtcaaacagggacgtcaatggatggttctggggagattggttgccccgtctataacttgattccagaatggaatgacctcgtgtatcgcggtcactggaaggaagcgttagaacgtctacacaaaacgaataactttccagaatttacaggacgagtttgtcctgctccgtgtgaaggctcgtgtacggttgcgatcagcgacgacgctgttgcaataaagagcatggaattccatattgtagaacgtggattccaggaaggttggattgtgcctaaccctcctagatcgagaacaggcaaaaaagtagctgtcgtcggtagcggtcctgcaggcttagcagcagcggctcaattgaacaaagccggtcattgggtaacggtttttgaacgagaagatcgcatcggcgggctgttgacgtatggaattcctgatgtaaagcttccgtatcacgtagtggaacgtcgaatcaaccttttaaaagaagaagggattgaattccgcaccaatgttgaaattggaaaagatgtttcagcaaagcagttaaaagacgactttgacgcggtcgttttatgtacaggtgcgacaaagccacgtgatgtaaatgttaagggcagagagctcaaaggtattcacttcgccatggacttcttaacagcaaatacgaaaagcctattaaactcgaaccatcaagatggtaactatatttccgcaaaagggaagcatgtcgttgtgatcggtggtggagatacgggggctgattgtattacaacctctgtccgtcatggggcaaaatcgattacgcaatttgatattaatcgtgaaaaatcaaacgaacggcctgacaataacccatggcctttgttcccaatcgtccatacggtagaggacggccataaagaagcggcggctgtttatggaaaggacccgagagcttatcaagtcatgacgacaaaatttgtcggtgatgctgaaggtcatgtgaaggaaattcatacgatttctgtggaaacaaccgtgcatcctgatggaagcaaaacccgtgttgaaattccaggcaccgagaaagtttggccagctgaccttgtgtttctagctgtaggatttacggggccagaagaacagcttgttcgtgaactagagttggaaactgatacacgttcgaacattaaagctgagtatggtaaatatgagacgagcttagaaggtgtttttgctgccggtgataatcgccgtggacagagccttgttgtttgggcgatccacgaaggtcgtgaagcggcacgagaatgtgataaatatttgatgggagcctcgaatttaccgtaactcgagacccagctttcttgtacaaa

SEQ ID NO: 56 - DNA, 1256 bp, Bacillus subtilis subsp. subtilis str. 168
aaaaaagcaggctcctgcaggaccatgacagctttatctaaatccaaagaaattattgatcagacgtctcattacggagccaacaattatcacccgctcccgattgttatttctgaagcgctgggtgcttgggtaaaggacccggaaggcaatgaatatatggatatgctgagtgcttactctgcggtaaaccaggggcacagacacccgaaaatcattcaggcattaaaggatcaggctgataaaatcaccctcacgtcacgcgcgtttcataacgatcagcttgggccgttttacgaaaaaacagctaaactgacaggcaaagagatgattctgccgatgaatacaggagccgaagcggttgaatccgcggtgaaagcggcgagacgctgggcgtatgaagtgaagggcgtagctgacaatcaagcggaaattatcgcatgtgtcgggaacttccacggccgcacgatgctggcggtatctctttcttctgaagaggaatataaacgaggattcggcccgatgcttccaggaatcaaactcattccttacggcgatgtggaagcgcttcgacaggccattacgccgaatacagcggcattcttgtttgaaccgattcaaggcgaagcgggcattgtgattccgcctgaaggatttttacaggaagcggcggcgatttgtaaggaagagaatgtcttgtttattgcggatgaaattcagacgggtctcggacgtacaggcaagacgtttgcctgtgactgggacggcattgttccggatatgtatatcttgggcaaagcgcttggcggcggtgtgttcccgatctcttgcattgcggcggaccgcgagatcctaggcgtgtttaaccctggctcacacggctcaacatttggtggaaacccgcttgcatgtgcagtgtctatcgcttcattagaagtgctggaggatgaaaagctggcggatcgttctcttgaacttggtgaatactttaaaagcgagcttgagagtattgacagccctgtcattaaagaagtccgcggcagagggctgtttatcggtgtggaattgactgaagcggcacgtccgtattgtgagcgtttgaaggaagagggacttttatgcaaggaaacgcatgatacagtcattcgttttgcaccgccattaatcatttccaaagaggacttggattgggcgatagagaaaattaagcacgtgctgcgaaacgcataactcgagacccagctttcttgtacaaa

SEQ ID NO: 57 - DNA, 1300 bp, Arabidopsis thaliana
ttaattaaaatggaacagacaaaggatgattctgattttgaggatgattgtgaaacgaagaagatggagactgatacatcagctcaagaggcaaggaatggtaaagacatacaagggattcagtgggaagggtttaagtataatagagacgagtttcgtgagactaggttgaaacaatatgataactttgttaatatcttaaggcctagctctcgagaaaagcttgataaggaacatgggcaagtagttgagaaaggaaagaacttttatgacttccaattcaatacaaggcttgtcacttccactattgtgcattttcagcttcggaatttggtatgggcgacatctaagcatgatgtatatctaatgcaaaattattcactcatgcactggtcatctctactccagagagggaaagaagtacttaatgtcgccagatcagttacccccactcagaaactacctggattgttttctgagccactctctagggtgcaagttagcagcatggcagtcaaagaaaatctgatccttttaggagggttcgacggggagcttctctgcaagtgtgtaaatcagcctggggttgctttttgcacaagattatcaacggaagataatgccatcacaaacacagttgatatataccgagacccaagtggctcccttaggcttataaccgcaaataacgactgtaaaattcgtgtattcgatgctcagagctttacacgtgtcagtgaatttgctttagattggtctgtcaataatacctcagttagcccggatgggaagctactcgctgtagtcggggacagtacagaatgcttgatctctgattcccattctggaaaagttatttcaagcctcagaggccacaaagactactcatttgcatctgcttggcacccgaatggtctaatcttagcaacgggaaaccaagacacggcatgccgtctctgggacattcgtaacccgtcagaatcattcgctgtcctgaaaggaaacatgggagccatcagaggactgaagttcacaccagaagggcggtttcttgcaatggctgagcctgcagactttgttcacatcttcgacacgcagtccgggtttctacagtcccaagagattgatctgtttggagaaatagccgggatctcgttcagccccgatacagaggcactatatgtaggggtcgcagaccgcacttatggaagtttgctggagtataagaggagaaaggataatcactatatggactccttttactgagaaaaggtaaatgaaaagtaaaaagcggcgcgcc

SEQ ID NO: 58 - DNA, 1053 bp, Arabidopsis thaliana
ttaattaagatgcaaccaaaaacagagttcgtgaagttcttgagaaaaggtgcgtatggatcagtcgatctcgtcaagtacatcaaacgcgacgataacgctttgcctctttacgccgccgtgaaaaccgccgaatgtgaagactacaactctctcgaaagagaaattcagattctatccaaacttgaaggatgtcgaaggatcgtgcaatgctatgggaattatactttagaagaggacttcgatgtcggtggattccgagtctacaagatggttatggagtacgcagctgcagggagtttattcagtttcatggacagttacaaagatagaaagttaccggaaacgatgattaaagactttactcgtatgattcttcaaggattagtctctgttcatagactcggttatgttcattgcgatctaaaacccgataatctacttgtctttccatgtagacaatcttacgaattgaagatttcagatttcgggtcttcgagaaaagtcggagaatattctgattgctgggatgttgatttgccgtttgttggaacgcctgtttacatgtcgccagaatcagtccgtagcggcgtggctgagaaagccctagatttgtggtcgttagggtgcatagtattggagatgtataccggtgtgattccatggtcggaggttgaatttgaggatcttgcgcctgctctatcaaaaggtaaagcgccggagattccaaagagtttaccgtgtgatgcaaggaagtttctagagacgtgtttttcaaggaaccctaaggagagaggaagtgcttcggatttattgtctcatcagttcttgcgtggtgaagtggtctccggcttctcgcttccgccgttgaagttgaagattaaactagcaccggagaaaccgacgaatgtttcgaagaagcccttgaagctaaagattatcccaccaaagcccccacagtttaagaaaggtgggattaaacccttgaagttgaagattatgcctttgaagcctccagcttctagtttcgtttctgttcaatagtggcgcgcc

SEQ ID NO: 59 - DNA, 1444 bp, Arabidopsis thaliana
ttaattaattgataaatcgtatttggctctgtaagtagtatttattggtattgaaacgatggatcatgtaatcggtggcaagttcaagttaggtaggaagattggtagtggatcattcggtgaactttatattgggattaatgttcaaactggagaagaagttgctcttaagctggaacctgtgaagacaaagcatcctcagctccattatgaatcaaaagtatacatgcttcttcaaggagggacgggtgttccgcatatcaaatggttcggtgttgagggtaactacaattgtatggctattgaccttcttggtccaagcttggaagacttgttcaactattgcactcggagtttttctttgaaaactgttctaatgcttgctgatcagttaataaacagagttgagtacatgcactctcgaggatttcttcaccgtgatattaaaccggataactttttgatgggtctcggtcgcaaagcaaaccaagtgtacattattgattatgggcttgctaaaaagtatagagatcttcagacacacaagcatataccttacagggaaaataagaatctgactggaactgctaggtatgcaagtgtcaacacacaccttggcattgagcaaagtagacgagatgatctggagtctcttggttatgttctgatgtattttatacgaggaagtttaccatggcaaggtctaaaagctggtactaagaaacagaaatacgagaagataagtgaaaagaagatgcttactcccgtagaggttctttgcaagtcatatccatccgagttcacatcatatttccattactgccgttcattgaggtttgaggataaaccagattattcatatctgaaaagacttttcagggacctttttattcgggaaggttatcagtttgactatgtgtttgattggacaatcttgaaatatcctcagagtggctctatttcaaaaccaaggccaaatcctaaaccagctctagaccctccaggaccatctgcagaacgaaatgaaaagcctatagtggggcaggatctacgagaaagattctcaggtgcagttgaagcattcgctagacgaaatgtaccgagtcatggcattcgcccgaagcacattttttctgatgatgcttccaaagaagtgcaagtgtctgaaaaaacccgaaatgagattgctacaaagatggcagtgatgtctagcagccaacctggctcatcaggtgagctgagtgagaaccgctcaagtaaacttttttcaagcagtgcccaaaagattcaaccggtgcaagaaactaagttatctgcaaggcttgggcgtgatgacggcctgagaagcttcgatatgcttactatcggttccggaaagcggaaatgagtcactcaagaaagcttgcggatcggagtttggaagaatctgaaaatgtggcgcgcc

SEQ ID NO: 60 - DNA, 1357 bp, Arabidopsis thaliana
ttaattaaggtcggaatagctttcaacactgtagcatttgtagcattgtcttttgtaatgtattctctgattctccatggaagaaggttggtccaatcgcagaaatgcttgagtttgagtgtttcagtgcaaaatgcatttgttttgtccaattccttctcttctgctagagctgctgatgtgagcattagagatggtcgaaaagggaagaactttacagtctcttacctcgttgattcattgggtttatctaaaaagctcgctgaatccatctcaaggaaagttagctttgaggacaaggtcaatcctgattctgttctaagtctgtttagaagttacgggttcacagattctcagatctctaccatcattacggattatccgttattgcttgtagcagatgctaagaaagcacttggtcgcaagcttcagattctgcagtctagaggagcttcaagctctgagatcactgagattgtttctacagtaccgagaatcttaggaaagaaatctattactgtatactatgatgctgtcaaagacattatagtagccgatacgagttcgagttatgaactcccacagggttctcaggggaataaaatccgaaatgtatcggctttgagagaattaggcatgccttctcggttgttattacccttgctcgtctccaaatcgcagcctgtgtgtggaaaagaaaattttgatgcatcccttaagaaggttgttgagatggggtttgatcccaccaccactaaatttgttttagctttgcggatgctttaccaaatgagcgagaaaacgattgaagaaaaagttgtagtctttagaagtttaggttttactgtggatgatgtatgggaaattttcaagaagactccttctgttttgaaagtctccaagaagaagatattgaagtcggctgaaacgtttctagacctaggatatagcagagctgagtttctgatgatggttaagcgttatcctccttgcattgaatattctgtagagtctgttaaaaagaagaatgagtttctggtgaagaagatgaaatggccacgaaacgccttggttttgcaccctcaggtgtttggatacagcatggagaagaggattataccaaggtgtaacatactcgaagctctcttgtcgaaaggactgctcagaaagggaagtgaactacctgcagtgtcctctgttttgtcgtgtaccgatgaaggatttttagacaggtatgtgatgaagcacaacgagctggtgcctacgttgatggctatattcaccaaaggtagtgtttcatagatcagaaggcacacctacaacaatgagcagtgccaaggtttgttcttggcgcgcc

SEQ ID NO: 61 - DNA, 1340 bp, Arabidopsis thaliana
ttaattaaatgacggacccccacaccgcccggacgatcgtcggaatcgttggtaagtcctccacaatttactcaaacataaagtttaattcaatcaacaacaaaaacatttgctcatgtctttgtttgtctgttatatgtttaggaaacgtgatttctttcggcttgttctgcgctccaatgtaagcacacatgatgattaaatctttttttgttttgttgcatgcaatgacatatgtgaaaattgtgcagaccaacgatggtgaagatatggaagatgaaatcggtctccgagtttaagccagatccatacgtagctacggttttaaactgcatgatgtggacattttacggacttcctttcgtccagcccgacagtctcctcgtcatcaccattaatggaactggtcttttcatggaactcgtttacgtcaccatcttctttgtcttcgctacctcccctgtccgcgtaagcctttaaaacctctaatttcaacacgaatgataaaaatatgtatatgcattctaaattattcaatttatataaacttttcagacataggtttgatagcctttaaaccaattgaaaattagtgaattagtggttgatgtttgttttagtttgttacttcaaatgtagatcgatatagattttgatatgtgaagttatgatatatatatatgtgtacagagaaagatcacaatagctatggttatcgaggtaatattcatggcggtggtgatcttctgcacaatgtattttttgcatacaacaaagcagagatcaatgcttattgggatcttgtgcattgttttcaacgtcatcatgtatgctgctcctctcaccgtcatggtatgatgcctcttctttctaaactaatcacggaaatgcaaaaattggatactacactatcaacttttttcttttgttctctttatctcgtgaatttccatttaatgagtttagttataatgtggaacagaaacttgtgataaagacaaagagcgtgaaatacatgccgttcttcctatcattagccaacttcatgaacggtgtcgtttgggtcatttatgcatgtcttaaatttgacccttatattttggtaaaccctcatatatatctttattgtttggaactcaaatccctacatctcaaaaaggactaattatcttccatgcatgaaaacagattccaaatggtcttggatcgctatcaggaataatccagcttataatatacataacttactataaaacaactaactggaacgatgacgatgaagataaagaaaagcgctattcgaatgctggaatcgaacttggccaggcttgaggcgcgcc

SEQ ID NO: 62 - DNA, 1791 bp, Arabidopsis thaliana
ttaattaaatgggttgcgttagctcgaagcagacggtctctgtgacgcctgcgatcgatcactcaggcgtcttcaaggataatgaaaatgagtgttctggatcgggtcggattgtggtggaggatccgcctcggccgacgttgaagaagctcgtgtcgtggaggagtaggagcgggaagaggaggagtcagaagagcggtagcgagttagggagtgagtcaggacgtgctagtgactcgcttagttttcgactcggtaatgttagtagataccttgaagctgagcaagtcgctgctggttggcctgcgtggttgagcaacgttgctggtgaagctatccatggttgggtcccacttcgatccgatgcgttcgaaaaactcgaaaaggttcgaaatttgataattctttgtgtgttatgtgaatgttgtttagaagaagaatttgtgaaatttagtttagatttggtttctgtagattggacaaggtacttatagcaatgtgtttcgtgcggtggagactgaaactgggaggattgtggcattgaagaaggtgaggtttgataattttgagccggagagtgttaagtttatggcaagagagattttgatacttagaagacttaatcatcccaacattatcaaactggaaggtttgattacttcaaaactatcctgcaacattcaacttgtgttcgagtatatggagcatgatcttactggtcttctttcttcccctgacatcaaatttacgacgccacaggttcgtttgattttatagtggaagtatcattgttcataatgttggggtgttttgttatgtgtttggttgcgtgatcatttgtttttggctcctgcagattaagtgttacatgaagcaattgttgtctgggcttgatcattgtcattcacgaggcgtgatgcatcgagacataaagggttcgaatcttttgttgagtaatgaagggatattaaaggtggctgattttgggttagcaaacttcagtaatagttctggacacaagaagaaacctcttaccagtcgagttgtgactctgtggtatcgtccaccagaacttttgctcggggcaacggactatggagcatctgttgatttgtggagtgttggttgtgttttcgctgagctgcttcttggaaaacctattctccggggaagaactgaggtaaacctcttcacagttaacactgtcttcaactatatatgatataggaccttttggtcatggatatgttatgttttacttggtgtataattcagtgctattacttgaattgtatggagcaggttgaacagttgcacaagatattcaaactgtgtggatctccaccagaagattactggaaaaagtccaaacttccccatgcaatgcttttcaagccacagcaaacttatgatagttgtctccgcgaaaccttgaaagatttgtctgagactgaaatcaatctgatagaaactcttctttctatagatccccacaaacgcggtactgcctctagtgcccttgtttctcaggtaacctttttatccttggtttaatatatcaagtttaaaaagctaagaatttgatatctgtggaaacacagcatattgctgtattttgttcatcttttacaaatgaagacattgccttttgtgttttcagtattttactacaaagccttttgcttgtgatccctcaagcttgccaatatacccacctagcaaggagatagatacaaagcatcgggacgaagcagcaaggtcagtaatttctttcattacctgaggcgcgcc

SEQ ID NO: 63 - DNA, 1626 bp, Arabidopsis thaliana
ttaattaagtggacacggatggctcaagccttggctcaaccaccactggtggtcaccaccgtcgtcccagacccgccgccgccgccaccaccaccgcacccaaagccgtatgctctacgatacatggcggatcttcttggccggattggtataatggatacagacaaagatggtaacatcagcccacagagtccgaggagtcctaggagcccaagaaacaacattctcatggggaagtacgagcttgggaagcttctcggccacggaacctttgcaaaggtttatttagctcaaaacatcaaatctggagataaagtcgccattaaagtcatcgacaaggagaagattatgaagagtggtttggttgctcacatcaaacgggaaatctctatcctccgccgtgtccgtcacccttacatcgttcatctattcgaggttatggcgacgaagtccaagatttactttgtgatggagtacgttggaggcggcgagttgttcaacacggttgctaaaggtcgattgcccgaggaaactgctcggagatatttccagcagctgatctcctctgtttcgttctgccatggccgcggtgtttaccaccgtgaccttaaaccagagaatctgcttttagacaacaaagggaaccttaaagtatctgactttggtctcagcgcggtggcagagcagcttcgtcaagacgggctctgccacacgttttgcgggactccagcgtatattgcacccgaggttttgactagaaaagggtacgatgcagcgaaagccgatgtttggtcatgtggagtgatcttattcgtgttgatggctggtcacattccgttctacgacaagaacataatggttatgtacaagaagatttacaaaggggaatttaggtgtcctcgttggttttcatcggatcttgttcggttattgactcggcttcttgatacgaatccggatactcggattacaatacccgagatcatgaagaacagatggttcaagaaaggattcaaacatgttaaattctacatcgaagatgataaactgtgtagggaagatgaagatgaggaggaagaggcatcatcatcaggccgctcttcgacagtttcagagagcgatgcagagttcgatgtaaaacggatgggaataggttcaatgccaagaccctcgagcttaaacgcgtttgacattatatctttctcttcagggtttgatctgtctggtttgtttgaggaagaaggaggagaagggacgaggtttgtgtcaggtgctcctgtttcaaagatcatatcgaagctggaagagattgcgaaaatcgtgagctttactgtgaggaagaaagaatggagtttgagattagaaggttgtagagaaggagcaaaaggaccgttgacaattgcggctgagatatttgagctgactccatctctagtggtggtggaggtgaagaagaaaggaggagacagagaagagtatgaagagttttgcaacaaggaactcagaccagagctggagaaactaatccatgaagaagttgtagtagaagaagcattgtatttgccatctgatactgaatagtataaaacaaggaaggctgataacagaatatacaagaggcgcgcc

SEQ ID NO: 64 - DNA, 1535 bp, Arabidopsis thaliana
ttaattaaatgggaagagctttcgtgtatgtaattctcggaggaggtgttgctgctggttacgcagctctcgaattcacccgtcgaggtgtctccgatggcgaactctgtatcatttccgaagaacccgttgcaccgtatgagaggcctgccttaagcaaaggttttctgctgccagaagctcctgcacggcttccttctttccacacttgtgttggagctaatgatgagaagcttacaccgaaatggtacaaggatcatggaattgaattggtacttggaactcgtgttaagtccgttgatgtgaggaggaagactcttttatcgagcacaggggagactataagttacaaattcttgatcattgcaacaggtgcccgggcgttgaagcttgaagaatttggggtggaaggctcagatgctgaaaatgtttgttacttacgagatctagctgatgcaaataggcttgccactgtgattcaatcaagctccaacgggaatgcggttgttatcggcggtggctatatcggtatggagtgtgctgcatctttagtgatcaacaaaatcaatgtgacgatggttttcccagaggctcactgcatggcacgtctctttacgcccaagattgcaagtttgtatgaagactactacagggctaaaggcgtaaaatttataaaaggaacggttttgacatcatttgagtttgactcgaacaaaaaggttactgcagttaatctcaaagacgggagccacttaccagccgacttggttgtggttggtatcgggatacgaccaaacacaagcttgtttgaaggacagttaacaatagagaaaggagggataaaagtgaacagcagaatgcagtcaagtgacagctcagtgtatgcaataggcgatgtagctacatttccagtgaaactatttggcgaaatgaggaggcttgagcacgtggactcagctaggaaatctgcgcgacacgcagtttcagccatcatggatccaataaagaccggagactttgattacttaccatttttctactcaagggtcttcgcattctcatggcaattctatggagaccctacaggtgatgttgtgcactttggagagtatgaagacgggaaatcatttggagcgtattgggttaaaaagggtcaccttgttggatcttttcttgaaggaggcactaaagaagaatatgaaactatctcaaaggcgacacaattgaaaccagctgtgactattgatttggaagaattggaaagagaaggactcgggtttgctcacacggttgtgagtcagcagaaagttcctgaagttaaggatattccgagcgctgagatggtgaagcaatctgcaagtgtggtcatgataaagaagcctttgtatgtatggcacgcagctactggagtcgttgtggctgcatctgtggctgcgttcgcgttttggtatgggaggagacgccgtagatggtgaggcgcgccaaaaattggagctctgcagagctttcgttcgtatcatcggttcgacaacgtc

SEQ ID NO: 65 - DNA, 813 bp, Arabidopsis thaliana
ttaattaaactggtcgaaagaagacgaacataaactcgtctccggtaaccaaaaatggtttccatgactacttcatcttcttcgtacggaacattctctacagtcgtcaacagttctagacctaattcctcagcaacctttctcgtcccttccttgaaattctccaccggaatatcgaatttcgcgaatctgagtaatgggttttctctaaaatctccaattaatcctgggtttctcttcaagtctcgtcctttcactgtccaagctagagctgctgcagaaaaaaccgttcacgatttcaccgttaaggacattgatgggaaggatgttgctttgaacaaattcaaggggaaagttatgttgattgtcaatgttgcttcaagatgtggtttgacatcatcaaattactcagagctttcacatctgtacgagaaatacaaaactcaaggatttgagattctagcttttccctgcaatcagtttggtttccaagagcccgggtcaaactccgagatcaaacaattcgcttgcacccggtttaaagcagagttccctatatttgataaggttgacgtgaatggaccaagcacagcgccgatctacgagttcttgaaatcaaacgcaggaggattcttgggtggtctcattaaatggaactttgagaagttcttgattgataaaaagggaaaggtcgttgagaggtaccctcccaccacatcccctttccaaatcgagaaagacatccagaagttgcttgccgcttaaaaacttttgctcatgagtgagcatatagagactgatggttggcgcgcc

SEQ ID NO: 66 - DNA, 1558 bp, Arabidopsis thaliana
ttaattaaatggcaggagggtcgtttggtccgaccggtgtggctaaggagagagcagaacaataccaagggaaagtcactagttatgttataatcgcttgccttgttgcagctattggtggatccatctttggatatgacattggaatctcaggaggagttacatcgatggatgagtttcttgaggagtttttccacacggtttatgagaagaagaagcaagctcatgaaagtaattactgcaaatatgataatcaaggcttagctgctttcacttcttcactctacttagctggtttggtttcgactctcgtggcttcacccatcactaggaactacggtaggcgtgcgagtattgtttgtggtggaatcagctttcttattggatctggtttgaatgctggagctgtgaacttagctatgcttcttgccggacggatcatgcttggtgttggtattggatttggaaatcaggcggttcctttgtatttatcagaagtggcaccaactcatctacgaggtggtttaaacatgatgtttcagctagctacaactatcgggatctttacagcgaacatggttaattacggtactcaacagcttaagccttggggatggagactctctcttggtttagctgcttttccagctctgcttatgacgcttggcgggtatttcttacccgagacaccaaacagtttggtcgaaagaggattaacagagagaggtcgacgagtcttagtgaagctaagaggaacagaaaacgtcaacgccgagcttcaagacatggtagatgcgagtgagcttgcgaattccatcaaacatccattcagaaacatcttgcagaaacgacacaggcctcagctagttatggctatttgcatgccaatgtttcagatactcacagggataaactccattctcttctacgcacctgttctgttccagacaatggggtttggaggaaacgcatctctctattcatcagctttaacaggagctgttcttgtcctatcaacatttatttccataggattagtagacagattgggacgaagagctcttctcataactggaggaatacaaatgataatctgtcaagtcatagtagcagtgatcttaggagtgaaatttggagacaaccaagagctatcaaaagggtactcagtgatcgtagtcatcttcatctgcctctttgttgtagcgttcggatggtcatggggtcctctaggttggaccatacctagcgaaatctttccgttagagactcgttcagcggggcagagtatcacagtagctgtaaatctcctcttcactttcatcatagctcaagctttccttggtctcctctgtgcattcaagtttggaatcttcctcttctttgctggttgggtgacagtaatgactatctttgtgtatttcctgttgcctgaaaccaaaggagttccaatagaagagatgacactcttatggagtaaacattggttctggaaaaaagtattacctgatgcaacaaatcttgaagatgagagcaagaatgtatctgtttaaggcgcgcc

SEQ ID NO: 67 - DNA, 1693 bp, Arabidopsis thaliana
ttaattaaatggctttcgctgtctcggttcagtcacatttcgcaatcagagcgttaaaacgagaccacttcaagaacccttctcctcgtactttctgctcgtgttttaaatcgaggcctgactcgtcttaccttagtttaaaggaacgtacttgcttcgtttccaaaccgggtttagtcactactagatacagacatatattccaggtcggagctgagacgggaggagagttcgccgacagtggagaagtagctgattcgcttgcttctgatgcaccagagtcattttcttggtcttctgtgatactcccgtttatcttcccggctttgggaggattattgtttgggtatgacattggggctacctccggtgctacgctctcacttcagtcacctgcgcttagcggaactacatggtttaacttctcacctgttcagctaggacttgtggttagcggatccttgtatggagcccttcttggctcaatttctgtctatggcgttgctgatttccttggaagaaggcgggaacttattatagctgctgttctctatctcctcgggtctctgatcactggctgtgcccctgatcttaatattctcttagttggaaggcttctctatggctttggtattggtttggcaatgcatggggctcccctctatattgctgagacatgcccatctcaaatccgtggaactttgatatctctgaaagaactcttcatcgtattgggaattttgttgggtttttctgttggaagcttccagattgatgtagttggagggtggcgttacatgtatggatttggtacgcctgttgctttgctgatgggactaggcatgtggagtctccctgcatctcctcgctggttgctgcttagagctgtccaaggtaaaggacaattacaagaatacaaagagaaggccatgcttgccctcagcaaattacgtggcagacctccaggtgataaaatctcagagaagttggtagatgatgcctatttatctgtgaaaacggcctatgaagatgagaaatctgggggaaacttcctggaagtattccaagggcctaatttgaaagctttgacaattggtggaggtttagtcctcttccaacagataactggacagcctagtgttctttattatgcgggttcgattcttcagactgctggattctctgctgctgctgatgcaactcgagtctctgttattattggtgttttcaagttactgatgacatgggtagctgttgcgaaagttgatgatctcggcagacgacctttactgattggaggtgtcagcggcattgcgttgtccttgtttctactgtcagcatactacaagtttctcggaggctttccccttgtcgctgttggtgcactgcttctctatgttggttgttaccagatctcatttggacccatcagctggctaatggtgtcagagattttcccgctccgcacaagagggagagggatcagtcttgcagttcttacaaactttggctccaatgctattgtgacatttgcattttcacctttaaaggaatttcttggagccgagaatcttttccttctctttgggggcatagcactggtatcactgctgtttgtaatactagtagttccagagaccaagggtctcagcttggaagaaattgaatcaaaaatcttgaagtgaggcgcgcc

SEQ ID NO: 68 - DNA, 551 bp, Zea mays
ttcttgtttgttgattaacccttaattaatccgggcgcgcctgatttatcacaagtttgtacaaaaaagcaggctcctgcaggaccatggcgcggagcgtatcgtacgtttcggcggcgaagctggtatccatggcgcgaggcaatccccgcctcgccatcatcgacgtcagggatgaggagaggagctaccaggctcacatcgcgggttcgcaccacttcgccagcggcagcttcgaggcgcggatgccggagctggtgcgggccgccagcggcaaggacaccctcgttttccactgcgcgctgagccaggtacgaggtccaacttgtgctcggatgttctcagactatctatcggagaccaaggaggattcagggataaagaacatcatggtactggagcgcgggtttaacggatgggaggtttcagggcagcctgtctgcagctgcaccgacgctcattgcaaagggacgtgttcttaactcgagacccagctttcttgtacaaagtggtgataaattggagctctgcagagctttcgttcgtatcat

SEQ ID NO: 69 - DNA, 1307 bp, Zea mays
ttcttgtttgttgattaacccttaattaatccgggcgcgcctgatttatcacaagtttgtacaaaaaagcaggctcctgcaggaccatggccaccctcaaccctttcgaactcctcggcgccgacgacaacgacgacccgtcgctgttgattgcggcggcggcggctgctgctcagaaagccgaggcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcagaggtggacggggatatggccagaaccgtggcttcagtggtgacaatggcaatgagttccagggaggttatggtggcggaggctatggggatggtgctgtaactggtggatctgaaggagaaagggagagagacactcgtcccccgtaccgtggcggaggcagacgtggtggttacaggaatgttgagtttggtgatgactctgagaggccaccacggagaaactatgagcgccacagcgggactggccatggctatgagatgaagcgtgatggcgcagggcgtgggaactggggcactgccactgatgagcttattgcccaggatgcagaggactctccgaagatggaggatgctgctcctgttgctgagaaacaaggtgagcagatcgatgccccagcagcagatgagaacaaagataacaaggatgctactgcaaatgaggaggaagaaaaggaagaggacaaggagatgactctggaggaatttgagaaaataagagaggagaagaggaaagcactacttgcgttgaaggctgaggagaggaaagttgaagttgacaaggatctgcgttctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcggccgtggccgtggaagggggggccgtggggatcgtggtggttttagaggcggatacggagggggatacagtcgtggcccagctgctgctgctccatccattgaagatcaagctcagttcccaagccttggtgggaagtgaagggcgcccagctgctgctgtcaccgagcgttgtgttgtctgctgttgtcctcgagacccagctttcttgtacaaagtggt

SEQ ID NO: 70 - DNA, 795 bp, Arabidopsis thaliana
ttaattaagctttgaatcggtgaaagatgattcaaatggatggtggagataggctgagagtgactttattagatcgtatgtcaacggttgagagtagccggagctgtttaactcttgaagctattctaatggctgataaaaacagaacctcgccgcagattctctcaccaccgccgtcgaggagccaatctaaccggtcacttgttgaagtcatgcaaagagagcaccgacacagtagagataaaaccgcttggaaaagtctccgtgaaaagctccgtcttaaacgtaacggttctgtttggatctcgtctaattctatcccgagtttggatacgcctattcctaaccgggataacgttagccaccaacttggtttcctcctttctaactctggaaatgtaacagaggaagcttcgtcggtggagggaaggattcggttaggagctgtgttggcagaggagagagcattatcggctagagaagaggaaacgccggcggagagggaagtggagccggcgaggatgtcattgatggagttgttggaagagaatgaagggcaaatgagttttgtaagtgtcgacggagaggcggaggaggaggtggcggcagtgacggcggcggagataagttgttgtgtgtgtatggttagaagcaaaggagctgcgtttattccgtgtggtcatacgttttgtaggttgtgttctagagagctttgggttcaaagaggaaactgtcctctctgtaataccacaattttagaagttcttgatcttttttagacttttcaggcgcgcc

SEQ ID NO: 71 - DNA, 816 bp, Xylella fastidiosa
acaagtttgtacaaaaaagcaggctcctgcagaccatgggccccaagattgtggttgggaattggaagttgcatggtagccacgcgttcgcacaggcattggttgcgcaggtcgctgctggtttgccgctgcctggagtcagtgtgattatcttgccgccattgctgtatctgagtgatttgacgcagcgcttcaaaggggaaggtttggcgtttggtgcgcagaacgtcagtcaccatgataaaggtgcttacactggggaagtttcggcggcgatggtggctgatgtcggtgctcattacactttggttgggcattctgaacgtcgggagtatcaccatgaggacagtgagttggtggcgcgtaaatttgctgctgctctgagtgctgggttgcgaccaattctatgtgttggggagagtttgccccagcgtgaggctggacaggcagaggttgccattgcgatgcagcttgcgcctgtgttggctctggttggcccgcagggtgttgcccgtggcttgattgcctatgagccggtttgggcgattggtactggccgtcatgcggatccgagccaagtccaagcgatgcacgcttttattcgtggtgaaattgcgaggcaagatgctagaatcggcgattatatgttgattctatacggaggcggcatcaagccttgcaacgctgctgagttgttttcccagcaggatgtcgatggtgggttgattggtggtgcttcgttggttgctgatgatttcttggctatcgctcgtgcgacggtttagctcgagacccagctttcttgtacaaagtggt

SEQ ID NO: 72 - DNA, 1461 bp, Zea mays
ttcttgtttgttgattaacccttaattaatccgggcgcgcctgatttatcacaagtttgtacaaaaaagcaggctcctgcaggaccatgttgcgagcggcggcgtcgagttgcgcccgcggcgccgtccggcggctgtcgtcgtctgcggtgatggaggcttcaccagtcgccgtggggtcgcggtgtcagtctctcctcgacgagggtgactggtcgtaccatcgggagtggtggggcaaggaggacggccccggcgagggcgtgcagaccgtcttccgccgccactccgagtgcggcaacggcgtcgtctccgtctccgcctaccctgcttcccttccggctagtgagcattggccagccatggagagatggcttcaagagagtaattcaagactatacccagaatcagccagctctgaccagtttaaggtactaggctaccagtggcgagtgatgcgttttaatgaccatacacggcaaagcactgcaaaagtgatgacatgttataggacttcgggtcagagatcattattcttgatgcagcaaccacatgttttagctgttccttatgtcaagagtatggtatcagcaggattgacagcgctctcatgttcttcgtatgatctaccacaagcagcatctggacagaacactatgaaaattctgtgcatcggccatggtggcggcagcttaccattgtttttggctagcaagttcagaggtgctaccatccacattgtggaaatcgatccggtggttgtttcggcatcagttgaatccatgggtttccccacgtcacccgttaataaaggcttatcccccgagtccatgctaccttccgacgccgatgacctattatggggaggcatacacgaccgcatcttcctgcacacagcagacgccgaggattttattggcagcgacggcaacgagtatgacatcgtcttcatcgacgcttacgacggagacgacgtgtttcctcgcaagctctgggacgtggacggggcgttcatgaagaacctagagaagagagtgcaccccgtccacggcaccgtggtcgtgaacctgcactccgactcagactccggggcagaaggcaacgccgacttccagagcgcgcttcccatgggcaggcacgtctcccaggtctgcagggcttacatgcagcacttcggggtggccttcacggccgcggtcccgtggctctgcaacatcacgctcgtcgcctgccgcgccggcgggatggcgggcggcgcgcgccgggggctgagccgcagggatctcgtccttggcaagcttctgtcgacgtccgacacggtggagcgcgcgctgggcctgccgttcccgtgtctgccctacatcaagaacggcttcacgatggttcactgactcgagacccagctttcttgtacaaagtggtgataaattggagctctgcagagctttcgttcgtatcatc

SEQ ID NO: 73 - DNA, 2074 bp, Nostoc punctiforme PCC 73102
ttcttgtttgttgattaacccttaattaatccgggcgcgcctgatttatcacaagtttgtacaaaaaagcaggctcctgcagggaccatggttaaatctgctccttccccaatcgctagccgtaagccttccaaagtagaaggaatcaaggaaaatagtaattttttgcgtgaacctgtagcaactgaaatccttcaagatactacccattttaccgaaaatgcggtgcagcttttgaagtttcacggttcttatcagcaggataaccgcgacaaccgcactaagggacaggaaaaagattaccagtttatgctgcggacaaaaaatccgggtggtttagtaccgccgcagctgtatctggctttagataaaatcgctgatgagtatggcaaccacacgttacgagcaactacccgtcaaggtttccaactgcacggtattttaaagaagaatctgaaatcagcgatcgccacaattgtcaagaatctgggttcgactttgggagcttgcggtgacattaaccgaaatgtgatggcaccaccagccccctttaagaatcgcccagagtatcagtatgcttgggagtatgctcagaatattgctgacttgctgacagcacagacgggtgcttattacgaaatttggttagatggggaaaaagcaattagtgctgaagagaacccagaggtgaaagcagcgcgacagcgcaatgggaatgggacaattatccatgacaacgaagaaccgatttatggcacgtactatatgccccgcaagtttaaaatttgcgtgacggtgccaggggataattcgattgatttgtattctcaagacctgacattggtagtgattaccaataagaagaagcaattagaaggatttaatatttttgctggtggcggtttaggtagaacccacggtaaagaagaaactttcgctaggttagcagaccccattggttatgtggcgaaagatgatgtctacgacatagtgaaagcgattgttgctactcagagagattatggcgatcgcactgatcgtcgtcatgccagattaaaatatttaattaacgattggggcctagataaattccgtgcccaagttgaagaatattttgggaaatcagtcgaagccttcaaaccactgccagagtttaaatattacgacttcctcggctggaatgaacaaggtgatggcaagctattcttaggaatttccattgacaatggtcgaatcaaagatgaaggttcgtttcaactgaaaaccgctttgcgggaaattgtcgagcagttcaacttacacatccgtctgacagccaaccataacctgattttttacgatatcgaaccagatagcaagcaagctattcaagacattctcagccgtcacggtatcgtagacgaccctagtaaaatagaacctttagtacggtatgcaatggcttgtccggctttgcccacttgcggcttggcaatcacagaatcagaacgagcaataccgggtattttggaaagagttcgcgcccttttagataaagttggtttgcaaaatgaacattttgtggtaaggatgacaggatgccctaacggttgcgctcgtccctacctagcagaattgggctttgtcggtagcgctccagaatcttaccaattatggttaggaggttcgccaaatcagactcgactggcacaaccttatacagagaagctgcaccacaatgacttagaaatcttcttagagccaatttttgtttactttaagaaatctcggaaatcgaaggaaaaattcggtgatttttgcgatcgcgttggttttgatgccatccgcgagtttgctgctagctacgatcctaacaccgctaatggtgcaaacaaatcacgtcaccgggtcaatttgaaagaagaagtttatagcaagttgaaggaagtagcagaaagccaagggaagccgatgactcagttagtgactgaagcgctagaagcctacttccagaatctttcgtaactcgagacccagctttcttgtacaaagtggtgataaattggagctctgcagagctttcgttcgtatcatc

SEQ ID NO: 74 - DNA, 2943 bp, Arabidopsis thaliana
ttcttgtttgttgattaacccttaattaatccgggcgcgcctgatttatcacaagtttgtacaaaaaagcaggctcctgcaggaccatgagtcgtagggtgaggcagagagtggaggataatggaaagtataaggttgattcaccaagttatactgtgattggagttgaggatttagcacctaaggttcaacagtatgtgaattggactagtttgccttatgacacagtgtttcatttgtttactcgattgaattatcgcgatagagctagcttagcctcgacctgtaggacatggagaagccttggtgcttcttcttttttgtggagttcattggatcttcgagcccacaaatttgatctttcaatggcagcttctcttgcaactaggtgtgttgatcttcagaagattaggtttcgtggtgttgactctgctgatgccataattcatctcaaagcaaggagtctgcttgaaattagcggcgactattgtaggaagattacagatgctacattgtctatgattgcggcacgccatgaagctcttgagagcctccaacttggaccagatttctgtgagaggatcactagtgatgctataagagttatagccttttgctgtccgaaactaaagaagctacgggtttctggcatgagagatgttagttctgaggcaattgaatctttggccaaacattgcccacagctcagtgatcttggattcttagattgcctgaacatcaacgaagaagcattgggaaaagtggtatctcttcgctacctctctgttgctgggacatcaaacataaagtggaaagttgcattagaaaattgggagaagcttccaaaattaatcggtttggatgtctcaagaaccaccattgaccatattgctgtgtccaggttgttgaaatcatcgcagagcttgaaagtcttgtgtgctttaaactgcccttatctcgaagaggataaaagttacagctccaatagattcaaaggaaaggtcttgcttgctgtgtttactgatacttttgatgagctagcttctatatttgccgataactcaaagaaaccaaagaatatattttcttactggagagatttgataagaaaggataaaagcattgacgaaataatgctttggattgagtggatcatttctcatacacttctacgaattgcagagagcagcaattcacaaggattaaacgatttctggctgaatcagggagctacgttgcttctcagtttaatgcaaagcgcacaagaggatgtccaagagagagcagccacaggacttgcaactttcatcgttgttgatgatgagaatgctagcatagactgtggaagagccgaagctgttatgcgagatggagggatccgtcttcttctagaacttgctaaatcttggcgagaaggtcttcagtcagaagctgcaaaggctattgcaaacttgtcggtaaatgctaaagttgcaaaggctgttgctgaagaaggagggatcagtgttcttgctgatttggcaaagtctatgaatagacttgtggctgaagaagctgctggtgggctatggaatctctctgttggagaagagcataagaacgcgattgctcaagctggaggagtgaatgcgttagttgatcttatctttagatggccacatggttgtgatggagttctggaacgtgctgctggggcattagcaaatttagcagcagacgataaatgcagcatggaagttgcaagagcaggaggtgtgcatgccttggtgatgctagctcggaattgcaagtatgaaggagcacaagaacaggcggctcgtgctttggctaatctagctgctcatggtgatagcaacggtaataatgctgctgttggacaagaggctggtgcattggaagctcttgttcagcttacgcaatcacctcatgaaggtgttaaacaggaagctgctggggctctttggaatttagcatttgatgacaagaatcgagaatccattgctgcatttggtggtgttgaagccttggtggcacttgcgaagtcctcttcaaatgcatcaacgggtctacaagagagagtagctggtgctctctggggactatctgtctcagaagcaaacagcattgcaattggccatgaaggtggtattccgcctctaattgctcttgtacgatctgaagctgaggatgtacatgaaactgctgcaggagctctgtggaatctttcttttaatcctggtaacgctctgcggattgtggaggaagggggagttgtagcacttgttcagctctgttcgtcttctgtttccaaaatggctcgttttatggctgcattagcattggcatacatgtttgatggaaggatggatgaatacgcgatgatagggacttcattggaaagtacatctaaaagtgttaccttaaatggtgctagaacaatggctcttgatcaaattaaagccttcattaaaactttcatggaacaccaaatcttctcaactggtgctttatcatctgctccatctatgttagcacaagtctcggagagagctcgaatcccagaagctggccacttgagatgcagtggttccgaaattggaagatttgttacaatgttgcgaaacccttgtcttgtactcagagcttgtgcagcttttgcacttcttcagtttacaatacctgaaagccgtcacgcaatgcatcacgcaagcttgatgcagaatgctggagaagcaagaggcttgcgttctgcagctgcagctgcgagtatgcctcgtgaagccaagatctttatgaaaattgtgcttcgcaatctagagcatcagcaggcagaatctcctgaaggaatgaaagtatcttataataggatttgactcgagacccagctttcttgtacaaagtggtgataaattggagctctgcagagctttcgttcgtatcatc

SEQ ID NO: 75 - DNA, 1690 bp, Arabidopsis thaliana
ttaattaactgagaaatatctccgacgaaggagaagaaacgaaaatgacggagactggagtaatcggatgtggctgtcgcggagtcaccggcggcaatttcttccatcccggaggattttctttgaaatcttgtttcctcgagcagagtacaaagcgtaatcgtaactttttccgaagcgtttctatgattcctcctttcaaacgcggtcgtttcatcactaagttgcgttccgtcgccgggaacagccgaatctttagcatggatgctcgagagaaatcacgatcgtttgtgttggtatcatcaaggcacaagagagttccagtttttgtgatgatgccgattgatacatttggaattgatgcttctgggtgtccaaagattaaaaggctcaaggctttaactgtatctcttaaggcactcaagttagctggtgttcatggaatcgcagttgaggtttggtgggggattgtagagcgtttctctcctcttgagtttaaatggtcactgtatgaagagctttttagactgatttctgaggcagggttgaagttacatgttgctctttgctttcattcaaatatgcatttgtttggtgggaaaggaggcatcagtcttccactctggatccgagagattggagacgtcaataaggacatatactatagagataaaagcggattttccaacaatgactatctcacacttggagtcgatcaacttcctttgttcggtggccgtactgctgttcaatgctatgaagattttatgctcagtttttcaacaaaatttgagccatatcttgggaatgtgattgaagaaataagtataggtcttggtccttcgggggagcttagatatcctgcacatccttctggagatgggaggtggaaatttcctggaattggtgaattccaatgccatgacaagtacatgatggaagacttgatggcagtggcatcccaagaaggcaaacctcaatggggaagcagagatcctccgaataccggctgctataatagctttccatctggagttccgttctttgaggagggcaatgatagctttctctctgactatggtcgtttctttctagaatggtacagtgggaagttgatttgtcatgctgatgctattcttgcaaaggcagccgatgtcttgcggagacgtcaggaagaagagaaaagctctgtaatgctggttgcaaaaattggtggaatctattggtggtataagacatcttcacaccccgctgaactaactgcaggttattacaacacctccctcagggatggttatgatcctgtagcttccgtcttgtctcgtcatggtgctgctctcaacatcccctgcttggatatggcagatagtgaaatacctgagaaatatctttgcagccctgaaggattacgtagacagatacatgatgtttcgaagaagtggacaatacatgtgactggtagaaacacaagcgaaagatttgatgagatgggactaaggcaaatacgagagaactgtgtgcaaccgaatggcgacactctaagatcatttacgttttgcagaatgaatgagaagatctttagggtcgagaactggaacaactttgtccctttcattagacagatgagtgcagatatgtaaacacactcaccacccattggtgtgtttgtcttttgttacagaggcgcgcc

SEQ ID NO: 76 - DNA, 1994 bp, Arabidopsis thaliana
ttaattaaaaaacccttccgcttaaaccctaattcacttcgccggccatgtcgacactcgaggatggatttccggcggataagctcttcgctcaaggatactcttacacctacgacgacgtcatctttcttcctcacttcatcgatttctccacagacgctgtttctctatccacgcgccttagccggcgcgtgcctctctccataccttgcgtttcgtctccgatggatactgtttcggaatctcacatggctgctgctatggcttctcttggtgggattggaatcgtccactataactgtggcatcgccgctcaagcatcgattattcgccaagctaagtcgcttaaacatccgattgcttccgacgccggtgtgaagttcccggagtatgagattacttctttagatgcttttggtccttcttccttcgtttttgtcgagcaaacaggtgagtgaatcatattcgtttttttttgcaaaaagaatctgaatttaatagttacaatggtgaatttaagtttgtttgttgtattgatttaaatgcaggaacaatgacgactcctaaattgttaggctatgtaacgaaatcgcagtggaagagaatgaattacgaacaaagggagatgaagatatacgattacatgaagagctgtgatagcagtgactattgtgtaccatgggaaattgattttgaaaagttggagtttgttttagaagataagcaaaagggctttgtggttcttgagagggatggtgagactgtgaacgtggtgacgaaagatgatatacagagggttaaaggatatcccaagtctggaccagggactgtgggcccagacggtgagtggatggttggtgcagcgataggtacgagggagtctgataaggagaggcttgagcatttggttaatgttggggtcaatgctgtagtgttggatagttcgcaagggaactctatttaccagcttgagatgatcaagtatgtgaaaaagacttaccctgaattggatgtgattggtggcaatgttgtgacaatgtaccaggcacagaatttgatccaagcaggagttgatgggttgagagttggtatgggatctggttcgatatgtaccacacaagaggtttgtgcagttggtcgtggacaggtaaattaaaaagctctgaatcctaactgtttaatcttttaaaaggtgtaaactttgtgactatatgtgactaaacagatttgtctttttgtgtgatttggacctgttaggctactgctgtgtacaaggtttgttcgatcgctgctcagagcgggattccagttatagcggatggtggtatctcaaattcagggcacattgtaaaggctctcgtccttggagcatcaactgttatgatgggtagctttttagctggaagtactgaggctcccgggggttacgagtatacggtatagtcacatcttctttcggtttaatttacagttttcttgaaactctgtttgttttgatcgttttgtggtaataacagaacggtaagaggatcaagaagtaccgtggaatgggatcgctagaagcaatgactaaaggaagtgaccaaagatacttaggagatcaaacaaaactcaagattgctcaaggagtggttggagcagtcgcggataaaggctcagtgttgaagctgataccttacacaatgcacgccgtgaaacaaggtttccaagaccttggtgcttcttccttgcaatctgctcatggtctgttgagatcaaacatccttaggcttgaggtgaatgaaacttgttgtctcaattctaattcccaaaaactctctaattttgctgagattagtgctaatactgtttggtttttgtgacaggctcgaactggtgctgcacaggtcgaaggaggagttcacgggctggtttcttatgaaaagaaatcgttttaagctttggcctaaaattgagtgctaagagtgtttcttatatcatgttccaggcgcgcc

SEQ ID NO: 77 - DNA, 897 bp, Zea mays
ttcttgtttgttgattaacccttaattaatccgggcgcgcctgatttatcacaagtttgtacaaaaaagcaggctcctgcaggaccatgaccatggcgacgcaccacccccgcgcccgcgcacccctccgcgtctgcgccgcctgggacatgaacccgggagccgccaccgtggccacgcccaagccctccaaggccaaggccaagccgccgcccgcgaccacaaccccggcccgcccgcctcctctgacccacgccgatctcttcgcgcgctccagcgaggcgcaaggaggggtgaagaagagcacatatatgggctttgagaaatggtggttgccacctgcgccagtggtgaagaaaccccgatcgctctacagtgcggtgtcactggcttacttgggagactgcatatatgaactttatgctcggaggcacttcttctttccacctctgagcatcaatgagtacaacaaacgtgtgatggatgttgtgaagtgtgagtcacaggaccttttgttgaacaagcttcttggagaagattttctaactgaagaagaaagggacatacttcgttgggggcggaatattgttagcagcaaaactcgcaccaggaagcgtgcaggaattgctgtctacaaccgggcatcttcactcgaaacactaattggatatctttacctcacaaatttcaaacggttggaacaactgatgtttcaattgggcttcacaagtggtgcctcatcacagcatattgcagacgagctgcgctcaagtttccagaaaacaacccccgcttcggccacacctccacaacctgcaacacagtgactcgagacccagctttcttgtacaaagtggtgataaattggagctctgcagagctttcgttcgtatcatc

SEQ ID NO: 78 - DNA, 1981 bp, Zea mays
cttttactccattcccctctttgcgcctccgccagtccgccccgccccgccccgcccagcagacagcgcagccatgccgctccacctccacctgctgtcgtccccggccaccgctgccaagctcgcggcaggtctgcgtgcggcgcctctccgccggtgccacagcttggccccggcgccgcgccacacggatcgcgtggcccttgcgtcgtccctctcggcggtggcgcggtctgctggccccgccgtggcagcggcgcagaccaagcccagcgtttcaggaaagaaacaagtattgatatccttgtcggataaaacggatttggcttatcttggcaatggtcttcagggtttggggtattccatcgtttccactggtggaacagcatccagtctggaagcagcaggagtcagtgtaacaaaagttgaagaaatcacacacttccctgaaatgcttgatggacgagtgaaaacattgcacccaagtatacatggtggtattcttgccaggagagaccaggagcatcatttgaaggcactaaaagatcatggaattgggacatttgatgtggttgtggtgaatttgtatcccttttatgacaaagtcacctctggtaacatctcttttgaggatggcattgaaaatattgatattggtgggcccacgatgatcagagctgcagccaagaaccataaggatgttcttattgtggtggatcataatgattatcctgctttactggagtaccttaaaggaaagcgagacgatcagcagttccccaggatgttggcatggaaagccatgcagcatgtcgcctcttatgattctgcagtgtcagaatggttgtggaagcaatcaaataaaggagagatgttccccccaagctttactgtgccactggagctgaagtctacactccggtatggcgaaaatcctcatcagagtgctgcattctatgctgacaagagcctttctcttgtcggtgctggtggtattgccactgctattcaacaccatggaaaggaaatgtcttacaacaactacttggatgcggatgctgcatggaactgtgtatcggagtttgatagtcctacttgtgttgtggtgaagcacacaaatccatgtggtgttgcctcacgaaaggatattcttgaagcttacaggttagctgtaaggggagatgctgtcagtgcatttggtgggatagttgcattcaacacgactattgacgaggatcttgcgaaggaaattcgtgagttcaggagtcctacagatggtgagacgcggatgttctatgagatagtggttgctcccggctatacggagaagggtcttgaggttctcagaggcaagtccaaggcactgaggatactcgaggcgaagagaagtggaaaagggatgctttcacttaggcaggtgagtggtgggtggttagctcaggagtctgatgatctaacccctgaagagatcacctttaccacaaagtctgagaggtctccgcaagaaaacgagcttgccgatgccaaatttgcctggctttgcgcaaaacatgtcaagagcaacgcaattgtgatagccaagaacaactgcatgctgggaatgggcagtggtcagccgaacaggcgagagagcgttcgaatcgccttcaggaaggcaggagaggaggccaagggagccgcattggccagcgacgccttctttccctttgcctggaatgatgccgtcgaggaggcgtgccagaacggcatcggcatcatcgcccagccaggaggcagtaagaaggacgaggacgccgtcgcgtgctgcaacaagtatggtgtgtcgctcgtcctcaccggcgtcaggcacttcaagcattagccgtcatgccccatggctggtcatcttagcttagggagttacggaaaaaaaaaacaagcttcgaaggctgcagcttgtggagctgccctgatgtttagctttctgcaaagtgcaaaactg

SEQ ID NO: 79 - DNA, 4424 bp, Arabidopsis thaliana
ttgagagcggttattttttctctatcaactaatacagtaaccttacgggtgtttatttgtatagatctctgtggttttcttggccaaatctagtgagatctttttggtttctcgaattcgatgaaaatgagacgaggcaattcaagtaacgaccatgaacttgggattctacgaggagctaactcggacaccaactcggacacggagagcatcgctagcgaccgtggtgcctttagcggtccgcttggccggcctaaacgtgcgtccaagaaaaacgcaagattcgccgacgatcttcccaagagaagcaatagtgttgctggcggccgtggtgatgacgatgagtacgtggagatcacgctagacatcagggacgactcggtggccgtccatagtgtccaacaagcagctggaggtggaggccacctggaggacccggagctagcccttcttacgaagaagactctcgagagcagcctcaacaacaccacctccttatctttcttccgaagcacctcctcacgcatcaagaacgcctcccgcgagctccgccgcgtgttctctagacgtccctccccggccgtgcggcggtttgaccgcacgagctccgcggccatccacgcactcaaaggtctcaagttcattgccaccaagacggccgcatggccggccgtcgaccaacgtttcgataaactctccgctgattccaacggcctcttactctctgccaagttttgggaatgcttaggtaagtaaatcacttcttactaagcaattctattagtactatatgtttccatttttgtgttagtctcatttttgttttgttttttactctaggaatgaataaggaatctaaagacttcgctgaccagctctttagagcattagctcgccggaataacgtctccggcgatgcaatcacaaaggaacagcttaggatattctgggaacagatctcagacgaaagctttgatgccaaactccaagtcttttttgacatgtaagcttttttttacatatcttcacctaacccacaataaatatataacgcgtaatcactatttgtcgtttaatattgactcttaatgaaaattaaacggtcatcagaatttaaggaccaaaagtagtaatattaatcatttgtggagttttggtggatttgtaactaatatatgacatcactgtttggtcagggtggacaaagatgaagatgggcgagtaacagaagaagaggtggctgaggtgagaaaacacacacaccactcaataattatctttttcaaatattttattatatttatacattttttttatcttatatttattcatattcctggttgaattttttttctcttattttatacgttattcttggttgattattttgacaattttgtccacgcgcaaatccccactgactttatctgctgacgtttactattaacatcatcaatatattaacttcatgtgaacacgacaaaatggtaatagatagatagagtagtagtctttgttactttagcttaggttattaatgtttcaaatactttagcttttgttttctaatttgttggtaatttattgcagattattagtcttagtgcttctgcaaacaagctctcaaatattcaaaagcaagccaaagaatatgcggcactgataatggaagagttggacccagacaatgctgggtttattatggtacgtgtggtccactttcacccactcaatcacactaatggtattatgtacgtcgtaaatttaaccactcttaaaatactagaaaaaacgtggaaaaacataacgttctagaagtctttagtggtcaaaattgggtcaccatgatgttttttaatttccaacttattgggccatcttgaactttttaccaaaccaatcaacaaaatctcgacaatgggtggttagtggttacgatatgaagaaatgaccaataaaattgtaaaatatatgaactaacactataatccaagcttagaaagtcttaggcggcttccgatagtatattgttttttaattattggagaaacctatgaaaagtgtttttaagaaaaacagtttggaacattaatgttttattgtaacgttttagttaattatatgatatggacattggtgaaacagatcgaaaacttggaaatgttgctattacaagcaccaaaccagtcggtgcggatgggagacagcaggatacttagtcagatgttaagtcagaagcttagaccggcaaaagagagcaaccctttagtgagatggtcggagaaaatcaaatatttcatacttgacaattggcagagactatggataatgatgttatggcttggcatctgtggtggcctctttacttataaattcattcagtacaagaacaaagctgcctatggtgtcatgggttattgcgtttgtgtcgccaaaggaggcgccgagactctcaaattcaacatggctctcatattgttgcctgtttgtcgaaacaccatcacttggcttaggaacaagactaagcttggtactgtcgttccttttgatgatagtcttaacttccacaaggttattgcaagcgggatagtcgtcggtgttttactccatgcgggtgcccatttaacgtgtgattttccacgtttaattgccgcggatgaggacacctatgagccgatggaaaaatactttggggatcaaccgactagctactggtggtttgtgaaaggagtggaaggatggactggcattgtgatggttgtgctaatggctatagcctttacactcgcgacgccttggttccgacgtaacaagcttaacttacctaacttcctcaagaagcttaccggtttcaacgccttttggtacacccaccatttgttcatcattgtttatgctcttctcattgtccatggtatcaagctctacctcacaaagatttggtatcagaaaacggtactctcttcaaacctcattttatctgttttaatttcttattttctttcctttttccggttaataacatttattacctgtttgtatgattcttgtagacatggatgtatcttgctgtacccatccttctatatgcatcggagaggctgctccgtgctttcagatcaagcatcaaaccggttaagatgatcaaggtcagatatatttctatttatctcttgaaaaccttatgtttcaagaaatatttcaactaatacttttaaaccatcttattttatagttctttttgataaaagtttgaaaattgcctttgaacttaatctatatatatgtaacaacaggtggctgtttaccccgggaacgtgttgtctctacacatgacgaagccacaaggattcaaatacaaaagtggacagttcatgttggtgaactgccgagccgtatctccattcgaatggcatcctttctcaatcacatcagctcccggagacgattacctgagcgtacatatccgcactctcggtgactggacacgtaagctcaggaccgttttctccgaggtttgcaaacctcctaccgccggtaaaagcggtcttctccgagcagacggaggagatggaaacctcccgttcccgaaggtccttatcgacggtccatacggtgctcccgcacaagactacaagaaatacgacgtggtactcctcgtaggtctcggcattggagccacgcctatgatcagtatccttaaggacatcatcaacaacatgaaaggtcctgaccgcgacagcgacattgagaacaataacagtaacaacaatagtaaagggtttaagacaaggaaagcttatttctactgggtgactagggaacaaggatcattcgagtggttcaagggaataatggacgagatttcggagttagacgaggaaggaatcatcgagcttcacaattattgcacgagtgtgtacgaggaaggtgatgcaagagtggctctcattgccatgcttcagtcgttgcaacacgctaagaacggtgtggatgttgtgtcgggtacacgtgtcaagtcccacttcgctaaacctaactggagacaagtctacaagaagatcgctgttcaacatcccggcaaaagaataggtaactaatctcgaccgttaatctcgttatgtacgtgatgttgtataataattaataaagtgatgaatttagactaaatactaatatgaattttgattgcaggagtcttctactgtggaatgccaggaatgataaaggaattaaaaaatctagctttggatttttctcgaaagacaactaccaagtttgacttccacaaagagaacttctagattaattatatacgttgtagaaaaataaaacaagaaacaactatacaaataaatatttattttaaattcttttcatttttatgtaaaattatctgagttatctttttttgttcttctata

SEQ ID NO: 80 - DNA, 1182 bp, Zea mays
ttcttgtttgttgattaacccttaattaatccgggcgcgcctgatttatcacaagtttgtacaaaaaagcaggctcctgcaggaccatggctcctctcctttccccgccgctgctcgcggacagcgtcaccaagttccatgcggcctcaacgccagtctcgtgctccggtagcccacaacgctacgtcatcacagggttggctggggccggaaggggagagcacgactggcgtcggaggacgtggggaagaacgaacctgagggtgaaagcggtggcggcagagtcccgcagctcggaggggggaatcgctgaagattattacgctgttcttggcgttatgccagatgcaacgccgaagcagatcaagaaagcatactacaactgcatgaaatcgtgccatcctgatctcagtgggaatgaccctgacgtgacaaatttctgcatgttcatcaatgaagtttacacggtgcttaccgatcccatccagcgagcagtgtatgatgagatacatgggtatgccgcgacggcaaccaatcctttcttggatggcagcgcaccccgggatcacgtgtttgttgatgagttcagctgcataggatgcaagaactgtgctaacgtgtgttctaaggtcttcgaaatcgaggaagatttcgggcgggcaagagtttatgaccaatcaggcagcacagaactgattcaagaagctattgatagttgcccagttgactgcattcactggacttcagctgcgcaactgtcgctccttgaggatgaaatgcgcagagtggagagagtaaatgttggattaatgcttgctgggatgggaggctcaattgatgtgtttcggatggcaagttcacgctgggagaaaagacaagccaaagtcctggagaaggtcagaaggcggatgagccaagatgattccagaaagggtggctcatggagtgacatctggggggcaccaacaagatacgagaagaacgaagaggaggtgaaggagagagcaaagcgagccgcggctgcagcaaggaggtggcgggagtactcacggaaaggcgccgacaagcctccaacattcaagcttccggaggcagtgcccagcaaggagtgactcgagacccagctttcttgtacaaagtggtgataaattggagctctgcagagctttcgttcgtatcatc

SEQ ID NO: 81 - DNA, 2156 bp, Arabidopsis thaliana
ttaattaaatccatgggaggtcaaagctcaaagattggtacatgttgttcacacaagactactgctcttgaagctccagatgttggtgacgtctctgtttttctctcttgctacaacgacaagccctcttttggctgatatcgtaatcccctttttacaatattacagaaaacaaagagaatggtgaggtaaacggtgtgcattcttttcgtgaatactcactagaacagcttaagatcgccacctcttgttttgctttggagaatgttgtatctgaacatggagaaacagctccaaatgttgtctatcaagggaaattggagaatcatatgaagattgctatcaagcgcttttctggaactgcctggcctgatcctcgccaattcctggtatggcatgtacctttcagtttatctagttgccaattctcaaatctattaactttggatatgtctgtttccaggaagaagcaagattggttggtcagctacgcagcaaaagaatggccaatttactcggttattgctgtgaaggcggcgagaggttacttgtggctgagtttatgcctaatgagacactagccaaacaccttttccactgtaaaaagaaaatgcctttgatcaattgtctttcgattttctttcaagattttctcctaagatttgcttaccacttttatcatctaccaggggatacagagccaatgaaatgggcgatgcgactaagggttgctctatacatttcagaagctcttgaatactgtagtaacaatggacacacgctatatcatgatctcaatgcttacagagttttatttgacgaggtaattacttaaacgcaactcttgtccgggaaaccatgttttgttttatgctatattcccccactaatgcgtttatgaatctttataaggaatgtaatccaagactttcaacatttgggttaatgaagaatagtcgggatgggaaaagttatagcacaaatcttgcttttaccccacctgagtatctacgaactggtgaaattgatttgcaccctcctcgtaggtcatattatttccaacaatttctacaacttgagacttaagtgtgtgttgatacagggagaatcacagcagagagtgtgatttacagttttggcactcttctgcttgatcttctcaccggaaagcatattcctcctagccatgtaagtgcccatggtagctactttaatcgtttcttgaattctctttattaattatctcagccttttgctgtgtgttttaggcccttgatttgattcgagacagaaatcttcagactctaaccgattcctgcttggagggacaattttcagacagtgatggtacggagttagtacgcctgacatcttgttgtcttcagtatgaagctcgtgagcgaccaaacataaaatctttggtcactgcactgatatctctccagaaagacacagaggttctgtctcatgttctaatgggtctgcctcaaagtggtacttttgcgtcacctccgtctccttttgctgaggcttgctcgggaaaagacctgacgtctatggttgagatcttggaaaaaattggttacaaagacgatgaagatgtaagtcgtcatgctttacggttaccactttagagttagaatccttatgcttcccatcccatgaaggcttctttatgtgacatgtttaaacgcagctttcgtttatgtggacggaacagatgcaagaagctataaactcgaagaaaaaaggtgatattgcatttagaagaaaagactttagtgaagccattgagttttacacgcaggtatgtctttctttcacacttgaatccgtaacaagaccttcctccatagttgatgatgccctgtctataaaaattgtcccagtttcttgatttgggaatgatctctgcaacagtcttggtgcggcgaagtcaaagttacctaatgagtaacatggcgaaagaagctttagatgatgcaatgaaggctcaaggcatttctcctgtttggtatgttgcattgtatctccagtctgctgctctttctgtcctgggaatggagaaggaatctcaaatcgcacttaccgaaggatccattcttgaagccagaaagatttcagcttccacacagaactaaagacttaggcgcgcc

SEQ ID NO: 82 - DNA, 1392 bp, Arabidopsis thaliana
ttaattaacactttccgtggtttagtgttgaggacgatcactgtttgtaattcgatggcgaggaagaagatcagagaatatgactccaagagacttctcaaggagcatttgaagcgtcttgctaatattgacctgcagattcgctctgctcaggtgacagaatctacggatttcactgagttaaccaaccaggagtcatggctatcgtccacaaagctagttgtgaaaccggatatgctatttgggaaacgcgggaaaagtggtttggtagctctaaagctggatcttgctgaagttgcagactttgtcaaagcccgcctcggcactgaggtcgagatggagggatgtaaagcacctatcactacattcattgtggagccttttgtgcctcatgatcaagaatactacctctctatagtatctgatagacttggatgcactataagcttctctgaatgtggtggcattgaaatagaagagaattgggacaaagtgaagactatatttcttcctgcggaaaagtcgatgacgctagaagtatgtgctccattaatagcaactcttcctcttgaggttcgagctaaaatcggcaacttcataatgggtgcctttgctgtatttcaagatttggatttcagttttatggagatgaatccttttacactagtcgatggagaaccattccctctggatatgagaggagaattagatgacactgctgccttcaagaatttcaacaagtggggagacattgaatttcctctgccatttggaagggtcctcagttctacagagaacttcatccatggtttagatgagaagacaagtgcttctttgaagttcactgttttgaatcctaaaggccgcatttggacgatggtagctggaggtggtgctagcgtcatatatgctgatacagttggggatttaggttatgcatcagagcttggaaactacgcagagtatagtggagcacctaatgaggaagaggtgttacaatatgcaagagttgtcattgattgtgccactactgatcctgacgggcgtaaacgagctcttctaattggaggaggcattgccaatttcactgatgtggcagctactttcaacggtatcattcgagcgctaagagaaaaggaaacaagattgaaagcatcaagaatgcacatttacgtaaggagaggtggaccaaattaccagactggtttggctagaatgcgagctttaggagaggaacttggtgtccctctagaggtatatggtccagaggcaacaatgacgggaatatgcaaacgagccattgactgcatcatgttgcctgatgcataacctacccaaaccttttatctcttcttcagtttgaaagcagaacaaaagctttggaggcgcgcc

SEQ ID NO: 83 - DNA, 1037 bp, Arabidopsis thaliana
ttaattaagttttctccttgattttcgcattctttagagtcttaacgcaaagatgagacctcctctaactggaagtggtggtgggttcagtggtggaagagggcgtggtggatacagtggtggtagaggtgacggtggattcagtggtggtcgaggtggcggtggtagaggaggaggaagaggtttcagcgaccgtggtggtcgcggcagaggaagaggaccaccacgtggtggtgctcgcggcggcagaggaccagctggccgtggaggcatgaaaggaggaagcaaagtgattgtggaacctcacagacacgcaggagtgttcattgcaaagggtaaagaagatgcccttgttaccaagaatttggttcctggtgaagctgtctacaacgagaagagaatctctgttcagaacgaagatggaaccaagactgaatacagagtttggaatcctttccgttcgaagttggctgctgctattcttggtggtgttgataacatctggattaaacctggtgctaaagttctataccttggtgctgcttctggaaccacagtctctcatgtgtctgatcttgttggccctgaggggtgtgtgtacgcggttgagttttctcatagaagtggtagagatttggtgaacatggcaaagaagagaaccaatgttattccaatcatcgaggatgctagacacccagctaaatacagaatgcttgtaggcatggttgatgttatcttctctgatgttgctcagccagatcaggctaggatcttggctttgaatgcatcatacttcctcaagtcaggaggacactttgtgatctcaataaaggcaaactgtatcgactccaccgttccagcagaagctgtgttccagactgaagtgaagaagcttcaacaggagcaattcaaaccagctgagcaagtgacgcttgagccatttgagcgtgaccatgcatgtgtcgttggtggctaccgtatgcctaagaagccaaaggctgctactgctgcttagaagttttctactctacgctctt

SEQ ID NO: 84 - DNA, 1187 bp, Arabidopsis thaliana
ttaattaactcaagtctcaccaatggcgataattctccgttcatcagatccactcctctcacgaatccatccggaaccacaagaaatcgaccacttcgataacctcccagactcaatcctcctcctcatcttcaacaacatcggcgacgtcaaagccttaggtcgttgctccgtcgtctccaaaagattccattccttaatccctcaagtcgaaaatgtcttcgttcgtgtcgattgcgttatctccgacgacgattcttcctctctcctctccgataaacctcgatccgcctccgccgcttctcctttctccgccattttccgtctcgtcttcaagccgttacaagctttgggacagttccttaaacgctcaggttcttcttctcttccttcaggatcatctccttcttcgttgttgattagtggtggtgatgatggagagattgaacaaggaggtgtaacgcatcattcaccgactcaggttttgaaaaacttcgatgagattaagtttcttaaaatcgagcttcctagtggtgaattagggattgatgatggtgttttattgaaatggagagctgaatttggttctactctcgagaattgtgtgatcctcggtgcttcctctgtgattccgccgacgaattcggataagacggaagcgagttcggctcccgtcgcggcggtggaagataatggaagtataccggaatcgttttatacaaacggagggcttaagctacgtgttgtatggactataagctctttgattgctgcttccgctagacattacttgttgcaaccgattatagcagagcataagacgcttgatagtttagtgcttactgatgttgatggtcaaggagttttgtgtatgaatcgagatcagttagaggaattgagagtgaaaccattgtcagcttcttcagcttctaagaggactcttgtacctgctttgaatatgagactttggtatgctccttctttggaattgcctgatgggactgtgttgaagggagctacgcttgtggcgattaggccgagtgagtcgaagaaggaggtgtgtgatgtgtcttgggtttcttctgcgtttgatgagccttatggggtagctgctaagatgttggttaagagaaggacttattgtcttgaaatgaattcgttctaaagcttgacgatttcggcgcgcc

SEQ ID NO: 85 - DNA, 845 bp, Zea mays
ttcttgtttgttgattaacccttaattaatccgggcgcgcctgatttatcacaagtttgtacaaaaaagcaggctcctgcaggaccatggcggtgctactccgccgcgccgcggcgctcctcgtcgtggctgctgtctgcgcggacggcgcctccacgttctactcctccgaccccaacctcggatccgcccgcgtcgtcttccagacgaattttggtgatattgagtttggcttctttcctcatgttgcacctaagactgtcgaacacattttcaaacttgtgcggcttggatgctacattacaaatcacttcttccgggttgacaagggtttcgttgcacaagttgctgatgttatgtcaggtcgaaccgcccctatgaatgaggagcagaaaaaagaagcggagaaaacaattgttggtgaatttagtagtgtcaagcatgtcaggggaatcctctccatgggaaggcactctgatccagacagtgctggctcttccttttctattcttctgggcaattcaccgcatcttgatggccagtatgctgtatttgggagggtcactaaaggtgacgatacattgactaaactagagaggcttccaacccggagagaaggcatttttgtaatgccgatcgagcgtatcaacatcctatcaacttactattatgatattgatctagagagctgtgaagcagaaaaatctattctccggaggagactttctgaatcagcatcagaagttgagcgatggagaagaaaatgctttgcttaactcgagacccagctttcttgtacaaagtggtgataaattggagctctgcagagctttcgttcgtatcat

SEQ ID NO: 86 - DNA, 1257 bp, Zea mays
ttcttgtttgttgattaacccttaattaatccgggcgcgcctgatttatcacaagtttgtacaaaaaagcaggctcctgcaggaccatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactcgagacccagctttcttgtacaaagtggtgataaattggagctctgcagagctttcgttcgtatcatc

SEQ ID NO: 87 - DNA, 825 bp, Zea mays
ttcttgtttgttgattaacccttaattaatccgggcgcgcctgatttatcacaagtttgtacaaaaaagcaggctcctgcaggaccatgtccgccgccggcggcgacctgccggagactgtggaggtgacgctgcgcgccgtcggcccgtcccgtccaaccaccctccgcctccctccgcttctctcggtcgccgagctgcgcggctgcatcgcgcgcgaacgccgtctagcaggcacggaagaagttcgactccgcttgatcctgcgggggaagacgctcccgcaccaagacgacagccatgtcactctccgcgatggggatactcttatagtcgccgtggcacctaagcctcctgttaatcatcttcttgatgatgacgttgaggacgaagaagaggatgaactgaagttcagaataccacaaacgacaaccttgtggaagaggaaattttttatgtttcttcgagacaaattgagattgcctgatatcattttgatggcgctgttttctctcagtatgaaagcatggattatcattgcaatgtggttcctattggcaccgattgctcagaagtacgacattggacctttatatataattggtactggtttcttgatcatacttattaatctcggaagacgacagcaaggtgatgttagtgcatactccatattcaacgaagattttagggagctgccaggaacacttaatgcagaccgcattgatgcagacatccgggcaggtcaattttaactcgagacccagctttcttgtacaaagtggtgataaattggagctctgcagagctttcgttcgtatcatc

SEQ ID NO: 88 - DNA, 620 bp, Zea mays
ttcttgtttgttgattaacccttaattaatccgggcgcgcctgatttatcacaagtttgtacaaaaaagcaggctcctgcaggaccatgataaattcaaagatgctagttcagctagcaaagaagtggcaacatatggcagcccttgggaggaggaggctaacaatgaccacaacgatcaaagatggcaacctatactgcacatcagccatagcgaacaagggtcactgcatcgtatacacagctgacggtaagcgatttgaagtccctttggcgtatctcagtacaaacgtttttgtggagctcctgcggatgtccgaggacgagtttgggttcacaagtgaagacaggatcacagtgccttgtgatgccgaagtgatggagtatgtgatgtgcttgcttaggagaaagccctcagaagaagtggaaagggcggtccttaactctgttgtaatgccatgcaactgcatgagtaccatgaccatggtttccaagggtcttaaccagtcactatctatattttagctaatgagaagtgttgtatgcatgcactcgagacccagctttcttgtacaaagtggtgataaattggagctctgcagagctttcgttcgtatcatc

SEQ ID NO: 89 - DNA, 705 bp, Zea mays
ttcttgtttgttgattaacccttaattaatccgggcgcgcctgatttatcacaagtttgtacaaaaaagcaggctcctgcaggaccatgggaggagagcacgaggagcaggagggtggcggcgcaaaggccgggggctactcctccggtctcccgccgtcggagccgccgcacctgcagggccagccgccgcaggagtacgggtacggcacgttccagggccctcggcatcctcccgtcgggttcccgcagcctgccccgcctcccgggttcggcggcggcggcggctaccacaaccagcaacagccgtacgcgcacgcggagacgtactacgcccaggggtaccaggccgtgccaggctatggtcctgttgctgaaggaagacctgtgagaatgaggcgtctcccatgttgtggcctcggcttaggctggtgcctgttcattgctgggtttttccttgctgccattccatggtacattggggctttcgttctgatatgcgtgcgggtacatgaccaccgagagaaaccaggatatgttgcttgcacaattgctgccgttgttgctgccgttgccatattcctgggggtaactaagggaacacacgtgtggtgaattgcttccagagaaggcaatggatttatacttgtactcgagacccagctttcttgtacaaagtggtgataaattggagctctgcagagct

SEQ ID NO: 90 - DNA, 623 bp, Zea mays
ttcttgtttgttgattaacccttaattaatccgggcgcgcctgatttatcacaagtttgtacaaaaaagcaggctcctgcaggaccatggcggagaatttggcccccgagaagcgccacaccttcgtgcacaacgggcagaaggtgttcgagtgggaccagacgctagaggaggtgaacatgtacatcgagctccccaagggcgtgcccaccaagctcttccactgcaccatccaggccagccacgtcgaggtcggcatccgcggcaacccgccatatctcaaccatgacctgatgcaccccgtgaagaccgactcgtcgttctggacaatagaggatgctgagatgcatataacactgcaaaaaagagagaaggggaaaacatggtcatccccaatacaagggcaagggattttggatccatatgctgcagatcaagagcaaaagcggcttatgctccaaaggtttcaggaagagaacccagggttcgacttttcgcaggctcagttcagtggaacctgccctgacccaagaaccttcatgggaggaatacgctctgagtgactcgagacccagctttcttgtacaaagtggtgataaattggagctctgcagagctttcgt

SEQ ID NO: 91 - DNA, 1842 bp, Arabidopsis thaliana
ttaattaaggttgatcgtcaaagaaatcgaaaaaatggcgaggacgacgcgagaaagagtgaaatcgttcataaacaatagatggctagtgtttgttgcggccatgtggattcagtcttgcgctggcatcggttacttgttcggcagcatctctcctgtcatcaagagctccctcaactacaaccagaaacagctctccaggctcggtgtcgccaaagatctcggcgatagtgtcggcttcctcgctggtactctctccgagatcttgcctctctgggccgctcttctcgtcggctctgtccagaaccttgtcggctatggctgggtttggcttatcgtcaccggtcgtgctcccattcttcctttatgggctatgtgtatcctcatttttgttgggaacaacggggagacctacttcaacaccgctgcattagtttctggtgttcagaactttcccaagagccgtggtcctgtcgtcggtatcctcaaggggtttgctggcctcggcggtgccatcctctcccaggtatacacaatgatccactcctctgaccgtgcatccctcatcttcatggttgctgttgccccttcagttgttgttgttcctctcatgttcttcatcagacccgtcggtggtcacagacagatccgttcttctgatgccaccagcttcaccgtcatctatgccgtctgcattctacttgctgcctatctcatggcagtgatgcttgttgaagatttcattgatcttagccattcaatcatcattgctttcaccgttgtcttgtttgccattcttcttgtacccatcttcataccaatcgcaacgagttgcttcacagcatcaaccgacccctgtgacacgctcgaagaacctctccttggcgatcagcaaggtcaggatccgggacagtccaccacccctgaccatggtcctgagcttatatttagtgaagtggaagacgagaaaccaaaagaagtagatttgcttcctgcagtggagagacataagagaattgctcagttgcaagcaaagctgatgcaagcagctgcagagggtgctgttcgggtcaagagacggaggggccctcacagaggcgaggattttactttaactcaagcactcgttaaagccgatttctggctcatcttcttctccctcttgctcggatctggttcgggtctaacggtcatagataaccttgggcagatgagtcagtctctcggttacgataacactcacgtctttgtgtccatgattagcatttggaacttccttggacgcattggaggcggttatttctccgaactcatcgtcagggactatgcgtacccaagaccggttgctatagcagtggctcagcttgtaatgtcagtaggacacatcttctttgcatacggatggcctggagctatgcacatcggcacactattgattggacttggctatggtgctcactgggccatcgtcccagccactgcctctgagctctttggtctaaagaagtttggagctttatacaatttcctgacgctggccaacccagcgggatccttagtcttttcggggctgatcgcaagttccatttatgaccgcgaagcagagaggcaagcacaaggatccttgttcaatcctgacgatgtcctgagatgccgaggttccatctgttacttcttgacgtcactcataatgtctggattctgcctcattgcggccgccttgagtatgatccttgtgcaacgtacgaagccggtttacacaaatctctacggcaaaacccgcaactgattttaagataccatattacgaaaatatcccaccaagaaaagaagcggcgcgcc

SEQ ID NO: 92 - DNA, 1230 bp, Arabidopsis thaliana
ttaattaaatggcggcgactatggcagattataatgatcagatcgtcaatgagacctctttttacaaccgaatggttctgagtcaccttttgccggtgaatctatgggaacctttaccacatttcctccagacatggctccggaactacctcgccggaaacatactctacttcatctccggcttcctctggtgcttctacatctattaccttaaactcaacgtttacgtccccaaaggttacttttttcaatttcgatgttctgttttgaaacctttcttttgttgattccttcgattgtatcgcctgatagattgtgttatacgttaaccttttttcttactgttactttcagttcttgtcttctacttctcatttaattagttttaaagtttaatatttttggctaatccacattttttaagttgaatcttccatgaaatttgagctcaaaatataccatgaaattgaaatttgtggttcttagttctatttcttgcttggtttcttctatttttgtggttagaatccattcctacgagaaaggcaatgcttttgcaaatatacgtggcaatgaaggctatgccttggtacactcttcttccagctgtctctgagtatatgatcgagcatggttggaccaaatgttactctacacttgaccatttcaactggttcctctgtttcctctacatagctctctatcttgttttagttgagtttatgatttattgggttcacaaagagcttcatgacattaaatttctctataagcatctccatgctacccatcatatgtacaacaagcaaaacacactctctccatttgccggtatgtcaaagctatatgttctcaatctaaattcaagagcttgtatcaatggtgacttctttacttgatgtttttcgggttttcagggctcgcattccatccgctggacgggatacttcaggctataccgcacgtgatagcgctgtttatagtgccgattcatctcataacacatctgagtcttttgtttttggaagggatatggacagcaagcatccatgattgcatacatggtaacatctggcctataatgggtgcaggataccataccatacaccatacaacatacaagcataactatggtcattataccatatggatggactggatgtttggctctcttatggttcctttagcagaaaaagacagtttcaaggagaaagaaaagtgaggcgcgcc

SEQ ID NO: 93 - DNA, 1749 bp, Nostoc sp. PCC 7120
ttcttgtttgttgattaacccttaattaatccgggcgcgcctgatttatcacaagtttgtacaaaaaagcaggctcctgcaggaccatgctaactaaaaaagaatctatttcccaagtcatcgttactgctgcacaaatgcgggaaattgaagggcggatatttgcagcaggaatgccagtacccgctttgatggaaaaagtggcaggattaattgctagccgcattcaagatttctcttccaactttgaacaaggtagacaaagagaacaagtaaggattttgcctccatttccttgcgtgggaatcctcgttgggcctggacacaacggtggcgatgctttggttgtggcaagagaattgcattttaggggttatgcggtttgggtttatttgccttttgataaactcaaggaattaacatcacagcatttgcaatatgctcagagtataggtataccttgttatggagaaattgagcaattaccagattgtgatgttttggttgatgggttatttggctttggcttagaaagaacaattaccgatcccattgcttcagtaattaatcagttgaatgaatggaacaagccaattattagtattgatttgccttcaggtttgcacactgatacaggtgaggttttagggactgcgattcgagcaacttacaccctgtgcttaggtttgtggaaacaaggtttgttgcaggatcaggctttagattatgtaggtaaagctgagttaattgattttgatattccctgggctgatgtgcaagctgtgttggaagatgtacccaaagtcaaacgcattacaccagcaacagctttatctactttgcctttacctcgtccaccagtaacacacaagtataaggaaggacatttactgttaatttgtggttcacgacgttatgctgggggggcaattttgacggctttgggtgctaggggtagcggtgtagggatgttatcaattgctgtacccgaatctctgaaacagcttttggtatcacacttgccggaagcattagtgattggttgcccagagacagaaagtggagcgatcgcccagttacaattaccagagaagacagagttaagttcctttagtgcgatcgcctgcggccctggtttaacgaaagatgctacatctattgtggaagaagtcttagcaagcgatcgccctttagttctcgatgccgatggtttaaatattttggcacagttggggacaatacccacactgcaacagcgcccagcagtaacagtactcacaccccacacaggcgaatttcaacgattgtttcctgatgttgctgatgctaaacatgatcgagtcaaagccgtgcaggaagcagccacccaaagcggtgcggtggtattgttaaaaggagcgagaactgcgatcgccaatcctcaaggttcagtatggattaatcccgaaagtacgccggctttagctcgtggtggtagtggcgatgtgttaacggggttattgggtggattgttggcacaagtggcaaataaagaaatacctgtagaagatattgtggctacggctgcatggtggcacgggcaagcaggtattttagccgccagtgagcgcacagagttaggcgtggacgcatttacgttgtcacagtatttgttgaaggtgattgttggtcgctcttagctcgagacccagctttcttgtacaaagtggtgataaattggagctctgcagagctttcgttcgtatcatc

SEQ ID NO: 94 - DNA, 1974 bp, Zea mays
ttcttgtttgttgattaacccttaattaatccgggcgcgcctgatttatcacaagtttgtacaaaaaagcaggctcctgcaggaccatgggtcctctcctccgcgccgccgcgctctccgtcgcgctcctcgccctcgccgccgtgggcgaggcgcacagcgccaccgaattcctcaacatcttcaaaccgcggaatgagcacgactacttccacaacgcgaaccaggaggaggatgtgatgccccgggccagcgaccagcagaacctcataacggcgccggtgaccaagagcggcctcatgaaggtgccgccccggtccgcgcccaccgcggtggcgcaggacacggtggtgctccccgtggacagcgccgcggggttccccggcgcttggtccatcatcagcgagaacgcgggcgtgtccgcgatgcacctggtgatcatgcggagcgacaaggccatcatgttcgacacggtcaccacggggccgtcgctgctgcggctgcccaaggggaactgccgcctcgatctccgcagcaagcaggtcggcgccaaggactgcgccgcgcacgccgtcgagtttgattacgcgacaggcggggtcagggccctcaaggtcttgacggacgtgtggtgctcatcgggcgcgctcgacgccgagggcaacctggtgcagaccggcggctacttcgaaggggagaaggttgtgaggtacctgagcccatgcggcaactgcgactggagggagttcccggggagcctggccgaaggaagatggtacgggacgcagcagctgctcccggacggccgctccatcgtgctcggtggccggcgtgcgttcagctacgaattcgttccggcggaagggcagtcgaatgcccaagccattcccctccagatactccgtgacaccaccgacgacgtggagaacaacctgtacccgttcgtccacctccttcccgacgggactctgttcatcttcgccaacgaccgctccatcctgttcgaccccaggaacggccaggtcgtccgcgagttccccgtcctcccaggcgggggtcggaactaccctgcctccggcatgtcggcgctcctgcccctcgacctccgccgcggcgacgtcctcagtcccgaggtcatcgtctgcggcggctcccccaagaacgccttcacgctcggcgagtccaacacgttcccgcccgccctcaaggactgcgcgcgcatcaaccccttgaagcccgacgctcggtgggcgctggaccagatgcccgtggcccgcaccatgggcgacctgctgatcctgcccaccggcgacctgctcattctgaacggcgcggccaagggctgctccggctggggcttcgggcggcagcccgtgctgagcccgctcctgtactctccgcgccaggcgcggggctcgcggttccgggcgctggcgccgaccaccatcccgcgcatgtaccacgccaccagcgctgtgctgcccgacgccaccgtgctcgtggccggcagcaacaccaactcggcctacaacttcagcggcgtcgacttccagaccgaggtgcgcgtcgagcgcttcaccccgccgtacctcgccccggagcgcgcggccaaccgccccgctatcgacgtggccaccgtccccggggacggcatggcgtacggggccaagttcacgttccagttctcgacgcccgtgcaggccgtggccgagcccgacctgaaggtgaccatgtacgcaccaccgttcacgacgcacggctactccatgaaccagcgcctgctggtgctgtccgtcaccgcgttcgcggccaacgggcagaggtacacgataacggtcgacgctccgggaaagcctgagctcgcgccgccgggatactacctgttgtacgtcatagcgaaaggcgtgccgagcaaggccgcgtgggtgaaggtacacaaatgactcgagacccagctttcttgtacaaagtggt

SEQ ID NO: 95 - DNA, 558 bp, Zea mays
ttcttgtttgttgattaacccttaattaatccgggcgcgcctgatttatcacaagtttgtacaaaaaagcaggctcctgcaggaccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgagggagagccgctggaagggccgctacgagcggggccccgccgagggcagctcgccctggggcgtcgccttgctcgtcctcctactcctcgtgctcgccagcttccactccaccatccacgacatgtgggggccgtgactcgagacccagctttcttgtacaaagtggtgataaattggagctctgcagagctttcgttcgtatcatc

SEQ ID NO: 96 - DNA, 1410 bp, Zea mays
ttcttgtttgttgattaacccttaattaatccgggcgcgcctgatttatcacaagtttgtacaaaaaagcaggctcctgcaggaccatgcctcccgtgaagaagtccaagaaggggaagcggaaatccaaggatggcaagctcaagattgtcagggcgcggggcgcgccgccggcgctgccgccggagctccgcgccctcgacaccgagtggtggtacgctttcctgaacaagcaagtcgagctagagcatgctgtgcctccagatgagggggaagcattcaggcacttcttcaggacttcaaggaagacttttgactacatctgctccattgttagggaagatctgatctcaaggccaccgtctggactgatcaacattgaggggaggctgctcagtgtggagaagcaagtggcaattgccatgaggaggcttgcgtccggtgattcccaggtgtcagtagggactgcttttggtgtgggccagtctactgtttcacaagtgacatggagatttatcgagtcgatggaagatagggctaggtatcatctggcatggccaagtcaagagagacttgagcagatcaaagctgtgctggaggatgcttatggcctgccgaattgttgtggtggtgttgatgccacccacgtaatcatgacacttcctgctgttgagtcatctgcagattggtgtgatcatgcaaagaactacagtatgttcctgcaagggattgttgatgatcagatgaggtttattgatattgttactggttggcctggcagcatgacattctcacgcctgatgaaatgctctgggtttttcaagctctgtgaagctggggaacgtttgaatggctctgtcaaagtttcagcagagggtgcagagatcagggaatacattgctggtgactcatgttatcctctactcccatggcttatgactccattcgaaggaaaacatctgcctgccccattgcaaaactttaatgcccgccaaaaagctgcaaggctgcttggaacaaatgcgttggcgcggctgaagggatcctggaggatcttacacaaagtcatgtggaggcctgacaagaacaagctgccaagtataattcttgtttgctgtctgcttcacaatatactcatagactgccatgatgaattgcttccaagtgttcaacttcccgaacatcatgatactggctataatcgagaaaactgcgagcaggtggatcctaatggcaaagtgatgagagaaaacattacagcacatctccaacactgtgaagcttccaagtttctctgcaactgagctaagttagcttgttgttttgctgggattgatgatctcgagacccagctttcttgtacaaagtggtgataaattggagctctgcagagctttcgttcgtatcatc

SEQ ID NO: 97 - DNA, 602 bp, Arabidopsis thaliana
ttaattaagaaaacaccaaaagaccacatatccttccaatggccccccttcaacgcaccatctcggatatttcacaccaaatttcaatagacaacactctaacaaaagaaccatctccaaccgcaaccgcaacaactttgttatccttatcagcgatatccgaagtggaagatgcaaagtgtgagtgttgtggcatgtctgaagagtgcacgccggagtacatacaccgtgtgcgttcaaaattctcagggaagctgatttgcgggctgtgcgaaaaagcggtggagggggagatggagaagatgaacaacagtgaagtgctgatggagaagcggcgagaagaggcagtgaaggtacacatgagcgcatgttcccggttcaacaggctaggccggagttatccagtgttgtaccaagcagaagcggttaaggaaatgctgaaaaagaggtctaagaagatggttggagccaccaagcctgaaaaaggtggcctcgctaggagctctagctgcatgccggctttagctaaggagcttaaagatcgtaccttggttaattagcttatttgtatactcacgtacactagttatgtcaggcgcgcc

SEQ ID NO: 98 - DNA, 917 bp, Arabidopsis thaliana
ttgtttgttgattaacccttaattaaaatgcctcgctatgatgatcgctatggaaacactcgcctctatgttggtcgcttatcatctagaactcgtaccagagaccttgagcgtctctttagcagatacggaagagtacgagatgtggatatgaagcgtgattatgcctttgttgaatttagtgatcctcgtgatgctgatgacgcaagatattacttggatggacgggatttcgatggaagtcgcatcactgtggaggcatcaagaggggctcctcgtggttcgcgggacaatggtagcagaggcccacctcctggttctggtcgctgttttaattgtggtgtcgatggccactgggcccgagactgcacagcaggagactggaagaataaatgttaccgctgtggtgaaagaggacacattgagagaaactgcaaaaacagtcctagtccaaagaaggccaggcagggtggaagctattccaggtcaccagtcaaatcccgctcccctcgtcgccgaaggagcccaagccgtagccgtagttacagtcgaggtcgcagctacagtcgatcgcgatccccagtgagaagagagaaaagcgtggaggacagatcacgcagtcctaaggcaatggagcgatctgtatctcccaaaggtagggaccaaagcctgagtccagaccgaaaagtgatagatgcaagcccaaagcgtggatcagactatgatggtagcccaaaagagaatggtaatggcaggaactctgcgagtcccattgttggaggtggtgaaagtcctgttggacttaatggtcaagacaggagcccgattgatgatgaggctgagcttagccgtccttcccctaaaggcagtgagtcaccttgatggatcacagggcgcgccaaaaattggagctctgc

SEQ ID NO: 99 - DNA, 927 bp, Arabidopsis thaliana
atggctacagccgttggaagcgggagcgatgtagaggttggatttgcgaagctccaaggtgaggatttcgagtactatatgcagtcttactccattattctcggccggaattctaagaaatcgaccgtcgacgtcgacctctcatctctcggcggtgggatgaacatttctcgcaaccacgctcggatcttctatgacttcactagacgacgcttctctctcgaggtacttggcaaaaatggctgcttcgttgaaggtgtcctccatctccctgggaaccccaacgtcaagctcgattcacaggaccttttgcagattggtgacaaggagttctacttcctgcttccggtttggagtatcctaggcggtccattgggacccaggcaccacgtcttagggaaggctactgttgttccgtaccataattatcattcgggtccaggttccgggtcgggtaagaatggcgtccggagtagagagttgtatgagtacgatgatgaagacgacgatgaagaggaggatatcagaggcagtggaaagaaaacatggagagatggacatgaaggagtatatgcctctggaggtaaaaccaaattgctcatgatagcttaacttcattgtgtcactaaatagatttcaggcttgttctagactttgagtataagttttactgtggtggttgatgattgaaccttgttagacttagattgaatgatagtgacaccacgacattgtatctgcttcatttgtgcagagaagaagagagagggaagatcaaaggcagatcgtgaagctgatgatcaacaatttttgcagctaatgcatggtagtggttggtctgtgacagatattaaaggagtatggaaacgtatggcatcacagtcgagtaagaagatacctatcacaagaagactgggctatccctga

SEQ ID NO: 100 - DNA, 2717 bp, Arabidopsis thaliana
caatttatttttcttattaataataataatagtgattatgttgacgattaataaaggattagtttcgaattatcaatatataaatccgtccaactaacctatcccgtcgttatcgaaccaatggagaccccactccctcctttatcgcaactaaccccaaatcctactcccgccgccgccgtctcttccgctattccggcgccagttaagagcgtagccgttcagcaaccgatcgatggatctccacgcgccgttgctactgataccggaggtattcctgagccacttgcggctgttcccggcgctaagcttcgtcttatgtgcagttttggtggccacatcatgcctcgtccacacgacaaatcgttgacgtactccggcggcgagactcgtattgtggttgttgatcgacgtgcgtcactgtcttcgctccgatctcgtctctctagtatgcttctcaacggccggtcctttactctcaagtaccagctccctagcgaagatctcgattcactcgtcaccatcactaccgatgaagatctggagaacatgatcgaggaatacgatcgcgcggcttcgtcagcgacggcgactgctacgcaacggctccggttgttccttttcgctaacaagctcgagaccgccgctactatgggatctctgcttgacggcacgaaatctgacacatggttcgtcgatgctctgaatcaatctggtttgcttcctcgtggtttatcagattccgccgccgtgaataataccttggtgaatctcgacgaagctagcggcggagagaccgagatccaaaaccttgaaactaatgttggtggcgagaacaataagcgaggggatttggttgctaacggtgtgatttcgcatcaggagatgcatatgagctcgatgcctgattctccaatgatggaagccgctggttcttcgataggatcttcttcttcatctccttccacatccaatttgccaccgattcgcgttagagtcagtgaggaccagaggatagaggaacaattggcacagatgaccttctcaaacatgcaaactcagaggcaatttgatgatggcgttagcttgatggcaaatcggccaatgatgattccacctggtgccatgaacgatgctgcgatggcgtataacaacgcacctggtgatggtactgctcccgcaagcaatggccatgtctcacctgaagacgatcgatccgaattaggtgtatcaactggctacaggaagccacctttgccgatgcaaccagtaacgatcccacctagaactgttggaggctatggcttgacatcccctgattctgttgcaaggtactttcatcttcccctggactctctctagttatttaggtagctataatgatctaggtaatttctgatctcaacttcttagtttctccatcattttcttcagcttgccttgaatttgtagtttcatttgcactgtttctgtttctgttctataatctttacatgtggtttgtattacatctctgatagtggctaagtagctaaaagaaatagatcattggtttgaagtatggtgtatgaatcgatgatggagaaatcatcttaaactgtcaaatgcttaagaattttctatgatctttatcatcatctttgttttattacaccttacaatcagagatttttcaatttggtgttctagatatttgtgtagatattggtatactctttgaaccataacgttacaagagatgttagctttattcttttgaatatgatgatactcaatgctgatatttcttgttgtttatacattacagtgatactagcatttcttctgctacttcattttcaaagccgatgtactaccaagaccaacctccagctctgccaagagctcctccagtggcacagcctgaaaccacctcggcccaaagctctcaagtcttacctcagactgaaaacacttcagcccaaaccacctcccatgtcttatctcagccaggtacgtacacaactatggatcaacaacaacaacaacctctggctcaacaacctttcttacaccaaggcgttcagtatatccctcacccatcacaatacataccaatttactctcatcagcaacaaaactaccctgtttacgtgatgtccgtcccacaatctcagcagtatatcccagcaggaactcccccgctctacccgaactcaaaacccggcacaaactcgagacctgaagctgcccagaacgtttaccgagctgctccccctcaggttattcagcttcagcaacagcatcagtacatgggttacgctggagctcctcaacatagcacaaacgcaaacgccaattacggtactggagctcctcaacatagcacaaacgcaaacgccaactacggtggaccctttgaatacacaaactctccaaacgagacagtgtattaccacacacaagctcctgctgcaaacactgccattccattagcgtctccataccaaagcatgacaccagcagcagccgcagcagctctagccgatatgtccaagcaaatggctcttgacggcggcaaacagcaacagcatatggctgcgtctcagccgctttaaacgctggatctttggtaataaatgcgcaaagtgttaagtatagccgacacggcgcgctctgttctttttgcgtattacatgtaacgtcctgttacatctcgttagatatacataggattt

SEQ ID NO: 101 - DNA, 1137 bp, Arabidopsis thaliana
atggccacatggaacgcatcctcccctgcggcgtctccttgctcatcgaggcgacgaacgaaagctccagcgagacgcccttcctccgaatctccaccaccgaggaagatgaaatcaatggctgagataatggcgaaatctgtccctgtggttgaacaagaagaagaagaagacgaagacagctacagtaacgtcacctgcgagaaatgtggttctggagaaggagacgatgagcttcttctctgtgacaaatgcgatagaggctttcacatgaaatgccttagacccattgttgttcgtgtccccattggaacttggctttgtgtcgattgttccgaccaacgacctgtaagaaggttatctcagaagaagattttacatttctttcggattgagaagcatactcatcaaacagacaaattggaattgagtcaagaaactagaaagcggagacgatcttgctctttgacagtgaagaaaagaaggagaaaactcttacctttggttccatcagaagatcctgatcagaggcttgcacaaatgggaacacttgcttctgcattaacggcattgggtatcaaatacagcgatggtttaaattatgttcccggaatggctcctcggtctgcaaatcaatccaagttagagaaaggtgggatgcaggtgctatgcaaagaagatttagagacattggaacaatgtcaatctatgtatagacgaggagaatgccctcctctcgttgtggtatttgatccgcttgaaggttacacagttgaagcagatggtcctattaaggacttaacattcatagctgaatatacaggggatgttgattacttgaaaaaccgagaaaaagacgattgtgacagcatcatgactctccttttatcagaagatccttcaaagactcttgttatctgtccagacaagtttggaaacatatctcgcttcattaatggcattaacaatcacaatccggttgctaagaagaagcagaactgcaaatgcgtgaggtatagcataaacggcgaatgtcgagttcttctagtggctacacgcgatatatcgaaaggggaaaggctctattatgactacaatggttatgaacatgagtatcctactcatcacttcctctga

SEQ ID NO: 102 - DNA, 1372 bp, Arabidopsis thaliana
atggatgccaaaaagttggatactggcccgagagatgcaatcaactggctccctgacgagattctgggcaaaatcttgtcattacttgcgacaaaacaggctgtttcaacatcggttctttctaaaaagtggaggactctctttaaattagtggataccctcgagtttgacgattctgtctctggaatgggtgaacaagaagcgagctatgtgtttccggagagctttaaggatttggtggatcgaacagtagctttgcagtgtgattatccgatcaggaagttgtcactaaaatgtcatgttggcagggacgatgaacaacgaaaggcttgtgtgggccgctggatatcgaatgtcgtagggcgcggtgtttcagaagtggtactaaggatcaatgatcgtggtttacactttctgtctcctcagctcttgacatgcaaaacactggttaagctgacactaggcacacgtctctttcttggaaagcttccttcatatgtgtcacttccatctcttaagtttctcttcatccatagcgtcttctttgatgattttggagagttgtctaatgtgcttcttgctggttgcccggtggtcgaggcgttatatctcaatcaaaatggcgaatcaatgccttacaccatatcgagtcctacgctcaagagactatcagttcactacgagtatcattttgagagcgtaatctcatttgacctgccaaatctcgagtaccttgactactctgattacgccttgtatgggtatccacaagttaacttggaatcccttgttgaagcttatctgaatcttgataaggctgaacatgtcgagagcccggatgtaaccaaactcattatgggaataagaaatgttgagatccttagtctatctcccgattcggttggagtaagttagtcaatttattctatatcgtttggaaactcttggacattattattaaactctgattgtgtttcaggtgatctattcatgctgtaaatatgggctacttctaccggtattcaacaatctggttagtttatcttttgggactaagaaaacacgagcttggaaattgcttgcagatatacttaaacagtctccaaagcttgaaactctcatcatcgaggtatgcaaaacctaagaccaaataaatatacacacgaacttagaggttgatcagttaacatacatttatcgattgatacttcttcaggatctgaatggttacccactcgatgtctccatgcctctgaaccaagtgaaggagttgcagattctggaatatggagaaagtgatgacgaggttaaacggttgaagagttttcttggggaagaaagtatgatagaagttgtgtttcctgaagtttga

SEQ ID NO: 103 - DNA, 1329 bp, Arabidopsis thaliana
atggtgaccttaacttcatcttcttcaactccaaacgtatcttttgatttcatgatgaacaataataataacagtaacaatctctatggtcctttctcttcttcttctacttctttctcttacttgacaagcaaggaagatgctctcacccagaagaacctaatgagtggtatcaccaatgatgttcttggaattaacaagaaagcttctgaagatttggagatcagtgtgtttggagctgagaagtacttcaatggagatatggattctgaccacagtcctagacttgtgtctcctctgccagatccagaagttccaatagagagaatctttgttggtccgaagcaaagctcgaagaattcctcggaaactcctagtcttcggtctgaatccagttggaatagccagagtttgttgcttcagagcaaatatgtagagaagaagaagaacatcaagaaaaactctagttgcaacagttactttcaggagaaggatatgagtagcaatcacaaggtgagtaataagaagagttttctcgctactcttggctgcagatgcgtgtgttcgaactggagttcagtggatgtcgtcgacgacaagagaagaagctctggtctgaagaagatcaagactcaattgagtttctctggagatctaagctcggagatgaagattcatcaacaacaacaagaagcaatgctagagcagaggaagtctctggaaatatttggatctcctcttattgagaagagaatcattcagaagaaatttccatgggaatactcgagctctgcgaaaaaagaagaacatggattctctgtgaagtatgaagaagaagaagatgggagtgtgagcgatgtaagtacggatctttttgagattgagagcttaacagggaaggcaaacccttttcttgcaaggcaaggaagtagtgatccagactcaccagatggttatgcaccaagtgaggtaagcatacaatggagtgtagtgacagcaagtgtagcagatttctctgttatgtctgaatgtgctacgagtcccgtcaaaaagaaccggtcttttcagattcctcgaatccctatcatggcaaaatcaaaccgagaaatcgcgcctcagagacggaaatctagcagtagcggtttattaatgggatgcaagagtcataaatctgtcagagtttctggtgattcatacacaagcatgaacagaacaccgagctatgttccaagattccctgtagaagctaatccaacaagcactgaaacaagaaggaggatcagcagtagttctgtttctcacacgcaatcgccttttttgtatacttaa

SEQ ID NO: 104 - DNA, 1014 bp, Arabidopsis thaliana
atgggagtggattactacaaagtcctccaagtcgatcgcagcgcaagcgacgatgatctcaagaaagcttatcgtaaacttgccatgaaatggcatcccgacaaaaatcccaacaacaaaaaggatgccgaagctatgttcaaacaaatatccgaagcttacgaggtactaagtgatcctcagaagaaagctgtgtatgatcaatatggtgaggaaggtttgaaagggaacgtgccacctccggatgcaggtggagctacttacttctctaccggggatggtccaacgtccttcaggttcaacccgagaaatgcggatgatatatttgctgagttctttggcttctctagcccatttggcggcggaagaggtggtacaagattctctagcagcatgtttggtgataatatgtttgcttctttcggcgaaggaggaggcggtggtggtggctcgatgcatcacggtggagctaggaaggctgctcctatcgaaaacaagttgccttgtagccttgaagatctttacaaaggaaccaccaaaaagatgaggatttctagggagattgctgatgtcagtggcaagacgatgcaggtggaagagattttgaccattgatgtgaaaccaggatggaagaaaggcacaaagatcacgttcccagagaaaggcaatgagcaacccggtgtgattccagcggatttagtcttcataatcgacgagaagcctcacccggttttcactcgagagggtaacgacctcatagtcacacagaagatctcacttgttgaggccttgactggttacacagtgaacctgactactcttgatggtcggagactgacaattccagtcaccaacgtggtccatcccgagtacgaggaagtggtaccgaaggaagggatgccattgcaaaaagaccagactaagagaggtaacttgaggatcaaatttaacatcaagttccctacaaggttaacctcagagcagaagacaggagtgaagaaacttctcggatga

SEQ ID NO: 105 - DNA, 561 bp, Arabidopsis thaliana
atggcgtcttaccagaaccgtccaggaggtcaggccactgacgagtacggaaacccgatccagcagcagtatgacgagtacggaaatccgatgggaggaggaggatacggaactggtggtggtggaggagctacaggtggccaaggatacggaacaggtggccaagggtacggatcaggtggccaagggtacggaaccggtggccaaggatacggaaccgggaccgggactgaaggctttggaactggcggaggagctaggcaccacggccaagagcaactccacaaggaaagtggtggtggcttgggaggaatgcttcaccgctccggatctggatccagctctagctcggaggatgatggacaaggagggaggaggaagaagggaataacacaaaagatcaaggagaagttgccaggtcatcatgatcagtctggtcaagctcaagcgatgggcggcatgggatccggatatgatgctggtggctacggtggtgagcaccacgagaagaaggggatgatggacaagatcaaggaaaagcttcccggtggtggccgttaa

SEQ ID NO: 106 - DNA, 999 bp, Arabidopsis thaliana
atgggtttcgatttaaaggagattaggacgaagaagacactgattggtcttggtttgggacagctcctctcacttcttgctacttctaatggctttacatcttctgagctcgccagaaaaggaattaatgttccaacatcacaatgctttctgaattatgtgttactggcaatcgtctatggaagtatcatgctgtatcgaagatccgacattaaggcgaaatggtattactatttcctccttgcttttgttgatgtggaggccaattttctcgtggtgaaggcttaccaatacacttcattgacaagtgtcatgctactggattgctgggcgatcccttgcgttttggtcttgacttggttttaccttaagacaaaatacagattgatgaagatcagtggtgtttttatctgtattgttggtgtttttatggtagtcttctcagacgtccatgcaggggatcgagctggaggaagtaatcctgttaaaggagattttcttgttttagctggagcaaccttatatgctgttagtaataccagcgaggagttccttgtgaagaatgcagatacagttgagctgatgaccttcttggggttttttggagccattattagtgccattcaggtaagtatacttgaacgtgatgagcttaaagctattcactggtcaactggagctgtttttccgttccttagattcacactcacaatgtttctcttctacccattagtcccggtcttactcaagaccaatggtgcaacaatgttcaacctctcgttgctcacatcagatatgtgggctgttttgatccgcacttttggttaccacgagaaggttgattggctctacttcttggcatttgctactacagctactggactgatcatatactccatgaaggagaaagatcaagaggaacacagatttgaagaagtgggcgacgaggcggctatgcagaggaagttgttaggtgaggatgatgagccgggaacctaa

SEQ ID NO: 107 - DNA, 927 bp, Arabidopsis thaliana
atggctctggaacaacaacatgtttgtgaaaagcggcttcaagccaagaccttttctacccaagagtttcagttgactctcaattgggatgatttaacttgtcccatttgtttggatttccctcacaatggtgtgcttctccagtgttcttcttacggaaacggttgccgtgcttttgtctgcaatactgatcaccttcactctaactgtttggatcgtttcattagcgcctgtggtactgaatcacctcctgctcctgatgagcctcgctctaaggttttagaagagagttgcaaacctgtgtgtccactgtgtagaggagaagttactggctggcttgttgtagaagaagctcgtcttcgtcttgatgagaaaaaacgttgctgtgaggaagaacgatgcaggtttatgggtacttacttggagcttcgcaaacatgctcagtcagagcatccggattctcgtccttcagaaattgatccagcacggaagcttgactgggagaatttccagcagtcgtctgaaataatcgacgtgttgagcacaattcactcagaagttccaagaggagtggttttaggggactatgtgatcgaatatggagatgatgacacaggagatgaatttgaggatgttcccaacaatgaaggaaactggtggacatcttgtattctctatcaaatgtttgacaatataaggaatgccaggaatcgaagaagatcaagaatgagtgagagtaggagagggagtcgccgctctagctatgagaattccaactctgatgacagctcagtagcatccatagagtttccggagtatagagtagatgagatcgatgacgagttcatcagcacaagtggagctaacagaagtagctctatgcaccaaagttcaagaaggcgtcgaacccgcttctatgaaaattag

SEQ ID NO: 108 - DNA, 1415 bp, Arabidopsis thaliana
ttaattaatcctaatttcgacacgttctttacataaattaccagatttgccactatgagcttcttgattcctaatagaggagtaggaggaaccaagattcctctctccatcatcgttctcgttctttgtggtttcatgttcttcattctcttatacactgaaagaatcagcttgttgtcttcttcttcctcttcgtcttcatctttcttcaagctaaagtcttgtccgaggaaagatgttagctcgaaacctaaggagaaaattcgaaaggaaagatcagagatattggaagtgcttgacgacaggttcgaattcgatcccgaagagtgtaacgttgcagcagggaaatgggtttacaatagctcaattgaaccactctacaccgatagatcatgtccatacatcgatcgtcaattctcttgtatgaaaaacggacagccagaaactgattatcttcggtgggaatggcagcctgatgactgtacaattccacgatttagtccgaagttagcaatgaacaaactcagaggaaaaagactactttttgtgggagattcgttgcaacgaagccaatgggaatcgttcgtgtgtttggtggaatcaataatacccgaaggagaaaaatcaatgaagcgtagccaaaaatactttgtatttaaagcaaaggaatacaatgcgactatagagttctattgggcaccgtatatcgtcgaatcaaacacagatatacctgtgatttcggatccaaagaaacggatagtgaaagtggactcagtgaaagatcgagctaagttttgggaaggagctgatattttggttttcaacacttatgtttggtggatgagtggtctccgcatgaaagctctgtggggttctttcggaaatggagagagtggtgcagaggcactagacacacaagtggcttacaggctaggactcaagacatgggctaattgggtagactccaccgttgaccctaataagaccagagtcttcttcaccaccatgtctcctactcatactagaagtgcggattggggaaagccaaacggcacgaagtgtttcaacgagacgaaaccgataaaagataagaagttttggggaacaggctctaacaagcagatgatgaaagtagtgtcaagcgtgataaagcacatgactacgcatgtgacagtcatcaacatcacgcagctctctgagtatcgcatcgacgctcacacatcagtttacaccgagacaggtggcaagatcctaaccgctgagcagagggctgatccaatgcatcacgctgattgtatacattggtgtttacctggactacccgatacatggaatcggatcctattggctcatttgtaaatcaagctaggaggaagctgagggttaaacgggaaaaacccaaatcctggcgcgcc

SEQ ID NO: 109 - DNA, 846 bp, Arabidopsis thaliana
atggcggtatcgtacaatgcattagctcagtctttagcgagaagtagctgcttcatccccaaaccttattcctttagagatactaagctgagaagcagatccaatgtcgtattcgcgtgcaatgataataagaacattgctcttcaagctaaggtagataacttgttggaccgcattaaatgggatgacaaaggattagctgtggcaatagcacaaaacgttgatacgggagcagtattgatgcaaggctttgttaatagggaggccctctccacaaccatcagttctcggaaagctacattctttagtcgatcaagatctaccttatggactaagggagagacatccaataacttcatcaatattcttgatgtgtatgttgattgtgatcgtgattcgattatttaccttggaacacctgatggacctacctgtcacacaggggaagagacttgttactacacatcggtttttgatcaattaaacaatgatgaggcttcaggaaacaagctagcattaacaacattgtactcgctagaatcaatcatttccaagcggaaagaagaatcaacagttcctcaagaaggtaaaccatcatggactcgacggttgttgacggatgacgctctgctttgctcaaagatcagggaagaagctgacgagttatgcagaacactggaggataatgaggaagtttcaagaacaccatcagagatggctgatgttttataccacgcaatggtgcttctatctaaaaggggtgtgaagatggaagatgttcttgaagttcttaggaaacgcttctctcaatctggaatcgaggagaagcaaaaccgtacaaagtaa

SEQ ID NO: 110 - DNA, 1396 bp, Glycine max
ttaattaatttggaaaaagggttctgaaatcttagctactgagtgcgtaatcactgagatctgccttcatcctgggttggttttgttgatgggtgcttgctggagtaataggattaagtctgtgagtccttccaatacagggatcacttctagaagtgtcagcaggagtggccatgacgtcagctcaaatagcaggagctcatcagcctccatatccgtcgcttctcggagtgagggtgagatcttgcaatcttccaacttgaaaagcttcagctataatgagctaagagcagccacaagaaatttccgcccggatagcgtcttgggggagggtgggtttggttcagtttttaagggctggattgatgagcattcacttgctgctaccaaaccaggaataggcatgattgttgctgttaagaggcttaaccaagacgggttccagggtcacagagagtggttggctgaaatcaactatctcgggaaactacagcatcctaaccttgttaggttaataggatactgctttgaggatgagcatcggcttctggtttatgaatttatgcccaagggtagcatggaaaatcatctattcagaagaggttcttactttcagccattctcttggagtttgcgaatgaagatagcacttggggctgcaaagggccttgcttttcttcatagtacagaacctaaagtcatataccgtgactttaaaacttcaaatatcttactcgatacaaactacagtgccaaactttctgattttggcttggccagagatggtcctactggtgataaaagccatgtctctactagggtcatgggaacccatggatatgcagcaccagagtatttagcaacaggtcatctcactaccaagagtgatgtgtatagttttggagtagttcttttggaaatgatatcgggaagacgagctatagacaagaatcagccaactggagaacataaccttgttgattgggccaagccttacctatctaataaacgaagagttttccgtgtgatagatccccgtctcgaaggtcaatatttacagagtcgagctcaagccgcagctgcgcttgctattcaatgtctctccatagaggctaggtgcaggccgaatatggatgaggtggtaaaagcgttagagcagcttcaggaatcaaagaacatgcagagaaaaggcgctgatcataaacagcatcatgtacgcaattccggtcctggccgttccaacggtggcaatggtggttcagatgtccctagaaaggcttctgcttatcctagaccttctgcttctctcctccgcggttgagagaattttgtgacgcagcaagtggtaaagcagataacaaacgattcagaggtttaggtggggctggatttaaat

SEQ ID NO: 111 - DNA, 1616 bp, Glycine max
ttaattaacacacctacaacgcacctttctttctcttttccctttttcttaggcacaccacacacccactcaaataatagaaactgagatgaatcctgatcagtttcagaagaacagcatgttcgtagaaacccctgaagatggtggcaaaaacttcgacgatgatggacgagtcaaaagaactggtacatggataactgcgagtgcccatatcataacggcagtgataggttctggagtgttgtcacttgcatgggcaattgcacaaatgggttgggtggcaggccctgcggttctctttgccttctctttcatcacatacttcacctccactcttcttgccgactgttatcgttcacctgaccctgttcatggcaagcgaaactacacctattcagatgttgtcagatccgtgttaggaggtaggaaatttcagctgtgtggattagctcagtacataaatcttgtcggtgtaactatcggttacacgataacggcttcaattagtatggtggcggtgaagaggtccaactgttttcacaaacatggtcatcatgataagtgctacacgtcaaacaaccctttcatgatcctctttgcctgcattcaaatcgtgcttagtcaaataccaaatttccataagctttggtggctctccattgttgcagcagttatgtcttttgcttattcttccattggccttgggctctccgtagctaaagtggcaggtggtggagaacctgtacggacaaccttaacgggggtgcaagttggggtggacgttacgggatccgagaaggtctggaggacgtttcaagctattggtgatattgccttcgcttacgcttattctaacgtgctcattgagatacaggataccctgaaatcgagccctccagaaaacaaggtcatgaaaagagcaagtttgattggcatcttgactacaaccttgttctatgtgctatgtggctgcctaggttatgcagcatttggaaacgacgcaccaggaaatttcctcacagggttcggtttctacgagcccttttggctaatagactttgctaacatctgcatagccgtacacttggttggagcatatcaggtcttctgtcagcccatatttgggttcgtagagaactggggtaaggaaaggtggcccaatagccattttgtaaatggagaacacgctttaaagttttcactatttggaaccttccctgtgaactttttcagggtggtatggagaacaacatatgtcatcatcactgctttgatagctatgatgtttccattcttcaatgacttcctaggcctgattggttcactgtcattttggccattaacggtttacttccccatagagatgtacattaagcagtcaaagatgcaaaagttttccttcacttggacatggctcaagatattgagctgggcttgcttgatcgtttctattatctcagctgctggctccatccaaggcctcgctcaagatctcaagaaatatcagcccttcaaagcccagcaataattaaatttgttccaaagtgttctaaattgctttcttccctaagtcactttgttttaataagtttcagcatgttcatggatatttaaat

SEQ ID NO: 112 - DNA, 1045 bp, Saccharomyces cerevisiae
ttaattaaatgtcagttttcgtttcaggtgctaacgggttcattgcccaacacattgtcgatctcctgttgaaggaagactataaggtcatcggttctgccagaagtcaagaaaaggccgagaatttaacggaggcctttggtaacaacccaaaattctccatggaagttgtcccagacatatctaagctggacgcatttgaccatgttttccaaaagcacggcaaggatatcaagatagttctacatacggcctctccattctgctttgatatcactgacagtgaacgcgatttattaattcctgctgtgaacggtgttaagggaattctccactcaattaaaaaatacgccgctgattctgtagaacgtgtagttctcacctcttcttatgcagctgtgttcgatatggcaaaagaaaacgataagtctttaacatttaacgaagaatcctggaacccagctacctgggagagttgccaaagtgacccagttaacgcctactgtggttctaagaagtttgctgaaaaagcagcttgggaatttctagaggagaatagagactctgtaaaattcgaattaactgccgttaacccagtttacgtttttggtccgcaaatgtttgacaaagatgtgaaaaaacacttgaacacatcttgcgaactcgtcaacagcttgatgcatttatcaccagaggacaagataccggaactatttggtggatacattgatgttcgtgatgttgcaaaggctcatttagttgccttccaaaagagggaaacaattggtcaaagactaatcgtatcggaggccagatttactatgcaggatgttctcgatatccttaacgaagacttccctgttctaaaaggcaatattccagtggggaaaccaggttctggtgctacccataacacccttggtgctactcttgataataaaaagagtaagaaattgttaggtttcaagttcaggaacttgaaagagaccattgacgacactgcctcccaaattttaaaatttgagggcagaatataaatttaaat

SEQ ID NO: 113 - DNA, 1654 bp, Arabidopsis thaliana
atggttgtagaaactatcgagaggtcttgtgagggttcaaagagaagacatgtgaacggtggagatatcgctgttccttgttcgggagaagagtgtagcaatggagatataaatgtagctcctggagtttcagcgaaaagagctagggtttctagagaaatgacgtttgaagatatttacggtgctgatgcattactcaatgatgacgatgatgaggatgatgattgtgattgggaacctgtgcaggcgcctatggagtttgtaaaatggtgttgtgtcaattgcactatgtcgaaccctggtgatatggtccactgttgtatatgcggtgagcacaaggaatctggcattttgaggcatggatatttagcgtctcccttttttaaagacactggtctcattgaagtcgaggagaaatatggaggaagctcatctgcaaccagctcgacagctgttgggttcgacgagagaatgttgctacactcagaatttgaagtgaaggcacaaccacatccagagagacctgatcgtcttcgagctatagctgctagtcttgccacagctggtgtttttcctggaagatgcttgcctatcaatgcaagggaaatcacgaaacaagaactccagatggtccacacttcagagcatgttgatgctgttgatactacaagccagcttctctatagctacttcacctctgacacatatgctaatgagtattcagcacgtgctgctagacttgcagcaggtttgtgcgctgatctagctacagatattttcactggccgtgtaaaaaatggttttgctttgacctcccggtcatcatgctggcgtcaggcatgctatggggttttgccttcacaataatgcagccgttgctgcattagtagcacaagcagcaggggcaaagaaggtgctgattgtggactgggatgtccatcatggcaacggaacccaagagatattcgaacaaaacaaatctgtattgtacatatccttgcacagacatgagggaggaaacttctatcccggtactggagctgctgatgaggttggttctaatggtggggaaggttattgtgtaaatgttccatggagttgcggtggagttggggataaagactatatctttgcgtttcaacatgtggttctccccatagcttctgcattttctccagattttgtcatcatatctgcgggatttgatgcggctagaggagacccactaggatgctgtgatgtgactccggctggctattctcgaatgacacagatgttgggtgatctgtgtggtgggaaaatgctagttattctcgagggcggctacaatcttcgctccatatctgcttctgcaacagcagtgatcaaggtgcttctgggtgaaaatccggagaacgagttgcccatcgccaccacgccttcagtagccggcctgcaaactgttcttgatgtactgaatatccaactggagttctggccatcacttgctatcagctactccaaattactctcagagttggaagcacgtctgatcgaaaacaaaaaaaatcagatgaaaaggaaggttgttcgggttccgacatggtggaaatggggacgaaagaagcttttgtacaactttctctcggctcgtatgatttcaagatcaaagtga

SEQ ID NO: 114 - DNA, 1189 bp, Arabidopsis thaliana
ttaattaagacacagccattgttcttcatcatctccatggattttgattccatttctcgggaaagcacttttctttccccattgcttaaccaaaatgcaatgtggcaaatgaacttgggatcagatgatacaatgggtgttgatgggtcttatccggaacgtcacggagagccagattgtgcttattatataaggactggactttgtaggtttggttcaacttgccgattcaatcatcctcacgaccggaaactggttatagcaactgcaaggattaaaggagaataccctgaaagaattggtcagcctgaatgtgagttttatctgaagacagggacctgcaaattcggagtgacttgcaagtttcatcatcctaggaacaaagctggtattgatggaagtgtatcagttaatgtcttaagctatcctctacgtccgaacgaagatgattgctcttactttttgagaattggacaatgtaaatttgggggaacttgtaaattcaatcaccctcagactcaatcaaccaacttgatggtttctgttcgtggctctccggtttactctgctcttcaatctctaactggtcaaccgtcttattcttggtcgagaacatcttttgttgcaaaccctcctcgtttgcaagatccttctggtttcgcttcaggatctcaaggaggtctcttctcatccgggtttcattcgggaaattctgttccgctcgggttctatgcattacctagagagaatgtattcccggaaagaccaggccaacctgaatgccaattctacatgaagacaggagattgcaaatttggaacagtctgcaaatttcatcatcctagagacaggcaaacccctcctcctgattgtgtcttaagctcggttggccttcctttacgcccgggagaaccactgtgcgtgttctattctcggtatgggatctgcaagtttggtccaagctgtaaatttgatcacccgatgcgagtcttcacttacaacaacaatactgcatctccttctccttcatcatctctgcatcaagagactgcaatcaccacagagctcaggaatctcctagtctcttcttctgtggaagcaaaacccacatcactccctgaaacaacctctgctaaagacaccattgttgatgcacagcactgaaaaccctgtgttttgtctatcttga

SEQ ID NO: 115 - DNA, 1160 bp, Glycine max
ttaattaagacgagtcgaaatggctgaagcagagagtgtgcagattcctcaagtcaaacttggaactcaaggccttgtggtttcaaagttagggttggggtgtatgacccttagtggacgctataatgatccacttcctgaagaggaaggcatatctgttattaagcatgctttcagccaaggaatcactttttttgacacatctgatgtctatgggctcgaccatgctaacgaatttttgctcggaaaagctttgaagcagttacctagaaaaaagatccaggtagccacgaaatttggcgttgcagtagcaaaatttcctaattttcaaatcaaagggacaccggagtatgtgcggtcgtgttgtgaagcaagcttgaaacgccttgatgttgaatacattgatctctattatcagcacaggattgaccaaacagtacctatagaggaaacagtgggtgaacttaagaaacttgtggaagagggtaaagtgaagtatatagggttatctgaagcgagtccagatacaataagaagagcacatgcagttcatcccatcactgctttacaaatagagtggtccctatggactcgtgacattgaagaggagataattcctctctgcagagagcttggcattggaattgtaccatatagccctcttggtcgaggcttttttggtggcaaaggagttctggaaaatatgcctgcaagtacagtcctgactttacatcatcctcggttccaagcagagaacataaacaagaacaagagaatatatgaacaaattgaaagccttgctaagaaataccagagcactcctccccaattggcattagcttgggtacttcaccaaggcaacgatgttgttcctattcctggaacaactaagattaagaacctggatcaaaacatcggtgcattatcactgaaatttacagaaagtgacttgagagaaatttccgaggcagttcccatacatgatgtggcagggtctcaatacttctttggaaatgataaagattcttggaaatttgccaacacacctccaaaagatccgagggtctccacttgaagcactctaaatcctttttagttggataattttctattttgtgagcggtcatatgtcagatgcaaaagctagtacgaatttaaat

SEQ ID NO: 116 - DNA, 1080 bp, Arabidopsis thaliana
atgggaaaggttcttcagaaagaggcgttcggattagccgcgaaagacaattccggagttctctcgcctttcagtttcactagaagggaaacaggagaaaaggatgtgaggttcaaagtgttattttgtggaatttgtcactctgatttgcatatggtcaagaacgagtggggaatgtctacttatcctcttgtcccagggcatgagatcgtgggcgtggtgactgaagtcggagccaaagtgactaaattcaaaaccggagaaaaagtcggagttgggtgtttggtcagctcgtgcgggtcatgtgacagctgcaccgaaggtatggaaaactattgtccaaaatcaatccaaacgtacggattcccgtactacgacaacaccataacatacggtggttactccgaccacatggtttgcgaggaaggtttcgtcatccgtattccagacaatctccccttggacgccgccgcaccgctcctctgtgccggtatcacggtctattcccctatgaagtatcacgggctcgacaaacccggtatgcacatcggtgtggtaggattaggcggtttaggtcatgtaggagtgaaatttgccaaggctatgggtactaaggttacggttattagtacttcggagaaaaagagagatgaggcgattaatcggcttggtgcggatgctttcttggtgagccgtgacccaaaacagattaaggatgcaatgggtactatggatggtataattgataccgtctctgcgactcattcacttcttccgttgctcggtttgctgaagcataagggaaaacttgttatggttggtgcacccgagaagccactcgagctacctgtcatgcctctcatctttgagaggaagatggtaatgggaagtatgataggagggataaaagagacccaggaaatgatagatatggccgggaaacacaacatcactgcggatattgagcttatctctgccgattatgtcaacaccgccatggaacggctagagaaagccgacgttaggtaccgctttgtgattgatgttgccaacacattgaagcctaatcctaatttataa

SEQ ID NO: 117 - DNA, 1555 bp, Arabidopsis thaliana
ttaattaaatgtttcctctaatctccttttctccaacttctcttgatttcaccttcttcgccattatcatctcaggtttcgttttcatcatcactcgatggaattccaattcaaagaaacgtttaaaccttcctccaggtccgccaggttggccggtggtcggaaacttattccagttcgcgcgctcaggtaaaccgtttttcgaatacgcagaggatctcaagaaaacgtatggcccgatttttacactgagaatggggactcgaacaatgatcatcctctccgacgcaactctagtccacgaagctttgatccaacgcggagctctcttcgcttcacgacccgccgagaatccgacccgaacaatcttcagctgcaacaaattcaccgtcaacgccgctaaatacggtccagtgtggcgatctctgagaagaaacatggttcagaacatgcttagctcaacacgtctcaaggaattcgggaaactgagacaatccgccatggataaactcatcgagaggatcaaatcggaagctagagacaacgacgggctaatctgggttcttaaaaacgcaagattcgctgcgttttgtattctcttggaaatgtgtttcggaatcgagatggatgaagagacaatcgagaagatggatgagattttgaagacggtgttaatgactgttgatccacgaatcgacgattatcttccgattcttgctccgttcttctctaaagagaggaaacgagctctcgaagttcgccgtgaacaagtcgattacgtcgtcggagttatcgagagacgacggagagcgattcagaatccaggatctgataaaacggcgtcgtctttttcatacttagatacactctttgatttaaaaatcgaaggtcgtaaaacgacgccgtctaacgaagagctcgtgacgctctgctctgagtttcttaacggtggtacggatacgacggggacggcgatcgagtgggggatagcgcagctgattgcgaatcctgagattcaatctcggctctacgatgagattaaatcaacggtgggagatgatcgtagggtcgatgagaaagatgtggacaaaatggtctttttacaagcttttgttaaggagcttctccggaaacatccgccgacttatttttctctgacgcatgccgttatggagacgacgacgcttgctggttacgatattcccgccggcgttaacgtcgaggtttatcttccgggtattagtgaggatccgagaatttggaataacccgaaaaagtttgatccggaccggtttatgttgggtaaggaagatgctgacataaccgggattagtggagtaaaaatgattccgtttggtgtgggccgtaggatctgtccaggacttgcaatggcaaccatacacgtccatttgatgcttgcgcggatggttcaggagttcgagtggtgtgctcatccaccaggaagtgagattgatttcgccggaaaattggagtttacggtggtgatgaagaatccgttgagagctatggtcaaaccaaggatttagggcgcgcc

SEQ ID NO: 118 - DNA, 1816 bp, Arabidopsis thaliana
ttaattaatgagtttgttgttgatgttgatcgcagacatgagatgcttcagatgcttctacactcgagcccactctcttctcctcctccgatcttccaatccggtcacggttcctatatctccggtccggttccgtcttcgtctccgtcgtctctcatcatctcccgtcgcctccgttttcgaccttcattcctccaatcaggacgcgaattcgaacagagaagacaaagacaccaaaattggattctccgatgataaatcgagaaaatcaggttcaaatcctccacgatggaatccaggggaagtagttatgaacaaatcgaagaaagggaaatcgaaaactgtttgggtttgtgagagctgtggtcactcggaagggcaatggtgggggagttgtcgtgcttgtcataaggttgggactatgaaacgtttttctgaaggttctgagtcaagtgctagtggtggtggtggcaacggtactggcttgggttttacggagggtaagggtttgtcttggttacctgagcaagctacggttcagccacatcgattgactgatgttattcatggcattactcaacaacaatggagaatttcactgcctggactttttgggaatgaagttgctagagtacttggtggtggtcttgctccaggttctctgattttgattggtggtgatcctggtattggcaagagtactttgttgttgcagattgcatctataattgctgaggggagtgagttggccgaaccagcaccggttttgtatatctctggtgaagagagtgtcgagcaaataggaagtcgggctgacaggatgagaattcaaactgaagagctctacctgttttcgagttcggatcttcaggacattctaagcaaagctcatcgactatctcctcgagctctcataattgactcaattcaaaccgtttacctaaaagatgtgactggaagtgctggtggtctcacacaggttaaagaatgcacatcaaccctgttgcgttttgctaagaaatctaatatccctgttttcttggttggacatgttacgaaagcgggcgatattgcaggacctcgtgttttggagcacatagtagatgttgtcttgtacttggagggtgaagagtcatcaacgtaccgcttgcttcgatctgcgaagaatcggtttgggtcgactgatgaacttggagtttttgaaatggcaaactcaggacttgaagtggtctcaaacccaagtggcatatatcttagtcaacagaacccagattcagatgttttagctggattagctgtagcagttgttatggatggatctcggagtttcctaattgaagttcaggcattgtgttcccctggctcaacagtttcaaggcatgtcaatggtgttcaagcaagcagagctgacatgataattgcagttcttatgaagcaagctggtcttagaattcaggaaaatgggatttttctgaacgtcgctaacggaatggctctttctgagactgctggtgaccttgcaatagcagcagctatttgtagcagtttcttggagtttccaattcctcacggtgtagcattcattggcgagattggtcttgggggagaggttcgcacggtaccaagaatggagaaaagggtgagtacagtggcaaagcttgggtttaacaaatgtgtagttcctaaatcagtggaggaatcacttaaggcgttgagtttgaaagagattgagataatcggatgcaagaatctgaaagagttaatcaatgctgtgtttaagggataacgagattgcgccttgtgtttagaggaggct

SEQ ID NO: 119 - DNA, 1561 bp, Arabidopsis thaliana
ttaattaaatggaggagattagaggagtgcctacgtggcaggaagagttagcgagcctagttgacgccggattacgatacgacggagcaccgatcgatttaacggcggctacaaagagatcgggttttgtgtcggcggatggatccggatccgaaccgaaggagacattgaaagatcaagtgacgggattcatgaaatcgtggggagagatgcttcttgagctcgcgaaaggatgcaaggacattgtgcagcagacggtggtcactgatgactcattcctagtacggaagctccggaaaccggcggctaaagtgtcgaagaagcttagctttctaaacgagttcttgcctgaggatcgtgatcccattcacgcttggcctgtgattttcttcgtcttcctcttagcactcgcagcattaagctttagtccagagaacgatagaccagtgacggttataacgaaactgcgtttacatcctaccggtgctacacgtgtacagcttccagatggtagatatatagcttaccaagagctaggtgtttcagcagaaagagcaagatactctttagttatgcctcattcttttctttcctctcgacttgcaggcatacctggagtgaagaagtcattgttggtggagtatggtgtccgtttagtgtcatatgatcttccagggtttggagagagtgatcctcatcgaggtcgaaatcttagctcatcagcctcagatatgattaacctagcagctgctattggaattgatgagaaattttggttacttggctactctactggtagtattcatacatgggctggaatgaaatattttcctgagaaaattgcaggagctgcaatggtggctcccgtgatcaatccatatgagccaagcatggttaaagaagaggtggtaaaaacatgggagcaatggctaacaaagaggaaattcatgtactttttagctcggcggtttccaattcttctgcctttcttctaccgtagatcttttctctctggtaacctcgatcagctcgatcagtggatggcattgtcattaggagaaaaggataaacttttaatcaaagatccaacgtttcaagaagtttatcaaaggaacgtggaggaatcagtccgtcaaggaatcacaaaaccatttgtagaagaagccgtgcttcaagtatcgaattggggctttactctttcggaattccgcacacagaagaaatgtgcaaccaacggtgtcctttcttggctcatgtcaatgtacagtgaagccgaatgtgaactaatcggatttcgaaaacccattcacatatggcagggaatggaggatcgagtggctccaccatcaatgagtgactacattagcagaatgattcctgaagcaactgtacataagattcgaaacgaaggtcacttctcgttcttctatttctgcgatgagtgccatagacagatcttctatgctttgtttggagaacccaaaggccagcttgaaagagtaaaagaaacagaggacactgtagtggaaacagaggcacataaggacacttagggcgcgcc

SEQ ID NO: 120 - DNA, 1220 bp, Arabidopsis thaliana
ctctttgtttcttgtttgttgattaacccttacttaaactctaccatggcgaaaccggtgtccattgaagtgtataatcctaatgggaaatacagagttgttagcacaaaaccgatgcctggaactcgctggatcaatctcttggtagaccaaggttgtcgcgttgagatatgtcatttgaagaagacaatcttgtctgtagaagatatcattgatctgatcggagacaagtgtgatggagtcatcggtcagttgacggaagattggggagagactctgttctcagctttgagcaaagctggagggaaagctttcagtaacatggccgttggttataacaacgttgatgttgaagctgccaataagtatggaattgctgtcggtaacactccgggagtgttgactgagacgacggctgaactagctgcttctctttccttggctgctgcaagaagaattgttgaagccgacgaattcatgagaggtggcttgtacgagggatggcttcctcatctgtttgtggggaacttacttaaaggacagactgttggagttattggagctggacgtattggatctgcttatgctagaatgatggtggaagggttcaagatgaatttgatctactttgatctttaccaatccactcgtcttgagaaatttgtgacagcttatggacagttcttgaaagcaaatggagaacaacctgtgacatggaaacgagcttcgtccatggaggaggtgctgcgtgaggctgatctgataagtcttcacccggtgctggacaaaaccacttaccatcttgtcaacaaggagaggcttgccatgatgaaaaaggaagcaatccttgtgaactgcagcagaggtcctgtgatcgatgaggcagctttggtcgaacatctcaaagagaacccgatgttccgagttggtctcgatgtgttcgaggaagagccattcatgaaaccagggcttgctgatacgaaaaacgctattgttgttcctcacattgcttctgcttccaagtggactcgtgaaggaatggctacgcttgcagctctcaacgtcctcggaagagtcaaagggtacccgatttggcatgacccgaaccgagtcgatccattcttgaacgaaaacgcttcaccgcccaatgccagtccaagcatcgtcaactcaaaggccttaggattgcctgtttcgaagctatgagttaagggcgcgcc

SEQ ID NO: 121 - DNA, 1505 bp, Arabidopsis thaliana
aactctttgtttcttgtttgttgattaacccttaattaaatgggtcatcagtcatcatggatgaagcaaacagttatcgactctgtggttcagtcttctaaagttggtgttttctcaatgtttagtatggattacaaggcgccaaggaaatactcacacggaaggaattttggagttgcgagacagcaagattttgcagcagatatagttacgagaagaccttatgccccgtatgacaatggtatgaagaaaggtcctaataagttgtcaaggaatctggtttggacgtcaaaagagtacaaatcaccagagggaaacaggccaaggcagaatgcagccaatgggtcagcgaaaccacaagttataggcacaggacatcgtgtatcaaaccagccgaggaagaatgctgtgtatgggccaaggagctcttctctttcagacaccagaggttgtgggccgagactcaatggcagtcccaaaaagagtgtgtgtaatttttggaaagatggaaactgcaaaaagggcgagaaatgccagttcttacactcttggtcttgttttcctggactggccatggtagctgctcttgaaggacacaagaatgatattaagggaatcgcccttcctcagggttcagataaactcttttcagtcagtggtgatggtacattgctaatttgggactgcaattctggtcagtgtgttcgatccatcaacctccaggcagaagcagggtctctaattagtgaaggaccatgggttttccttggcttgccaaacgctgtaaaggcttttaacgttcaaaacagtaaagatgtgcatcttgaaggggtggttggtcaggtgcatgcaatgactgctgcaaacggaatgctttttgctggaacaagttctggtagtatattagtctggaaagctacagactcggagtctgatccattcaaatacttgacatctctcgagggacatcatagtggtgaagtcacttgttttgttgttggaggtgaagtgctatactctggttctgtcgataaaacaataaaggtgtgggatctcaacaccttgcaatgtagaatgaccctgaagcaacatatcggcactgtcacttcactcttatgttgggacaagtgtctgatatcgtcttccttggatgggaccataaaactttgggcttgttctgaaaatgaaagtttgaaagttgttcaaactcgcaaacaagaactgagtgttcatactctctgtggaatgcacgatgcagaggccaaaccgatcatgttttgctcttaccaaaatggagcagttggcattttcgacctaccatcttttgaagaaagaggaaagatgttctctacgcagacgatctgcacacttacaattggtcctggaggattgttattcagtggagacaagagtgggaacttgcgtgtatggagcttagcttctggcaccaaagtttagggcgcgccaaaaattggagctctgcagagctttcgttcgtatcatcg

SEQ ID NO: 122 - DNA, 3088 bp, Arabidopsis thaliana
ttaattaagaaatgctccttgttttggatctagggatttctagtctagtccttgtggtctctcttgttttacctttgatcggtctctttgttcgtcacaaatggagggtcgctgcccaaagaagggaggagattagaagacttcttattcatgcttctgaagaggctgccagggctgagctagaggcctctgttgagttctcttctgttgccgtctctaatgtcttccattgtcctgtttgctattgtcttgccacgactcgttgctctcgctgcaaagccgttcgatattgttccgggaaatgtcaaatcattcactggcggcaaggtcacaaagatgaatgtcatcctgcttccattgtatatgatagtgaagatgagagtgattccgatttgagattaggagaagaaaatggacaaaatactcctgaggaaactttactggtgggtccagaaccagttactataccaatcggggaatcactattatctaatcgtgccagatctcctgaagatgggaatggagatattgcagataacaaagatgaccttatagataaggaagaagctgtttctgttgctgaaacatctggatcctcgttttctggcttctcctcctccccccgtaatgactctggcgacgagatttctcgttgtgagagcttcagttcatctgaatccgagagatcagagtccctacttgatgctcatgtctctgtagagccagaagacacctgtttcagcaccattgaagatgctccatccaaactgttgtctccaaaatttgtgcacttggttgaatctgtagataatctcgctaatctgcctaaattaagtgtacataaacctgaggatgatgctgggcagaaccagagccaatcaaggagcttacactcattagttacggataggcatccagtatcagctgacccatctctgaagtcatctgatttttggggtacggctcttggatcagccgaacgtgtgagtgattcttgtgttaaatctaaatctggtagacctggtaactcctctctgcatttctcctttggctctggctcctctagagacacctcagctgctaaagtttctgagcagaggagtagcattttaaaagaagctcctagggggactggttatatatctgatggagtaaacttaagagaaagaaatgctaaaagatttgatgaagctgaaattgcattaccaatttcctcttctactgatgcgctgagtcctttggactcttctaatttgtcccatgtgacccttccgaagtcaaagagcgctagtagtgaaaatggctctatgttggcccctttgaaggttggggaagtccaacttttggcatccaaggcctcgaataccaagaagtgtgctgatcttatgaagcattctcctttaggtgcaaaatcggtaagagttcttgatcatcagaaacagaatggtgctgtcgttcagcatataaattctctacatggaagaagtggtttaaaggcatcagtactgaaagttgtagaccagtggaccagaccgaagtctgaaaatgagatggcaggaagacatggtcataaggggctctttccatatgaagtctttgctaaactgtatacatataaaattgagttccagccttgtggcctcatcaacgttggcaatagctgctttgctaatgttgtctttcaatgccttatgttcactcctcctctgacgacatacttcctccagcaatttcattccagagcatgtacaaaaaaagaacagtgcttcacctgtgggtttgagaagctggtcgtaaaggcaaaagaagagaagtctccactgtcccctaatggcttgctatctcagctgcagaatattggaatctttcttgggaatggcaaggaagaagatgcacatgaattccttaggtttgttgtcgatacaatgcagtctgtgtgcattaaggcatctgaatatgatatgaccaagagtagcaaattagaagatacaactcttattggtttgacatttgggggatacctccggtcaaagattaaatgcatgaaatgtcaagtaaaatctgagctgcgtgagaaaatgatggatctaacggttgagattgatggagatattagcaccctggatgatgctttgcgtcgatttacaaggactgagatattggatggagagaacaaatacagatgtggcagctgtaaatcctatgagagagccaaaaagaagctgaaaataacagagcctccgaatgtccttaccattgcactaaaacgattccaggcagggaaattcgggaagctcaataagttgattaggtttccagaaactctagatttggctccatatgtcagtgggggaagtgaaaaatcacatgactacaaactctatggagttattgttcacttggatgtaatgaatgcagcattttctggccattatgtctgctatattagaaaccaaaataagtggtacaaggctgatgatagcacggtagtaacttcggatgtggaaaggatcttgacaaagggagcgtatatgttgttctacgcaaggtgcactccaacgcctccaagattagcagtatgtaccaaaactgaagcatccaataaaaaaagcagagtgccactacctaaggctaatgagaaaagtaccatatcccggtctgtgtctacttcaagtcctgagttgtcttccaacacgcctggtggtggtcgatccggcaatatacagtcattttattctagtttccagaggctgcagaagattttagaagaagactcggcgagtgacagttcatctctctttgacagcaactcagatgaatgctcttgtagcacagacagtacaagcatggacgactttgctgatttcatttttggagatcatcagggacgggctcacggacagtctgagactccctcaccaacatcatcgtcttcctcatcttctccccccttcacaaggcgttcgccgctcagtcgttcttctccagaaacttacggaacctcaagacatcagttgcccttgggaggagaaaggtaagggaaacaagatggttttttgtccacttggccccaactaagtatttaaat

SEQ ID NO: 123 - DNA, 1037 bp, Saccharomyces cerevisiae
aactctttgtttcttgtttgttgattaacccttaattaagatgtcttataatccgtacgcatatgcaacaagtgagcagaatggcgttaacgatcgcttttcccacactccacaacagcaacgaccaatgcaaattccgaggaacacgcccgtgaatggccaaggtaatgcgaatatgaatgcaaacgtaaatggcagtcgcggtggttttccattccaagatcctcgtggttcgatggcattccaactagggcagagcgcattttctaattttattggtcaggataactttaaccagtttcaagaaacggtcaataaagccactgcaaacgctgccggctctcaacaaatttcaacgtattttcaagtcagcacccgttatgtcatcaataaattgaaactcatcctagttccttttcttaacggaaccaagaactggcaacgaattatggactctggcaactttttgccaccaagggatgacgtgaactccccagacatgtacatgcctattatgggactagttacctatattctcatctggaatacgcagcaaggtctgaagggttcattcaaccccgaagacttgtactacaaactgtcttctactctggcgtttgtgtgtttagatttgttgattttgaagcttggcttgtatcttttgatcgattctaagattccaagcttcagtttggtcgaactgttgtgctatgtcggctacaaatttgttccattgattctcgcccagcttttgaccaacgtgaccatgccatttaacctgaatattttgataaaattttacttatttattgcctttggcgtattcctactaagatccgtcaagttcaatttactaagccgctccggtgctgaagacgatgatatacacgtttccatcagcaaatcgaccgtcaagaagtgcaattacttcctattcgtctatggcttcatttggcaaaatgttctaatgtggttaatgggttgaatttaaatacccagcaaattggagctctgcagagctttcgttcgtatcatcg

SEQ ID NO: 124 - DNA, 2788 bp, Saccharomyces cerevisiae
ttcatttatttgtcagctttcaaactctttgtttcttgtttgttgattaacccttaattaagatgtcaggagaagaagaagtagattatacaacgttacccctagaagagcgattaacgtacaagttatggaaggcacgtttagaagcttataaggagttaaaccagctttttagaaactccgttggcgacatcagtagggatgacaacatacaaatttactggagggatcctacattatttgcacaatatataactgattctaatgtggtcgctcaagaacaagccattgttgccttgaatagtttaatagatgcctttgcgtcatcgtctttgaaaaatgcacataatattactttaatatcaacatggacaccattgcttgtggaaaagggcttaacgtcctcaagggctacaacgaagacgcagtcgatgagctgtatactctcactatgtggtcttgatacatctattacgcaatcggtggaattggtaataccctttttcgagaaaaaactgccaaaattaattgctgcggcagccaattgtgtttatgagttgatggctgcattcgggctcactaatgtgaacgttcaaacgtttctaccagaattattaaagcacgtacctcaactagccggtcatggtgatagaaacgttcgatcacaaacgatgaatttgattgttgagatctataaggttacgggcaacaatagcgacttgttagaggagatactgtttaaaaaattaaaaccaattcaagtgaaagatcttcataaattgtttgcaaaagttggtgacgagccatcgtcatcgaaaatgttattcgagtgggagaaaagagaattggaaaagaaaagaagccaagaggaggaagccaggaaaagaaagtccatattatcgaatgatgagggggaatatcagatagataaggatggagatacattgatggggatggaaacggatatgccaccatcaaaacagcaaagtggagttcaaatagacaccttcagtatgctaccggaggagacgatcctcgataaactgcctaaggacttccaggaaaggataacgtcgtccaaatggaaagatagagtggaagcgttggaagaattttgggatagtgttttatcgcagactaagaagttaaaaagctcctcgcaaaattattccaacttattggggatatatggccatattatccagaaagatgcaaacattcaagctgttgcactagccgctcaatcagtagaattaatctgcgacaaactaaaaacaccaggcttttccaaggattatgtttcactagtcttcactcccttgttagacaggacaaaggaaaagaaaccttctgtgatagaggccattaggaaggcattattaaccatctgcaagtattacgatccattagcctccagtggacgcaatgaagatatgttgaaagatattttggagcatatgaagcacaagacacctcaaatcagaatggagtgtacgcaattgtttaatgcaagcatgaaagaagaaaaggatggatactcgaccctgcaaagatacttgaaggatgaagtggtaccaattgtgattcagatcgtcaacgacacccaacctgctataagaactattggatttgagagtttcgccattctaattaaaatatttggcatgaatacctttgtgaaaacattagagcacttggataatttgaaaaggaaaaaaattgaagaaacggtcaaaactctacctaatttcagtattgcaagtggtagtacccatagcactattgaaacgaataaacaaactgggccaatggagaataaatttctgctgaaaaaaagttctgtacttccctccaagagagtggcatcttcaccgttgagaaatgataacaaaagtaaagtgaacccaatagggtcagtagcctccgcatcaaaaccatcaatggtagctgctaacaataaatcgaggatcctgttgacgtctaagtctttggcaacgccaaaaaacgtagtagctaatagcactgacaagaatgaaaagttgattgaagaatacaagtacagactgcaaaaactacaaaatgatgagatgatatggaccaaagaaagacaaagcctattggaaaagatgaataatacagaaaattataagatcgaaatgattaaagaaaacgaaatgctaagagagcaactaaaggaagcgcagtctaaattgaacgaaaagaacattcaattaagatccaaggagattgatgtcaataagctgtctgatagagtactgtcactagaaaacgagcttagaaacatggagatcgaattggatagaaataagaaaagaaatgatacaaacttgcaatcgatgggtacgatttcatcatactccataccttcttccaccgtgtcaagcaactatggggtaaaatctttatcttccgctttgccatttaaggaggaggaagatgtcagaaggaaagaggacgtcaactatgaaagaagatcaagcgagtccatcggcgacctgccgcaccgcgtaaactctcttaacatacggccgtacagaaaaaacggcactggagtgagcagtgtctccgacgatttggatatcgatttcaacgatagttttgcctcagaagaaagttataaacgtgccgctgcagtgacatctaccctaaaggccagaattgaaaaaatgaaggccaaatcaaggcgggaagggacaaccaggacgtaaatttaaatacccagcaaattggagctctgcagagctttcgttcgtatcatcggtttcga

SEQ ID NO: 125 - DNA, 2022 bp, Saccharomyces cerevisiae
ttcatttatttgtcagctttcaaactctttgtttcttgtttgttgattaacccttaattaagaaggtacaagtaaacacaggaaaaaaagaactaactctaagtaatgaagatgcctctaaagaagatgtttaccagcacgtctcctcgtaactcttcttctcttgacagtgatcatgacgcttactattcgaaacaaaatcctgacaatttccctgtaaaggagcaagaaatctataacattgacctggaagaaaacaatgtgtcctctcgttcatccacctctacatcaccttcagcaagggacgactctttcgcagttccagatggtaaagacgaaaacacgcggttgaggaaagatttaaaggcaagacatatttctatgatcgccattggtggttcattaggtacaggtctgcttataggtacaggtaccgccttattgacgggtggtccggttgcgatgttaattgcatatgcctttgtcggccttttagtcttttacaccatggcctgtcttggtgaaatggcttcttacattccattggatggttttacaagttatgcctcacgttacgtggatcctgcattaggttttgctattggttatacttaccttttcaaatatttcatcttacctcccaaccaacttactgctgctgctttggtcattcaatattggatcagcagagaccgtgttaaccctggtgtgtggattactatattcttggttgttattgtcgctatcaatgtcgtcggtgtaaaattctttggtgaatttgaattttggttgtccagtttcaaagtcatggtaatgttgggtctaatcctgttactatttattattatgcttggtggaggtcctaaccatgaccgcctagggtttagatactggcgtgatcctggtgcgttcaaagaatattcgacggctatcactggtggtaaaggtaaatttgtttcgttcgttgctgttttcgtttacagtcttttcagttacacgggtattgaattgacaggtatcgtttgttctgaagctgagaatccaagaaaaagtgttccaaaggcaattaaattgacagtttaccgtatcattgttttttacctatgcaccgttttccttttgggtatgtgcgttgcatacaatgaccctcgtttactttccacaaaaggtaagagtatgtctgctgcggcatctccattcgtggttgccattcaaaactcaggtattgaagtcttacctcatatcttcaatgcttgtgtcttggttttcgttttcagtgcttgtaactcagatttgtacgtttcttccagaaatttatatgcgttggcaattgatggtaaagcgccaaagatcttcgctaagacaagtagatggggtgttccttacaatgctttaatactctccgtgctgttttgtggcttggcgtacatgaatgtgtcttcaggatcagcaaagattttcaactactttgttaacgttgtttctatgttcggaatcttgagttggatcaccattttaattgtttacatctacttcgataaagcctgccgtgctcaagggattgacaaatcaaaatttgcttatgtcgctcctggccaacgttatggtgcttattttgctttattcttctgcattttgattgctttaatcaaaaacttcactgttttcctaggtcataaatttgattataaaacattcatcaccgggtatattggcttgcctgtctatatcatttcttgggctggttacaaattgatatacaaaaccaaagtgataaagtctaccgacgtggatttgtacacatttaaggaaatatacgatagagaagaagaagagggaagaatgaaggaccaagaaaaggaagagcgtttaaaaagtaacggtaaaaatatggagtggttctatgaaaaatttttgggtaatatcttctagatgcctttttaatcaaagccttagggcaacatgaaactatattcatccatttaaatacccagcaaattggagctctgcagagctttcgtt

SEQ ID NO: 126 - DNA, 1191 bp, Saccharomyces cerevisiae
tttatttgtcagctttcaaactctttgtttcttgtttgttgattaacccttaattaatccgggcgcgcctgatttatcacaagtttgtacaaaaaagcaggctcctgcaggaccatgagttcaccagcgaacctattccctggattaaacgacataactgacgtgctggaggaattcccactggccacctccagatatttaacattactacacgaaatagatgcaaaatgtgtgcattctatgccgaatttgaacgagaggatagataagttcttgaagaaagacttcaataaagatcaccaaacacaagtaagactgctcaataatatcaacaagatttatgaagaactgatgccatcgctggaggagaaaatgcatgtctcatccattatgctggataatctagacagattgacgtcccggttagaattggcgtatgaagtcgcaatcaagaacacagaaattcctagaggtttaagactgggtgtggacaaccatccagcaatgcacctccatcatgaactaatggaaaaaatagagagcaaatcaaacagcaaatcgtcgcaggcactgaagagcgaatcaagaagagaagccatggctgccaacaggaggcagggcgaacattactccgccagcacacaccaacaagacgactcaaagaacgacgcaaactacggaggcagcaggcacgagagccaagaccacactggtaacaacacaaactcaagaaaaagagccaacgctgccaataccaacaacgccgatccagagaccaaaaaacgcaagaggagagttgccaccacagccgtttcaccaagcactatcagcacggcaactgccgtcaataatggcaggataggtacatctacagcgtccaggggagttagcagcgtcggaaacagcaacaacagcaggatatcaagaccaaaaaccaacgactacggcgaaccgctctactgctactgtaaccaagtggcatacggggaaatggtggggtgtgatggcgcagactgtgagctagaatggttccatttgccatgtattggactcgaaactctacctaagggcaagtggtattgcgacgactgcaaaaaaaaactgtgactcgagacccagctttcttgtacaaagtggtgataaattggagctctgcagagctttcgttcgtatcatcggtttcgacaacgt

SEQ ID NO: 127 - DNA, 1521 bp, Saccharomyces cerevisiae
aactctttgtttcttgtttgttgattaacccttaattaatccgggcgcgcctgatttatcacaagtttgtacaaaaaagcaggctcctgcaggacctataagaaacgtcggtagcacaacaattaactcattatttaggtatggcggaaatacctgatgaaaccatccagcagttcatggcattgaccaatgtgtcgcataacatagccgttcaatatctctctgaatttggagatttaaatgaagcactaaattcctattatgcttctcaaacggatgaccaaaaggatagaagagaggaagcacattggaacagacagcaggagaaggccctcaagcaagaagccttctccaccaactcttcgaataaagccataaatacggagcacgttggtgggttatgtccaaaaccaggatcctcacaaggtagcaacgagtacttgaaaaggaaaggttctacctctcctgaaccaaccaagggtagtagccgctctggaagtggtaacaactccaggtttatgagcttttcggatatggtaagaggtcaagctgatgatgacgatgaagatcaaccgagaaatacttttgctggtggtgaaacatccggcttagaggttacagatccttcagatcctaattcattactgaaggatttgctggaaaaagcgagaaggggtggtcaaatgggcgctgaaaacggattccgtgatgacgaagaccatgaaatgggtgccaataggtttactggaagaggttttagattagggtcaaccatcgacgcagcagatgaagtcgtagaagacaacacttcacaatcacaacgtagaccagaaaaagtcacaagagaaattacattttggaaggaaggttttcaagtggccgatggtccgctttatcgctatgatgatcctgcgaacagtttctatttgagcgagttaaatcaagggagggctccattaaagctcttagatgtgcaatttggacaagaagttgaagttaatgtatataaaaaattagatgagtcttataaagctccgacgagaaaactgggcggtttttcaggccagggccaaagactaggatctcctatcccgggtgaatcgtcacctgcggaggttccaaagaatgagacacccgctgctcaggaacaacccatgccggacaatgagccaaaacaaggcgacacctccatccaaattagatacgcaaatggcaaaagagaagttttgcactgcaattccacagatacagtaaagtttttgtatgagcatgtgacatcaaatgcgaacactgacccatcgaggaatttcaccttgaattatgcctttcctatcaaaccaataagcaacgatgagacaacattgaaggacgctgatctgctgaactccgttgtcgtgcaaagatgggcatgagcataaatatacaaaaacagaaacgggaaaagacttcctcgagacccagctttcttgtacaaagtggtgataaattggagctctgcagagctttcgttcgtatcatcgg

SEQ ID NO: 128 - DNA, 1460 bp, Arabidopsis thaliana
ttaattaagtaaaacaaaaacgagggaggaaccatggcggtgagctcattcgccgtccttcctccatttggttcctcatacagctccacaaccgatagatcttcttcttcttcgttttactcatcttcgaaacttctccgcatatctcaataccggttccagtcaaattcccgttgtccaaatgtgttcgtctcgtgctcactgaatcagccttctgatgatgcttccgacgccgccctttttctcgaatccaattcaattgctgattacatgcggttcaaacgccgtcccgaccccggaaatggtaccagcgagttgcagactgcaatcgtgagttacaagaaacgtttcccttggattcttctcaacccttttcttcaggtggatttggtctcaactattcatattgcagataaagagtacttcacaactcttcagaaggagcttgaaccatatgattctatcttgtatgagatggtggctagtaaagagaccttggaaaacaggagaaaccctattgcatctaagaggctcaagagttctcgttcaagaggtttcagtattcttgggttcattcagcggcagatggcaagagtactaacacttgattttcagctagattgtctagattacgatactgagaattggtaccatgctgatctcgatttcgagacattccagttgcttcagaaggagaaaggagaaagcttcttctcatttgccagggacatgactattagatcaacaaaagcaatgatacagccagctttggtaactgaaggtcgtgatacttggaggtcaaagcttctatgggtttcacgggtttttcctatgcctcttgtgggtcttttcctaatcggggctttttgtgctgactttggagatcagacctcagactatccagaattagaagcactttcacggcttgactttggagctgctatgaaggttttccttgctaagagattgacatccgagctaacactagagacatcagatatagaggaaaaatctgtcatcattggtgagagaaaccgagcagctacggaagctttaagaagagcaatagagcaaggacacaagagaattggaattctatatggcggaggccacatgcccgacctgggaagacgactgagagaagagtttgatcttgttccttcagaggtaagatgggtaacagcttggtccatcagaaatccaacggacttggagactagttcatatccgattctgaggaaaatggcagaggctttgcgttggccactaaaccggtaccaaacattggcattgctaatattttcatctgtacttgcactggatctctgcttttgggagctcttctttggttcgacaattgactgggctacccagataggtgcagagttataccagtttatagataatacaaaaattgtatgacgcagcacagaatcatgtacaaacagtgtcggcgcgcc

SEQ ID NO: 129 - DNA, 1397 bp, Arabidopsis thaliana
ttaattaatctaccaaaagaatgtctaattatcgaggagatgatgctgagtacatggaagacgtagatgatgagatggaagatgttgaagatgatatggatgaggagtttcgtggtgatgatcttggtgcttcagattctgacgttgaagaatttgactattcgaacaataaagtagctgataccacggctgagcaagctcggaaagggaaagatatccaggggattccgtgggacagacttaatatttctagagagaaatacagacaaactagattagaacagtataagaattatgaaaatgtccctaattctggagaatcatcagaaaaggtttgcaaggtcacacagaaaggaggactattttatgacttctggcggaattcacgatctattaagtctactatactacatttccagctgagaaatttggtatgggcaacttctaagcacgacgtgtatcttatgtcaaattttctggttacacattattcttctctaacgtctggaaagcatgaagttctcaatgtccgtggtcatgttgcgccatctgagaaacatcctggaagtttacttgaaggatttacgcagactcaagtaagtacacttgcagtaaaagatgactttctggttgctggcgggtttcaaggagaacttatttgcaagcatcttgatagaccgggtgtcagcttttgctctcgtatgacttatgatgataatgctataaccaatgctattgagatctacaacaaacccagtggtgcacttcattttactgcgtcaaataatgactgtggagttagagactttgacatggagagataccagcttgttaagcatttccgttttccttggccagtgaatcacgcatctttgagtcctgatggtaaattactggctattgttggagacaacccggagggccttattgtagaccccaacacaggaaagacgttggaaacactatcaggacacttggacttttcctttgcctctgcgtggcatccggatggagtcactttctctacaggaaaccaagataagacttgtcgtgtatgggacatccgtaacctatctcagtctgttactgtcttgaagggtaacctgggagcaatccggtcaatccgctacacatcagatggaaaatacatggccatggctgaaccggctgactttgtccatgtctatgatgtctcaaacgggtatgaaacagagcaggaaatcgacttctttggggaaatctctggaatatctttcagccctgacacagaggcgctatttattggggtatgggaccgcacttatggtagcctccttgagtttggtcggcgcaggaactattcctaccttgactcgtatctttaagctagaagagaagtatacacaaccctgtccggc

SEQ ID NO: 130 - DNA, 1285 bp, Cupriavidus metallidurans
aactctttgtttcttgtttgttgattaacccttaattaatccgggcgcgcctgatttatcacaagtttgtacaaaaaagcaggctcctgcaggaccatgaaaaccaaagccgccatcgcctggaaagccggtgcaccactcaccatcgaagaggtggacctcgacggtccgcgcgcgggcgaagtcctcgtggagatcaaggccaccggcatctgccatacggactactacacgctgtccggcgcggaccccgaaggcattttccccgccatcctgggccatgaaggcgcgggcatcgtcaccgacgttggtccgggcgtcacgtcgctcaagccgggcgatcacgtgattccgctctacacgccggaatgccgtcagtgcaagttctgcctgtcgcgcaagaccaacctgtgccaggccatccgcgccacgcagggcaagggcctcatgccggatggcacctcgcgcttctcgatcgatggcaagccgatcttccactacatgggcacgtcgacgttcgccaaccatatcgtggtgcccgaaatcgcgctggcgaagatccgccccgacgcaccgttcgacaaggtctgctacatcggctgcggcgtgaccacgggcgtgggcgcggtgatcttcacggccaaggtggaagccggcgcgaacgtggtggtgttcggcctgggcggcatcggcctgaacgtgatccagggtgcaaagatggtgggcgcggacaagatcatcggcgtggacctcaatcccgcgcgcgaggcgatggcacgcaagttcggcatgacccacttcgtgaatccgaaggatgtcgacaacgtggtggaccacatcgtccaactgaccgacggcggcgccgactactcgttcgagtgcatcggcaacacgcaggtcatgcgtcaggcgctggagtgctgccacaagggctggggcaagtcgatcatcatcggcgtggccgaagcgggcgctgaaatctccacccgtccgttccagctcgtcacgggccgcgaatggaagggctcggccttcggcggcgcgcgcgggcgcaccgatgtgcccaagatcgtcgactggtacatggacggcaagctgaacatcgacgacctgatcacgcatacgctgccgctcgaccgcatcaacgagggcttcgacctgatgaagcgcggcgaatcgatccgctcggtggtcctgtactgactcgagacccagctttcttgtacaaagtggtgataaattggagctctgcagagctttcgttcgtatcatcggtttcgacaac

SEQ ID NO: 131 - DNA, 1253 bp, Escherichia coli K12
aactctttgtttcttgtttgttgattaacccttaattaatccgggcgcgcctgatttatcacaagtttgtacaaaaaagcaggctcctgcaggaccatgacaaaaaagggcgctttcactagcgccttttttatttacgcgttttcagcgtgcataataagaaaatcacaacaacacacatcggaggctgttatgccactgcataatttaacccgttttccacggctggagtttatcggcgcgccaacgccgctcgaatatctgccgcgcttttctgattatctaggacgggaaattttcatcaaacgggatgacgtcacccccatggcaatgggcggcaataaattacgtaagctggaatttctcgcggcagatgctctgcgtgaaggtgccgatacgctgattactgccggggcgatccagtctaaccatgtgcggcagactgccgcagtcgctgccaaactcggtctgcactgcgtggcgctgctggaaaatcctattggcacaaccgcagaaaactatttaaccaacggcaatcgcttgttgctggatctgttcaatacccagattgaaatgtgcgacgcactgaccgatcccaatgcccaactggaagagctggcgacgcgagtcgaagcacaaggctttcgcccgtatgtcattccggttggcggttctaatgctcttggcgcgctaggttatgtggagagtgcgctggaaatcgcgcaacagtgtgaaggggcggttaatatttcatcggtggtagtcgcatcgggcagtgccggaactcacgccggactggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcggggctgattgacggtatcagtcagaaacgcttcaaagatgaagggccgattctgtttattcataccggcggtgcgcctgcgctgttcgcctatcatccccacgtttagctcgagacccagctttcttgtacaaagtggtgataaattggagctctgcagagctttcgttcgtatcatcggtt

SEQ ID NO: 132 - DNA, 1497 bp, Arabidopsis thaliana
ttaattaaaaagtccttcaacaagaaaatccaatggctgatccggcaacgagttctccgttgttggatgaccatgtaggtggagaagatgaaagaggaaggagatcaagatcatcaactttggttcaaaaagtgatcgacgtggaagaagcaaaagctcaaatgatttactctttgccaatgatactcaccaatgttttctactactgtattcctataacttctgtgatgtttgcttctcacctcggtcaactcgagctcgccggtgccacccttgccaattcttgggccaccgtctccggttttgccttcatggtagggttaagtggatcacttgagacattatgtggacaaggctttggtgcaaaaagatacaggatgttgggagttcatctacaatcatcttgcatcgtttcattagttttcagcatcctcatcaccatcttctggttcttcacagaatcgatttttggacttctcagacaagatcctagcatttcaaaacaagctgcactctatatgaagtaccaagctcccggtttactagcttacgggtttttacaaaatattttgagattttgccaaacacaatcgatcattgctccactagtcatcttctcgtttgttcccttggtgataaacattgctaccgcatatgttcttgtttatgtagctgggcttggattcattggtgctccaatagctacatctatttcattgtggatagctttcctttcgcttggaacttatgtgatgtgttcagaaaagtttaaggaaacatggactggattttcgttggaatcattccgttatatcgtaataaacttgacattaagcctcccttctgctgctatggtatgtttggaatattgggcattcgagattcttgtgttcttggcaggagtgatgccaaacccggaaatcaatacttctttggtcgctatatgcgtcaacacggaggcgattagctacatgttaacatacggacttagtgcagctgcaagtacgcgtgtgtccaatgaacttggagcaggaaatgtaaaaggcgcaaagaaggcgacctctgtgtccgtaaagttgtctttagttcttgctctcggcgttgtaattgttttactcgtaggtcatgatggttgggttgggttatttagcgatagctatgtgattaaagaggagtttgcatcattgaggttttttcttgctgcctctataactcttgattcaatccaaggagttttatcaggagttgcaagaggatgcggatggcagcgtttagtcacggttataaatttggcgacattctacttaattggaatgccgattgccgccttttgtggtttcaagttgaagttttatgccaagggtttgtggattggtttgatatgtggaatattttgccaatcatcatctcttttgcttatgacaatattccggaagtggacaaagctgaatgttgctacggtctgaaaactctagttacgttccattttggcgcgcc

SEQ ID NO: 133 - DNA, 1675 bp, Arabidopsis thaliana
ttaattaaatggagctgaagtgggtttcttgtcggaaacaatctctgttcttgatctcttgtctggctctgctttgtctcgcgtccttggatactatatcatgtgaatcaactcagaatgctactgacttcaagaaacgatctcagacagtttcttgccctcctgattggatcattggaccgaaccaaaccaagtgctatgcttactttaaaaactctacttcatgggagaagtcagaaatgttctgtagaacttatggtggtcacttagcatcgcttgcatcgagcaaagaactcagctttgttcaaaaactatgcaatggaaatgttagcagttgttggattggaggacgaagtatgaattcttctacctcaggtttccgttggagctggtctgatcctaagactcctcaatggaaccaatccatgtttcctaaagttccaattcgcacccgctgtggcaatggcaacggcagttcatcgtgtcgtgctaatatatgtatagccgtgacaaatggttcatcatcaatattcggtgaaagatgtaatgcgtctcatgcttttgtttgcgctgttgattctgatatcaaatgtcgcaattgtcacaaatatctagttatcctcgctgttgtcagcggtttgattctcttcacgacattcgccattatattatggctccttgtctataagcgaagcaagaaacgccgaaaatcacgaaaagtatctaatccagcttcatcatcatcagtagttcctccttcatggaagatcttcactagtgaagaactgagatcaatgacgaagaacttcagtgaagcaaaccgtctagctggggacgcgaaaaccggtggaacctatagcggtggtttatcagacgggactaaagtggcggttaagagattgaaaaggtctagttttcagaggaagaaagagttctactccgagattagaagagcagctaaactttatcacccgaatgtagttgctataaaaggttgttgctatgatcatggagaacgtttcattgtttatgagttcatagctagtggacctctcgatagatggctacaccatgtgcctagaggtggtagaagcttggactggaacatgagattgaacatcgccacaactcttgctcaaggaatcgcgtttctacacgacaaggtcaagccacaagtggtgcaccgcgacatccgagctagcaacgtgctacttgatgaggagtttggagctcatttaatgggtgttggtctctcaaaattcgttccttgggaagtaatgcaagagagaaccgtaatggcgggtggaacctacggttacctcgcacccgaatacgtttacagaaacgagctaaccacgaagagcgatgtctacagtttcggagtccttttgcttgagattgtgagcggtcgtagaccaactcaggctgttaattcttcagttgggtggcagagcatattcgaatgggcaacaccattggttcaagctaaccgttggttagagattcttgatccggttattacatgcggtttaccggaagcatgtgtggttcagaaagttgttgacttggtttattcttgtactcagaatgtgccatcaatgcgtccaaggatgtcacatgtggttcatcagcttcagcaattggtccaacctttagaggttaagtagggcgcgcc

SEQ ID NO: 134 - DNA, 360 bp, Arabidopsis thaliana
atgcacgatttctgcttcactatcccgtacgggatccttctgatcgtcggaggatttatcgggtatctgaagaaaggaagtattgcatctctcgccggaggagcaggcactggattgcttgtcgttctcgctggtttcatcagccttaaagctttcgagaagaagaagacatcgttactcgctactcttctcgaaacagtcattgcagctgctctcacatttgtcatgggacaacggttcttgcagactcagaagattatgccagctgctttggtagctggaatcagtgctctcatgacttgtttctacgtatacaagatcgcaactggcggcaaccacataccaccgaaagctgaatga

SEQ ID NO: 135 - DNA, 2418 bp, Arabidopsis thaliana
ttaattaaccggaagcaaaacattcctaaatttcgccaagtgatccgccatgggagaagagaagtctctgcttcagttccgtagttttccttcactcaagacctctgatttcgctctcaccgaagaaccttcatggaggctggagaacaacgtgtcgtcgaatcgccggagaggaaacaagagaagcggtggcgtttttaccaattttgcgtccctttccgtagcgattaggagagatcggagagaatctacatttaacggtcgtaatggcggcggaggcggagcgttcgcatcggtttcggtggtgattccgaaggaagaggatgaattcgcgcctacctcggcccagctgttgaaaaaccccattgctttactgtcgatagtaccgaaagacgccgcactattcttcgccggagcgttcgccggagccgccgcaaagtcagtgacggcaccgcttgaccgaataaagctcctaatgcaggtaagggctctctctcctctccttctcaacaacttttaaggttttctggcacgtgtgttttctccattttaaaaagtaaaataaaaataaaactggtgactggtgagcacaacgaatacgctgtcgtttcggctagttgttgcttgtgggacattgttgattttcctcttcttttttcttttcctaagagactcttccatgacatggtctatgataaaattgatcatgtatttatatctcattatttcaagccaagaaccttgaggggaatctatggagtatttgtgattgtgttcttgttacaggcttgtagtaatgtacattgattcttaaatgatgtcttattaattcatagacacatggtgttcgagctgggcaacaaagtgctaagaaggctattggtttcattgaggtatatatactctcaatcgtgtaatttttaagaggattagttagttgttcttattgtaaaagtcttgttgatttggttttgtttgggatgactacaggccattactcttatcggaaaggaagaaggtattaaaggttattggaaaggaaatctacctcaggtacgtcacacaatttcttgcatccttttggaaagaatggtgttgaattttgtagagtttgattgcacataatcttagtctgaatgttccaggtgataaggattgtaccttatagcgcagtccagttgtttgcatatgaaacatacaaggtatataatctttctatatctgattctggtttcgtttcgaaagtttttgaaaccgtgtctaatcagtaatcactttgttctgtacattctgccttttttatgttgtttagaaactcttcagggggaaagacggtcaattgtcagtcctcggaaggctcggtgctggtgcttgtgctggcatgacgtctactctggtaagtaacgttgtttataggcctgagtgagtttgtctaatcgtaaagtaacttaagactcttactacttaatgcagattacataccctttagatgtgctgagattgaggttagctgttgaaccaggttatcgaaccatgtcccaggtatattcatcgcattatacaccaactttctcttccataaattaatcaggttttaaagcagacatgtcatatctaggttgccttgaacatgctgcgggaggaaggagttgcatcattctacaacggtctaggtccttcgcttttaagtatagctccttacattgccatcaacttctgcgtctttgatctgtaagtctactaacagttcaaacattacccctgaatatttttaactagattgtttacatattcgataatacaatatatgcacagggtaaagaaatctctgccagagaagtatcaacaaaagacacaatcatctttgttaacagcagtagtagctgctgctattgctaccggtacttgctatccattggataccattagaaggcagatgcaattgaagggtactccatataaatcggtattagacgctttctcaggtaggaacaaaaacatcattatctgcttttattcttccagtttccggtgactgaccttattaaacccttaaaccgttgtgcaggtatcattgcgcgtgaaggagttgttggcttgtaccgtggctttgtccccaatgcactcaaaagcatgccaaacagcaggtagttatagttttgataaaacaagttcatttttttcatttttcttgtttcagtattaacattttggaatcctctttttgtattgtttcagtattaagcttacaacattcgacatcgtcaagaaactcatagcagcgagtgagaaggagatccaaagaatcgcggatgataaccgcaagaaagcaagtcctaacacaatcgatgaacaaacctgaagacgcaattttggatttccacaaggtcatttttgcccgttatcttatggcgcgcc

SEQ ID NO: 136 - DNA, 2788 bp, Arabidopsis thaliana
ttaattaaatgtggcggcgaagtaacttaccggtgactgttatgcatcgctgagaattgtttgcttttttctctttccaggacattgatttgattttctgttttgcttttttcttgttggattatcatcaggggaatccagattccgatcagagcatatctggtgaggactgatgattgcttctttttcttcatctgaaatttcgattttagatctttgtgtttcattgtctatcgagtgattctcaagctgttgtttggtcttttagaggaagaagaagaaaatgatatttcgccgaaggagaatgcgaaggaacaagaggtaatgtttaatctcaactttcgattcgttaagcttgcataaagctctctgtgaactcctgagaagttgtctttgagaaagaacttggcaacttctgatttgccgaattgattgttgttggcttgagtagttttttttgaggagctatagggaatttgattgtggtttgaccatagttggcttcaatattgtagagaggattactacttcaaacaaagctcgaaaaactcataggtacatataatatatccattttgcggtcaagccttttctacgactatttaacttcagtcaagtttcacaaagagcttctgtgttgtttccaggttgtggtgagctaaattatgctagggaaaccggtgatgtaactctggaagcaactgtgagtctttttcgttgcaaattcttttgtgcagcttcttttttggaggaatattggaatcaaatggtgatgagagaaatttcctttttagctacggaagatatcatcctctcttgaagatgtggtcgaagttcctgactcccccgaggagagttatatttcttcttccagaagaactggattagcatgcatatctgctcaggaaaatgggtcagatgatgaggttaccttctaatcttggagtccatttcactcatgcatcttgataagttcttcaaattggtgacagtatcctctacttatgttttgaatggtgattgttgttgccttcagattacacatgatgaacaagtggcaacttggtctgctataagtaaagaaaccaagtcactaatccatttgaatggtgttgcttcagtcgcatcatcccatctatctggcttcagagccaagaaaagtagtaatggtactgttttatccaaaactcttcttggtatttttttaccgtacaagttaaagaacgttgcaccacgtatgaaaactcaaagaaacagatcatgtatgcacgattttctgaaatctctgagttgggtttctaatgtatatgcaggtctcaaagatcatgggaggccaaaattttcatttaactcacatactcatggagaaacgtcatccaagataagtgacatggctgaaatctttgagcctgatgtggaggatcaggctatagaagaggatccaattattgaatgccccaacagttttgatgaaagatcagaaaacaggcagggtgtttctgttgctgagtcgagagaagttttgcacgagtgcactaaagatgcggtacccaagcttcaagaaattcctctagataaaattagactgataaaaagaagctctgaactggtattattgattatacagtggattagcatttgatttgctgctttgctctcagacatctgtttcattcgtttggcctcctttctgctccaggacagcagacatgaagcaaaaagtcggaaatttactcataagggaaattcatctaacttccaagatagtgatactgatgatgaacttcctggacctatggatagtggatcatcaagcgatgatgaggttttattcttttcctttcttgtgatttgggtaatctccttctcctcagtttacagtcaaattcaaattatattgttctgtgacatagcctagttatcaaagctcagtgccaaacatttccaaccagaagaaacaatttgttggggaccggtttgatgaagcaataaaagcttcctctttgagcaaagaaggtctcttgttcggttcacctaaattatctgggtaatcaaactctcaacatcttttatgcaccacactcttaaaatcacacatcagttaacatgaaaacccatttttggttgcatcaatttgcagtggctctagcctgtatggcaagctgcaacagatcatgaaacaagaaaaagagacggaaatggaaatcatgaggaaattgcaaagcggaatcggagaagcaggtaactctttttgtaactcccatataaacaaaatctagttcatacctctgttactcgttccaatttcccaactcagattcatcgggctatgttgatgttaaagtcatgtcaagacacttggagggaaagcttgtcgtctgcaaatgctctgtcattgacctctctggggtttatctctccatctctttgacgcatctgataaacctgctcctttaattagacccttaagcaattgatttagtcacattcgattttgtaggactccctattactcaagaacacacaagctcttgcggcaaaagaaacagaaacaacaattatttttagtccgaaagtttgtgcggatgttgatatcgaaatagggaactttatccgagtatatgcgccatggtcagttttgattccactctttagactcttatcccatgtcactaaactcttttgtgatatttagcttttcaattttcaacaggaaggagttggaagtgcagaaaaccaatgatgtgattattttgtcttcatatttctcaagtttgtaaggcgcgcc

SEQ ID NO: 137 - DNA, 791 bp, Arabidopsis thaliana
cttgtttgttgattaacccttaattaaatgagcaagaaacattgctcagaattattaccaaataagatgtttagaaaccaagactcgaaatacttgatcccggtgcagaaagaagcgccaccggtgacaactttaccgatgaaagcttcaacggtaaaatctccacacaactgtgaggccattctcagagacgcagatcctccgatctctctctcctctgttaatctctctgaacagctacggtctggtgttttcttgaaacccaagaaacagatcaaatattgggtggacgagagaaacagcaactgcttcatgctctttgcaaagaacctctctataacttggtctgatgacgtcaactattggacttggtttaccgaaaaagagtcaccaaacgagaatgtggaagctgtgggattgaaaaacgtttgttggctcgacatcacgggaaaattcgacacgaggaacctcactccggggattgtttacgaggtagtctttaaggtgaagctagaggatccggcctatggatgggacacgccggtgaacctaaagctagtcttgcctaacggtaaggagaaaccacaagagaaaaaggtgagtttgagggaacttccaaggtataaatgggtcgatgtcagagttggcgagttcgtacctgagaaatccgctgccggagagatcactttctcaatgtatgagcatgcggctggtgtttggaagaaagggctctccctcaaaggtgttgcaattcgtcccaaacagtaaggcgcgccacaaaattggagctc

SEQ ID NO: 138 - DNA, 2129 bp, Arabidopsis thaliana
ttaattaagaagaaagacgagtagattgatttcttagacgacggagaaatgcgagtgatgagatcattgcgcggtaattccggtgctggattggttttccggccggcgaggttaaattctcttcggagcgtctttaccggttgccgtgctgtgattttgccccgctttggtggtccggaggtttttgagctccgggagaatgttccggtgccgaatctgaatccaaatgaggttcttgtcaaggcgaaagctgtctccgttaatcctcttgattgcagagtgagtgttaatctgcttgatccgttttgatttcattttatgagtggcattagatatcttcggagattgctttatttgggaattaagattggcgtgatcggttagcttggatctcttgcatatgttctaggagtttaatctcacgttgatgataatatccagaatgtttgctgcttgctgcttcacttctttagatttcaaatcaaaatcttgtcttcgatactttgaagagtagtgaaattgtttttttcatgatcattttgctgatatggcatcaagtgttaagatgagaaatgtgtttgttttcagatacgagctggatatggacgttctgtattccaaccgcatctacctattatagttggacgtgatgtcagtggtgaagttgcggcaattgggacttcagtaaagtcacttaaagtaggacaagaagtttttggtgcgttgcatccgacggcgttaagaggtacttatactgactatggaattctttcggaagacgaactcacggaaaagccatcatcaatttcacatgtggtaagtagaaagatctagataccctttaacctctctacctttttttttatattgttttttggttaagtgatttcagctattcttgtgtctgtctcttgtaggaagcaagtgccattccttttgcagctttgactgcttggcgtgctttgaagagtaatgcaaggataactgaagggtatgattttgagaaactattattcatgtggcaagaagttgatactaattcacctttcaacattcacacaaatgcttttcgtgttttttgtgaactactatgaactcaatagcataatcttaaaatcctttttatttgcagacaaagactattagtctttggaggaggaggagcagtaggtttttctgcaatccagcttgcggtagcatctgggtgtcatgttacagcctcttgtgttggtcagactaaagacagaatacttgcagctggggccgagcaagctgttgactacacaaccgaggtaatgacaccagctgtttatttatctgctcacccaaagtagagccattatgatcttgttctgattcttgaatctgaatctgtttcatgtacaggacattgagttggcggtaaaaggaaaatttgatgccgtgttagatactattggtgggcctgaaacggagagaataggcattaacttcttaaggaagggtggaaactatatgactcttcaggtatataacatttcttgtgtttctgctttacaagctgcagtgaccttggttggtcttggattttgttttaacaacagtgatttattttttccctcttttgaatttatctgttaaagggtgaggctgcatcgttgactgataaatacggttttgtggttgggcttccccttgcaacatcgctcttgatgaagaaaaagatacaatatcagtattctcatggaataggtatatgatgtatatatatatatcctgcattactctctctctctctctctttgattttgaagtaactattctgataataagacctgtctcattgagcttttgagtgggaaagaaatggttaatgtgataaaatctgactgtgatgaacttatataaaaacagactattggtggacgtatatgagggctgatcctgaaggtctagccgagattcagcgtttagttggagctggaaagctaaaaatacctgttgaaaaaacatttccaataaccgatgttgtagcagctcatgaagccaaggagaagaaacagattccgggtaaggtggttctagagttctgaactacatatacatagtagaaataataacacctgcatagttctctagcagggcgcgcc

SEQ ID NO: 139 - DNA, 558 bp, Arabidopsis thaliana
ttaattaagtgagaactgagaagcgattatggcgagcaagatgagtctccgttactctctctttttgatcttcttctctctcatttcactccaaggttttgccaagaagaccggagatgtgtcggaattgcagatcggtgtcaagtttaagccaaaaacatgtgaagttcaggctcacaaaggtgatacgatcaaggtgcactatagggggaaacttactgatggaactgtattcgattcgagttttgaaaggggtgatccgtttgagtttaaattaggaagtggtcaggttatcaaaggttgggatcaaggtttgctaggagcgtgtgtaggtgagaagaggaagttaaagatacctgctaaacttggatatggagaacaaggctctccacctactatccccggtggtgcaacactgatctttgacacagagcttattgcggtaaatgaaaaaccagctggtggtgaagaatacggaggggatgaagatgatgagggatatggaaatgacgagctatgatccggtctccgttctttaacgattttgcttggcgcgcc

SEQ ID NO: 140 - DNA, 834 bp, Arabidopsis thaliana
ttaattaagatcccaacaacacttcttgttcatggattctgggcttcagcaactcgcattgtgcctcttcttcattctctgccgcctctttcaagccactgccgaagatgactggaagatagccacagccacgctttctagagacagagacggctcctcctccgtcgctactggaggcgcttgtgggtatggagatctgaggcagagcagctttgccggctacagcgcaggcctgagcgggaagctgttcaacaggggaagcagctgcggagcttgtctagaagtgcggtgcgtgaaccacatccgttggtgtcttcaaggcagcccctccgtggtggtcaccgccaccgatttctgtcctcccaattcgggactctcctccgattacggaggttggtgcaacttcccaaaggaacacttggaactatctcatgccgccttcacagggatcgcagaaaccagagctgagatgatacctatacagtataggagggtcaagtgtgggcggagaggcgggttgagattcagcttgagcgggagctcccactttttccaggtgttgataagcaatgtgggcctcgacggggaagtggttggtgtgaaagtgaagggccacacaacggcttggatcccaatggccagaaactggggacagaactggcactcctctctcgatctcatcggacagtctctctctttcgaggttactctcaaaggcggcaaaaccattgcctcttatgatgtggctcctccgtattggcgcttcggaatgacataccaaggaaagcagttccactcctgactcctttatcttcttcaaatcatgggcgcgcc

SEQ ID NO: 141 - DNA, 449 bp, Arabidopsis thaliana
ttaattaagcataaaagagagtagcaaagactgagaatggaaagcttggacactaattttcctgtgcgccatagaaaggtctcgtttgaaagtaagggaaacaagacagagattgtgatctgcagctatgaagatcatatccttatcatagcaacacagattggtgccatgggaactatattgcacgcaaggaaggaagaagggatgtctgttgaaccaacatttagtgtttcagtgatattcggaaagcgagacgagccaatgctgacagcaactgctcgaagactcattgaacacataagttctattgttccctcgaagcctctggttctctcacttggtctcaaagatcattcttcggagacgttgaaggaaatagtagcgacagtgattgagaatcgcctttggtaatacatattgttgtccatgttaaaaggagaaggcgcgcc

SEQ ID NO: 142 - DNA, 666 bp, Synechocystis sp.
tcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgaattatgcggcgatcgtcggccagggcttaggaattctgctggcagtgatgacggtgttatttatttttcggattattctcacttggtatccccaggtagagctgactaaatggccatggaagctcattgccctacccaccgagccattattaattcccctgcgtaagctagtgccccccatcggcggcgttgacctagctcctatcctctgggtcttcatctgtacctttttacgggaaattcttatcggtcagcaggggctgatcaccatggccagtcgcttgcagtaaatttaaaaaccctgcaaatacccagcaaattggagctctgcagagctttcgttcgt

SEQ ID NO: 143 - DNA, 2047 bp, Arabidopsis thaliana
ttaattaatacaaggacgagtacagaaactggttcaggagtcatcatgcctcagaactgcatagcaccaaggcctgaagaagatggtggagtcatggttcaaggtttgccagatatgtcagacacgcagagcaagtctgtactagccttccctacgattacttcacaacctggtctccagatgtctatgtatcccataactctcaagtttgaggaggttgtgtacaaggttaagatagagcagacaagtcagtgtatgggatcatggaaaagcaaagagaagacgattttgaatgggataacgggaatggtttgtcccggagagtttctagccatgttaggtccatcaggcagtggcaaaaccactcttctatcagctctcgggggccgtctctccaaaactttctcaggtaaagtcatgtacaacggtcagcctttctctggctgcatcaagcgcagaacaggatttgttgctcaggatgatgtcctgtaccctcacctcacggtttgggagactctcttctttaccgcacttctacggctaccaagcagcttgacgagagacgagaaagcagagcatgtggacagagttattgctgaactcggattgaatcggtgtacaaacagcatgataggaggaccactcttcagaggaatatcaggaggtgagaaaaaaagggttagcattggtcaagaaatgctgatcaatcctagcttgctccttcttgatgaacccacttcaggtcttgattcaaccactgctcatcgcattgtgaccacaatcaaacggttggcttctggaggaagaacagtcgtcacaaccattcatcagccatcaagccgcatctaccatatgtttgacaaggtggttttgctatctgaaggaagtcccatctactatggcgctgcctcttctgctgtggaatatttcagttctctaggattctccacttccttgacagttaacccagctgacctcttacttgacctcgccaacggaatcccacctgatactcagaaggagacctcggaacaagaacagaagacagtaaaagaaaccctggtttcagcttatgagaagaacatttctactaaactgaaagctgaactatgcaatgcggaatcccacagctatgaatacaccaaagctgctgccaaaaacctcaagtcagaacaatggtgcacaacttggtggtaccagttcactgtattgctccaaagaggagtcagagagaggagattcgaatctttcaacaagctcaggattttccaagtcatcagtgttgcttttcttggtggccttttatggtggcatactccaaaatctcacatccaagatagaactgctttgctcttcttcttctcggtcttttggggcttctacccgctatacaacgcggttttcacatttccacaagagaaaagaatgctaatcaaggaacggtcttccggaatgtaccgtctttcctcctatttcatggctagaaacgttggggacctgcccttggaacttgcccttccaactgcttttgtgttcataatttactggatgggtggacttaaacctgacccaacaacgtttatcctctcgctactggttgttctctattctgtccttgttgctcaaggtcttggcttagccttcggtgctctgcttatgaacatcaagcaagccacaacgttagcatctgttactacactcgtttttctcatagccggaggatactacgtgcaacaaattcctcccttcatcgtatggctcaagtacctaagctacagctactactgctacaagctgcttttgggtattcaatacactgatgacgactactatgagtgttcaaaaggagtctggtgcagagttggagacttcccagcaatcaagtcaatgggattgaacaatctctggatagacgtgtttgttatgggagtgatgttggtgggttatcggctcatggcttacatggcactgcatcgggtgaagttgcggtaaacgtgcagccgaaggtaacaacaactaagtaactccaagaagctccaggcgcgcc

SEQ ID NO: 144 - DNA, 1839 bp, Arabidopsis thaliana
ttaattaaatgggaagttttaatgatacttcatgttcatatgttgatgttgagattaagtatgttgatgaatgtgaggagaggttaaggagattgtttgatcaagctttgttggtttttcttgaggaagagggtagtataaagcctctccctgcagttataggtgatggcaaaaatgttgatttgtttaagctgtttgtattggtgagggagagggaagggtttgatactgtgtctaggaaaaggttgtgggaagtagtggctgagaagttaggctttgattgttcactggttccttctttgatattgatttacttgaagtatttgaaccggatggagaaatgggcggtggaggaatctaggattgtgaattgggataataaggatagtgaaaagaaagggtgttatagtggtatgttgcatgagttagggaatggttttaagagtttgttggacaatgggaagtgtcagaaacgtaacagagctgttgcgtttggttgtaaccatatggaagagtcgtgttcagagtttgataggtctaggaagaggtttagagagagtgatgatgatgataaaggagtaggactgtctagtgttgttattagggaggagactgttgtatgtgctgtggaagaaggtttgtcggatttttccttggagaagcgagacgatttaccgggaatgttgaagtggctggctttggttgcaacatctcctcatgatcctgccattggagttataccgcatagttcaaaatggaagcagtataacggtaacaagtgttggctccaagtggctagagcaaaaaactctttgctggttcaaagagacaatgctgaactcagatatagatatcatccatttcgggtaatgccttgagaacagctttattataatctttctttctatctaagtatgctttctttttctacctgtgagacagtttaactcatggtaaactcatgcagggtcaccaaaatatacatcatccgtctatgtatgaagatgatcgaaagtcgatagggaggttaagatacagcataagacctccaaatttatccaaacactgttcgagctcgtgttgcaatggaagcagtttggtctctctatctaaatcaagatctaccaaatgcagaaaactgacgatcattgcttctgagagagcaggccttactgcaggaacatctagagccagaaagcgaaacaaagcagagatcccgagaaggtgtattaaagtaggacatcaacaccaagcccaagtggatgaatggacagagtccggtgtagatagcgatagtaaatggttaggaacccgtatatggccgccagaaaatagtgaagctttagatcagacgcttggaaatgatttagttggaaaaggaaggccagattcttgcagctgtgagctctctggttttgtggaatgcactaggttgcacattgcagagaagagaatggaactgaaacgtgagctcggcgatgactttttccattggagattcaatcaaatgggagaagaagtgtgtctaagatggacagaagaagaagagaagaggtttaaagacatgatcatcgcggatcctcaatctttctggacaaatgcggcaaaaaatttcccaaagaagaagagagaggagcttgtgagttactacttcaacgtcttcttgattaacagaagacggtatcagaaccgtgtgactccaaaaagtatagacagtgatgacgaaggagcgtttggtagtgttggtggcagttttggtcgtgatgctgttacttcgtctggttcagatgttatgatctgtgctcagaatcgtcagtgtgaggactactgaggcgcgcc

SEQ ID NO: 145 - DNA, 570 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggcgaatcaaagcgtcgtaaacaatcccttggcgatcgctatggccaggatcaacgggttgtggagtggctgcctttaaccaaaaaacaagccgaagatttctataaatggaccaccaaaggagcttggattggcatcggtgttatggcaggcctgtgggttacagtcagatttattggccccacttttggctggtggaccgtccaataaatttaaatacccagaaatacccagcaaattggagctctgcagagctttcgttcgtatcatc

SEQ ID NO: 146 - DNA, 1852 bp, Bacillus halodurans
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaacgggaccactatcggatggtcattaacggagaacgggtcgatagcgacgaaacctttgagacgtttaaccctgccaaaggtgagattttagcaacggttgcaaaagcaagtcgtgagcatgcagaaaaggcagttcaggcggctcgccatgctttcgatcacggcaaatggcgaaagtaccctgttggaaaacgtgctcgtgtgcttaatcaaattgccgccattatgagggagcggtttcaagagcttgtagaaatcgaagtgcttaatagtggcaaagcgatcagtgctgctcaagcacaaatcaatcaagcaatcgaagactttgagttttatgctggggcgattgtaggccatcgtggaaccgtaaacaacgtccctaatggatttctgaactacacacagaaggagccggtcggtgtttgtgcacagatcattccgtggaactacccgttgatgatggcagcatggaaagtcgctccggcactagctgcgggttgttctgttgttgttaagccggcaagcttaaccccgattacagcgattcttttaaatgaaatttgccatgaagctggtgtgccagaaggtgtggtcaatacggttgcaggggctggaagcgttgttggtgattatctagttgggcatgaagacgtaaataaagtcgcatttacaggctctactccaatcggaaaagacatcatggaaaaggcctcacacacattgaagcgtgtcacgttagagctcggcggtaaatcacctaatctagtttttgcagatgccgatatggaagcagccgttgcaggttctttatttgggatttactttaatactggtcagtcttgtgaagcgagatcgcgcctgtttgttcatgaagaaatttacgatgagtttatagaggagtttatcactcgcgcaaaaaagttacagctaggagatccatttgataaaggtacacatgtcggttcgatcattagtagagaccagcttgaaatcattgatagctatgttcgttcagcagaggaagaaggggcaacgattgccttaggtggaaaagagaggcgggtggaaggctttgaaaacggccattggtatgagccaacagtcattaccaatgtaacaccagatatgaaggcggtacaggaagaaatctttggacctgttgtggttgtcgaaacgtttcaggatgagagagaggtcattaagcgggccaatgatacgaaattcggcttaggttcagctatttggacgaaagatcaaggtcgtgctacgcgcgtggctcatcagctggaagcagggattgtcatggtgaactgtccattttcggcttttcctggtaccccttttggcggctacaaagaatcaggatttggtcgtgagctttgcgtagagactctcgatctctatatggaggataagagtatcttatcctattatggaccgaagcctattaatccattcggagtttaactcgagacccagctttcaaatacccagcaaattggagctctgcagagctttcgttcgtatcatcggtttcgac

SEQ ID NO: 147 - DNA, 920 bp, Arabidopsis thaliana
ttaataaatgacgaaggatgagttgacggaggaagagtcgctctccggcaaggactacttagacccaccgcctgtgaagacgttcgaggtgagagagctcaagaagtggtccttctacagagctgtcatcgctgagttcatagctactttgctctttctatacgtgactgttttgacagtcatcggctttaagagccagactgatatcaacgccggcggcggagcttgtgccagtgtcggcctcctaggcatctcttgggcctttggtggcatgatattcatcctcgtctactgcactgccggcatctctggtggacacatcaatcccgcggtgacgtttgggctattcctagctagcaaggtatcattggttagagctgtgtcgtacatggtggctcagtgtctcggagccacttgtggagttggtttggtgaaagtcttccagtcgacttattacaaccgctacggtggtggagccaacatgctctccgacggatacaatgttggcgttggggttggtgctgagattatcggcacttttgtcctcgtctacaccgtcttctccgctaccgaccctaagcgaaatgcccgtgactctcacattcctgtattagcaccattgccaattggattttccgtgttcatggttcatttagccacaattccaattactggcaccggaataaacccggctaggagttttggagctgccgtcatctacaacaatcaaaaggcttgggatgatcagtggatcttctgggtcggtccatttgtgggtgcagccattgcagcattttaccatcagtttgtgttgagagctggtgcaatgaaggcctatgggtcagtcaggagccagcttcatgagctccatgcttaaatttaaatacccagctttcttgtacaaagtggtcccaagggcg

SEQ ID NO: 148 - DNA, 1774 bp, Xenorhabdus nematophila
ttcttgtttgttgattaacccttaattaatccgggcgcgcctgatttatcacaagtttgtacaaaaaagcaggctcctgcaggaccatgagcgttaaaggcattactgcgcaggaacttgcggtttatggtatttgtgatgttagcgagattgtttataacccaagttatgaattgttattctctgaagaaactcagccctcactgcaagggtatgagcgtggcacactgacccatcttggtgcggttgcggtggatacagggattttcacggggcgttctcccaaagataaatatattgtccgcgacgatgtgacgtgcgataccgtatggtgggctgatcagggaaaaggtaaaaacgataacaaaccgctcagtcaggaaacctggtctcagctcaagggattggttacgcagcagctttcaggcaaacgtttgtttgtcgtagatgcattttgcggcgcaaatgcggatacccgcctgaaagtgcgttttatcaccgaagtggcgtggcaggctcattttgtcaaaaacatgtttattcgcccatcggatgaagaattagttaacttcacgcctgattttattgtgatgaacggggcgaaatgtaccaacccgcagtggaaggaacaagagctgaattctgagaactttgttgcctttaacctgacagaacgtatgcagttgattggtggtacttggtacggcggcgaaatgaaaaaaggaatgttctcaataatgaactacctgctgccattgaaaggtattgcatccatgcactgctctgccaacgtgggtggagaaggcgatgttgccattttcttcggcttgtctggtacaggtaaaaccacgctttccaccgatccgaaacgcaagctgattggtgatgatgagcacggctgggatgatgacggcgtgtttaacttcgaaggtggctgctacgcgaaaaccattaacctctccaaagaagcagagccggatatttatcacgcgatctgccgtgatgctctgctggaaaacgttaccgtgctggcggatggcacagtcgatttcaatgacggttctaaaaccgaaaatacccgcgtttcttatcctatctaccatatcgaaaacatcgttaagccagtatcgaaagccggacatgccactaaagtgattttcttgaccgctgacgctttcggtgtattgcctccggtttcctgtctgacgccagaacagacccagtatcacttcctgtctggttttacggcgaagctggcgggaactgaacgtggtgtgacagaacctacgccaacgttctctgcctgctttggtgcggcattcctgtcactgcatccgactcagtacgcagaagtgctggttaagcggatgcaggcatcaggtgcgaaagcttatctggtcaatactggctggaatggcacaggtaaacgcatctctatcaaagatacccgtgcgattatagacgcgatcctgaatggtgatattgaagatgcagataccattgagctgccgatctttgacttagctgtaccgacagcattgccaggcgtggatacaggcattcttgatccacgtaacacctatgcggataaatctgaatgggatgttaaggctaaagatctggcacagcgttttgtcgataactttgacaaatatactgatacagccgcaggtgctgcattggtgaaagcagggcctaatctgtaactcgagacccagctttcttgtacaaagtggtgataaattggagctctgcagagctttcgttcgtatca

SEQ ID NO: 149 - DNA, 1326 bp, Arabidopsis thaliana
atggggaacagtgaaatgtcagcgagtgaggttgcggcggccaagcagaagaacgtcgacgattggttaccgatcacatcttccagaaacgctaagtggtggtactctgcttttcacaatgtcaccgccatggttggtgctggtgttcttagcttgccctacgctatgtccaatctcggatggggacctggagtgacgattatggtgatgtcatggatcataacgttgtacacactgtggcaaatggtggagatgcatgagattgttccagggaagaggcttgataggtatcacgagctaggtcaacacgcttttggtgaaaagcttggcctatggatcgtcgtgccgcagcagcttatcgtggaggtcggtgttgacatcgtttatatggtcacaggaggagcatccctcaagaaagtccatcaactagtctgtcccgattgcaaagagatcagaactacgttttggatcatgatctttgcttccgtccactttgttatctctcaccttcccaatttcaactctatctccatcatctcacttgccgcggctgttatgtccttaacttactcaactattgcttgggctgcatccgtgcacaaaggggtacatccagatgtggactactctcctagagcatcaaccgatgttggaaaagtattcaacttcttgaatgcgttgggagatgtggcttttgcttatgcaggtcacaacgttgtgttggagattcaggccacaatcccttcgactccggagatgccatccaaggtcccaatgtggagaggagttattgtagcctacattgtagtcgccatctgttacttccctgtagcattcctcggctattatatctttggaaacagcgttgatgacaacatcctcatcactttggagaagcctatctggcttattgctatggctaacatgttcgtggttatccatgtcattggaagctatcagatatttgcaatgccagtttttgacatgctcgaaaccgttttggtcaaaaagatgaatttcaatccttctttcaagctccgcttcattactcgtagtctttacgtcgctttcacgatgattgttgcgatatgcgtcccgtttttcggtggactactcggcttctttggaggattcgcctttgccccaacaacttactaccttccatgcattatgtggctcgttctcaagaaaccaaagaggtttggtctatcttggacagctaactggttctgcatcatagtaggagttcttttgacgatccttgccccaattggaggactcagaaccatcattatcaacgccaagacctacaagttcttctcttag

SEQ ID NO: 150 - DNA, 1640 bp, Bacillus halodurans
aaaaaagcaggctcctgcaggaccatgttgcaaccatataagcatgagccatttacagattttacggtggaagcgaatcgaaaagcgtttgaagaagcacttggacttgtagaaaaagagttaggcaaagagtatccattaattatcaatggtgagcgggttacaacagaggacaagatccaatcttggaaccctgctcgtaaagatcaattggttggttctgtttctaaagcgaatcaggaccttgcagagaaagctattcaatcagcagatgaagcgttccaaacttggcgcaacgtcaaccctgaggagcgtgcgaacattttagtgaaggctgctgcgatcatccgtcgccgcaagcatgagttttctgcatggcttgtacatgaagctgggaagccgtggaaggaagcggatgcggatacggcggaagcgatcgacttccttgaatattatgctcggcaaatgattgagcttaataggggaaaagagattcttagccgtccaggcgagcaaaaccgttacttctatacaccaatgggcgtgacagttacgatttctccatggaacttcgcccttgcgatcatggtcggtacggcagtagctccgattgtgacaggaaacacagttgtccttaagcctgccagtacgacacctgtcgttgctgctaaatttgttgaagttcttgaggatgcagggttaccaaaaggcgttatcaactatgtaccaggaagcggcgctgaagtcggtgactaccttgttgatcatccgaaaacgagtcttattacgtttacgggctcaaaagatgtcggtgttcgtttatatgagcgggcagctgttgttcgaccaggacaaaaccacttgaagcgcgtcattgtagaaatgggtggaaaggataccgttgtcgtcgatcgcgatgctgatcttgatttggctgcagaatccatcctcgtctccgccttcgggttctcgggacaaaaatgttctgctgggtcacgggctgttatccacaaggatgtctacgatgaagtgttagaaaaaacggtcgcccttgcgaaaaacttaacggttggcgatcctacgaaccgcgacaactacatgggaccagtaattgatgaaaaagcgtttgaaaaaattatgtcatacattgaaattggtaaaaaagaaggccgtctcatgacgggcggagaaggagacagctctacaggcttcttcatccaaccgacgattattgctgaccttgatccagaagcggtgatcatgcaagaagaaatatttggaccggtggttgctttcagcaaagcgaacgattttgatcatgcactcgaaattgccaacaacacagagtatggcttaacaggagcggtgattacgagaaatcgcgcccacatcgagcaagcaaagcgagagttccatgtcggaaacttgtatttcaaccgtaattgcacaggagcaatcgttggctatcatccatttggcggctttaaaatgtctggtaccgattcaaaagcaggtggtcctgactatttagcgcttcatatgcaagcgaagacagtatcagaaatgtattaatcacagcaaggtatgggctcaggctcatacctttttcgtttactcgagacccagctttcttgtacaaa

SEQ ID NO: 151 - DNA, 1911 bp, Bacillus halodurans
ttcttgtttgttgattaacccttaattaatccgggcgcgcctgatttatcacaagtttgtacaaaaaagcaggctcctgcaggaccatgcgaaagacaaaaatcgtttgtacgatcggtccggcgagtgaaagtgtagaaaagttagaacaattaatggaagcaggcatgaatgttgcgcggttaaatttttcccatggggactttgaagagcacggtgcacgaatcaaaaacattcgagaagcagcgaaacgtatcggaaaaacagttgcaattttacttgatacaaaaggaccggaaattcgtacccaaacccttgaagggggcgtggccgaattaaaggcagggcaagagcttgtcatctctatgaaggaggttgtaggtacgagtgagcgtatttctgtcacatatccgggcctagttcatgatgttgtaccaggtgcaaaaattttattagatgatgggttaattgggctagaagtcgttgaggttcgcgatcaagagattttgacaaaagtcttgaacagcggcacattgaaaaataaaaaaggtgtcaatgtcccgaacgtaagcgtcaacctgcctggaatcacagaaaaagacgcagcggatatcaagtttgggatagagcaaggcgtcgatttcattgcagcttcattcgttcgcagagcgcaagatgtactagaaattcgcgaattgcttgagcagcacggggcagagcatattaaaatcatccctaagatcgagaatcaagaaggcgttgataacatcgaggaaattcttgaagtatcagacggtttgatggtggcccgcggagatctaggggtagagattcctgctgaggaagttccacttgtgcaaaagtcgcttattaagaaatgcaaccttgtagctaaacctgttattacagcgacacagatgcttgactcgatgcagcgtaacccacgtccaactcgagccgaagctagtgatgtagcgaatgcgatttttgatggaacggatgcgatcatgctttccggtgaaaccgcagctggggattatccagtcgaggcggttcagacgatgagccgaattgcagagcgtgcagagcaagccctaaactatcaagaaatcttgtccaagcatacaaaagaagcgagaacgacgattacgagtgctattagtcaatcggttggccacacagcattcaacttgaatgcaagtgcaatcttgacggcgactgaaagcggccatacagctcgcgtagtagcgaaataccgcccgaaatcaccaattgtagcagttacaagtaacgaaacagttgttcgtcaactcgctctcgtttggggagtgtattcaatccttggagaagaggcagagacgacggatgatatgcttcaagtgaccgttgagacagcgttaaagtcccaattggtgaaacaaggggatcttgtcgtcatcacggcaggtgttccagtgggagagacaggaacgacgaacattatgaaagttcacgtcattggtgaagtggtcgcgaaaggtcaaggcattggacgcgacacggtgaacggcaaagtcgtcattgctgctaatgcagaggaagcaaatgcaaaggttgaagaagggtcgattttagttactttcagcacggataaggatatgatgccagcctttgaaaaagcagccgccgtcattaccgaagaaggtgggattacatcccatgccgcagttgttggtctaagtcttaatacacctgtgatcgtcggtgtacaaaatgcgtctgcgctctttaaagatggggaagaaataacggtcgatacgagccgcggtgacatttacagagggcaagcaagtgtactataactcgagaccagctttcttgtacaaagtggtgataaattggagctctgcagagctttcgttcgtatcatcg

SEQ ID NO: 152 - DNA, 513 bp, Arabidopsis thaliana
cacataactcactctttcaatcatcaaccaacaacaagaaatccaataacttgaatcttttcatacatcttcagaagcttcaaaaagaattcaaacattttaaacaaaaaaacaatagatatggctttcgtgagaagtctattgggagcaaagaagattctaagccgctccaccggagcaggatctgcggcaccaaaagggtttcttgcggtgtacgtaggagagagccagaagaagagatatttggtgcctgtctcatatttaaaccagccttcatttcaagctcttctcagtaaatccgaagaagagtttggatttgatcatccgatgggaggcttaacgatcccttgtcccgaagataccttcatcaatgtgacttctcggctccaatgatgatgatccaacattttttccttcagttagaaatagacttattcattgtaaatagatgagccctttttcctctttcttcttgaaagagttgttctaaaagtgtagaaagtgaaatacaaa

SEQ ID NO: 153 - DNA, 705 bp, Arabidopsis thaliana
ttaattaaagctgaagattatcgtatcgacctgcgattctcttcagatcgataatccatggctgcagctggaaacaagagcattaacgccaaattggtgttgcttggagatgttggtgctggaaaatcaagtcttgtgttacggtttgtcaaagatcagtttgttgaattccaggaatcaaccattggtgctgcttttttctcacaaacgttagctgtgaacgatgccactgtgaagtttgagatttgggatacagcgggtcaggaacggtaccatagtttggctccaatgtactacagaggtgctgctgctgcaatcattgtttttgatgttacgaatcaggcttcgtttgagagggcaaagaaatgggttcaggaactgcaggcacaaggtaaccctaatatggtcatggcccttgctggaaacaaatctgatttattagatgcaaggaaggtgacagcagaggatgcacaaacatatgctcaggaaaacggtcttttcttcatggaaacttcagcaaaaaccgctactaatgtcaaagagatattctatgaaatcgcaagaaggctaccgcgagtacagccaacagaaaacccaacaggaatggttctgccagacagggccatggatagggcagtgagctcatcttgttgtgcttagttatattgtgtaatggcacacacttctcttaaaaagaggcgcgcc

SEQ ID NO: 154 - DNA, 1637 bp, Arabidopsis thaliana
ttaattaaaaatcactgacccgaaaataaaaatagaagcaaaacttcatgtcgtggtttctaatagcggtggcgacaatcgccgccgtcgtatcctacaagctaatccaacggctaagatacaagttcccaccaggcccaagccccaagccgatcgtcggtaacctctacgacataaaaccggtccggttcagatgttactacgagtgggctcaatcttatggaccaatcatatcggtctggatcggttcaattctaaacgtggtcgtatctagcgccgagctagcaaaagaagttctgaaagaacacgaccagaaactcgccgaccggcaccggaacagatcgacggaagcatttagccgcaacggtcaggatcttatatgggccgattatgggcctcattacgtgaaggtgagaaaagtttgcacgcttgagctcttcacaccgaaacgactcgagtctctcagacctatccgtgaagatgaagtcaccgccatggttgaatccgtcttcagagactgtaaccttcctgaaaacagagcaaaaggtttacaactgaggaagtacttaggagcggttgcgttcaacaacataacgcggctagcctttgggaagcgttttatgaacgctgaaggtgttgtggacgagcaagggcttgagttcaaggccatagtatccaacggtctgaagctaggtgcttcactgtcaatagctgaacacatcccgtggctcaggtggatgtttccggctgatgagaaggcgtttgctgagcacggggctcgtcgtgaccgcctcactcgagctatcatggaggagcatactttggcccgtcaaaagtctagtggagcgaaacagcatttcgttgatgcgttgctaacgttgaaggatcagtatgatcttagtgaggatactatcattggtcttctatgggatatgatcacggcagggatggacacgacagcgataacagcggaatgggcgatggcggaaatgatcaagaatccaagagtgcaacaaaaagtgcaagaagagttcgacagagtggttggacttgaccggatcttaaccgaggcagatttctcccgcttaccttacttgcaatgcgtggtgaaagagtcattcaggctgcatcctccaacgcctctaatgctacctcaccgaagcaacgcagatgtcaagatcggaggctatgatattcccaaaggatcaaacgttcatgtgaatgtgtgggctgtggctagagacccggctgtatggaaaaatccatttgagtttagaccagagagattcttggaagaagatgttgacatgaagggtcatgattttaggctgcttccgtttggagctggaagacgggtttgtcccggtgcacaacttggtatcaatttggtaacttcgatgatgagtcatttgcttcaccattttgtttggacacctcctcaagggactaaaccggaggagattgacatgtctgaaaaccctggactcgttacttacatgcgtacccctgtgcaagcggttgcaacgcctcggttgccttcggatctgtacaaacgcgtgccttacgatatgtaaatgtcactctgatctaccttttgttgctgctgctcaatttaaatacccagctttctaagggcg

SEQ ID NO: 155 - DNA, 1875 bp, Arabidopsis thaliana
ttaattaaagaaacatgttgagcaaatgaaggtttgtttgatgagatgggttgtgtattgggtcgacccggatcatcaggatcagtttctgggtctagagacgaagttagtactaggattgagtctaatcgacatcaagttaacaatgtgtctgtgaccaaaaccgaaacaacagagagcactagtgctgttgttgttgcttctgcttctaatggtgaggaagttaggaatcatgaagatgttgtggatcagaagaaagagaatggctttgttgtgactgaggccaaggagaggaaatcgaaaggcgaaagaaaaaggtctaagcctcctgacccgagacggagcaacccgccaaagaatttgctcggtgagcaagttgctgctggatggccctcgtggttgtctgaagtttgtggggaagcgttaagcggatggcttccaagaaaagcggattcctttgagaagattgataagattggatcaggaacgtatagtaatgtgtacaaggcgaaagattcgctgacaggaaacattgtggctttaaagaaagtgcggtgtgatgttaatgaacgggagagtttaaaatttatggctagagagattctgattttgaggagattggatcatcctaatgtcattaaattggaaggtttggttacttcgaggatgtcgagtagtttatacttggttttccgttatatggatcatgatttagctggtctcgccgctagcccggagataaaattcactgagcaacaggttaaatgctatatgaagcaactactttcagggctcgagcattgccataaccgaggagttctacaccgtgatattaaaggatcaaaccttcttatagatgacggtggagttcttagaataggtgatttcgggcttgcaacgttttttgatgcgagtaagaggcaagagatgacgaatcgggttgttactttatggtacagatcaccagagcttcttcatggtgttgttgagtacagtgtcggagttgatttgtggagtgctggttgcattttagctgagttattagctggtagagcgataatgccaggtcgtaacgaggtcgagcagttgcataggatatataagttatgtggatcgccttcagaagaatattggaagaagattagacttccttctactcataagcatgctcatcacaagcctttaccacagtataagagaagaataagagaggtttacaaagatttctctcctgaggcgctttctctactcgatacgcttctagcgctcgatccagctgaacgccagacagctacagatgtgttgatgagtgatttcttcacgacggagccattggcatgtcaaccttctgatctcccgaaatatcctccaagtaaagagattgatgccaagagacgagacgaagagtatcggagacaaagagaagcgcgcaaggcccaaggagagagcggaagaagaatgagaccccgagaacgagccccaagagcaatgccggctcctgaagccaacgccgagaaccagtctaacattgataggatgcgtatgatcacacacgcgaatgcaaagagcaagagcgagaagtttcctccaccgcatcaagacgggtcactcggttttcaggtgggatcttcaaggcgactggatccatcagagataccgtatagcacaaactcattcacatcatcatactccaaagagccatttcaaacttggtcaggccctttggctcccattggagcacctgactcaaccacaaggagaagaaacgatattaacaaagagagaagaatggcttctaaggtcaaaggcaaaagaatcgttgtttgagataataattattattcatctccaaatttcaaaagtttccggcgcgcc

SEQ ID NO: 156 - DNA, 1579 bp, Arabidopsis thaliana
ttaattaaaaactccggctccggttactcgggagttcaagttttggattttgatgggtcatgctcgaactcgtaccggtatcatctccgtcgcttttaaattcttcaggtctctgttccctcgccatcaccgtactaacagcatgaagataaaaacaggaacgtttttgggggtttcgatatcattgattcttataaacttagctgcgatcatggaacgtgcagacgagaatctattgccttcggtttataaagaagtgagtgaagcatttaacgcaggaccatcagatttaggctacttaacattcgttagaaactttgttcaaggacttgcatcaccattagcaggagttcttgtcattacctatgatcgtcccattgttcttgcaataggtactttctgttgggctttatcaactgctgcagttggagccagcagctacttcattcaggttgctttatggagagcagtgaatggttttggattggcaattgttatacccgcgcttcaatcgtttattgcagatagttataaggatggtgcgagaggagctggtttcggaatgttgaacctcattggtacaatcggtggtataggaggaggtgttgtagcaactgttatggctggttcagagttttggggcataccgggatggcgttgtgcttttataatgatggcagcgctcagcgcagtgatcggattacttgtctttctcttcgttgttgacccgagaaagaacattgaacgagaggaactaatggctcataagatgaattcgaactcggtttggaatgattcattagcagctgcaaaatctgtcgtcaaagtaagtacctttcagataatcgtcgcgcaaggaatcattggttcgtttccgtggaccgcgatggttttctttacaatgtggtttgagcttattggcttcgatcataaccagactgcagctttgcttggggtatttgctacaggaggagcgataggaacattaatgggagggataatagcggataaaatgtcgcggatatatccgaattcgggtagagtgatgtgtgcgcagttcagtgcattcatgggaatcccattctctattattcttctgaaagtaatcccacaaagcacaagcagctactcaatcttctcgataactctcttcctgatgggtcttaccataacttggtgcggatcagcggtcaatgcaccaatgtttgcagaagtcgttcctccaaggcaccgtacaatgatctacgcgtttgaccgtgctttcgaagggtcattctcatcttttgctgcgcctttggttggaattttgtcagagaaactgtttgggtatgactcaagaggtattgatcctttgaaaggttcctctgttcgtgaggctgatgccctttcaaaggggcttctgtcaatgatggctgttccgtttgggctctgttgtctctgttacactccgttgcattttgttttccagaaagatcgagaaaacgcgaaaatcgcgagctctaaagaaactgaaatgatctgagagacttgctcatgtagtcatgttgtgattctttttataccacaaacgaggcgcgcc

SEQ ID NO: 157 - DNA, 1488 bp, Arabidopsis thaliana
ttaattaaccaacaaaacacaaaacacaaacatagcattcaaaactttgaaaaatggcaccagctcctagtccaatcaattctcaacacgtggcggtgatcggagccggagcagccggtttagtagcagccagagagcttcgtcgtgaaggtcacaccgtcgttgtccttgaccgagagaaacaagtaggtggtctttgggtttacacacctgaaaccgagtccgacgagcttggtcttgacccgacccgacccatagtccactcgagcgtctacaagtctctccgaaccaatctccctagagaatgtatgggttacaaggatttccctttcgtgccacgtggcgatgatccgtcaagagactctagaaggtatccgagtcacagggaagttcttgcgtaccttcaagactttgctacagagtttaacatagaggagatgatccggttcgagactgaggttcttcgtgttgaaccggttaatggtaaatggagggtccagtctaaaaccggcggcggtttttccaacgatgagatctatgacgccgttgtaatgtgttgtggacatttcgcagaaccaaacatcgctcaaattcctggaattgagtcatggccggggaggcaaacacacagccacagttatcgagttcctgatccattcaaagatgaggtggtggtagtaatcgggaattttgcgagtggagccgatatcagtagagacatatctaaagtcgcaaaagaagttcatatcgcatctagagcaagtaaatccaacactttcgaaaaacgtcctgtacctaataacaatctctggatgcactctgagatagacaccgcccacgaggatggtaccattgtttttaaaaatgggaaggtggtacatgctgataccattgtccattgtaccgggtacaagtattactttccatttcttgagaccaataattatatgagagttgatgacaatcgcgttgaacctctctacaagcatatttttccacctgcgctagctcccggactttctttcattggtttacctgcaatgggtctacaattctatatgtttgaagtccaaagcaaatgggttgctgcagtcttgtctggacgagttacacttccttcggtagatgaaatgatggacgatcttaagttgtcgtatgaaacacaagaagcgttaggtattcccaaaagatatacacataagttgggtaaatctcagtgtgagtacctcgattggatcgcagacctgtgtggattcccacatgttgaacattggagagatcaagaagtaactcgcggttaccagagacttggtaatcaaccagaaactttccgtgatgaatgggatgatgatgatctcatggaagaagcatacgaagattttgctagactaaatctgatcaattttcatccttctcgttttctcgaatccggaagatgaagtttgactacgattgtaattgtgtctacttgtttggatttggcgcgcc

SEQ ID NO: 158 - DNA, 1478 bp, Arabidopsis thaliana
ttaattaagccaaacaaaagaagaaaagaaacacaaaatcaacaacaatggcggtgaagaagaaagtttcatggagatcactaatcgttggatgtttaggagatccagaaaccctaatggcatcttcaaagaaacctaaaagaaaaaatgacgtcatcaagaaacagagctcttttcaaagactatcgatacttgatatgagcaatccaagttccaacactttgtcagaagatctatcgatttctttggccggatcagatcttcatgtgtttaccctagcggagcttaaagtcattacacaaagcttttcatcgaccaattttctaggtgaaggtgggtttggtcctgttcataagggtttcattgatgataagctacgtcctggtcttaaagctcagcctgttgctgttaaattgcttgatcttgaaggtcttcaaggtcaccgtgaatggctgacggaagttatgtttttgggacaattgaagcacaaaaatttggtgaaattgattggttattgttgtgaggaagaacatagaactcttgtttatgagttcatgcctcgtggaagcttagagaatcaacttttcagaagatactctgcctcgcttccatggtcaacaagaatgaagatcgctcatggagctgcaacaggacttcaatttctacacgaagctgaaaatcctgttatctatcgggatttcaaagcctccaatatcttgttagattccgattacacggcgaaactctctgacttcgggttagccaaagacggaccagaaggagacgacactcatgtgtcaactcgagtgatgggcacacaaggctacgcagctcctgaatacatcatgaccggtcatttaacagcaagaagtgacgtatacagctttggagttgtgttgctagagcttttgaccggacggagatcagtagacaaaaagagatcatcgagggaacaaaaccttgtggactgggctcgtccaatgctcaatgacccacgtaaactatctcgaatcatggacccgagacttgaaggtcagtactcagagacaggagcaagaaaagcagcaacattggcttaccaatgcttaagccatcgacccaagaaccggccatgtatgagtgccgtcgtctctatactcaatgatcttaaagactataatgatattcctatggggactttcacttacacggtgccaaacactccggacaataaagaagatgatggtcgtgttggtaataagccacgtaagagtagtcatcatcatcatcatcaacaacaacaaagtaatcatccccggtcgtctccatctccgacaaccaagtctccatctcccacggccaagtcgccgaggaattcaacggaaaatcaccggagaacgttgagaaatggagtgaattcgccgttgagaagtgaggcaggtggggaacggtactaagtttttctagtcacaccaactcttaaaattcatttttattta

SEQ ID NO: 159 - DNA, 1126 bp, Zea mays
aactctttgtttcttgtttgttgattaacccttaattaatccgggcgcgcctgatttatcacaagtttgtacaaaaaagcaggctcctgcaggaccatggttacgctatgccatccgattcggatccgagcaagcgggagcaccgcgagctggcggaggagaaatgcggcggcggcggcgaaggtcctctgctccgtgcagcaaatgccgccgccgccgccggcggccacggctgcccagagcacgatcaaggtcgttatcgttggggcaacgaaagagatcgggaggacggccgtcgttgcggtgagcaaggccaggggaatggagctcgcgggcgcgatcgactcgcagtgcattggcgaggacgcgggacagataagtggcatggacgagccgctggagatccctgtgctgaacgacctcaccatggttctgggctccatagcgcagtcgagagcaaccggcgtggtggtcgacttcagcgagccttcagctgtttacgacaatgtcaagcaggcagcggcgtttggtctgagcagcgtcgtctacgttccgaaaatcgagctagagacagtgactgaactgtcagcgttctgcgagaaggcaagcgtgggctgcttggttgcgccaacgctgtcgattgggtccgtgctccttcagcaagcggctatacaggcctcgttccactacagcaacgttgagattgtggaatcgagaccaaacccatcggatcttccatcgcaagatgcaatccagattgcaaacaacatatcagaccttggtcagatatacaacagggaagatatggattccagcagtccagccagaggccagctgctcggggaagacggagtgcgcgtgcacagcatggttctccctggtctcgtctccagcacgtcgatcaacttctctggcccaggagagatgtacaccttacggcatgacgttgcgaatgttcagtgcctgatgccaggactgatcctggcgatacggaaggtggtgcggttcaagaacttgatttatgggctagagaagttcttgtagctcgagacccagctttcttgtacaaagtggtgataaattggagctctgcagagctttcgttcgtatcatcggtttcgacaac

SEQ ID NO: 160 - DNA, 1033 bp, Desulfitobacterium hafniense
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtaaaaattgcgccctccattttatcggcagactttgcccatttgggagatcaggttgccttagtggaaaaagcaggggctgaagtcttacatattgatgtgatggatgggcattttgtacccaacattaccattggccccctggtggttaaagcgctgcggccttattcccagatgcgctttgatgtccatttaatgattgaacatccggaacgctttattgaggaattcgcgaaagccggggcggatcatattacagtgcatctggaagccacgccccatatccatcgtgccatccagcagattaaggggttaggtcttaccgcaggagtttccattaatccggccacccctttggacggaatcaagtacatcctcgatgaattggatatggttttgattatgagcgttaatccgggctttggggggcagaaatttatccccgcggttcttcctaagattgaagttcttcaccggcatctcgatcagatgcaatcctcttgtgagattgaggtggacggaggaatcaatctggacacggctcctgccgtagtcaaagccggtgccaatatcctggtggccggagcggcggtatttgcctgcgctgacccggcccgggcagtccaagagctccgggaagcggcccaaggctataagggtgatccaaagtgaatttaaatacccagcaaatacccagcaaattggagctctgcagagctttcgttcgtatcatc

SEQ ID NO: 161 - DNA, 880 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcccgcacccaacgtaacgataatttcattgataagtcctttaccgttatggcggacattatcctaaaaattctgcccactaaccaaaaagcgaaggaagcctttgtttattatcgggatggtatgtcggcccaggcggatggggaatacgcagaggcgctggataactatgaagaggcgttacggttggaggaaaatcccaatgaccgcagttatattctctataacatggccctaatccacgctagtaatggagaccatgaaaaggcgttggggctttaccaagaagccattgaactgaaccccaaaatgccctcggcgttgaataacattgcggtaatttaccatttccaaggggaaaaggcgaaggaagcagggcaggaagacgacgcagagaatttatttgataaagcggcggaatattggaaacaggccatacgcctagcccctaataattacatcgaggcccaaaactggctcaaaatcaccgggcgctctgaaatggatgtgtttttctaaatttaaatacccagcaaatacccagcaaattggagctctgcagagctttcgttcgtatcatc

SEQ ID NO: 162 - DNA, 1167 bp, Arabidopsis thaliana
ttaattaaaatcagatctttcgcccaggattttcgctatttgttgaatggaatcgatggtgaagaaattgaagcaaaatctgagaactgggtcctggaaaaagaaggaaaaaagcatgaagaaggaaagatggttcttagagaatggaagtatcttcttaaaagagctcatcgttgattgtaatggtaaatccattcctatacgtagctttacttcttcccagattcgtaaagccaccaagaatttcgatttaagctgttttgtagctgaagaagggttctacatatggtacaaaggtgtaatcgaagatagatcttacatgatcaagagattctctgagtataaagtcactgattacagagtaagtgaggtttataaagacattgtcttgtctgctcgtatgagcaaccacaacaactttcttaaactactaggatgttgtcttgagttcccttttcctgttcttgtgtttgaatttgctgagcatggagttttgaattaccgaggaggtattacggttaacggtgaagagtctttattgcctttgagtttgaggttgaagattgggaaggagattgcaaatgccttggcttatcttcacatggcgtttcctaagatcatcatatatagagatgtgaagccactgcatgttttcttggacaataattggactgcaaagttgtctgatttatctttctcaatatcgctggaagagggaaaatcacagatagaagcggaagacgtgctgggtacatatggttaccttgatccattatactttgcaactagaattgtgacagaatatacggatgtgtacagctttggagtctttttgatggttgttatcactggtatatcggtttacttcaccggatctgatgggtatcctgtaggtattcttggatatatgaaaggcttagctgagaatgggaagctcaatgaaatagtatatcctatgataatgaaagagatgacaagtgctcaaagattgcaggtggaagcatgcgttttacttgcactgagatgctgcgaggagagggtagaagacagaccgaagatgattcaggtagctaaagaactcaagcggattgaacatcatgttttgagatcctagctagagatcagctctactcttagactgtatagccaagtttcaaatggcgcgcc

SEQ ID NO: 163 - DNA, 1986 bp, Arabidopsis thaliana
ttcttgtttgttgattaacccttaattaatccgggcgcgcctgatttatcacaagtttgtacaaaaaagcaggctcctgcaggaccatggcgactgttcatgctgcattacatgcggcggatgcttcttcttcgggatcgagttctccagtgacggcgtcgttatatgtcggagacttacacccttccgtcaccgaaggtatactctacgacgcgttcgccgagttcaagagcttaacttctgttcgtctctgtaaagacgcttcgtctggtcgctctctctgttatggctacgctaactttctctcgcgtcaagacgctaaccttgccattgagaaaaaaaataacagtttgttgaatggaaaaatgattcgagtaatgtggtctgttcgagcacctgatgctaggagaaatggggttggaaatgtctttgttaagaatttgcctgagtcagtcaccaatgcggttctgcaagatatgttcaagaaatttgggaacattgtttcctgtaaggttgcaactcttgaagatggaaagagtcggggatatggttttgttcaatttgagcaagaagacgctgcacatgctgctattcagaccttgaatagtaccattgttgctgacaaggagatctatgttggaaaattcatgaaaaagactgatcgagtgaaacctgaggaaaagtacacgaacttgtacatgaagaatctcgatgcagatgtcagtgaggatcttttaagggaaaagtttgcagagtttgggaaaattgttagcctagcaattgcaaaagatgagaaccgattatgtagaggatatgcatttgtcaactttgacaacccagaggatgcaagacgggcagctgaaacagtgaatggaacaaaatttggttcgaagtgtctatatgtaggaagggcgcaaaagaaagcagaacgggagcaactgctaagggaacaatttaaagagaaacatgaagaacagaagatgatagccaaggtgtcaaacatatatgtgaaaaacgtcaatgttgctgttactgaggaggagctgagaaaacacttcagtcaatgtggcacaatcacttcgacaaagctgatgtgtgatgagaaaggaaaaagcaaggggtttggatttgtgtgcttctcaacacctgaagaagctattgatgctgtgaaaacctttcatgggcaaatgtttcacgggaaaccactatatgtggctattgctcaaaagaaagaggacagaaagatgcagttacaggttcaatttgggaaccgtgtggaagctagaaaaagcagctcttcagcttctgtcaatccagggacatacgctccactttactacacaaacactcatcccgggatggtatatcaatcatacccgctgatgtggaagtctgctaacatgattggttcatcatacccaaactctgaagcagtcacatatcccccaatggttgctaatgcgccaagtaagaataggcagaacagaataggaaagttggataggaatgctgtttcgtatgtgccaaatgtgtatcagtctactcaaatgcttcctttgtcaagagatttttcgaagcagcagcatagcagaacctatggtcgtgggaaagaaatgaagaaatcaatccaacagagacagtctgaaacagttgggatggagatgcaattgctcggagagttgctacaccctcttgtcgagaaactggagccccagcttgcaaacaaaatcacagggatgcttctggaaatggacaagtcggaattgcttcttttgctgaaatcaccagaagacttggctgttagagttgatgaagcgtttgaagttctgaaatcatccaagacaaatctgaccgctccaaacactcatcgttctgattacttggcgtctggcattgctggcgtttcgattaagtgactcgagacccagctttcttgtacaaagtggtgataaattggagctctgcagagctttcgttcgtatcatc

SEQ ID NO: 164 - DNA, 1698 bp, Arabidopsis thaliana
ttcttgtttgttgattaacccttaattaatccgggcgcgcctgatttatcacaagtttgtacaaaaaagcaggctcctgcaggaccatggctatgatgagaacttctcctagagattcgataagcaatttgccagatgagattcttggcaaaatcttgtctttgctcccgacaaaagtggctgcttccacatcggttctgtccaagaggtggaggaatctgttgggtcttgtagacaacctctgctttgatgagtcgatggttgtttatcccaacgaagaagaagaaacaagtggttcacttcgcttctgtgatttcgtagacaagacatttgctctgttaagcaattctcacatcaagaagttctctctgtctcgtgtatataagtataacgatgatgtagacggtatggtccggcgttggattcggactgtaatggaacgcggtttattggaaatacacttgcacgccacccccatgtcttttgttgccatagaaactaagctgttaacgagcaacacactggttaagctcacactatccgctcgatgttttgttgaagtagagcgtgtgtttttccctgccctcaaatcactttctctcttctcaattctgggtgattataccaactatatacggctcatcgatggctgccctgtgttggaagaattatacatgcgtgatggtgattatccgttcttgcggcttacttgtggtaccaacgtggaaagtgcatccctcaagcgacttgtgatttttacccataatccaaatgaaatgatttggcacgaactgatttattttgaagcaccaagtcttgtctaccttgactattccagttatgtctcggctaagtatgatgttgttgatttcgatttgcttgtcgaagccaggctgagtctcaggttatgggtgtcaactaacgattatgattattctgatgatgatgatgatgatgatgatgatgatgatgatgatgatgatgatgatgatgatgatgatgatgatgatgatgatgatgatgatgatgatgatgatgatgatgatgatgatgatgatgatggtgattattatattgtagaaccaaaggcgcctatatttggtgatgttacagaactacttgcggctatacgcaacattacgacccttcacttgtctcctgattcccttgaggtgtttcatttctgctgtaaatccatgcccgtgttcaacaacctccttaatttatctattgagagtaacaaggataaaggttggcaagtaatgccacttctcctcaagagttgtccaaatctacacaccttagtcatcaagggtcttgtccacagagtaactagtagatgtggagatgcatgcgcttgcatacctaagaagcagaggaagattgtacagaaagaagaggcattatgttgtctgcggacatgtcaagtgaaggtgctacagatttcagagtatggaggttattttcaagagctgaaacagatgagacatttcttgggcaagttggaatgtcttgaaaccgtgaaagttggtgttcacgcagaaaacaacaacaacagtgagttcttgcgagctaatgtgctgactcttcccagagtttcagcaaagtgcaacgtccacttcatctgactcgagacccagctttcttgtacaaagtggtgataaattggagctctgcagagctttcgttcgtatcatc

SEQ ID NO: 165 - DNA, 899 bp, Arabidopsis thaliana
ttaattaattgcaatggatcttctcaagactccttcctccacggttggtctatcagaaacattcgctaggttaaagtcacaaggcaaagtggctctgattccatatatcacagctggtgatcctgatctttctacaacagcgaaagctcttaaagtgcttgattcgtgtggctccgacataatcgaactcggtgttccatactctgatccattagctgatggtccagcaatccaggctgctgcgagacgttcgttacttaaaggaaccaactttaactccattatctctatgcttaaagaggttattcctcagttatcttgtccaattgcattgtttacatattacaatccaatcctgcgacgaggagtagagaactacatgactgttataaagaatgctggagttcatgggcttctggttcctgatgttccactcgaggagactgaaactctgcggaacgaagctcggaagcatcaaattgagctagtactgctcacaacacccacaactccaaaagaacgaatgaatgccattgttgaagcctctgaaggatttatctatctcgtaagttcagtaggggttactggtacaagagagtctgttaacgaaaaagttcaatctcttctacaacaaatcaaagaggcaactagcaagccagtggcagttggatttggcatatcaaaacctgagcatgtgaaacaggtagctgaatggggagcagacggagtcattgttggtagcgcgatggttaagatcttgggcgagtctgaatcacctgagcaaggacttaaggagctagaattcttcactaaatctttgaagtctgctcttgtctcttgaatacccacaatgattctttcttaattgaatgcaaagaaccagatgaagctggcgcgcc

SEQ ID NO: 166 - DNA, 1227 bp, Arabidopsis thaliana
ttaattaatcgaaatccctaatctactctctcttctctatatctctactcttgagaaatggctcttagaactgtgctcgtctccgacgtccctagcctcccggattctgtctacggtttatccgaaggtttagagttgagcaaaccgacgtcgtttaggttaccggggttttcggtgattggacatagaggaatcggtatgaatgtgttgcaatcgtctgatcggagagcgagaggtgttaaagaaaactcgattctttcattcaattccgccgctaagtatccgattgatttcattgagttcgatgttcaggtgacaaaagatgattgccctgtcattttccatgatgatttcatctactctgaagaaaatggtattgttaatgagagtagagtgacggatctgagtctgtctgagtttctcctttatggacctcagaaggaaactgagaaaatagggaagacactgatgaggaaatctaaagaagggaaggttttgaaatgggacgttgatttggatgattctctttgtacgttgcaagaagcttttgaacaagttgaacaaactcttgggttcaatatcgagttgaaatttgatgatcagaccgtctatgaacgagagtttcttgtccatatcctgagatcagtactacaggtggtctctaattatgctaaagacagaccagtaatcttctcaagtttccaaccagatgcagctaagcttgttagggaactgcagagcacttaccctgttttctttctgactgatgcgggaaacgagattcacaatgacgagagaagaaactcgctcgaagaagccattcaagtttgcttggaaggaggtcttcaaggtattgtttcagaggtaaaaggagtgttcaggaacccagcagccattagcaagatcaaagaatctaacctctctctcctcacatacggcaaactcaacaatgtcggagaggcagtgtacatgcaatatgtgatggggatcgatggagtgattgtagattttgttgaggagattatagagtccacgacacgcatgatgataagaccaccaccatcatcatcaccattaccatcaccttccaaggatgatgatgttgccattacaagacctgagttttcacagaaggagatttcttttcttctcaagcttctctctcagttgatacaacattgatatctctgttttttcgttttcttttatcccaagtttcggcgcgcc

SEQ ID NO: 167 - DNA, 1539 bp, Zea mays
ggcaatccgagacgccggaggcctcctcctctcctaatacccgccccccctcgggaccgggagggagtccgccgcggtgcggatcgcggccacggccacggaaacaccggggcgcggctcatggaccgcatcgtcggcggcaagttcaagctcggccggaagatcggatgcggctccttcggcgagatctacctcgccacgcacgtggacacctacgagatcgtcgccgtgaagatcgagagcagcaagacgaagcatccacagctgttctatgaggcgaagctgtacaataccctccaaggaggaagtggcattgctaacgtcaagtggtgcggtgtggatggagaagagaatgttctcgtcattgatttgctgggtccgagtttggaggacctgttttgttattgtggccggaaattcacgctgaagactgtcctgatgttggctgaccagatgattacaagaatagagttcatgcattccaaagggtacttacacagagacatcaaacctgacaactttctgatgggtcttggtcggaaagcaaaccaggtatatataattgattttggccttgcaaaaagataccgtgattccactacgaatcgccatattccttacagagaaaataagagcttgactggtacagcgcgctatgcaagttgcaacacccaccttggaatagaacaaagccgcagagatgatttggtatctctaggctatgtgcttttgtattttctccgaggaagccttccttggcagggactaaaagccgcaacaaaggcacagaagtatgacaagatatgtgagaaaaagatatcgactcctatcgaggtcttatgcaaatcctgtccggtccagttttcatcttacttccattattgccattcattggcatttgatcagcgacctgactatgcatttgtgaagcgacttttccgtgacttgtttatcagccaagattatgagtttgattatgtcttcgactggacagttttgaaatacaaacaaggccacaaacaaaagcaaagtcctggggcacctattgctcgacctattcaagcacatggaccgaaacaagcaggtgtaaatggtgttattaatcataacgaagcccaggagcatgtagagacaagtcgtccaacagggcaagctgcatggtcgcaagacaaacaggcaaccaacaatgatcggaatcctgatgtgcggcataccgtgaaccttagacaagacatggctgctggaaaagcacagctgacaacatctgtggctcttcctagttcccagtggaaaaattatagcgattcaagacataaaggacaatttgatgctgttcaccacaatcagggtattgtaaacataactagctcatctaacagttggcttcctacattccagcacaatgccccaggaaaatgacagatcatatctggtggagcaaagaggaagtgctttgagagttagaggaggcccctgttcatctgagttggttcagagttaagcattgcacaatctgtagacttgatgtctcatgtattg

SEQ ID NO: 168 - DNA, 1602 bp, Saccharomyces cerevisiae
aaaaagtagacgaagaagctcatctcatcgcgatattagttcgatatctgggtttgagtgagtagtatgtttaataataaaagagtataatccagatatagcagacaataaaatttcaagatggccaagagaagacaaaagaaaagaacacatgcacagcttacacctgagcaggaacaaggtatacctaagtcaatggtaatcagagtgggtcaaacttctttggccaaccattctctgaaccaattagtaaaggacttccgccaaatcatgcaaccacatacggctataaaattgaaagagcgcaagtccaataaactgaaggatttcgttgttatgtgtggcccattaggtgttacgcatctttttatgttcactcaatctgaaaaaacaggaaatgtctccctaaagatagctagaactccgcaaggtcctactgttacttttcaagtattggactattctctgggtagagatatcaaaaaatttttgaagagacctaaatcgttgaataatgatgatgtattaaatcctccattgctagtgctaaacgggttttccacatccaaaagatctggtgaagacgaccaggatgtaaacgtggagaaggtcattgtttctatgtttcagaatattttcccacctctgaatcctgcgagaacttctttgaattctatcaaacgtgtatttatgatcaataaagacagggaaacaggggaaatttctatgcgccactattttattgacattcgagaagtagagatctctagaaacctaaaaaggctttataaagccaaaaataatctaagtaaaacagtgccgaatttgcatcgaaaagaagatatttcttctttgatattagatcacgacttaggcgcctatacatcagaatctgaaattgaagatgacgctatcgtgagagtagttgataatcaggacgtgaaggcaaagcattctcaaagtttgaagtcccaaagaacaccggtcgaaaagaaggataataaagagcgtgaaaaagaaacagaagaagaagatgtggaaatggaggaacctaagccttcagaaaacttgcaaccaaccccacgtaagaaagctatcaaactaactgaattaggaccaagattaactttaaaactggtcaagatagaagaaggtatttgttcaggtaaagtgttacatcatgaatttgttcaaaaatcaagcgaagaaatcaaagctttagaaaagagacacgctgcaaaaatgaggctgaaggaacaaagaaagaaggaacaagaagaaaacattgctaaaaagaaggctgttaaagacgctaaaaagcaacgtaaattggaaagaagaaaagctagagcagcagaaggaggtgaaggtcaaggaaaagatgatgcgatgagcgatgatgagtcttcatcaagtgacagcgaacattatggtagcgtaccagaggatctagatagtgacttatttagtgaggtcgaataaattgttctccggtaccaagaaaattttagttaagcctggctatccaccaacgcacgtatacttcttcactttagataaattgcatacttgatacatataaactctttgtcttttaaatca

SEQ ID NO: 169 - DNA, 1240 bp, Zea mays
ttcttgtttgttgattaacccttaattaatccgggcgcgcctgatttatcacaagtttgtacaaaaaagcaggctcctgcaggaccatggctgtggaaagagatatatttggaatttctgggccaacgtatctgaaatcaattgattggaactgtgagcataatcggagatctgtggctgcaagcttagttcaggctgtatatgtgttggagagagaccggcaactgaatcatcaatcttttgaagccttggcacctgcttggtgggaattcctccattttgagctgattcgcaagctgattgatgatgctgatatgtccatatttggtgcaatatttgaattcaaccctccaagggaggaagcttctggtgcaaatgctccaagatttgtcatcgcattcagaggcaccataacagagaaggatactatctctagggacctttccctggacctgcaccttgttcaaaatggtctccacaggacctcgagatttaatatagcaatgcaagctgttcaaaacgtagcctcggttttccctggatccacgatttggctagcagggcattcactaggcgctggcctggccatccttacgggaagaaacatggttaagaagggtgtgcttttagaaagctttctcttcaacccaccgttcgttgctgctccagttgaaaggatcagggacgaaagggtaaagcacggatttcgtattgcaagaagcgtgattactgctggattgactattgccatgaaagctaaaactgagggtagcagtcagagatccgtcgctgatgaatctttcagcattttgtcatcatggacgccgtatctgttcgttaatccaggggaccacatttgctcagagtacatagggtacttccagcaccggaagaacatggaggatcttggtgccggatttatcgagaagcttgcgacacagaattccatcggagacctgttcttcaaggcactagggtgggagtcagaaccgctgcaccttcttccgtctgccgatctaatcgtcaacgtgagcccttcgtctgatttcaagtacgctcacggcatcagccagtggtggcaacctgagctgaatttgcagtgcagtaaatataggtactcatagttgtacgtcactagaaatgatgtctcagaaacttagttatcctctcctcgagacccagctttcttgtacaaagtggtgataaattggagctctgcagagctttcgttcgtatcatc

SEQ ID NO: 170 - DNA, 2227 bp, Arabidopsis thaliana
ttaattaaatgggttgttgttactcactatcttcaacagtagatcctgttcaagaccacacgaccgatgcttcttccgaacctagaaacggcggaggagaagatccaccattgacaaaattctctttttccgctctcaagacggccacaaatcattttagtcccgaaaacatcgtttcagatcaaacctccgatgttgtctttaaaggacgtttgcaaaacggtggtttcgtcgctatcaagagatttaataacatggcttggtctgatcctaaactatttttggtacgtagcttttgttttgtctgaaaatgcttatcatttttgtggcggttattgatcttatttgatggggttttataggaagaggcacaaagagtagggaagttaagacacaagagactcgtaaatttgattggatattgctgtgatggagataaaaggtttcttgttgcagatttcatggctaatgatactcttgcgaagcgtttattccagcgtatgattcattctcttcataccttattttattttcacattttagggtttgtggatttgatgatatagaggttgtttcgttgttgggttatatgacatgatgtgtgcatggttcatatcaatgtatatgcttgtagtcgtagaaacccgattgaatcagaacttgctagcattttttgttttgtatcacagggaaatatcaaaccatggattggtctattaggttaagagtcgcctattttgtagctgaagcattggattattgcaacactgcaggctttgcatcatacaataacttaagcgcttacaaggttttgtttgatgaggtatagaagaggaatccttttcatctatatgccttctcgtgtggtctctaaaatgtcataattgttttaatggatgtggaaggatggtgatgcatgtctttcttgtttcggcttgatgaaggagattaataatgatcaaattacaacaggtaattaattagcgtttctctcttcagatttattataagaattaatgtgatgtttattttatcattgtaggaagtgtgaaccctgaaaatgtgatataccgatttggtactgtccttgtgaatcttctaagtggaaagcaaattcctccaagccacgtaaatgattatgctcaagttgtctctttgcttttttagggttttggatcaacagttcatcttgactttgtaattgtaatcataaggcttatctagcattgtcattttcttgcaagacaagccaattaattcttatatatgtttctaggctcctgagatgatacatcgaaagaatgtgtttaagttgatggatccatacctgaaggggaagttctccatagatgaagctaacgtagtttataaactcgcctctcaatgtttgaagtacgagggtcaagagagtcccaacacaaaagagattgttgcaacgcttgaaaccttgcaaactagaacagaagtaaggagctcattgcatccataattgaattcttgatcttttatctcgcatttatgttggagtcgatcttcttgcttgtaggctccatcatatgaagttgttgaaatgacaaaccaagagaaggatgcatcatcgtcaagtaatctttcgccactaggagaggcttgtttgagaatggacctcgcatcgattcattcaatcttggtcttggcaggatatgatgatgacaaggatatcatcgaggtaaccaaactatcatcaagttaaacttgtacaactagtttgggatcaaagatcttactttactttaatcttttcatgagctaagttatctttcgaagaatggatacaagaggtgaaagaacttcaagatgttcgaagaaacggtgatcgagccttcgtagagcaagacttcaaaaccgctattgcctgttattctcaggtagttaacattctccgccttatcatgcatattagtagaatctctatttttaactttgtttttgttttttgtccacagttcgttgaagagaggtcattggtatacccaagtgtttacgcaaggcgtagtctaagctatctattctgcgatgagccagaaaaggccctcctcgatgggatgcatgcacagggagtgtttcctgattggccaaccgccttctacttgcagtctgtggcattagccaaactcgacatgaacactgattctgctgatactttgaaagaagcagctcttcttgaagtaaagaaatagggcgcgcc

SEQ ID NO: 171 - DNA, 1218 bp, Arabidopsis thaliana
ttaattaatcttacctgagtgaaacatggtcgacgttgaccggagaatgaccggtttgactccggctcacgcagccggtctccgccgtctctcagctcgcgccgccgctccatccactcctacgatcagaaacagccttcaatctttctcccctttcgccgataaagtaatcaatcatcttaaaaattcaggtatcaaaatccaaccaggtctctccgacaccgagtttgcccgagtcgaagccgagtttggtttcaccttcccaccggacctccgtgttatcctctccgccggtctctccgtcggcgcaggattcccagactggcgttctcccggagctcgtctccacctccgtgccatgatcgatttaccagtcgccgctgtatcgttccaaatcgctaaaaacagtctctggtgcaaatcttggggcttgaaaccacccgacccggaaaaagctttaagggtcgcgagaaacgccttaaaaagagctcctttactgattcccatctttgatcactgctacattccttgtaacccgtctttagctggtaatccggttttcttcatcgacgagactcggatcttctgttgcgggtcggatctatccgagttcttcgagcgtgaatctgcttttcgaagctctgaattcttcccgagaattctcactaagcaacgttcagtgagcgagaaatcagctggatcatcctcgaatttttcccggagaagcttagatttgggtcgggctaatggtgcgggtaagtcgagatgggttgagttttggagtgacgcggcggttgatcgttgccggcgaaactctgcctccacatcatcgtcgtcttcttcatcgccggaccttcccaaaacagagactccgaaatgggtgaaccagtacgtaaaccggatcggttcggttttaagaagaggcgggtggagcgaatccgatattgatgagattatccacgtgtcagcatcgggtttctttgagggcgaaatggtaattatcgataatcaaactgttcttgatgtgcttctattaaaagcgggtcggatctcagagtcgctccgtaaatccgggtggagctccgaagaagtctcggacgcgcttgggtttgattttcgaccggaaaaggagaggaaaccggttaagaaactctcgcctatgctcgtcgaacaattcgaaaaacttgctgaatgggtttctcagtcatgaggcgcgcc

SEQ ID NO: 172 - DNA, 1944 bp, Arabidopsis thaliana
ttaattaaaagaacatttccctcaggttcagatcgcctgaagttaaacaaaaaaaatgctccggtcacttcttctccgacgctccgtcggccattctctcggaaccctatctccgtcttcatccaccatccgttcctcattttcgcctcatcgtactctctgcaccaccggtcaaacattgacaccaccaccgccgccaccgccacgtcctccacctccgcctccggccaccgcctcagaagctcaattccgtaaatacgccggatacgcagcactcgctatcttctctggagttgctacctatttctcatttccattccctgagaatgctaaacacaagaaggctcaaatcttccgttacgctcctttacctgaagatcttcacactgtctctaattggagtggtactcatgaggtacagactaggaactttaatcaaccggagaatcttgctgatctcgaagctcttgttaaggaatctcatgagaagaagttaaggattcgtcccgttggatcgggtctctcgcctaatgggattggtttgtctcgctctgggatggtgaatctggcgcttatggataaagttctagaggtggataaagagaagaagagagttacggtgcaggctgggattagggtccagcaattggttgacgccattaaagactatggtcttactcttcagaactttgcctccattagagagcagcagattggtggtattattcaggttggggcacatgggacaggtgctagattgcctcctattgatgagcaggtgatcagtatgaagctggttactcctgcgaagggaacaattgaactttcaagagagaaagatccggagctctttcatctagctcgatgtggccttggtggacttggagttgttgctgaggtcaccctccaatgcgttgcaagacatgaacttgtggaacacacatacgtctcaaacttgcaagaaatcaagaaaaatcacaaaaaattgctctctgcaaacaagcatgttaagtacctatatattccttataccgacacagtcgtggttgtaacatgcaatcctgtatcaaaatggagtgggccacctaaggacaaaccaaagtacactacagatgaggctgtacagcatgtccgtgatctctacagagagagcattgtgaagtatagggtccaggactctggtaagaagtctcctgacagcagtgagccagacatacaggagctttcatttacagagttgagagacaaactacttgcccttgatcctctcaatgacgttcacgttgcaaaagtaaatcaagctgaggcagagttttggaaaaaatcagaaggatatagagtagggtggagtgatgaaattctgggctttgactgtggtggtcagcagtgggtgtcagaatcttgttttcctgctggaaccctcgccaaccctagcatgaaagaccttgaatacatagaagagctgaaaaaactaatagaaaaggaagcaataccagcacctgctccaatagagcagcgatggacagctcgaagtaagagccccattagtcctgcattcagcacttcagaggatgatattttctcatgggttggtataatcatgtacctcccgacagcagaccctcgccagagaaaggacatcacagatgaatttttccactatagacatttgacacagaaacaattgtgggatcaattttctgcgtatgaacattgggctaaaattgagataccaaaagacaaagaagaacttgaagccttacaggcaagaataagaaaacgtttcccagtggatgcatacaacaaagcacgtagggagctggacccaaatagaatcctctccaacaacatggtggaaaagctcttcccagtctccaccactgcttaaaacattttcatcaataggttttttcctctttttgggatcctatacatcggcgcgcc

SEQ ID NO: 173 - DNA, 935 bp, Arabidopsis thaliana
ttaattaagatgaatggaggaggctcgagtagtttgcgttcagcattgtcctattgtgtgcagcaagtacgaaactatgactatcatcactacctctgtctccttgaactcccaactgagatgcgtaaagcagcatttgctctccgggcttttaatgtagaaaccgcaagagccatggatgttgcatctgatcccaaaatcggcttgatgcggttactttggtggcaagaagcaattgacaaactctacaccaaaaagcccataaaccatccagctgcacaagctctgtcttgggcaatatcagaacataacatcagtaaaccttggctaaaacgctcagttgacgctagaatccgagatgcccaaagagaagtagacgatataccagagagcattgcggagctagagaaatacgcagaagacacagtttccactcttctgtacaatacactccaagcaggcggaattagttcaacaacagctgatcatgcagcttcacacattggtaaagccagtggtcttgtcttgctgcttaaatcattaccgtaccactgtaccagaaaccgtcaccagagttacatccctgcagatctcgctgagaagcacgggttgctcgtgaaacaaggtggacgattagaaattcttctggataacgattcaagagaaggactaagcaatgtcgtgtttgagattgcatctgttgccaatgcacatctcctgaaagcccgtgaactggcgggaaaggttcctgcagaagctaaaccggtactgcttcattctgtgccggtacaagttcttctggattcgttaaataaagtacaattcgatgtgtttgatcccaggattcaaagaggagttcttggtgttcctccactcttgtttcagtttaaactcaagtggtattcatggagagcaatgttttgaaaaggcgcgcc

SEQ ID NO: 174 - DNA, 2146 bp, Zea mays
ttcttgtttgttgattaacccttaattaatccgggcgcgcctgatttatcacaagtttgtacaaaaaagcaggctcctgcaggaccatgtcggccggctccacggcgtccctcctcgcggccgtcatctgccttgccctcgccgtgcttgctcccgtcgttcctggagatggtgccacattggaatcagttccagaccttgtgaaggcaatgtacctaaacgttgaaagcttcccttgtgtgaggctgttgaatctttctggtgaaattggctgttctaatcctggaagtgagaaggtcattgcaccaattgtaagacttagaaaaggcagtgatcaattggttcaaccatctactattctcctttccttagatcagatgtcagatttctttctgagggtatccaatgatccagaacttcaccagaaggtggcaggtgtattggttgagtcaaatggtgtcaacaatgacttacaagagctgtctcctgatagaaaatttccacaagatgattttgcaccctactcaaatcacagccatgattggaatcctgctggatcaggtatcatgtggaacaaatataattttcctgtatttctactttcagaagagagtacaaacactcttcaaaagatttcagaaaaaaatgagaagactggcaatggatataaagcaaatgttgcagaattcgaccttgttatgcagacaaccaaagctcaaacacatgattcagcatcctgcctcaaagaacaatcatgcttgcccttaggtggacacagtgtatggacttcattaccgccacttaataacggatctacagagcatccgaaacctttaatattggctattgcgtctcaagactctgcatcattttttcgggaccgtagtcttggttcagattctcccatatctggattgattgctttgctcactgctgttgatgctctttctcacattcatggtctaagcaagcttaagaaacagcttgtgttcgctgtttttaatggtgaggcctggggttatcttggtagtcggaaattcttacaggaattagatgaaggcgctgcttctgtgaatggaattagtagcttaaagattgaccaggtactggagattggttctgttggcaaggctatacttgaggaatatccatcattttatgtgcatgctgaagggaatccatcagcttcaaaggaaatattagatgcactgcaaagtgccagcaagtctcttggttctgataatgttaaagtaaaacaagcagcttcatcaaatcctggtgttccaccatcttcattaatgtcattcataaggaagaacatgtcaacttctggagttgtgttggaggattttgattcccacttctccaatagattttatcatagctatctggataactctgtaaacatcaattcctcgtcaatagctgcagccgccgctttggttgcgaggtcgatgtatattcttgctagtgatgactcagttgttgaccttataacactaaacactataaaagtgaacgtttcattggtcgaagaacttattggatgcctgcttacttgcaatcctggtctttcgtgcggccttgtgaaaagattcatttctccaagcaatccctgcccaagtcattatgttggtgtttttctggatgacccatctggcacgcagcttccttcatatgcagatgacacgtctcggtttgtatggaactttttggcagacagaactaattcagcaggcaataaaagctcatgtactggaaagtgtggtgatgaaggtgaagtatgtgtaggggcagaggtggagggtggaggtagatgtgttgtatctacaaccaggtatgttcctgcttattcaactcgggtgaagtttgaggacaatgcatggcacgttcttccagcgaactcgtcagatccaatgggtgctgcagatcccgtgtggactgaaagcttctggaacactattggcctcagggtctacgccgtgcaagatccagcttacgattggcttattcttcttgccgggctcggaatcactgctgcatcttattgcgctgtacactttggcagagcatacatttcaaaggtggcgaagcttgactgactcgagacccagctttcttgtacaaagtggtgataaattggagc

SEQ ID NO: 175 - DNA, 1779 bp, Zea mays
ttcttgtttgttgattaacccttaattaatccgggcgcgcctgatttatcacaagtttgtacaaaaaagcaggctcctgcaggaccatgtctcctttggctcttctccaagctctcatcttcatcctgtgctgctcgcctctggcttctgcttcctcgtcggagctaacccttgcaggagctgcttgtggagatgatcagcttgtcatcttcgatgcttctgatggcctccttaacctgtcggtcaatggggttctgatgcaagatcgcgtttttgcctgccagaagctcggcttctactttggcagtggatgcctccgctgcagcaacctttcagatgcgtggaggagtgccgtaaagcagtactgtggtgaagggagcgaaaagagccatgcaactttacatcaagatgtgccaaggaagctcttgaggtggtccacagaaaatagctcaaggaatgcatgtgaaaggtctgggttgaatgaaaataatcaggacattggtgattcttcagaaaagcaggagcatctcctggctgtgccaggtgtgattctcttatgctgtggccttatgttaccatgctttcatgctgaaaggaaagaagtcagcaggcatgacaatgcaaccattcagcgcaacgcacttgaatcagtttcatcctatgaaggaagcatgtcatctgagaaagtcccaccaactccacatcgaatacctccaagtccctctagatttgcgccgtctccacagatagctagagttggatctgtcaacttaagcatccagcagatcctcagggcaactcagaacttctcaccttcatttaagttaggtgaaggaggatttgggatggtctacagggctgtattgccagatggcaatgttgttgcggtcaagagagctaaaaaggatcagtttgcaggtcctagggatgagttcagcaatgaagtagacttgcttgctaagatagaccaccgaaatttggtgaggttactgggttttactgataaaggaaatgagcgcattatcatcactgagtatgttccaaatggtactcttagagaacatctagatggtcaacatggaagagtcctagattttaatcagcgtctagaaattgcaattgacgtggctcatgcacttacttatcttcatctgtatgcagagaagactataattcatcgtgatgtgaagtcatcaaacatcctgctgacagatagctatcgggccaaggtgtctgactttgggtttgcaagaagtggccctagtgacacggagaagacacacatatcaacgaaagtgaaaggcacagctgggtacctggaccccgaatacttgaggacataccagctaactccaaagagtgatgtcttctcatttggcatattgcttgtagaaattctttctgctcgcagacccgtagagctgaagcgaacccctgaagagaggatcacaatcagatggactttcaaaaaattcaacgaaggcaacacgagagagatactggacccattgctggaagatcacgtggacgacgaggtgcttgaaaagctccttagcctggctttccaatgcgctgctccgacacgggacgaccggccgaccatgaaggaagttggggagcagctgtgggagataaggaaagagtacggaaagagtgttaggaaggtgtgaagatcatggaaaacatttccctgtttctcaagactttccctcgagacccagctttcttgtacaaagtggtgataaattggagctctgcagagctttcgttcgtatcatc

SEQ ID NO: 176 - DNA, 411 bp, Arabidopsis thaliana
atggacattactgttcgaatctccggcttaaaatcctccaatctaatccggataacccctagattctcatcttcctctagattccgttgctccaacaacgaacctcctcgaaagggaaacgagtccaacgcaggtggtggtggtgataaagcgtcgacggactgggacaaggcgtggaagaatttcaagaagcagagcaagaagtcattgttctcgcaattcaacgtggacaagtacgtgacttggaatcctcccagatcggagtttgatttgtcggaagaagtcgatcctataaaaagaacagagagatccaatctcatgctctggacaagtccaaggttcacacttgttggagccatcgtcattgtctcattcctccttctctacaccattcttgctcctgtcaagtga

SEQ ID NO: 177 - DNA, 1729 bp, Arabidopsis thaliana
ttaattaaatggagccgaaagagaacggctcagaattgggtcagaagatcattgacggaccaacgaatccaatggtcacacctttactcaatgatctttatcaattcaccatggcttatgcttattggaaagctggcaaacacaacgaacgatccgttttcgatctgtattttcgtaagaacccatttggtggtgagtacactgtgtttgctggattagaagagtgtgttaagttcttagccaatttcaaattgactgatgaagaaatcgatttcgttcaagagtgtttgcctggatctgaggaagctttttgtgattatcttagagggcttgattgttctgatgttgaagtttatgcaattccggaaggatcagttgtttttcctaaagtacctctcatgagagttgaaggacctgttggtgttgttcaattgttggaaactccattcctcaatcttgtcaattttgcatctttggtagctactaacgcagctaggcatcgctttgttgccggaaaatctaagagtctactcgagtttggtgctcgaagggctcagggtccggatggtgcaataagcgcatcaaaatattgctaccttggaggttttgatgcaacaagtaatgtagcagctggaaaactttttgggattcctcttcgtggaacacactctcatgcttatgttagctcattcatgagtactgatgagattgttgacaaagtacttcgtagtgctgatgggaaaaccacgtgcgaggattttgttagtcatgttcagacatggttaaaaaagattcagtattcaccatctctaagtggcattttctctgagacaaatcaaagcgagctagcagctttcacctcatatgcactggcattccccaaaacttttcttgccctcgtagatacatacgatgtgatgaagagtggaatccctaacttctgtgcagttgctttagcactcaatgactttggatataaagcattaggtattagactggattcaggtgatttagcttatctatctagagaggccagaaatttcttctgcacggtagagagagaactaaaagtgcctggttttgggaagatggtcgtcactgctagtaatgatctaaatgaagagacgattgacgctttaaataaacagggacatgaggtggatgcttttggcatcgggacctacttggtcacttgctattcacaagcggccttaggttgcgttttcaaacttgtggagataaacaatcagcctcggattaaactttctgaagatgttacaaaggtatcaataccgtgtaaaaagcgaagttacagattatacggcaaagaaggttaccctctggtagatataatgactggagagaacgaaccacctccaaaggttggtgagcgtttactttgtcgtcacccattcaacgaatccaaaagagcatatgtagtgccacaacgtgtcgaagagctcctcaaatgttattggcgtggaagtgcagatgaagcaagagaagtattaccgcctttgaaagagataagagaccgttgcatcaaacagctcgaaaacatgcgacctgatcatatgaggagattaaacccaactccttataaggttagtgtaagcgcaaagctgtacgatttcatccacttcttatggctaaacgaagcacctgttggtgaattgcagtgacagaacaaccaaaaagaagaatctggttttggtttggtgggcgcgcc

SEQ ID NO: 178 - DNA, 907 bp, Arabidopsis thaliana
atgtcgtcatcgttagaacaagaaatcttcttacagtggggaaacaagaagagattgagatgtcttagagccaaagccaaaaagatctctcgttctaaaaactcttctcgctttctaggtcaagataccgtcctccttcaatcctctagattctccaggttaactttgtgattcctttatttactgttgtgaaattgctcaattccactcttggcatcgaagccaaagactcataatttcttggtgggtttttgtagaggatcagaaggagcaatcctcagatctggactaccagatcgccggagaccgtctccggagaaagaggagaggtattatactacgagaggtgtagtggataacattgggaaagattgtttagatggaaacatcaatggagaagatagcaacaacaaggaagagagtatgtggcctaagctctttataacattatcaaacaaagagaaagaagaagatttcatggctatgaaaggttgcaaaccttctcataggcctaagaagagagctaaactcatccaaagaagcttacttgttagtttcccatactcttttttgtcgtttttagaaaagtgttctgaagattcttcagttgtctgtttatagttttgagaataatgtgttgtctgattttaaacagttggtgagtcctggaacatggttggctgatttgtgccctgatagatacgatgttagggtgaagaagagctctaagaaggtatgacctttttatcaatttcattccagtgatccatcaatagtgattgagattgtatttgctttactttttgttagagatatgaaaatgatgatggtgtgtgttgtgtttgtgttgcagaggcgagcaagagggctaaaagccatgggaaacatggagactgattcagattga

SEQ ID NO: 179 - DNA, 1422 bp, Arabidopsis thaliana
atgagtaaagaagagttcatgaagatccagacttgtgttcttaaagtgaacatacactgtgatggctgtaagcagaaagtcaagaaaatcttgcagaaaatcgaaggtgttttcacgaccaagattgactcagagcaagggaaagtgactgtctctgggagcgtagatccttcagttctcatcaagaagctcgccaaatctggtaaacatgctgaaatctggggagctccaaagggtaacaacaatcccaatcagtcccaaatggccaatcagtttaagggaatgcagattgaccatggaaaagccggaggcggtggtggcggaaacaataataacaacaagaaaggccagaaaaacggcggaggaggtggcggcggtggaggtggaggtaacagtaatgcgccaaagatgggccagcaactgaatccacaacatttgcagcagcttcaacagcttcagaagatgaaagggtttcaagatctgaagcttcctcctcagttaaaaggctctgttcctgtcaacaagaaccaaaaccagaaaggagtcaagtttgatgtccctgaagatgatgatgatgatgatttcagtgacgaattcgatgatgaatttactgatgatgatgacgacgagtttgatgatgagtttgacgatctccctcttccgtctaataagatgaagcccaacatgacgatgatgcctaatgctcaacagatgatgatgaacgctcagaagaatgccaatcttgccggtggtcctgctaaaaacggcggtaaaggcgctcccgctgctggcggcggcggtgccggtggtggaaagggtgctggcggcggtgctaagggtggtcctgggaatcaaaaccaaggtggaggcaagaacggcggtggtggacatccacaagatggtaaaaacggcggtggaggcggtggtcccaacgccggaaaaaagggtaacggcggaggtgggcccatggctggaggagtttcgggaggtttccgacccatgggaggtggaggaccacagaatatgagcatgccaatgggtggtcaaatgggtatgggtggtccgatggggaatatgccggcggttcaggggttaccagcgaccggtccaggcggtgcaccacagggttatttccaaggggccgggatagatcctatgcaaatgcagcaacagcaacaacaacagcaatatttagcggcggttatgaaccagcaacgagctatggggaacgaacggttccaaccaatgatgtacgcaaggccaccaccggcagttaactatatgccgccaaacccgcaccaatatccgaatccgcatccgtatccgtatccgtacccgtatccatatcctccaccttatgggaatgatcaatactctcatgcctttagcgacgagaacacatcaagctgcgatattatgtga

SEQ ID NO: 180 - DNA, 1119 bp, Arabidopsis thaliana
atggaaaacggagaagcaaaacagagtgtacctcttctcactccctataagatgggaagattcaatctttcccatagggttgttctagcaccattgacgagacagagatcgtacggaaacgttcctcagcctcacgctgccatatattactctcagagaacgactccaggaggttttctcatcactgaagccactggagtttcagatacagctcaaggatatcaagatactcctgggatatggactaaagagcatgtggaggcatggaagccaatcgttgatgctgtacatgccaaaggtggtatcttcttctgtcagatctggcatgttggccgcgtttctaatagcgggtttcagccaaatggaaaagctcctatctcttgttcggataagccattgatgcctcaaattcgctctaatggcatcgatgaagctctctttacccctccaagacggcttggtatcgaagaaatccccggcattgtcaatgattttaggcttgctgcaagaaatgctatggaagctggttttgatggagttgagattcatggagctaatggctatctgattgaccagttcatgaaggatacggtgaatgatagaactgatgaatacggtggatcattgcaaaaccgttgcaaatttcctctagaaatagtcgatgcagttgctaaggagatcggaccagaccgtgttggaatcaggctctctccatttgctgactacatggaatctggagacactaatccaggagcattagggctttatatggcggaatctttgaacaaatacggaatcctctactgtcatgtgattgaagcgagaatgaaaacaatgggagaagtacatgcttgtcctcacacactaatgccgatgaggaaagcgtttaaggggacttttatctccgcaggaggtttcacgagggaagatgggaatgaggctgtgtcaaagggaagaactgatttggtggcttatggtcgatggtttctagccaacccggacctgccaaagaggttccaagtggatgcaccgctgaataagtacgatagaccaacgttttacacttctgatccagtcgtcggttacaccgattaccctttcctcgaatcaacagcttaa

SEQ ID NO: 181 - DNA, 1680 bp, Arabidopsis thaliana
ttaattaacttattgactaaattctctctggtgtgagaagtaaaatgggtcacggaggagaagggatgtcgcttgaattcactccgacgtgggtcgtcgccggagtttgtacggtcatcgtcgcgatttcactggcggtggagcgtttgcttcactatttcggtactgttcttaagaagaagaagcaaaaacccctttacgaagcccttcaaaaggttaaagaagagctgatgttgttagggtttatatcgctgttactgacggtattccaagggctcatttccaaattctgtgtgaaagaaaatgtgcttatgcatatgcttccatgttctctcgattcaagacgagaagctggggcaagtgaacataaaaacgttacagcaaaagaacattttcagacttttttacctattgttggaaccactaggcgtctacttgctgaacatgctgctgtgcaagttggttactgtagcgaaaagggtaaagtaccattgctttcgcttgaggcattgcaccatctacatattttcatcttcgtcctcgccatatcccatgtgacattctgtgtccttaccgtgatttttggaagcacaaggattcaccaatggaagaaatgggaggattcgatcgcagatgagaagtttgaccccgaaacagctctcaggaaaagaagggtcactcatgtacacaaccatgcttttattaaagagcattttcttggtattggcaaagattcagtcatcctcggatggacgcaatcctttctcaagcaattctatgattctgtgacgaaatcagattacgtgactttacgtcttggtttcattatgacacattgtaagggaaaccccaagcttaatttccacaagtatatgatgcgcgctctagaggatgatttcaaacaagttgttggtattagttggtatctttggatctttgtcgtcatctttttgctgctaaatgttaacggatggcacacatatttctggatagcatttattccctttgctttgcttcttgctgtgggaacaaagttggagcatgtgattgcacagttagctcatgaagttgcagagaaacatgtagccattgaaggagacttagtggtgaaaccctcagatgagcatttctggttcagcaaacctcaaattgttctctacttgatccattttatcctcttccagaatgcttttgagattgcgtttttcttttggatttgggttacatacggcttcgactcgtgcattatgggacaggtgagatacattgttccaagattggttatcggggtcttcattcaagtgctttgcagttacagtacactgcctctttacgccatcgtctcacagatgggaagtagcttcaagaaagctatattcgaggagaatgtgcaggttggtcttgttggttgggcacagaaagtgaaacaaaagagagacctaaaagctgcagctagtaatggagacgaaggaagctctcaggctggtcctggtcctgattctggttctggttctgctcctgctgctggtcctggtgcaggttttgcaggaattcagctcagcagagtaacaagaaacaacgcaggggacacaaacaatgagattacacctgatcataacaactgagcagagatattatcttttccatttagaggatcatcatcagaggcgcgccaaaaat

SEQ ID NO: 182 - DNA, 1637 bp, Glycine max
ttaattaatggaaacgcggagatgaagttctacatatcaacgaaggggataaagagagtgacgatatcgaacggcgagggaaagggatcggcgaagacgacggcggtggcggccggcgccggtcgccggatatcggctcggacggtgtttccggtgatggtggtgctcgggatcgtgctgccgtttctgttcgtgaggatcgcgatcttgatgctggaatctgctgcggcgtgttcctcattggaatgtgctgggtggaggtttttcagtggagtcgacacgtcactggaactcagagatgagctgaccagagcgctaatagaggcaaatgatggtaatgttaatgagggagcagggtcgttcaatgaacttgtgaaagagatgacctcaaaacaagaccttaaggcttttgctttcaagaccaaagccatgctatcacagttggaacgcaaggtgcaattagcaagacaacaggagtcggtttattggcatctagcttctcatggtattcctaaaagtctacattgtctatgtctaaagttggctgaagaatattctgtaaatgctatggccagatctcgtctaccccctcctgaatttgtatcgcgccttgttgaccctacctttcaccacttagttctcctaactgacaatgtccttgctgcctctgttgttgtaacctctacaattgaaagttcaatcaacccagaaaaactagtttttcatattgttactgacaaaaaaacttatgctccaatgcatgcttggtttgccaccaattctattaaatcagttgtggaagttaggggattacaccaatatgactggtctgaagaagtgaatgctggtgttaaagagatgctagcaactaatcacttaatttggaagcaatactataataaggaaaaggaccttgactatactcaagagaatagcagatatttggaggctttaaggcccagcagcctatccttgatgaatcaactccgcatttatttgcctgagctgtttccagatctcaaaaagatagtattcttggatgatgatgttgtagtacaacatgacatatcttttttgtgggaactagatcttaatggcaaagtcattggttctgtattcaagtcgtggtgtggagacggctgctgccctggaagtaaatacataaactacttgaacttttcacatcctcttgttgcatcaaactttgacggtgatcagtgtgcatggctctatggcatgaatattattgatcttgaaacttggaggagaacaaacattacggagacctaccatcaatggttgaaacttaacctcaagtccgggatgacaatgtggaatccaggagtgcttccacctgccttgatgacatttgagggtcaagtgcatcctataagttcatcaatgcttgtgactgatttaggttatcgccatcaatcagcagaaattagcaaagagaaattagaagctgcagctgttattcatttcagtggccctgcaaagccatggcttgaaattggtttcccagaggttcgaagtttatggagtagatacgtaaatatctctaataaatttattgggagatgtagaattacagggtgaaggaacaaagttttttcacctcccatatttatttaaat

SEQ ID NO: 183 - DNA, 2221 bp, Glycine max
tttgtcagctttcaaactctttgtttcttgtttgttgattaacccttaattaattcgatctccggcaatctaactaaaacggcggcgtatagcgggatctgcgagcatggagggtgagaacgcgagcaaggtgatcgaattggtgaacgagatagccagcatctccgagtacaggcctccggtgaagaagcagtactgcaacttggcgcggaggctgaagcttctgatcccgatgttcgaggagattagggacatgaacaaagacgcgcttcccgaggacacttccaacgccgtcctcgccttcaaggaagctctccaatccgctagggaactcctcagattcggaagcgaaggcagcaagctttacttggtccttgagcgggacgatattatgaataagttctacgaggtgacagctcagttggaacagtcattgggtggtatttcccatgataaacttgatatatcagatgaagttaaagagcaggttgagttggttcttgcccagttcagaagagctaaagggagggttgatgaaccagatgtcaggttgtatgaggatatgttgtctgtttacaacagcagcagtgatgcagctacagatccatctgttctaagtcaattagctgaaaaattgcaattgatgggaatagctgatcttactcaagaatcacttgctttgcatgagatggtggcatcaagtggtggggatccaggagcacgcattgagaaaatgtcaatgttattgaagaagataaaggatttcgtgcaaatagaaaatctagtcaaggatgataatttaggaggaaaaggcattttctcaaaagtctatggacttgggacaaatgaaaagagtcatcaggctcctgttatccctgatgattttcgatgtccgatttccctggaattaatgaaggaccctgtcattgtttcaacaggacagacttatgagcgtacttgtattgagaagtggttgcaagcagggcacgggacctgccccaaaacacagcagactctcactagtactgttctcacacctaactatgtattacggagcctcatagcacaatggtgtgaagccaatggcatagagccaccaaaacgacctagcgattcacaacctagtaaatcagcatcagcctactctcctgctgagcaaagtaagattgaaagtcttctccaaaagctcacatctgtgagtcctgaagaccagagatcagctgctggcgagatccgccttcttgcaaagcgcaacgcagataaccgcgttgccattgctgaagctggtgcaatacctctccttgttggtcttttgtctgtgcctgactcccgcactcaagaacatgccgtgacagcgctcctgaatctttccatatatgaaaacaacaaaggaagtattgtttcttcaggagcagttccaggtatagttcatgtgctgaagaagggaagcatggaggctcgggaaaatgcagcagcaacacttttcagcctttcagtaatagatgaaaacaaggttacaattggatctttaggagccataccaccactagtgacactgctaagtgagggtaaccaaaggggtaagaaagatgctgcaacagcactcttcaatttgtgcatttatcagggcaacaagggaaaggcagtgagggctggcgttattcccacgctgatgcgactactgactgaacctagcgggggaatggtggatgaagcattagctattttggcaatattggctagccatcctgaagggaaggctactattagagcttcagaggcagtgccggttttagtagagtttattgggaatggctcaccaaggaacaaagagaatgcagctgccgttttagttcacctctgttctggagatcaacaatatcttgcacaggcacaagagctgggggtgatgggtccactgttagaattggctcaaaatggtacagacagaggcaaaagaaaggctggacaattgctagaacgtatgagcaggttagttgagcaacagcaggaagttccaatacaaactgaaactcaagctcagaacgaggatacccaaccacctttgattactaaccccgatgattcctaagatgtcttattatactttgttcattttgtctttttgttctctttaaagtgttgaaagaagcatctgtttggatttaaattggagctctgcagagctttcgttcgtatcatcggtttcgacaacgttcgt

SEQ ID NO: 184 - DNA, 1526 bp, Arabidopsis thaliana
aaaaagcaggctttaattaaatgtcttgctcggccaccgatctcgctgtcctgttgggtcctaatgccacggcggcggccaactacatctgtggccagttaggcgacgtcaacaacaaatttatcgacaccgctttcgctatagacaacacttaccttctcttctccgcctaccttgtcttctctatgcagcttggcttcgctatgctctgtgccggttccgtgagagccaagaatactatgaacatcatgcttaccaacgtccttgacgctgcagccggtggtctcttctattatctgtttggctacgcctttgcctttggatctccgtccaatggtttcatcggtaaacactactttggtctcaaagacatccccacggcctctgctgactactccaactttctctaccaatgggcctttgcaatcgctgcggctggaatcacaagtggctcgatcgctgaacggacacagttcgtggcttacctaatctattcctctttcttaaccgggtttgtttacccggtcgtctctcactggttctggtcagttgatggatgggccagcccgttccgtaccgatggagatttgcttttcagcaccggagcgatagatttcgctgggtccggtgttgttcatatggtcggaggtatcgctggactctggggtgcgctcatcgaaggtccacgacttggccggttcgataacggaggccgtgccatcgctcttcgtggccactcggcgtcacttgttgtccttggaacattcctcctctggtttggatggtacggatttaaccccggttccttcaacaagatcctagtcacgtacgagacaggcacatacaacggccagtggagcgcggtcggacggacagctgtcacaacaacgttagctggctgcaccgcggcgctgacaaccctatttgggaaacgtctactctcgggacattggaacgtcactgatgtatgcaacggcctcctcggagggtttgcagccataactggtggctgctctgtcgttgagccatgggctgcgatcatctgcgggttcgtggcggccctagtcctcctcggatgcaacaagctcgctgagaagctcaaatacgacgaccctcttgaggcagcacaactacacggtggttgcggtgcgtggggactaatattcacggctctcttcgctcaagaaaagtacttgaaccagatttacggcaacaaacccggaaggccacacggtttgtttatgggcggtggaggaaaactacttggagctcagctgattcagatcattgtgatcacgggttgggtaagtgcgaccatggggacacttttcttcatcctcaagaaaatgaaattgttgcggatatcgtccgaggatgagatggccggtatggatatgaccaggcacggtggttttgcttatatgtactttgatgatgatgagtctcacaaagccattcagcttaggagagttgagccacgatctccttctccttctggtgctaatactacacctactccggtttaa

SEQ ID NO: 185 - DNA, 855 bp, Arabidopsis thaliana
tttgttgattaacccttaattaagatggcggcgagcgcgaacccgtcggggaacaatcaggaaggttcgtcggcgacgcagaaggtatcgtcttcttcagcggcggcggcgaatggcgctgctgtgaattccgtcgataatggtggaaatacaggcgcggcggcggataattcacagacgattggcgcgttgaggcataatccagggatctctaccgattggactcttgaggaacaatctctattggaagatttgcttgtcaagtacgcgacagaaccgtcggtttttcgatatgcgaagattgctatgaaaatgaaagataagactgttcgagatgttgccctgcgctgtagatggatgactaaaaaggaaaacggaaagcgtaggaaagaagatcattcctcgaggaaaagcaaagataagaaacaggaaaaagctacagattcttcagccaagtcctcatctcatttgaatgttcatcctaatggtccttcttatgctccgcctatgatgcctatcgatactgatgatggtatttcatataaagctattggtggtgtgagtggagatcttctcgagcaaaatgctcaaatgttcaatcaactttcaacaaatttctcagctttccagctacatgagaatgtcaatatcttgtgcaaagctcgagacaatatccttgcaatcttgaacgacttgaatgacatgccagaagttatgaagcagatgccacctcttccggtgaagttgaatgaggagctggcaaattcgatcctccctcgcccatcccatcaaaggaagtcatgaatttaaatacccagaaatacccagcaaattggagctctgcagactttcgtt

SEQ ID NO: 186 - DNA, 1538 bp, Arabidopsis thaliana
ttaattaaagggtttcaaactaaaatcgagtccttgagttttcccaatttaaatcgttatgagctctatcaatatcactaacgtcaccgtcttggacaatcctgctccgtttgtgaatccattccagttcgagatttcttacgaatgcttgacctctctcaaagacggtaccttttactttccctgatcctctatctttcgaaaattgatactatgttgatttattttcgattttgttattatattcttcggaaccgattgaagaatgaagaacctgtgattggatatgtgaataatgctacaaaagattcaatttttggggttttaaagtatgatttgtagctaattgacttcactgtgttagggttttcttgcatttgtatgagctcacacacgatctgtctcgagcttagtgtactctctttggcttagaagttggttatatgtctgcaattgttcgtattcaacattgtagttgtggtatttaggagccttgtctttgctctatgaggattgtttactgtgaatggttattttgtatggcttatctttcggatgtgttggctctcaaatgagatttgacctctggctcagtggctatgtactgtaatttcacacattactagttgcaagttatcggttcttgatcatggcagagaattattgttctagatatcattatgtgtgtgttgcttatccttctgcaataaaagcgtaaaaccgttttgcctataccaactggttaagtttctgtgctttgtaaattttcgtgatttctagtcatgatcacattctggtaagcctgatgtgtgagataacgtttctttggttttgctacagatttggaatggaagcttatatacgtagggtcagctgaagacgaaacgtatgatcaagttttggaaagtgttcttgttggtcctgttaacgttgggaactatcgatttgtgttgcaggtagtgtatgattagttttattcttctctctttgtttctggtggtttaggtacataatcttagtctaaactttttgtttgattaaatgataggctgactctccagatccgttaaagattcgtgaggaagatattattggtgttactgtgttattgttgacttgctcatacatggatcaagagtttataagagttggctattatgtgaacaatgactatgatgatgaacagctcagggaagagcctcctaccaaggttttgattgataaggtccaaaggaacatactcacagacaaacctagagtaactaagttccctatcaactttcatcctgagaatgagcagactcttggtgatgggcctgcacctactgaaccatttgctgattctgttgtaaatggagaagctccggtgtttcttgagcagccacaaaagcttcaggagatagaacaatttgatgattctgatgtaaatggagaagctatagcgttgcttgatcagccacaaaatctccaggagacatgattcttgtttgactcaagcttaactggaaactggattagaactatcatctcggcgcgcc

SEQ ID NO: 187 - DNA, 2489 bp, Arabidopsis thaliana
ttaattaaatgaatccttcaactccaagtttactctacacatccatcttcttctacttcacaataatagcaactcaaaccctctctcttgatccaaagttcaaggcttgtgagccgaaatcatgcggcaaaggtccccagatctcctatccattttatctatctggaaagcaagaatctttttgtggttatccaagttttgaactcacttgtgatgatgaagaaaagctccctgttctcgggatctccggtgaggaatatgtcatcaagaacatatcttacttaacacagtcgtttcaggtcgtgaactcaaaggcttctcatgatccatgtcccagaccgctgaacaatcttaccctccataggactcctttctttgtgaacccttctcatatcaacttcactatactttacaattgttccgatcacctgctggaggattttaggacataccctcttacttgtgctcgaaacacgagtcttcttcgatcttttggggtctttgacagaaagaaacttggaaaagagaaacaaattgcatccatgtcgtgccagaaactagtggatgttcctgttttagctagtaatgagtctgatgtgatgggtatgacttatgttgagattttgaagaggggttttgttctgaattggactgcaaacagttgcttccgctgcatcaccagcggcgggagatgtggaactgatcaacaagaattcgtatgcttgtgtcctgatggacctaaacttcatgatacttgcacgaatggtaaccacttgtgaattgacgtctaattgatcttctgacatgttgtcccttcctttttctttgctttagttttgtcaatacattgttaaaggcttttttacaatctctgactggttaagtaacttttagtctcaatctatatgttcttacgaatgctgaaatctgaaagtccattgactggtttattcttctctgtttcttcattccaggcaaaaatgataaaagaaggagagtgatagtgaaggtactcataggtaaaattctttaatcttctgttttgggaaaaagactttgatatgtggttataataactaaccagtattttaatagattcgatttgatttatgatgctcttcgcaccatcaaaagatataaaattctactttggcaaagttatgttatgctctgttgtttcgttaatcatcccgctcaagttttaacagattacaaaatccatctcaggtgcatccgctgcggtcgtaggattaatagctgcgagcatattttggtatgtataccatcgtagaaaaacaaaaagttacagaaattcttcagcattgcttccaagaaacatctcatcagatccatctgcaaagtcttttgacatcgagaaagcagaggaattattagtcggagttcatattttctcttacgaagaacttgaagaagccactaataacttcgacccatctaaagaactcggtgatggaggctttggtactgtctattacggtaagcttaaagatggacgaagcgtagccgttaaacggttatacgataacaacttcaaaagagcagagcaattcaggaatgaagttgagatcttaacgggtttacgccatccaaacctcgtggctctctttggatgctcctcaaaacagagccgggacttactgctagtgtatgagtatgttgcaaacggcacgttagctgatcatctacatggtccacaggcaaaccctagctcacttccttggtctattcggctcaaaatcgctgttgaaactgcctctgccttgaagtatctccacgcctccaagatcatccaccgtgatgttaaatccaacaacatccttctcgaccaaaacttcaatgtcaaggtcagtaactcacactggttattactcaatctggtgggattttatcggatcataatcttaacttctttctgtgttttttttactgttttcgacattttaggttgcggattttggactctctagactgtttcctatggataaaacgcacgtatctaccgctccacaaggaactccgggatatgtcgacccggattaccacttatgctatcaactctcaaacaaaagcgacgtgtacagctttgcggtagtgttaatggagcttatctcttcacttccagcagtcgacatcacaagaccgcgccaagagatcaacctctcgaacatggcagtcgttaaaatccagaaccacgagctccgcgacatggtggatccgtcacttgggtttgacacggatacaagagtgagacagacggtgatcgctgtcgctgagctggcgttccaatgcttgcagtcggataaagatcttaggccatgtatgtcgcacgtgcaggatacgttgacgaggatacagaacaatggatttggttcggaaatggatgttgtagatgtgaacaagagtggaccgttggttgcacagtctccagatagtgtcattgtgaaatgggacagtaagtaaggcgcgcc

SEQ ID NO: 188 - DNA, 1131 bp, Synechocystis sp.
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgaggagttatagccaattagacctagatatatccctttgcacaaagtaccggctcctatgtaatgctggtgatagcctaattagtctattacctcatcctatgactgctactgttacagcccaagaagccttccgagccgcctatgaaaaccgctacacctgggacgaaaattttcccggttatcgggcccatctcaccgtcacccaaggggatgaacgctacgaaggggaagtggaggtgaaggcggactacactgtcaccgtgactggttttagtgacgagacggtacaggaaagcgtttataaccaaatgcgggacattgttacccaccgcaaacaagggaattttgaaaagtcccacggcaaaaatgagtttagctttggggaaaccgatgcttccggggcgatcgccattgatgtgaagggagatgccatggggtcgaactataaaatccggggcacggaaatttgtcaggtcagtcgggtgatggggccggtggctttcaccatcaacaccgaagaaagtttggatactggttccggctacattgccatcaaatataatgccatttttaaagaccctaaaactgataccctcaaaggcaaacgggacttcaccgaaacctatggggaattggggggctattacctacccactcaacaaaccgtagaggcgatcgccgctgggggagaaaaaatcttcaccgattttagcttcactaatctagaacttttggcataggtgacgacgttttgtctagcttagtaactccattgggatcaacatttaaatacccagcaaatacccagcaaattggagctc

SEQ ID NO: 189 - DNA, 2393 bp, Arabidopsis thaliana
tcattttttgtcagctttcaaactctttgtttcttgtttgttgattaacccttaattaaaagagagtgacgggggaagaagatgacttctgctttgtatgcttccgatttgtttaagcagctcaagtcaattatggggacagattcgttatccgacgatgttgtacttgtgattgcaacgacgtctttggcactagtagctggatttgtggtgttgttatggaagaaaacgacggcggatcggagcggggagctgaagcctttgatgatccctaagtctcttatggctaaggacgaggatgatgatttggatttgggatccgggaagactagagtctctatcttcttcggtacgcagactggaacagctgagggatttgctaaggcattatccgaagaaatcaaagcgagatatgaaaaagcagcagtcaaagtcattgacttggatgactatgctgccgatgatgaccagtatgaagagaaattgaagaaggaaactttggcatttttctgtgttgctacttatggagatggagagcctactgacaatgctgccagattttacaaatggtttacggaggaaaatgaacgggatataaagcttcaacaactagcatatggtgtgtttgctcttggtaatcgccaatatgaacattttaataagatcgggatagttcttgatgaagagttatgtaagaaaggtgcaaagcgtcttattgaagtcggtctaggagatgatgatcagagcattgaggatgattttaatgcctggaaagaatcactatggtctgagctagacaagctcctcaaagacgaggatgataaaagtgtggcaactccttatacagctgttattcctgaataccgggtggtgactcatgatcctcggtttacaactcaaaaatcaatggaatcaaatgtggccaatggaaatactactattgacattcatcatccctgcagagttgatgttgctgtgcagaaggagcttcacacacatgaatctgatcggtcttgcattcatctcgagttcgacatatccaggacgggtattacatatgaaacaggtgaccatgtaggtgtatatgctgaaaatcatgttgaaatagttgaagaagctggaaaattgcttggccactctttagatttagtattttccatacatgctgacaaggaagatggctccccattggaaagcgcagtgccgcctcctttccctggtccatgcacacttgggactggtttggcaagatacgcagaccttttgaaccctcctcgaaagtctgcgttagttgccttggcggcctatgccactgaaccaagtgaagccgagaaacttaagcacctgacatcacctgatggaaaggatgagtactcacaatggattgttgcaagtcagagaagtcttttagaggtgatggctgcttttccatctgcaaaacccccactaggtgtattttttgctgcaatagctcctcgtctacaacctcgttactactccatctcatcctcgccaagattggcgccaagtagagttcatgttacatccgcactagtatatggtccaactcctactggtagaatccacaagggtgtgtgttctacgtggatgaagaatgcagttcctgcggagaaaagtcatgaatgtagtggagccccaatctttattcgagcatctaatttcaagttaccatccaacccttcaactccaatcgttatggtgggacctgggactgggctggcaccttttagaggttttctgcaggaaaggatggcactaaaagaagatggagaagaactaggttcatctttgctcttctttgggtgtagaaatcgacagatggactttatatacgaggatgagctcaataattttgttgatcaaggcgtaatatctgagctcatcatggcattctcccgtgaaggagctcagaaggagtatgttcaacataagatgatggagaaggcagcacaagtttgggatctaataaaggaagaaggatatctctatgtatgcggtgatgctaagggcatggcgagggacgtccaccgaactctacacaccattgttcaggagcaggaaggtgtgagttcgtcagaggcagaggctatagttaagaaacttcaaaccgaaggaagatacctcagagatgtctggtgattgatgatatgatttattggtggcgcgccaaaaattggagctctgcagagctttcgttcgtatcatcggtttcgacacgttcgtcaagttcaatgcatcattttcattgcgcacacaccagaatcctactgagtttgagaataatgggattgggaaaactgttttcttgaaccatttgttgggcttggaaattaactggggtttttatttcggttttcgtaatcaaactgtga

SEQ ID NO: 190 - DNA, 1160 bp, Arabidopsis thaliana
ttaattaattcacgatctcaaaacccagaagaaagaatcatgctttcgttatcatgctcttcttcttcttcttcgttgcttcctccgagtttacactaccacggttcttcttctgttcagtccatcgttgtaccaagaaggagtcttatctcgtttcgtcggaaagtctcttgctgttgcatagctccacctcagaacttggacaacgatgccaccaaattcgatagtcttaccaagtctggaggaggtatgtgtaaagagcgagggcttgagaatgattctgatgttcttattgaatgtagagatgtctataaatcgtttggggagaaacatatcttgaaaggtgttagctttaagattagacatggtgaagctgttggggtgattggtccttctggaactggaaaatcaacaattttaaagattatggctggtcttcttgctccagacaagggagaagtttatatacgaggaaaaaaacgagctggtttgataagtgatgaggaaatatcaggacttcgtattggcctggtatttcagagtgcagctctctttgattcactatcagttcgtgaaaatgttggttttctactttatgaaagatcaaaaatgtccgagaatcaaatatctgagcttgtgacacaaaccttggcagctgttggtttgaagggggttgagaatcgattaccttctgagctatctggtggaatgaagaaaagggttgctttagctcgttcactaatttttgatacaacaaaagaggtcatagagccagaggtgcttttgtacgatgagccaactgctggacttgatccaattgcatcaactgtagttgaagatcttatacggtctgttcacatgacagacgaagatgcagttggaaaacctggaaaaattgcgtcttatcttgttgttacccatcaacatagcaccattcaaagagctgtagacaggttattgtttctgtatgaaggaaagatcgtttggcaaggaatgacacatgaattcacaacctcaactaatccaatagttcaacagtttgctacaggcagcctcgatggaccaatcagatactaggggaggcaaaccgagcctaaagagggacactaaccgataatagggaacgcaaacaagtaatggctgacatacaccacatggct

SEQ ID NO: 191 - DNA, 766 bp, Arabidopsis thaliana
ttaattaatctctgaattcttctttacgattttgtaacttctatcaaataccttaataatgggagcctacagagccgacgacgactacgattatctcttcaaactagtcttgattggagattccggcgtcggaaaatccaatcttttgtctcgcttcaccagaaacgaattcagcatcgagtcaaagtcaaccatcggtgtcgagttcgccacaagaagtgttcatgtcgacgaaaaaatcatcaaagctcagctttgggacaccgctggtcaagaaagatacagagcaatcacgagtgcatactacagaggagcagtgggggcacttctagtatacgacataactcgacacataacgttcgaaaacgttgaaagatggctcaaggagcttcgtgaccataccgatgccaacgttgtaatcatgcttgttggaaacaaagccgatcttcgtcaccttcgtgcagttcccacagaagaagctagatcattctctgaaagagaaaacatgtttttcatggagacttctgctttggatgctacaaatgtcgaacaagctttcactcatgtcttgactcaaatctatcgtgtaatgagccgtaaagctcttgatggtactggagatccgatgtctttacctaaaggacaaaccattgatatcggaaataaggatgatgttactgctgttaaatcttctggttgttgctcaggttgagattattgtttttgtttttgtaaactgtctttttggaagaaggcttggcgcgcc

SEQ ID NO: 192 - DNA, 1811 bp, Arabidopsis thaliana
ttaattaagtcttctcattcttcattcccagatccgtagaatagaaaatgtttggccgatctgcgattcgtggaggaggattccgtgcagagaatctaggtcaaaacgcacttaccttaatcggtaacataggcttctcactcttcgtcttcggagtactaatcttcaccataatcgccgcaacttacgaaccagaagatcctctcttccacccatctgacaaaatcacaactttcctcacttccacatcaaacgctacacttagatccgatgactccgttgttaaaaccggtgaagatttcatgctcgctaaccaaaccgcatttgcagagtttatcaacataaacgatgttgaagccagcaccaatgagactactacagaggaagagggtaacaagttggaatgtgatgtgaatactccaattgattgcaaagatcagcaagtgtttcatcttatgatgagagctactattgacaagtttaaagatattcacttttataagtttggtaagcctgttactggcgaagaaggtgtgaattcttgtgatatggcgtggcgttataggcctagagatgggaagagtgctgctttttataaggattataggaggtttgttgttgctaagtctgagaattgtagtgtgagtgttgttgggattggtgagtatcattcgggtttgaatgcgaggaagaggaagaagaatcagaaagctgggtttgagaaaactggtgggaagaaagatgatttctctttgcctgttgttggtgaacttgtgaatgattctcttcctatggttgagtctgatagtgtgtttaagactggcaagtatttggtttatgttggtggtggagataggtgtaagagtatgaatcattttctgtggagtttcttgtgtgctcttggggaagctcagtatttgaataggactctagtgatggatttgaccttgtgtttgtcttctatctatacttcgtctggtcagaatgaggaaggcaaggatttcaggttttactttgatttcgagcatttgaaagaagctgcttctgtgttggatgaagctcagttttgggctcagtgggggaaattgcgtaagaagagaagaaatagattgaaccttcatctcgtggaggattttagggtcactcccatgaagctcgcggctgtcaaagatacgttgataatgaggaagtttggatctgtagaaccagacaattattggtacagggtttgtgaaggagatgcagaatctgttgttaaacgaccgtggcatctgttatggaaatcaagaaggttgatggaaatcgtctctgctattgcatcaaggttaaactgggactacgatgctgtacacattgagagaggagagaaagcaagaaacaaggaggtttggcctaatcttgaagcggatacttccccgagcgctctcttgtcgaccttgcaggacaaagttgaagaaggaaggcatctctacatcgcaacaaatgaaggagaattatccttcttcaaccctttgaaagataagtacgccactcatttcctttacgactacaaagatctttgggatgagagcagtgagtggtattcagagactactaagcttaatggaggcaacccggtcgaatttgatggttacatgagagcatctgttgacacagaagtattcttgagagggaagaagcagattgaaacattcaacgatcttacaaacgattgtaaagatggagttgggacctgcaatgctgcaacttcctgatctctgtcatattcctcatttatttgttgtttgaatcgtcttgtaccacggcgcgcc

SEQ ID NO: 193 - DNA, 1249 bp, Arabidopsis thaliana
ttaattaaatgaactgtctgttcttgttcaaatcaaagaaacccagaaagcaacagaaagacaacaacaagaacaaaagaaaaggtaaagagttgttacaaaactcagctccagaactgacgaatcggagtgaaacgtcttcgtttaatctccagacaccaagatcgttgccttctccaagaagtatcaaagatttgtatacagagagagaacaaaatcttagggttttttcttacgaagaactcagtaaagccacttatgtgtttagcagaaagcttgtgatcggtgaaggtggatttggtattgtttataaaggaaagattctcagcaatggagattcttctgatcctccacttgtcgttgccatcaagaaactcaatcgacaaggtttacagggtcacaagcaatggctagcagaggttcagtttcttggagtagtgaatcatccgaacgttgtgaagctcataggttattgctcggaagacggcgagaccgggatcgagaggcttttggtttatgagtacatgtcgaatcgaagtttagaagaccatctcttccctcgtcgatcacacacattaccgtggaaaaaaagactcgagatcatgcttggtgctgctgaaggattgacttatttacatgatcttaaggtgatatatagagatttcaaatcctctaatgtgcttttagacgatcaattctgtccaaaattatcggactttgggcttgccagagaaggacctgatggcgacaatactcatgtcactaccgcaagagttggaacacacggctatgcggctccggaatacgtgcaaacaggtcatcttcggttaaagagcgacgtctatagcttcggtgttgtgctctacgagatcataaccggacgcagaaccattgagaggaacaagccagtggctgaacgaaggctattggattgggtcaaagagtatcctgctgatagtcaacgtttcagcatgatcgttgaccctcggttacgcaacaattatccagctgctggagctaggagtttggctaaattggctgatctttgcctgaaaaagaacgataaagagcgacctacgatggaaattgtagtggaaagattgaaaaagattatcgaagaatcggatagtgaagattatccgatggctacgactacgaccaaggaaagtagtcaggtaaggaggagacaagttgcaaaacctgagaaacaaagtttgagaggggttagtgtcagaggatgaggcgcgcc

SEQ ID NO: 194 - DNA, 2199 bp, Zea mays
ttcttgtttgttgattaacccttaattaatccgggcgcgcctgatttatcacaagtttgtacaaaaaagcaggctcctgcaggaccatgtgcgggatcttcgcctacctcaactacaacgtctcgcgggagcgccgctacatcctcgaggtcctcttcaacggcctccgccgcctcgagtaccgcggctacgactccgccgggatcgcgctcgatgccgaccgccaggtcccctcccccgctcccgcttcctcttccgacgcgcggccgtacgccggggcgccgccgctcgtgttccgccaggagggcaagatcgagaacctcgtgcgatccgtctactccgaggttgatgagaaggatgtgaacctggatgctgcgttcagtgtgcatgctgggatcgcacataccaggtgggccacgcacggtgtgcctgctccaaggaacagccacccccaatcgtctggtgccggtgatgagttcttggtcgtccacaatggcattatcaccaactatgaggtcctgaaagagacactaactaggcacggcttcacctttgagtctgatacagacacagaagtcatccctaagctagcaaagttcgtttttgataaatctcatgatgaacaaggtgatgtgacgtttagccaagttgttatggaagtcatgaggcagcttgaaggagcctacgcacttatctttaaaagcccgcactatcccaatgaattgattgcatgcaaacgaggcagccaactgatacttggtgtcaacgaattgagtggtcaacagaatgggaaatcatttcatgatgtcaaaaccttgacaacaaatggaaagcccaaagaattattcttctccagtgatctatgtgctattgtagagcatacgaagaactacttagctcttgaagataatgaaattgttcatattaaggatggtagtgtttcgatcctcaagtttgaccctcacaaagagaagccagcatctgtgcaacgagcattgtctgttcttgagatggaagttgagcaaataaagaaaggaagttatgatcacttcatgcaaaaagaaatccatgaacagccacattcgttgaaaacaacaatgaggggtagattgaaggatggtggggttgttctaggtggactgaaggaatatctcaagacaattaggcgctgtagaagggtggtatttattggttgtggaacaagttacaatgctgccttagctgcaagaccttttgtggaagaactgactggtattcctgtgactatggaggttgcaagtgacttgctggacagacaaggtcccatctacagagaagacactgcagtttttgttagtcaatctggggagacagcagataccctccttgctctagattatgcactagaaaatggagctctctgtgttggcataacaaatactgttggaagcacgctgtctagaaaaacacactgtggtgttcatatcaatgctggttgtgagattggtgttgccagtacaaaggcttatacaagtcaaatagtagccatggcgatgatggcgttggctattgggtccgatcagatatctactcaagctaggagggacagtatcattagtggactgaacaacctttcaagcaatgtcagcgaagttctcaagctagatgctggaatgaaggagctcgcctcttcgctgatcgactcagagtcgctcctcgtgttcggaaggggttacaactacgccaccgcgctggagggcgccctgaaggtcaaggaggtggcgctgatgcacagcgaaggcatgctcgctggcgagatgaagcacgggccgctggccctcgtggacgagaacctccccatcattgtcattgcgactcgcgacgcgtgcttcagcaagcagcagtcggtgatccagcagctcctctcgcgtagggggcgcctgatagtgatgtgctccaggggagatgcctcggctgtgtgccctagcggtgggtcgtgcagagtcattgaagttccacaggttgcagactgtctccagccagtgatcaacataattccattacagttgctcgcgtaccatctgactgttctccggggattcgacgtggaccaaccaaggaatctggcgaagagcgtgaccacgcagtagctcgagacccagctttcttgtacaaagtggtgataaattggagctctgcagagctttcgttcgtatcatc

SEQ ID NO: 195 - DNA, 2394 bp, Arabidopsis thaliana
ttcttgtttgttgattaacccttaattaatccgggcgcgcctgatttatcacaagtttgtacaaaaaagcaggctcctgcaggaccatgaggtttgggaaagagtttgtgtctcagatgatcccagaatggcaagaagcttatatagattacgcttacctcaaaaccattcttcaagacatccaagcttcccggaataggtcagattccaataaccagagcagtactccttccttcgcacgtaacctaaccagacggtacaaccgcgacgccttggtctctgagaatcacgacattgtggtcaacactgtgacacggctcgaagaagggctcgagacggcggcttacgagactacgtttttaaaggccggagaagcaggtggcgactttgaggttaccttttttagaaccctagatcgagaattcaacaaggtaaataacttttacaggctgaaagtggagacagctagaactgaggctctggctctgaacaaacaaatggatgctttgattgctttcagacacaaagtcatggatcagaatcagaagaacccttctgtctttgattcagtttcagaagacatcaatggctcagcttctgaggttggatcatcttcaaagtgtacagaacacaatgtggcgttagctgatcttatgaggaacgaagatacatcgaatgagagtattcttgagcgcatcaggatgaacaaaactcgagaaataactcctctgtccgcaattaaaactatactcaaggtccataagcaggacgagctcaaattcacaagagataatctcaaggaagtggaaaagcgacttcaggtagcgttcattgagttttatcagaagcttcgacatcttaaaaactacagcttcttgaacgcttccgctgtttccaagatcatgaagaagtatgataagatagccaaaagaaatgctgcgaaactgtatatggagatggtcgataaatctttcctcagtagctccgaagaagttcataagttgttgctaaaggttgaatctattttcattgaacatttctccaattcaaatcggagggaagggatgagccatttaagaccaaaaataaataaagaacgtcatcttataacgttttccaccggcttctttttcggctgtggtatttctctcattgtagctctgggtttgatcatccatgctcgtaatatcatgggtacaccgggacaaagaacttatatggaaacaatgttccctctttacaggttttttgggtttgtagttttgcacatggacgtgtacgctgctaatatctacttctggaggcgataccgtgtgaattactccttcatctttggattcaaacaaggcactgaacttggttatagacatgttctacttctcagctttggtcttggtacactttctttatgtgctgtcttattaaaccttgacatggaaatggatgctcaaacaaaagattacagattagtcaccgaacttatccccctctttcttctcgtattagtgattatcattgttctctgcccctttaacattttgtatcggtcaagccgattcttcttcctctcggttctgttccgctgcattgctgcaccattttacgcggtgcatcttccggactttttcttgggagatcaactaacaagccaggttcaagcactgaggagtctagagttctacatatgctactatggttttggagatttcagatatagacgacgaaacacctgcacatcaaatattggattcagaacattctacttcatcgtcgccgttataccttactggttacggtttcttcagtgcatccgaagaatggtggaagacagagatctgagtcatggctacaatggcatcaaataccttttgaccatcgttgctgcttctcttagaacagcttatactctaaaccgaggaagcaactggaatatcacagcttgggttttctcaggagttgcaacgttttacggaacttactgggacattgttcttgactggggattgcttcaaagaggatgtaagaatagtttcttgagagacaagcttcttgttcctcacaaaaccgtgtactacgctgcaatggtcctgaatgttttgttgaggttagtgtggttgcaaacagttttggatctgaaattctctttcttgcatagagaaactatggtcgcgcttatggcttgccttgagatcatacgcagaggtatctggaacttctttaggctggagaatgagcatttgaacaacgttgggagatacagggcgttcaaaactgtcccgttaccgttcaactacgaagaagatggagatcatcataacaattagctcgagacccagctttcttgtacaaagtggtgataaattggagctctgcagagctttcgttcgtatcatc

SEQ ID NO: 196 - DNA, 1131 bp, Zea mays
ttcttgtttgttgattaacccttaattaatccgggcgcgcctgatttatcacaagtttgtacaaaaaagcaggctcctgcaggaccatggcggtggaccgcgtggacggcgaggaggcgttcgaggaggtggacccgacggggcggttcgggcggtacgcggacgtgctggggctcgggtccgtcaagaaggtgtaccgcgggttcgaccaggaggaggggatcgaggtggcgtggaaccgtgtccggctgcggtcgctggccgaccgcgaccccggcatggtggagcgcctccacgccgaggtgcgcctcctccgctcgctcagccacgaccacatcatcggcttccacaaggtgtggctggaccgcgacgccggcgtcctcaacttcatcaccgaggtctgcacctccgggagcctccgcgagtaccgccaccgacaccgccacgtctccgtcaaggcgctcaagaagtgggcgcgccagatcctcgaggggctcaaccacctccacacccacgacccctgcatcatccaccgcgacctcaactgcagcaacgtcttcatcaatggcaacaacggccaggtcaagatcggcgacctcgggctggcggcgatcgtggacaagacgcacgtggcgcacaccatcctgggcacgccggagttcatggcgccggagctgtacacggagacgtacactgagtcggtggacatctactcgtacggcatgtgcgtgctggagatggtcacgcgggaggtgccctacgccgagtgcggcagcgtcgtgcagatcttccacaacgtcacccggggcgtcccgcccgcggcgctcaagcggctcaaggacgccgagctgcggggcttcatcgagcgctgcatcggccagccccggaaccggccctcggccgccgatctcctgcaggaccccttcttcaacggcgtccgtggcggggacgacgacgacgacgccacggcgctcgccgacgcctccagcgttgtcgccgccacgcccgtgccgcgccccaggagctacgtcgacgacctcgccgggctccggctggactgactcgagacccagctttcttgtacaaagtggtgataaattggagctctgcagagctttcgttcgtatcatc

SEQ ID NO: 197 - DNA, 1011 bp, Arabidopsis thaliana
atgggaggcacaaaattgacccatgtgaccaccactaaccctaataactccaacattcatggaccagtcgtagacgaagtagaaggccttattaaagtttacaaagatggccacgtggaacgatcccagctcttgccatgtgttgatccctcactacccctcgagctcggcgtgacttgctccgatgttgttatagacaagttgaccaacgtatgggcacgtctctatgtcccgatgaccacgaccaagtcgtcggtctctaagctccctttgattgtttacttccacggtggaggattctgcgtcggctcggcttcttggttgtgttaccacgagttcttggctagattgtccgctcgctcgcggtgcttggttatgtctgtaaattaccgtctagccccagagaaccctcttccagcagcttacgaagatggggtcaatgccattctttggctcaacaaagcaagaaacgataacttgtgggccaagcaatgtgactttggcagaatattcttggcaggagatagcgctggaggcaacatcgcgcagcaagtcgcggcaagattagcatcccccgaagatctagcactgaagatagaaggaaccatcctgatccaacctttctacagcggagaggagcgtacggagagtgagaggcgcgtggggaacgacaaaacagcggtgctgacactggcgtcgtccgacgcatggtggaggatgtctttgccacgtggtgcaaacagagagcatccttattgtaaacctgtgaagatgatcatcaagtcgtcgacggtgacaaggacgctggtgtgcgtggccgagatggatctgctcatggacagcaacatggagatgtgcgatggtaatgaggacgtgatcaagcgcgtgttgcacaaaggcgttggtcacgcgtttcatattctcggaaagtctcagcttgctcacaccacaactctggagatgttgtgccagatcgacgcttttatccaccactacgatcccttaaattag

SEQ ID NO: 198 - DNA, 438 bp, Arabidopsis thaliana
atggcttccaaggctttggttctgttgggtctctttgctgttcttctcgtcgtctcagaagtagccgcggcatcttctgccacagtgaattcagagagtaaggaaactgtgaaacctgatcaacgtggctacggtgacaatggaggaaattacaataacggaggaggttaccagggaggagggggtaattaccaaggaggaggaggtaattaccaaggaggaggaggtaattaccaaggaggaggaggaagataccaaggaggaggaggacggtaccaaggaggaggaggacgataccaaggaggcggtgggcgacaaggaggagggggaagtgggggaagttactgccgccacggctgctgctacagaggttacaacggctgctcaagatgctgctcgtatgccggagaagctgttcagactcagcccggtcactaa

SEQ ID NO: 199 - DNA, 537 bp, Arabidopsis thaliana
atgcagtactacgaaaaccgtgagaaagactactacgaggtggctcaaggccaacgcaatggttatggccagagccagagccacaaccacgagggatatggccagagccagagccgtgggggatatggccagatccataaccgtgagggttataaccaaaaccgtgagggatatagccaaagccagagtcgcccagtatatgggcttagcccgactttgaaccaccgtagccacggtgggtttcttgatgggctcttcaagggtcaaaatggccaaaagggtcagagtgggctaggcacgtttctagggcaacacaagagccaagaggctaaaaagagtcaaggacatgggaagctcttggggcaacatgaccagaagaaaactcatgagacaaacagtggtcttaatggccttggaatgttcattaacaatggtgagaagaaacataggaggaaaagtgagcacaagaagaagaacaaggatgggcatggcagtggtaatgagagtggaagcagcagcggtagcgacagcgactga

SEQ ID NO: 200 - DNA, 583 bp, Glycine max
ttaattaaggtatcgagggaaaaatatggcggaagaacacagatgccaggcaccgcgcttctgcgccaacaattgcggtttctttggcagccctgccacgcagaatatgtgctccaagtgctaccgcgatttccagctcaaggagcagcaatcttccaacgccaagatggttctcaatcagtcgctggttccttcaccgccaccggcggtgatttctcagccgtcgtcttcttcttcggccgcggtagatccgtcatcggcggtggttgatgacgcgccacgcgagtcggaggaggttaaggcgccgcagcagaaccggtgtatgacgtgcaggcggcgcgtggggctcacagggttcaagtgtcggtgcgggatgatgctgtgcgggacccaccgttacccggagcagcacgcgtgcgagttcgacttcaaggggatggggagagagcagatcgcgaaggcgaatccggtggtgaagggcgagaagctcgacaagatctgaaacgaatgaacgaagggtgttatggtaatttcgtgtttatcaagttggtggtgatggataacggatgcgaaacatttaaat

SEQ ID NO: 201 - DNA, 1648 bp, Escherichia coli K12
tttatttgtcagctttcaaactctttgtttcttgtttgttgattaacccttaattaatccgggcgcgcctgatttatcacaagtttgtacaaaaaagcaggctcctgcaggaccatgaaacttaacgacagtaacttattccgccagcaggcgttgattaacggggaatggctggacgccaacaatggtgaagccatcgacgtcaccaatccggcgaacggcgacaagctgggtagcgtgccgaaaatgggcgcggatgaaacccgcgccgctatcgacgccgccaaccgcgccctgcccgcctggcgcgcgctcaccgccaaagaacgcgccaccattctgcgcaactggttcaatttgatgatggagcatcaggacgatttagcgcgcctgatgaccctcgaacagggtaaaccactggccgaagcgaaaggcgaaatcagctacgccgcctcctttattgagtggtttgccgaagaaggcaaacgcatttatggcgacaccattcctggtcatcaggccgataaacgcctgattgttatcaagcagccgattggcgtcaccgcggctatcacgccgtggaacttcccggcggcgatgattacccgcaaagccggtccggcgctggcagcaggctgcaccatggtgctgaagcccgccagtcagacgccgttctctgcgctggcgctggcggagctggcgatccgcgcgggcgttccggctggggtatttaacgtggtcaccggttcggcgggcgcggtcggtaacgaactgaccagtaacccgctggtgcgcaaactgtcgtttaccggttcgaccgaaattggccgccagttaatggaacagtgcgcgaaagacatcaagaaagtgtcgctggagctgggcggtaacgcgccgtttatcgtctttgacgatgccgacctcgacaaagccgtggaaggcgcgctggcctcgaaattccgcaacgccgggcaaacctgcgtctgcgccaaccgcctgtatgtgcaggacggcgtgtatgaccgttttgccgaaaaattgcagcaggcagtgagcaaactgcacatcggcgacgggctggataacggcgtcaccatcgggccgctgatcgatgaaaaagcggtagcaaaagtggaagagcatattgccgatgcgctggagaaaggcgcgcgcgtggtttgcggcggtaaagcgcacgaacgcggcggcaacttcttccagccgaccattctggtggacgttccggccaacgccaaagtgtcgaaagaagagacgttcggccccctcgccccgctgttccgctttaaagatgaagctgatgtgattgcgcaagccaatgacaccgagtttggccttgccgcctatttctacgcccgtgatttaagccgcgtcttccgcgtgggcgaagcgctggagtacggcatcgtcggcatcaataccggcattatttccaatgaagtggccccgttcggcggcatcaaagcctcgggtctgggtcgtgaaggttcgaagtatggcatcgaagattacttagaaatcaaatatatgtgcatcggtctttaactcgagacccagctttcttgtacaaagtggtgataaattggagctctgcagagctttcgttcgtatcatcggtttcgacaacgtt

SEQ ID NO: 202 - DNA, 1558 bp, Arabidopsis thaliana
tttcttgtttgttgattaacccttaattaagatggcgatagtcataggtttacttgaaatcttcacagcatttgttttcttcattttcttccaatgtttattactccacaagaaaactcccaagcctttgctcacgaactggccggcccttgggatgcttccgggtctactcctccaagtgcctcgtatctacgactggatcaccgaggttcttgaggcgacagatatgacgttttgtttcaaaggtccatgtcttagcggaatggacatcttgcttactgttgatccggtgaatatccactacattctaagctcaaattttgctaactaccccaaaggaatggagttcaagaagatcttcgaagtcgtgggtgattcaattttcaacgttgactcgggtttgtgggaggatatgaggaactcgtctcatgccatttttagtaatcaagatttccaaatgttctgggtgagtacaagtgtaagaaaattaaggcaagggcttgttcctattcttgaaaacgcagctgataaaaatatccttgtcgacttgcaagatttgttccagagattcttgtttgatacatctttgattttgatgaccgggtatgatccaaaatgtttatccgttgaaatgcctaaggttgagttcggtgacgcggtcgatggtgtttctgacggggttttctatagacatgttaagccggttttcttgtggaggctccaatatttgattggtgtaggagtagagaaaagattgaaaagaggtctagcggtattcgatcaactactcgagaagatcataacggctaaacgagaggagatcaatagtcatgggactcatcatccctcaagaggagaggccatagacgtgttgacatactacatgactatggacacgaccaaatataagtacttggaaccaagtgatgatagattcatcaaagacactattttgggtttcttgatagcggcaagagatacaacaagttcagcactcacttggttcttctggcttatgtccaagaaccctgaggcaataaacaagatccgacaagaggttaacaagaagatgccgaggtttgatcccgcagatttagaaaagctcgtgtatctacacggtgccgtgtgtgagacgctaaggttatacccaccagttccatttaaccacaagtcaccggcaaagccagacgtacttccaagtgggcatagagtagatgagaaatggaagattgtcatatctatgtatgcattagggaggatgaaatctgtttggggagatgacgcagaagatttcagaccagagagatggatttcagacagtggaaggttaaaacatgaaccttcatataagttcttggcgtttaacgccggtccaagagcttgcttggggaaaaagttaacgttcttacagatgaagacagtggctgcggaaatcatacgaaactatgacatcaaggtcgttgaagggcacaaaaccgaaccagttccttctgttctttttcgtatgcaacatggtctcaaagttaatatcactaggatctagatttaaatacccagc

SEQ ID NO: 203 - DNA, 1557 bp, Synechocystis sp.
tcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgaccccagaattgaatcctaattttcccgaagaaactacctccgatgcttggctgaccccagcagatgccggccaggatggtgatgcccaggaaccggcggaagatgggggagaagaaggagtagtgtcggaagaactggccctgcctgaggacttacctcctatggatgccatggtggcggcagtggaagaaatgactccggtggtggtgcccgaaactgtaccagaaacagaaaccccagccttagaggatttggtcgcccaaaagaccgccctggaaaaggacattgccgctctgcaacgggaaaaagcccagtggtatggccagcagttccagcaattacagcgggaaatggcccggttagtggaggaaggcaccagggaattagggcaaagaaaagcagctctggaaaaggaaattgagaagttagagcgccgtcaggaacggattcaacaggaaatgcgtaccacttttgccggggcttcccaggagttggccatccgcgtgcagggctttaaggattatttggtggggagtttgcaggatttggtttccgccgccgaccagttggaattaggggtgggggacagttgggagtcttcctctacccatggggatgcgattattgaaaatgccgacccaactccggtggtgagttttgcggagcagggttttagtagccaaaaacgacaaatccaagctttgctggagcaataccgcactcgccctgattattacggtcccccttggcagttgcgtcgtacctttgagccagtccacgccgaacggattgagaattggttctttaccctgggcggtcggggagcaatcctcagtttagacagtcgtttacaaaatattttggtgggttcagcggcgatcgccattttgaatcagctctacggcgatcgttgtcgggcgttaattttggcggccaccccagaaagattgggggaatggcgacggggtttacaggattgtttgggtatttcccgcagtgactttggcccagaccggggcattgttttgtttgaatcggccaatgccttgatccagcgggcggaaagattggtcggcgatcgccaaatgccgttggtgttggtggatgaaacagaggaacaaattgacttagccctgttgcaattcccccttttactggcctttgcacctagttaccaagtcggaggcagtaactatttttcttagatttaaatacccagcaaatacccagcaaattggagctct

SEQ ID NO: 204 - DNA, 1055 bp, Arabidopsis thaliana
ttaattaaaaattgggaagaattttgacatggaggaggaccggtgttcgatcaaggatgatgcaactcaattgataggtaacaccccaatggtatatctgaacaacattgtggatggttgtgtagctcgtattgcagctaagcttgaaatgatggagccttgctctagtgtcaaggagcgaattgcttatggtatgattaaagatgcagaagacaagggattgattactcctgggaagagcacactgattgaggctacctctggtaacaccgggattggtttagccttcatcggtgcagctaaaggttacaaagtggtcctcacaatgccctcatcaatgagccttgagagaaaaatcattcttttagcattaggtgcggaggttcacctcacagatcctagtaaaggcgttcaaggaataatcgacaaagctgaagagatatgtagcaaaaatccagatagtatcatgctagaacagttcaaaaatccttcaaacccgcaaactcattatcgaaccacgggtccagagatatggagagactctgcaggggaagtagacatattggttgccggtgttggaactggtggaacgctttccggatcaggaagattcctcaaggagaagaataaagactttaaggtttatggtgtggaacctacagaaagtgcggtaataagtggaggcaaaccgggtacacatttgatccaaggtattggggctggactcatcccagacaatttggatttcaacgttcttgatgaagtcatccaagtgacaagtgtggaagcaattgaaacagccaaacttcttgccctgaaagaaggattactggtgggaatatcttctggagctgctgcagccgctgcgataaaggtggcaaagcggccagaaaacgccggcaaactcatagttgtgattttccctagcggtggggaacgttacctatcgacctcattgttcgaatcagtcagacatgaagcagagaatttgccaattcaatgaggcttttacacgacctgacttggttcgttttggtgaaaaagtacggcgcgcc

SEQ ID NO: 205 - DNA, 761 bp, Arabidopsis thaliana
ttaattaacgacttttgttttccgggttttgtcaataatggattccgattcatggagtgatcgtctcgcttcagctacgaggagataccagctagcttttccatcacgatctgatacattcttagggtttgaagagatagatggagaagaagagttcagggaagagtttgcttgccctttctgttctgactattttgatattgtctctctctgctgccacatagatgaagatcatcctatggaagccaaaaatggggtatgtccagtttgtgcggttagggtgggtgttgacatggttgctcatataacccttcagcacgctaatattttcaagatgcaccgcaagagaaaaccaagaagaggcgggtcatattccacattatcgatcttaaggagagagtttcctgatggaaactttcagagcctctttggaggatcttcgtgtatagtatcgtcttcctcatcatccaatgtagctgctgacccattgttatcgtcgttcatttctcctattgctgatgggttcttcaccacggagtcatgcatatctgcagaaacgggtcctgtcaagaaaacaactattcagtgtttacccgaacagaatgcgaaaaaaacttctctttcagctgaggatcacaagcagaagttgaaacgcagtgagtttgttcgagagctattgagctctacgattcttgatgacagcttataatggagtatcgcttctggtaacttgtcagcaatgaggaaactccaggcgcgcc

SEQ ID NO: 206 - DNA, 799 bp, Arabidopsis thaliana
ttaattaagtaatgaagaaaacgaagacgatggtggcttccatctccacccttattagacggacctatccttcaactaaccagtgtaattcactcgcgacgattcaatcacaaacccaattgcctcgcgaatctctgcaacatcattcttcagctgagggacgactccgattctccgggagagttttctgctcggaatctggcgccggatgctggaactgtggcgagaaagctgcctttttgttctgtaactcatgccgtagcattcaacctgttgatgactccgtcgactattttcagatttttggcctggagaagaagtatgagatagatcctggaagccttgaaggcaagtacaaagattggcaaaagaagctacatcctgatttagttcataacaaatctaagaaagaacgagactacgcagccgagcagtctgcaaaggtgactgaagcgtgccggacattaacaaagcggctgtcgagagcaatgtatatcatgaagctgaatggtgtaaatgtcaatgaagaagaaacaataacagacccaacattgttaatggagattatggaactcagagaggccatatcagaagcagatgattcaacatcgttaaaccagatccgatcccaggtacaagagaaactaaagcaatggtctgactctttcgtcgaagcgtttgaaagccagaagtttgatgatgctgtaaaatgtatacagagaatgacttattacgagcgagcctgcgaagaaattttgaagaagctatgaggcaattagtcctcccttaaaggcgcgcc

SEQ ID NO: 207 - DNA, 1599 bp, Arabidopsis thaliana
ttaattaaatgtatatgatagagagcaaaggaggagcaattgcatgtatgctcttggctcttctcttcttagggacatggccagcaatcatgactctaaccgaaagacgcggtcgacttcctcaacacacttatcttgactacacactcacaaatctgttagctgcagtgatcatagcgttgacactaggagaaataggtccgagcagaccaaatttctttacacagctctctcaagtcagtcacatcttcttacttctccttagacatcttgtcgaaaactattgtataaccgcggtttttttttttatcataggataattggcagtcagtgatgtttgcaatggctggaggaatagttcttagccttggaaacttagcaacacaatatgcttgggcttatgttggtttatcagttactgaagtcatcacagctagtatcactgttgttatcggtacactcttctttcttcaactactcttaactgattttttcctctgtttcttctctgttcttatgaccatttctgttttctagtacaggcacaactttgaactatttcttggatgatagaatcaacagagctgaggtccttttcccgggggtcgcttgtttcttgatcgctgtttgtttcggttccgctgttcataaatccaatgctgctgataacaaaaccaaactccaaaatttcaaaaggtttgaaaaagattcatatctattgttgtttccgtttggtttggtttggtactaatcttgatcttgtttcagtttagagactacttcttccttcgaaatggaaacaatttctgcaagcaacgggttaacaaaagggaaagcgaaagaagggactgcagcttttctcatagagcttgagaagcaaagagctataaaggttgaaacatactactcttcctttaccctaacagatataactgatatgtatatatgttctctgaagattcatgattggcattgaggacaggtctttggcaaaagcacaataatcggattggtgataactttctttgccggtatctgcttttctctgttctcacctgcattcaacttagcaacaaacgatcaatggcacacattaaaacatggagttccaaaactaaatgtgtacactgccttcttctacttctccatctctgcatttgtagttgctctgatacttaacatcagatttctctattggcctatacttggtctcccaagatcttctttcaaggcttatttgaatgactggaacggtcgaggctggtctttcttggctggatttctatgtggatttggcaatggtcttcagttcatgggtggtcaagccgcaggctatgcagctgcagacgctgttcaggtttagacaataaacaaatcctctgttccatgatttaagagtgaaatatgttttacttattatgatttgaatatgtttcaggcacttccacttgtgagtacattttgggggatattgttgtttggagaatatagaagatcatcaagaaaaacatatacacttctcatcagtatgcttcttatgttcatagtcgctgtcgcggttcttatggcttcctcgggacatagaaaatgaggcgcgcc

SEQ ID NO: 208 - DNA, 1286 bp, Synechocystis sp. PCC 6803
aactctttgtttcttgtttgttgattaacccttaattaatccgggcgcgcctgatttatcacaagtttgtacaaaaaagcaggctcctgcaggaccatgaaatcccgtgccgccgttgcctttgaagtgggcaaacctttgcaaattgtggaaatagatgtggctccaccccagcaaggcgaagttttggtcaagatcacccataccggagtctgccacacggacgcatttaccctcagcggcgatgacccggaaggactttttcccgttgtgctgggccatgagggagcaggcattgtggttgaagtgggggaaggggtaaccagtgttcaactgggagaccacgttatccccctttacactgctgaatgtgggaaatgtttgttttgtcgctccggtaaaaccaatctctgcgttgcagtgcgggccacccaaggcaaaggggttatgcccgatggcaccagtcgtttttcctacaatggccagtccctctatcactacatgggttgtagcacctttagcgaatataccgttgttgccgaagtttccctcgccaaaattaaccccgaagcaaaccacgaacacgtttgtttactgggttgcggcgtcaccacaggcatcggcgctgtgcacaataccgccaaagtacaaccaggagactcagtggcggtgtttggcctggggggcatcggcctcgctgttgtacagggagctcgtcaggccaaagctggtcgcatcattgccatcgacaccaaccccgccaaatttgagctagcgaagcagatgggcgccactgactgcattaatcccaaagaccatgaccaacccattcagcaagtcatagtggaaatgaccggctggggagtggaccactcctttgaatgcatcggcaatgtggaagtaatgcgctccgctctggaatgtgcccaccggggttgggggcaatcggtaatcattggcgtagcaggggctggccaagaaatttccaccagaccattccagcttgttaccggccgcaaatggatgggcaccgcttttggcggtgtgaaaggtcgttcccaattaccaggtatggtggaacaatccatgcggggggagatccaactagccccctttgttacccacaccatggaactaaaggatatcaaccaagcctttgacctcatgcatgacggcaaatcgattcgcagtgtgatccactactaactcgagacccagctttcttgtacaaagtggtgataaattggagctctgcagagctttcgttcgtatcatcggtttcgaca

SEQ ID NO: 209 - DNA, 1462 bp, Arabidopsis thaliana
ttaattaaatggcgagaccgagacgaagaaacacagagatcggtgatggcttcacagagatattcaacagagagattggtttctctcatccaatcaccatctctcgtcgaatctccgcttctgaggggagagtgaagaaactagatctttacgggaagttaaatggtcatgagggatgtgtgaatgcagtggagttcaattcgactggcgatgttcttgtttccgggtccgatgatcgacaaatcatgctctggaactggttgagtggaagcaggaagttgtcgtatccctctggccattgtgaaaatgtgtttcagactaagttcataccttttacggatgacaggacaatcataacatctggtgctgatggacaagtaagacttggtcagatcctagaaaatggtaaagtggagacgaaaagactagggaggcatcacggtcgcgtgtacaagcttgctgttttgcctggagatcctaacgtattctacagctgtggtgaagatggttttgttcaacattttgatatacgcagcaacagtgctactatggttttgtattcctctccgttcacacaaggatgcaggagacatcactccagcagtaggatcagattgaattctattgcgatagatccgaggaattcatattatcttgcggttgggggttctgatgaatatgcacgagtctacgatactagaagagtacaattagctccagtatgtcgccacgtcttaccagacgctcctgtgaacactttctgtcctcgtcatctccgggaaaccaacagtgttcacatcacgggattagcatattccaaagctggagaactattggtctcttacaacgacgagcttatttatctgtttgagaagaacatgggttatggttcgtcgcctgtttctgtctctcctgagaaactgcaagaaatggaagaaccacaggtgtatataggtcaccgcaatgcacaaacagtgaaaggagtgaacttctttggtccaaatgatgaatatgtcacgagtggttcagactgcggtcacatttttatatggaagaagaaaggaggtaagcttgtccgagctatggtgggtgatagacgagtggtgaatcagttagagtctcacccacacataccgttacttgcatcctgcgggattgaaaagagcgttaagctctggacgccaatgtcaaatgatgttctttccctgcctgaaaagatcgataaggtgatggaattgaacagggtggggagagaagaccaatcgagggtaacactgactcctgatgtaattatgcatgttcttaggctacagagacgtcagacgtcggcttttacagagaggagatacgtttcaactgacattggcagtgatgaaggaaatgatgctcgcttcattgcaagcttagtagccaacgacgatgagtcttcagacagagaatgtactgtaagctgaggcgcgcc

SEQ ID NO: 210 - DNA, 1900 bp, Arabidopsis thaliana
ttaattaaatgattaccttcaaatctatagctctaacgataatcttcctatcatattttgtttcttgtgtctcaagtcaacgagagaccaagtttcttaaccatggcttcctcggggctaatctcctcaacttcggctcctccaaggtctacccaagtggcctcttggagttgacaaacacttcgatgaggcagataggtcaagcttttcatggctttcccatccccttgtcaaaccctaactcaacaaattcggtttctttttccacaagcttcatcttcgccatcactcaaggaaccggcgcaccaggccatggcctagctttcgtcatttcaccctcgatggacttcagtggtgcttttcccagcaattatctgggcctcttcaacacctccaacaatggaaactccttgaatcgaattcttgcaattgaatttgacaccgtgcaagcggttgagttgaatgatattgacgataaccacgtaggcatcgacctaaatggagtgatctccattgcgtctgcaccggctgcatattttgatgaccgagaggccaagaacataagcttgaggctggcgagtgggaaaccagtaagagtctggatcgaatacaacgccactgagacaatgcttaatgtcacattggctcctctagatcgtccgaagccaagtatacctcttctctcgagaaaaatgaatctttcagggattttctcccaagaacatcacgttggattctctgcgtccacggggactgtagcgagctcacattttgttctaggttggagcttcaacatcgaagggaaagaatcagactttgatatcacgaagcttccttctctcccagatccgccaccaacattgtctccatccccaagtcctccggtttcaaccgagaagaagtcgaacaacacgatgctgatcataatcgtcgctgcatcagcaacggttgcactcatgatcctaatcttctcaggattttggttcttacgtagagacaaaatattcttcatcggaggtgcaaggaaattctcctaccagacgatatcgaacgcaacgggaggtttcgacaattctaaactcttgggagagagaaactctggaagtttctacaaaggacagcttgctcccacagagataattgccgtaaagaagattacttgcaccacaaggcaacaaaagacaaccctaatagccgagatcgatgcgatctccaagattaaacaacgaaacctagtcaatctacatggttactgcagcaaaggaaaagatatctatcttgtttacgagtatgtccccaatggaagcctagaccggttcttgttcaacaacgaccgaccagttctcacctggtcagatcggttctgtataataaaggggattgcagcagcacttcaacaccttcacggtgaaggtcaaaaacctttgattcatggaaacgtaaaagcaagcaacgtactcttagacgaagagctaaacgctcgactaggcgactatggacaaggaagcagacacagcaccacagggcacgttgcaccagaactagtcaacacgggaaaggtaacacgtgacacagatgtgtttgcgtttggagtgttgatgatggagatcgtttgtggaaggaaggccatagagccgactaaagcaccagaagagataagtttggtgaactgggtgcttcaagggttcaagaaaggtgatctgttaatgagctgcgacacaagaatcaatagagagaatttggtagctcgagaagtattattggttctgaaaacaggacttctctgcgccaaccgatctccagaatcaaggccaatgatgaaaaatgtgtttcggtatctcgaaggaactgaagctctccctcatgatgactacctcttctatggagtctaaggcgcgcc

SEQ ID NO: 211 - DNA, 850 bp, Arabidopsis thaliana
ttaattaaatggctgcctcataccacgtccgatctagtagcttaccagctcggctacacccacatggtctcaaccaaattcagcaactccttaataagcttcgtgcagatgataacaatagtctctcacttctctcaaatctctacgactctgtctctcatcttttcaacgattcaccttcttcacttctagtccctcatcactctttcttcactcaccttcttgatctctcccttttacaccttgacttgtgttccaagctaagagacatcacttgccgcatcaaggattgcctccgcgacctccgttctgctttcagacggaggagacacagtggagattctaccattcggtgtcacgtcaaagcttttatccgctctaggaaagcggttcataaggacattgctaagctactcttgttgctcaaacaaaccggcctatcctcatctgagtcctctcatcccttgatcacactgctccaacaagtttgttcccaaacatgtcaaacctttaggacagtcttgttgtccctatccacagctgtacctaagcccaggccttccaaatgggccctggtcaccaaactggtgatcaagaacgttactagtacaagtggtcaagttaggactggacacagaaacgaattccagatgatggacgaagaactgcgaagattcagcatggcagaagagataaagaaggatcggatcaagtctatgatcaccaacttggataaagtagatgtagcggttgaagatctggaggagtcgctcgaaagattgtacagacgtatgatccaagctagagtttctttattgaacatactctctttgcatatataaggcgcgcc

SEQ ID NO: 212 - DNA, 1208 bp, Arabidopsis thaliana
ttaattaacatgtacggatctagggggtatgtattcttacattcgatcgccatttattctactggatttattttcctgttgcctgattggtattaatcgatttgtgttggaaaatcttgaggaatttagagggttggtgtataggaagaggatctggaatcgattattgtcattttgctacttgttgttatttgttccattaggtatataatcgatatgagtgtcattggtcgttgtttaggttcggtatttgtttgtgtggtgtataattaagaatgggtcttacttactatacaacatatatagactaagaatgacagggaagtctgggttgggtgtggttatattaactggttgagttgggggatctttttccgggtttcttgtttggtaattgaagggccatgtttgggagcggggggtacgaggtgggatcaaagagacaaagaatgatgcaatcaaatccctacttggcagttggcactggacctaccagctttccaccttttggctatgccggcggattcccagtcgttcgcctcaggggtcttcccttcaactgcgctgacattgacatcttcgagttctttgcgggcctcaacattgtcgatgtcctgctcgtcagcaaaaacggtaaattctctggggaggcctttgtggtgtttgccggccctatgcaagtcgagattgccttgcaaagggacagacacaatatggggaggagatacgtggaagttttccggtgctctaagcaggactactacaatgcggtggctgctgaggagggagcgtatgagtatgaggtacgtgctagcccacctcccaccgggccatccagggcaaagaggtttagtgagaaagagaagcttgagtacacagaggttttgaagatgcgaggcctcccttactcggtgaacaaacctcaaatcatagagtttttcagcgggtacaaggttatccaaggacgggtacaggttgtgtgtcggcctgatgggaaggccacgggagaggcatttgtggagtttgagacgggggaggaggcgaggagggcaatggctaaggacaaaatgtcgattgggtcaaggtatgtggagttgtttccaactacacgtgaagaggctcgaagggctgaggccagatctaggcaatgactctttccttcactatgtatcattatatatatcctttggaccaattttgggcgcgcc

SEQ ID NO: 213 - DNA, 2111 bp, Arabidopsis thaliana
ttaattaaatgattcttgatttgggttttccttgttttgttcctcctcgaaccagctctcgtgaggacaacaaagcttggcttctggctgaaacagagccgaagcttattgactcagaacaacattcgttgcagtcttcgtttaggtttagtctttgctcacagttggagctggagaagattaaaaaggagaaaccttcgttgtcttatcggaattttccagtgtctgaaggatcagagacggttctgctagtgaatctggagaatgagacaggagaattgacaggtgagatgaattggtcgagaggcctttcactggagaagagtatttctccggtggccgattctttgatccgattcagttaccgcgaactcctcactgccacgcgcaatttctcaaaacgtaaaccctaaaacaccctcaaaatgtcctgttattgttcttattttttttgtactttgatatgttagatctttgaattgtatttgaggaagatgtgttgaaattggttagggagggttttgggaagaggagcttgtagctatgtttttaagggaagaatcgggatttggcgtaaagccgtggccatcaaaagacttgataaaaaagataaagaatctccaaagtcgttttgcagagagttgatgattgcaagctctcttaatagccccaacgttgtgcctctgctaggtttctgtatcgatcccgatcaagggcttttcttggtgtacaagtatgtgtctggtggcagcctcgaacgctttttacatggtaattactctatttcctctctttctttaccattggattgaaatttgtgcatagattgacgggttttactcggtttcaaaataagataagaagaaaaagaagagtaggaagacccccttgaatctgccttggtctacaaggtacaaggttgccttaggtattgcagatgccatagcctatttacataatggcactgagcaatgcgttgtgcatagagacattaaaccctcaaatattcttctttcctcaaacaaaattccaaaggtaaagagactttgaaccactctttagtcatttgtcaacataagtgtgttctgtattcactgttggagtttttctttcagttgtgtgattttgggttggctacttggaccgctgcgccttcggttcctttcctctgtaaaaccgtgaaaggaacttttgggtatctaacttataaaccttttgatgccataaagtcacacctatagatgttaagtgcgcaataaattggaaaacttttgcagttatctggctcctgagtatttccaacacggcaagatatctgacaagaccgatgtttacgcatttggagtcgtgttgcttgagctaataactggtcggaagccaattgaagcaagaagaccatctggtgaagaaaatttggtagtttgggtaagtgtaattttacttttgtatattttcttgataaactactagtaaaccaacctatttgacttttggtagttgtagcacttatactccacaagccccttttcctataaatggacgcttctcaatacatcaattcgaatttgtgacttgacatactaaattcgggttttggtcaagctaaaaattacggttcaactaagttttaatgatctttaaactgttaacgatttataacattgtcaaatgcagtttaagacctttttaataaaaaataaccattttggctacacttctgcttgcatcaatggcttggttttatatatttttgtgcaggcaaaaccgttgttgcatagagggatagaagctacagaggagttgctagatccaaggctgaaatgtactagaaaaaactcggcttcgatggagcgtatgatccgagctgcggcagcgtgtgtgatcaatgaggaatcacgaagaccggggatgaaggagatactttcaatcctaaaaggcggtgaagggatagaactaaggacgttatcaagccggaagaaatcaaatcttccgggtataatggactgttatccgcagttgcaacggacaaaatctgagatgaagagtcatcttacgcttgcgatgctcggagtaacggaatttgaagctgatgatcttttgtagggcgcgcc

SEQ ID NO: 214 - DNA, 737 bp, Zea mays
aaaaaagcaggctcctgcaggaccatgggcaacggcccctctctctcgccgtgcctgaacccgcacctgccggagtcgtccgcgacggtgcgcctggtgtactggggcgggcgggcgaggcagctggcgctcacgggcggcggcgacgacgccattgtcacggccggtgacgtcgcggcggagctcccaccgccggccacgggctacgccgtgtgccccgccgacgccttcttcatcggcctcccgatcccggccatgtccccgggcgaggagctcctgccgggccgcacctactttgtgctccccgccgcgcgcctcccctgcctcaaggcgctcacgcccgccacgctcgccgcgctgtcgcaatcgcacggcagaaagaagcagcagcctatcttcgcggtcgcggggtgcccgttcgagcacgtcaagggcgcccacggcggcgccccgctcatcagggtcctcccggagttcatcgagaagctcatcaccgcctgcgacgccggcgcgaacgcgagcgccaacaaggacacggcggccaagcaggccgcggagctgtgcagcacgcccgagctgaagcggcattacgcgcagctcgtcggggccggcaggagccgcccgtggtcgcccaggctggagaccatcgccgagcgcggtaggtcacggtggatgaggttggcggcgaggaccatgctgtcctcgcgttagctcgagacccagctttcttgtacaaa

SEQ ID NO: 215 - DNA, 1071 bp, Chlorobaculum tepidum
ttcttgtttgttgattaacccttaattaatccgggcgcgcctgatttatcacaagtttgtacaaaaaagcaggctcctgcaggaccatgaagataggctttgtaggcctcggcaagatgggctccaatatggtcgagcatctgcttgaacttggtcacgaagtagttgcattcgatctctcggcggaagcggtcaaagcgattgcggccaaaggggcgacggcggccagttcgttgcagcatctggtcggtgaacttgccgcgccgcgcgtcgtgtggatgatggtgcctgccggtcgtccggtcgatgcggtgatcgacggtctcacgccgtttctcagagcgggtgacatcgttatcgacggcggcaactcgcgctacaccgactcggtcgcccgagcggaaaagcttcgcaagcagggcatccggatgctcgacatcggtaccagcggcgggctggacggcgcccggcacggggcgtgcatgatggccgggggcgaccgcgaggcctatgagcacgtcgagccggtgctgcgcgacctctgcgtcgagaacggctacggctatatgggcgcgtctggctccgggcacttcgtgaagatggtgcacaacggcatcgaatacggcatgatgcaggcgatcggcgaagggttcgagctgctccgggccagcggctacgacctcgataaccagaatgtggcgcgggtctggtcgaacggttcggtcatccgtggctggctcatggatctggcgggcaaggcgttcgctcagggtaacgatctcggctggcttggcggcaaggtggccgattctggcgaggggcgctggacggtcgaggcggccatcgaactcggcgtggcggtaccgatcatctctggttcgctgttccggcgcttccagtcgcagaacgaagaacacttttctgacaaggtggttgctgcgcttcgccacgagttcggcgggcacgcctacgagaaacctggcgaaggggagggcaaagcatgactcgagacccagctttcttgtacaaagtggtgataaattggagctctgcagagctttcgttcgtatc

SEQ ID NO: 216 - DNA, 564 bp, Zea mays
ttcttgtttgttgattaacccttaattaatccgggcgcgcctgatttatcacaagtttgtacaaaaaagcaggctcctgcaggaccatggcaagtacagcatgctttgtgattgtcagtaagaatgacatcccaatctatgaggcagaagttggatctgcacccaaaaaagaagatttgtcttatcaccatcagtttattctgcatgctgcattagatgttgttcaggatctagcatggacaacaaatgcaatgttcctgaagtcagttgatagattcaatgaccttgtggtgtctgtttatgtaactgctggtcataccagattcatgctgcttcatgactcgcgtagcgaggatggaataaaaagcttttttcaagaggtccatgaactttacatcaagatattcctcaacccgctttacctgcccggctctcgcatcacatcctctcatttcgataccaaggtgagggcgctcgcgaggaggtacctgtaactcgagacccagctttcttgtacaaagtggtgataaattggagctctgcagagctttcgttcgtatcatc

SEQ ID NO: 217 - DNA, 1836 bp, Arabidopsis thaliana
ttcttgtttgttgattaacccttaattaatccgggcgcgcctgatttatcacaagtttgtacaaaaaagcaggctcctgcaggaccatgaattcacacttcatacaagaagcttcagaagcttgcttcaatggctgctgttcatcaccattctcatcccattccatgtctgagaaaccagaagagctcgagttctcagtaaccacaacaggaacttctttcctgaccagaaacaccaaattcaccagccaagaatctctccctcgtctccgtacatctttctacgatctcatcacagcttttccagattacttgcagacgaatcaagccgatcatctccgttctacagagtaccaaaacctctcatcatcctctcacgtctttggtcaacaacaacccttgttctcttactctcagtttcgagaaatatccgaatcagaatccgatttgaatcattctctcttaaccttgtcttgcaagcaagtaagctctggtaaagaactgttatcattcgaagaagaatctcggtttcagtcaaggataaggaaaagaatcacgagttttatgaatctcgaagaatctgaatatcacatgattctaactcaagaccgttcctctgctttcaagattgtagcagaactttactctttcaaaacaaatcccaatcttctcacagtgtacaactacgaagacgaagcagttgaagaaatgatcagaatctcagagaaaaagggtataaaaccccaatcagccgagttttcatggccgagcactgagattctatcggagaaactgaagaggagaatcactagaagtaagagaagaggtaaaagaggactctttgtgtttccacttcaatctctggtcacaggagcttcgtattcttactcatggatgagtttagctcgcgaaagcgaatggcacgtgttgcttgatacctctgctttaggttctaaagacatggaaactttagggctttctctgttccaaccagatttcctcatctgttcttttacagaggttttaggtcaagatgatccttctggtttcggttgcttgttcgttaagaaatctagctctacagctttgtcagaggaaccaacgaatccggagaatctcacggcagtaaaagcagagccatcttggaaatggaaaacagagtatcaagcaggatataacgagattacccctgtggaccacgaggaccacaaggcagcttctacttctagctctgagatagttgaaatcgaatcatcggttaaacaagataaagcaatgattgagtttcaaggattagatcacgcagattctctaggactaatactaatcagtagaaggtcaaagtcgttgactttatggttactacgagccttgaggactctgcaacatccaggctatcatcaaacagagatgcctctggtcaaactctacggaccaaagacaaaaccaagccgaggaccgtcgatttctttcaacattttcgattggcaaggcgaaaaagtcgatcctttgatggtggagaggcttgcagagagggaaaagattggtttacgatgcgcttatttgcataagtttaggattggaaacaagagaagaagtgatgaagctgtgagcttgagattgtcagtggtgactgttaggttaggagggtttatgacgaattttgaggatgtttttaaggtttgggagtttgtgtcgaggtttttggatgctgattttgttgagaaagagaagtggagaatgaaagctcttgacaaaaacaaatgactcgagacccagctttcttgtacaaagtggtgataaattggagctctgcagagctttcgttcgtatcatc

SEQ ID NO: 218 - DNA, 519 bp, Arabidopsis thaliana
ttaattaatgatgaacacgtacaacatggtgaagcaagaatttatcaagaaatggataaatactctccacatgttagattcttctatcgaacatcctttgaacgtaacggaaaggaaaaatgcgattagactatcatcggacttagccatggcagctgctcgaaatggctctaccgtatggagccgcgctcttatttctaggagcggaaataagacagcaaacaaacccatggcacgtcgaatactaaaaaaagctcgaaatcggatgaagaaccgttgtaacattcttagacgaaatggcaatttcacggcgaaaacctgggtgagaaaacgtacggacttgcttaagagtcttgtaccgggaggtgagttgatagacgacaaagattatttgataagagagacacttgactacattgtctatctccgagcacaagtggacgtcatgcgaaccgtcgcagccgtcgatttattcacccgaaacttaaccaacgatcgtaggaacaaataaggcgcgcc

SEQ ID NO: 219 - DNA, 1737 bp, Zea mays
gggtccaaactagcctgaccaggtcgtccaacgactccgctcacccttcgcggtcgcccgcgcgatctctccaccacttccccgccggcgcctgctaggcgtccgcgaggagggccagcgatgaagggctcctcccactcgcaggcgggggcgcaggcggtacggaggcggcgctgggggtgtcttctgccgctcctcgttggcgccgccttcctcgccgagatcgcgttcctcggccgcctcgacatggcgaagaacgccgaggcggtcgagagctggaccacctccttttaccgccgctccgccgatttgggcgatgccgttggcgggggcgcagcctcgagggcaggcggcgacagcgaggacgaagagatccggctgtgcgagcagcggctcgagagggaggatgccgtgccctacgaccgcgactttgacagtgatcccgtgcttgtcggtggcgctgccaaggattggaataaatgctacgtaggatgtgaatttggtttttctgcgagtaagacacctgatgctacatttggaattgcaccagatccttctgtagatggtatcctcagatcaatggaatcatctcaatattattcagagaataatattgatgtggctcgagggagagggtacaagattgtgatgacaaccagcctttcttcagacgtaccagttggctacttttcatgggctgaatatgatatcatggcacctgtgcctccaaagactgaagaagctcttgctgcagcctttatttctaactgtggtgcacgaaactttcgtttgcaagcccttgagatgcttgaaaacttggatgtcaaaatagattcatatggtagttgtcatcgtaaccgtgacggcaaagtggacaaagtggacactttgaagcgctacagattcagcttggcatttgagaattctaatgaggaggattatgtaactgaaaagttttttcagtcactagtagcaggttctattccggttgttgttggtgctccaaatattcaagagttttctccgggagaaggcgcaatattacatattaaggagcttgatgatgttgcttcagttgctaagacaatgaaaaatattgcttcaaaccctgatgccttcaatcaatctttgaggtggaagtatgatggtccatccgattctttcaaagctcttattgacatggcagcggttcattcatcttgtcgtctttgtatacatattgctaccaagatccatttaaaggaggaaaggactccaaaatttacaaatcgtccttgtagctgttccaccaaaaagggaacaatttaccacttatttatccgagagagagggcggtttaagtcagagagcatttacatgagatcaggccagttaactctgggagccttggaatccgcagtgctcggtaaatttaggtccctcaaccacgttcctgtatggaaggatgaaaggccaccgagcattagaggtggggatgacctgaaattatacagaatttacccagtcggtctaacgcaacgtcaggctttgtacggttttagatttagggatgattctgaactcgagcaatatatcaaagaccatccctgtgcaaagcttgaagtaatttttgtgtaactactatgcccaaggcttaacgttttccccccgattcttactgaactctgtgtgcgagtttcagttgtactgtaatgtagagtgttatgtgtagcaaagaaactcatgccagtacggatc

SEQ ID NO: 220 - DNA, 1588 bp, Arabidopsis thaliana
ttaattaaatgatcccatacgcaacaatcgaagaagcgtcgatcgcattatctcgaaacctcacatggctagagactctctggttcgattactccgccaccaaatccgattactacctctactgccacaacattctcttcctcttcctcatcttctctctcgttcctctccctctcgttttcatcgaatcatctcaatccacctcagatttgttcaatcgctacaaaatccaaccaaaagtgaaaaactcattctcatcgatgttcaaatgttacaaagacgtcatgaagatgttcatcctcgtcgttggtccattacaactcgtttcttatccttcgattcaggttaatttctggaatttggcttctaatttcggaattgatgcgatttaggttgattttgtttttcgtgtgttgaaacagatgattgagatacgaagtggattaccattaccatcatgtatggagattgtagcacagttagtggtttacttcttggtagaggattatactaattactgggttcatagattctttcattgtaaatggggttatgagaagtttcatcatattcatcatgagtatacagctcctattggttatgctgctccttatgctcattgggctgaggttttgcttcttggcattcccacgtttcttggacctgctattgctcctggtcatatgattaccttttggttgtggattgctttacgacagattgaggctatcgaaactcatagcgggtaaggaaaaggaatggttttgaattgtttatcttagtttataatgcgttggggctatgtgggaagtttcaatagtgcgtttaccttttgttggtggggctaaggttaggcactagccttttctgatgctttattgactgtaattagctctaggtgattgtttagagactgcttagttaatcttttgtggtcaacatgagcaagaaatcattcttgagatgataagcatcttgtcttgttcaaataagtatttggacaatatgatgattgcttggtgcatgaaacttgtttctctggagataaattgacttgttttttttatttttcgttttcttttgaagatatgatttcccatggtctctgacaaagtacattccattttatggtggagctgagtatcatgattaccatcactacgttggaggacaaagccagagtaactttgcttcagtttttacttactgcgattacatctatggaactgataaagtgagtaatgaaacttcagttcttttccggttagcgtctactaattctggataaaaatttgacaatgtgggtatatgttcttattttcatcagggttaccgattccagaagaagcttcttcagcaggtaaataaatactccataaactgagactagcttatctctcggcataccgcatacccataaacgcagccatcaaattgcaagctcacataacagtatatgtggtatctagtatcatcatattgatgatatgtttcttgatgctatatcttatgagttgcagatgaaggagaagtccaagaagagcaacaagctggttaatggaggagagaaattcgattagggcgcgcc

SEQ ID NO: 221 - DNA, 957 bp, Zea mays
ttcttgtttgttgattaacccttaattaatccgggcgcgcctgatttatcacaagtttgtacaaaaaagcaggctcctgcaggaccatggcggcgagcatcgggatcatggacggcgcctacttcgtcggcaggggcgagatcctgcactggatcaatgcgaccctccagctctccctcgccaaggtcgaggaggcagcgtctggcgcagtgcagtgccagctcatggatatggttcaccctggagtggtgcccatgcataaggtcaatttcgatgcgaagacagaatatgacatgatccagaactacaaggttcttcaggatgtgttcaacaagctgcggattggcaagaatattgaggtcaacaagcttgttaaaggacggccattggacaacttggagttccttcagtggttgaaaagatattgtgattctgtgaatggtggaattatgaacgaaaattacaaccctgtagaaaggaggtcaaagggatgcaaagaacgtgtctcaaagggttccaataagccatctaaatcattgcaagccaataggctttctggtgctgatccaacagatggaggccatggagttgggaaagtatgtaacactttttctgaagagcattacatagaacagattcagaagttgtctgaaaagattgcagacctgaaagtttctgtcgatagtactgaaaaagaaagagacttctacttctcgaagttgcgtgatattgagatactgtgtcaacggcctgagttagagcatctaccgatgactaaggcggtccggaagatactttatgcagctgatgcaaaggattcaccgctacctgaggcgaatgatataatcacaaagtcaccaagcttgttctcaaatgaaaccgagtgactcgagacccagctttcttgtacaaagtggtgataaattggagctctgcagagctttcgttcgtatcatc

SEQ ID NO: 222 - DNA, 1735 bp, Bacillus halodurans
ttcttgtttgttgattaacccttaattaatccgggcgcgcctgatttatcacaagtttgtacaaaaaagcaggctcctgcaggaccatgaaatcaaaagtcatgtcagcctatgacgccattcagatgattccagatggagcgacgattgcgaccggtgggtttgttgggaatggccatccggaagcattaactgcggccgtggaggagcggtttatcaaggagaggcatccaagagacgtaaccgttgtttatgcggcaggtcaaggagatgggaaaatgcgtggcttaaatcatttaggtcatgaagggcttgtctcgcgagtcattggtggccactggggattagcgcctaagcttcaacagctggcgatcgctaataaaatcaaagcctataatttccctcaaggagtgatctctcatctcttccgtgatattgcagcgggaaagcctggtacgatttcacgagtcggtttaaaaacattcgtagacccacgtattcaaggaggtaagctgaacgctgctacgacggaagatcttgtggaagtgatgacaataaaaggcgtagagtatcttttctatcacacgtttccgattcatgtagcattgattcgtggtacgtttgctgatgagctgggcaatgtcaccctcgaaaaagaagcgggaacccttgagattctctccatcgcgcaagctgcaaaaaattcaggaggaatcgtcattgtgcaagtggaacgaatcgtggaaacagggagtcttgatccacgtcttgtcaaggttcctgggattcttgtagacgcgattgtcgtcgctaccccagagcaacatatgcaaacgttctccgagcaatataaccctgcgtatagcggtgagatccgtgcagtcgttaaggagctcggcgtcttgccaatggatgaacgaaaaatcattgccagacgttccgccatggaactaaagccttatgccgtaactaatttagggatcggcatgccagaaggtgtttccatgattgccaacgaggaaggaataggggctaaaatccatcttacggttgaatcaggtccgatcggtggtatccctgctggggggttgagcttcggagctgccacaaatccagaagcgattattgatcaaccgtatcagtttgacttttatgatggcggagggttggatgtcgcttttcttggcctagcccagctcgatcgtttcggaaatgtgaacgtcagtaagtttggtacgaaaatcgctggagctggtggatttattaacatcacacaaaatgccaagagggtggtcttttgtggaacatttaccgctggagggcttgaggtggacattacggatggaactctctccataaaacaagaagggcgagttcaaaaattcgttcgtgatgtagagcaaattacatttagcggtccattcgcatcggaaagcaaacaaacggttctttacattaccgaacgggcggtttttgaattgacggaaaatggtatcgcgcttatagaaattgctcctggtattgatgtacaaaaggatattttagatcaaatggggtttgagccgatcatcgcaagcccgttaaagccaatggatcaacgtatttttaggcttggcgccatgggtcttacatttgcaagcggaggcgcactcgtcactcaataactcgagacccagctttcttgtacaaagtggtgataaattggagctctgcagagctttcgttcgtatcatcg

SEQ ID NO: 223 - DNA, 1756 bp, Arabidopsis thaliana
ttaattaaatggagcaacagcaacaacaacaactaccttctactactactagacccaagcccaagctactaaaccggctcaatacctacgtcggttcgagccgggttggcaaacggttcaaactcgccgaacgtaattcaactttcacgacggagctccgtgctggtaccgccactttcttaaccatggcttatatcctcgccgtcaacgcttcaatcctttctgattccggtggtacttgctctgtttccgattgtatccctctatgctcaaacccagcgatcgaaccttcgcagtgtaccggaccgggtctccgattaatccaacccgacgtttcctgtaaattcaacccggttaatcctggttacgccgcatgcgttgaagaaattcgaaaggatctaatcgtcgccaccgtagctgcgtcactaatcggttgtgtaatcatgggattgatggcgaatcttcctctagctttagctccgggaatgggaactaacgcttatttcgcttacaccgtcgttggatttcacggatccggttcaatctcataccggaccgcactcgccgccgttttcatcgaaggactgatatttctcttcatctccgccataggtttcagagcaaaacttgcgaaactcgttcctaaaccggtcagaatcagttcctccgccggaatcggacttttcctcgctttcatcggtttacagaacaatcaaggaatcggtttagtcggttatagtccttcaacactagtcactctcgccgcttgtccagcctcatcacgaatatcgttagctcccgttataacgtcagctaacggaaccgttagtttactcgccggaggatcagtttccggcgatattatgtgtattcacggacgaatggagagtccaacgttctggttaggtatcgtcggattcgtgatcatagcttattgtttggtaaagaacgtgaaaggagcgatgatctacgggatcgtcttcgtaacggccgtttcgtggttccgtaacacagaggtaacggcgtttccgaacacatcggccggagatgcagctcatgattatttcaaaaagatcgttgatgtacacgtcattaaacataccgccggagctttaagcttctccgggataaacaaaggacatttctgggaagctctggtgacattcctctacgttgatattttggatacgacgggaacgctttactccatggctagattcgccggattcgtcgacgagaaaggagatttcgccggacagtatttcgcgtttatgtctgacgcgtctgcgattgtgatcggatcgttgcttggtacatctccggtgactgttttcatcgagtcgtcgacggggataagagaaggagggaggacgggtctaacggcgattacggtggctgtttatttcttgttagcgatgtttttcacaccgttgctagcttcgattcccgcatgggcggttggtccgccgttgatattagtcggagtgatgatgatgaaatcagtcacagagattgattgggaagatatgagagaggcgattccggcatttgtgacaatgattctgatgccgttgacttactccgtcgcgtatggattgatcggagggattgggagctatgtagtgttgcatctatgggattggggagaagaaggtttggtgaaattagggtttttgaaaaggaaagttaaagaagaggataataataatggagttgtcaaagctagtgagattgatactaccgtttagggcgcgcc

SEQ ID NO: 224 - DNA, 551 bp, Arabidopsis thaliana
ttaattaacgagtcaagtcagagagttaaacgttttcaaagacacttaaactaaaaatgggagcgtgcgcttcacgtgaatctttgaggagtgattcagcgaagctgatattactcgacggtactttacaggagttctcatctccggtcaaagtttggcagattttgcaaaagaaccctacgagtttcgtctgtaactcagacgaaatggacttcgacgacgcagtttcagctgtcgccggcaacgaagagctccgatcagggcagctctattttgtcttacctctgacgtggctcaaccatccgttaagggcggaggaaatggcggccttggccgtgaaagctagttcggcgttgaccaagagcggtggcgtcggttgggtttccggcgacgacgatgtaacgacatcggaaaaaacttaccaaaagaaaaacattgccggagttaagacaaacggtggtggcggaagaggttgcggtaaagggaagaggcgattcacggctaatttgagcacgatcgccgagtagggtcaatttagtcattggcgcgcc

SEQ ID NO: 225 - DNA, 741 bp, Arabidopsis thaliana
atggcgaccggtggtgctgcggcggatttggaagatgttcagacggtggatctcatgtcggagctcctccgccgcctcaagtgttctcagaagcccgacaaacgcctcatcttcattggacctccagggtcagggaaaggtactcaatctccagtagtgaaggatgagtattgcttgtgtcacttatccactggagacatgttaagagctgctgttgcttctaagacccctcttggtgtcaaggctaaagaagctatggaaaaaggagagctcgtctctgatgatttggttgttggtataattgatgaagccatgaacaagccaaaatgtcaaaaaggatttatccttgatgggttccccaggactgttactcaggcagagaagctcgatgagatgcttaagaggcgaggaactgaaattgacaaagttctcaactttgctattgatgacgcaatcttggaggaaagaataaccgggcgatggatccacccatcgagtggcaggagttaccacaccaaatttgctcctcccaaaacccctggagttgatgatattactggagagcctctgatccaacgtaaagatgataacgctgatgttctaaagtcgaggcttgcagctttccacagtcaaactcaaccggtgattgattactacgcaaagaaggccgttctcacaaacatccaggccgagaaggctccccaagaagttacatcagaggttaaaaaagcattgtcatga

SEQ ID NO: 226 - DNA, 1392 bp, Arabidopsis thaliana
atggatttctccggtttgtttctcactctctccgcggcggctctgtttctctgtttactccgatttatcgccggagtccgccgtagctcctccacgaaactccctcttcctccgggaacaatgggttatccttacgtcggcgaaacattccaactttactcacaagaccctaatgtgttctttgcagcaaaacagagaagatacggatcggtgttcaagactcatgtattgggatgtccatgtgtgatgatctcgagccctgaagcagcgaaattcgtattggttacaaagtctcatttgtttaaaccgacttttccggccagtaaagagaggatgcttggaaaacaagccatcttcttccatcaaggagattatcattccaaacttagaaagcttgttttaagagctttcatgcctgatgcaatcagaaacatggtccctcacattgaatcaattgctcaagaatcactcaattcttgggatggaactcaactcaacacttaccaggaaatgaaaacatacactttcaatgttgcgttaatctcaatactcggcaaagacgaagtttattaccgagaagatctaaaacgatgctactacattctagagaaaggttacaattcgatgccgattaatcttccaggaacattattccacaaagccatgaaagctcgcaaggagctagctcaaatcctcgctaacatcttatccaaaagaagacaaaacccatcatcacacacagatctcctcggatcattcatggaagacaaagcaggattaaccgacgaacaaatcgccgataacatcatcggagtaatcttcgccgcaagagacacgacggcgagtgttctgacgtggatcctcaagtacttagctgataatccaactgttctagaagctgtcactgaagagcaaatggcaataaggaaagataaaaaagaaggagagagtctcacttgggaagatacaaagaagatgccattaacttatagagtaatccaagagacattaagagctgctacaatcttatctttcacatttagagaagctgtcgaagatgtcgaatacgaaggatatttgataccaaagggatggaaagtactgccactattcagaaatattcatcacaatgctgatatattttcggatccggggaaattcgatccgtcgagattcgaagttgcgccgaaaccgaatacattcatgccttttggtagtgggattcattcttgtccaggcaatgagttagctaaacttgaaatctctgttctaatccatcatctcaccactaagtacagatggtcaatcgtagggcctagcgatggaattcagtatgggccgttcgctcttcctcagaatggattgcctattgccttggaacgaaaaccatag

SEQ ID NO: 227 - DNA, 1092 bp, Arabidopsis thaliana
atgtcgagtgatgcagctcgtacgccattgttacccactgagaagatagataccatggctcaagatttcaacctgaactcaagaacttcttcttcaagaaaacgaagattgcgtcgctctagaagtgctcctcgtggtgattgtatgtacaatgatgatgtcaaaatcgacgaaccacctcctcatccgagtaaaatcccaatgttcagtgatctaaacccgaatctcaggcgagtgatcatgttcttggctttatatcttaccattggtackctctgtttctacctcgtgagagaccagatctccggtcataaaaccagtggtgtggtagatgctctctatttctgtatagtaacgatgacaactgttggatacggtgaccttgtccctaatagttccgcctcaaggctacttgcttgtgccttcgtcttctcgggaatggtcctcgttggtcacctcttaagtcgagcggcggattatctagtggagaaacaagaggctttgctcgttagggctttccatttgcgtcaaagctttggtccaacagacattctcaaggagttgcatactaacaagttgagatacaaatgctatgctacatgccttgtccttgtagtcctcttcattgttggcacgattttccttgtaatggttgagaaaatgccggttatctcagctttctactgcgtctgctccacggttacaacattgggttatggagataagagctttaactcggaagccggacgcctttttgctgtgttttggatcttgacgagcagcatatgtttggctcagtttttcctttatgtagctgagctaaatacagaaaacaaacagagggcgttggtgaaatgggttttaacgcgaagaatcacaaacaatgatctcgaagcagctgatctcgatgaagatggagttgttggagctgcagagtttattgtgtataaactgaaagaaatgggtaagattgatgagaaagatatttctgggataatggatgagttcgagcaacttgattacgatgaatcaggaactctcacgacttctgacatcgttttagctcagaccacgtctcagattcaaaggtaa

SEQ ID NO: 228 - DNA, 660 bp, Arabidopsis thaliana
atggctttgcctttgtctggcacgcgccacctcacgcgcgctctcctctctaatgtcactcttatggctcctcctcggattccttcctctgttcactacggtggatctcggttaggttgttcgacccggttcttctcaattcgatgtggagctaaccggtcaggttctacttactcgccgcttaactctggctctaactttagtgatcggcctccgacggagatggctcctttgtttccgggatgcgattatgagcactggcttattgttatggataaacctggcggggaaggcgcgactaagcagcagatgattgattgttacattcaaaccctagcgaaagtcgttggaagtgaggaagaggcgaagaagcgaatctacaatgtttcatgtgagaggtatttagggtttggttgtgagattgatgaagagacatccactaagcttgaaggtttaccaggtgttctgtttgtgcttccagattcctatgtggatcctgaaaacaaagattatggagctgagctgtttgttaatggagagatagtccaacgatcaccagagaggcagaggcgggttgagccacagccgcagagagcccaagatagaccgagatacaatgacagaactcgttactctcgccgcagagaaaacacaagatga

SEQ ID NO: 229 - DNA, 1488 bp, Arabidopsis thaliana
atgtttaagaagatcatgaaaggggcaaatcgaaaagcctctaaagctgaggcgaatgattcgtctatgtatgggtttgatccaccaggtaggtcaggccctggatccaatatgattgtaaatcacgcatctcgtggttcgcttgttccttcttctccaaattcaatggcggcggccaccacacaaccgcctcctatgtattcagtcgagcctcttcccttgttcagagacgtctctgtctccgagcgtcaatccttgttcttgaggaaactccagatttgttgttttcaatttgattttacggatacgttgaagaatgcgagagagaaggagattaagaggcaaacgttattggagctagttgattttatacagtctggagcagggaagctcactgaagtttgtcaagaagaaatggtaaagatgatttcggttaatatattccggtgtcttcctccggcttcacacgagaatacaggtcaagagcctgctgatcttgaggaagaggagccttatttggaaccatcttggcctcatttacagctaatttatgagttgctgctgagatacattgttccttctgacacagatacaaaagttgcaaaacggtatattgatcattcttttgtgttgaggttgcttgaattgtttgaaactgaagatcctagagaaagggagtacttgaaaacgattcttcataggatttatggcaagtttatggttcacaggccctttattaggaaagcaatgaaccatattttctataggtttatttatgagacagagagacatagtgggattggggagcttttggagattctcggtagtattattaatgggtttgccttgccaatgaaggaggagcacaagctctttttgattagggcgttgataccgctgcataagccaaaaccaatcgctatgtatcaccaacaattgtcttactgcatcgttcagtttgtggagaaagattataagcttgcggatacggtgatcaggggcttgttaaagttttggcctgtgacaaattgtacaaaagaggttctctttcttggtgaacttgaagaggttcttgaggcaacacaaactgttgagttccaacgctgtatggtccctctgttccaacagattgctcgatgcctcagtagctctaattttcaggttgcagaacgagctctgttcttgtggaacaacgagcatgtggtgggtctaatagctcagaaccgaggagtgatccttcccatcatatttgcatccctggagaaaaacatagagtctcattggaaccaagcggtacacggtctaagtgcgaatataaagagaatgttcatggagatggaccctgagctctttgaagaatgtcagcaacagtacgaagaaaaacaagccaaatctaaacaagtggaagagcaacgccaaaataggtggaggagattagatgaagcagtggaggaacgagaaagagaagatcctatgatcacttcttag

SEQ ID NO: 230 - DNA, 1224 bp, Arabidopsis thaliana
cacaattcttcttcttcaccaaaccacaaacgttgacaacttgtgtgagtttttgcaatgatgagaggtgctgctcccaccggagtagtatcggtcatggttttaatgatacttgtgttgttaaaacaaatagagagtgctagtgcgaatggttcatcattagggctaccacctagaaagttttgtaatatttatcaaggaagttgggtctatgacaaatcttaccctctctatgattccaagaattgccctttcatcgagagacagtttaactgcaagtccaatggtcgccctgacagcgagtacctcaagtatcgatggcaaccttccggttgcaatctccccagattcaacggcttagattttctgggaaggataatgaaagggaagaaactgatgttcgtaggagattcactgagtctaaaccaatggcaatctctcacgtgtttgctccacaacgccgcaccaaaagccaattccacatccacacgttccccttctggcctctccgtcttctcattccccgcttacaattcttcgattatgttttcaagaaacgcgtttcttgtggatatagtcggagccccaccgaagcgagtgatgaagcttgactcaatctcgagtggttcgttgtggaaaaccgcagacgttttggtcttcaactcttggcattggtggcttcacacagaccgaaaacaaccatgggacgcaattatgtccgggaatgtaacggttaaagacatggaccggttagtggcatatgagaaagcaatgatgacttgggctaagtggattgatcaaaatattgatccttccaaaaccaaagtcttcttccaaggtatttctccggaccatggccgggcaagggaatggtcgaaacaaggtggcaaaggcagttgcataggagaaacaaagccgattatgggatcgagttacctggctgggccgcacgcagccgagatggtggtggcgaaagtgataaagacgatgaagaatcaggcgcggttaatggatgtgacattgatgtctcagctaaggaaagatggacatccttcagtatacggttttggcggtcacagaatggcggattgtagccattggtgtctctctggagtcccggatagctggaaccagctcttgtattctgagctgtttcattcttaaaattttgatggttttgacacaaaactaaattcattatatgatttatacatttatttatga

SEQ ID NO: 231 - DNA, 225 bp, Arabidopsis thaliana
atgatgaagacgagatttctggattggtatttgaagatcgcgattggatcggctattatcggcggaggcatggaattcttcatgatcaagactggtttctacgacaaggttactgtaatagaagcagagagacgggcgttggaaaattctcctgaagctcaagccatcagagaagctcttaatccttggaggaacaaggacgcagaaacaagcaaaaccccataa

SEQ ID NO: 232 - DNA, 1725 bp, Arabidopsis thaliana
tttttggcgcgcccttctcggtaatgagaaagaaacttgtaggctaagaccacttaaaacgtgtgagcagcattgtcgagctgcacgccttacctctttcatcatagagcggaacagcacgaattccttctattagttcagaaaccggtagacaagtctgaccacaaaatgcatctgcagtcgatacttcgtagtcataaacttcaaaactaatcaaagcaaggtcaggataggtcaaagggaatgtgaattcttctccccatgtaggtgtccattcgttgtttttcaccgttgttttcataatgttctcatcatggggtacaccggcaatactaatcctaacgtataagtccggcttagacagtcgacctatgcgcttcttgaagtccacaatccatccatctcccatgtagattttgaccttcaatatcttcacaaccaccggattcactgttggatagaaaactccactaggaccagcattcaaaaggaaatccggcttcttgacataaccgcaccctccatttgctctaaacatcccttgcatcaaccaaagtttttctttctcctccttcctgcttagtgcaatcaattgagcaccgtgcatccacgctctttggggtttatagggggcatagatcaacaatttccgttgtggacgtgtccgcaagaatctcttttgggtgaagcttataatatctgtttcgtaccatcctggtcgttggattttgttagccttgcctgttaatacgttttgtagcatgcctcttggctccactacatggaaggaaactaaactctggtaatttggatctgccgggtgttgtcttatctcaaccccattccgtacgccaacctttccatcatcatcattagcatataacaactcttttgggggtcttcttgatattagtatcttatttcgcagttgttgtggcgaaggaaaaacctccaaactatgaggatcatggtgatataccatatgattaaatgtctgttgtatcatctgagtagctttggattgaagttccggtttcaagccgtccttgaacgtaattatcaagggatatgtacatttggtaaaggcatgttctttaatagaatccaaacactcttgcaatttcagaggcttctcaaagttccagctaggcctaacgcagatgctgcctctaccatccggccacagatctagttcaaccaccctcacaccctgttcaagtgcttcaatgatgggcaaaatgctgtatttcccaaagacattcccggtgaagtaggaattgaggctggtgtgaatgaagtaatgcgacagcggagcatgcatgtcatgatgaacctggtcaccgatcgggggattgagcttcgtagaaaaaagaaactcgttcaactgatcaagctcgagacaccgcaagcgtctgaaagccggtatatcatcttttcggcgattcaattccgccgcgattttcttggctgcattcattccggcgccgtcttcttccttctcataacccagcaactccgtcaacctccgcaatgtctcaggcatatcgtcaccgtagccgtggaattcattcccaaaaaactgtaagatgaggtccggcgagttcgccggatgcgattcccatcgcctcgtaactaacatatgaaaggggaggatttgtgttaattaagggttaatcaacacacatttagtgaaggagtttgaaagctgacaaataaagaataaat

SEQ ID NO: 233 - DNA, 1335 bp, Arabidopsis thaliana
atggctactatcaccgttgttaaggctagacagatcttcgacagtcgtggtaatcccaccgttgaggttgatatccacacgtcaaatggtattaaggttacagcagctgttccaagtggagcttccactggtatctatgaggctcttgagctgagggatggaggatctgactaccttggaaagggtgtatctaaggctgttggcaatgtgaacaacatcatcgggccagcacttattggaaaggacccaactcagcagactgctattgacaacttcatggtccatgaacttgacggaacccaaaacgagtgggggtggtgcaagcaaaagcttggagccaatgcgattcttgctgtgtctcttgctgtctgcaaagctggggctgttgtcagcggcattcctctatacaagcacattgccaaccttgctggtaaccccaagattgtgctaccagttcctgccttcaacgtcatcaatggtggatcccatgccggaaacaagcttgctatgcaggagtttatgatcctccctgttggagctgcttctttcaaggaagccatgaagatgggtgtggaagtttaccaccacttgaagtctgtgattaagaagaagtacggccaggatgccacaaatgttggtgatgaaggtgggtttgcaccaaacattcaggagaacaaggagggtcttgaattgctcaagactgctatcgagaaggctggatacactggaaaggttgtcattggaatggatgttgccgcttcagagttctactcagaagacaagacctacgacttgaacttcaaagaagagaacaacaatggctctcagaagatttctggtgatgctctaaaggacctgtacaagtcctttgtcgctgagtacccaatcgtgtccattgaggacccatttgaccaagatgactgggagcactatgctaagatgaccactgagtgtggaaccgaggttcagattgtcggtgatgatttgttggtcactaaccccaagagagttgctaaggcaatcgcagagaagtcttgcaatgctcttcttttgaaggttaaccaaatcggatctgtaaccgagagtatcgaggcagttaagatgtcgaagaaagcaggttggggagtgatgaccagccacagaagtggtgaaaccgaggacacattcattgctgacttagccgttggcttgtccactggacaaatcaaaaccggtgctccttgcagatccgagcgtcttgccaagtacaaccagcttttgcgtattgaggaggagttgggatcagaggcaatttacgctggagtcaacttccgcaaacctgtggaaccctactaa

SEQ ID NO: 234 - DNA, 807 bp, Arabidopsis thaliana
atggctgctgccgctaatacctccgccgttttcgcctctccgtcgcagcctttatcctcgaaacgtagttttttgtacagttcaaggattggtccaatactaaggagatttccgaggaagaaacttgatctccaagttaaagctgttgccacgactcttgcacctctcgaagagatcaaagaatacaagcttccttcatgggccatgttcgagatgggtactgctcctgtgtactggaaaaccatgaatggtcttccaccaacctcaggtgaaaagttgaaacttttctataatccagctgcaagcaaactcactcttaacgaagactatggggttgctttcaacggaggatttaaccaaccaatcatgtgtggtggggagccaagagcaatgcttaagaaagatcgaggcaaagccgattctccgatatacactatgcagatttgcattcctaagcatgctgtgaatttgatattctcattcactaatggtgtcgattgggacggtccatacagacttcagtttcaagtccccaagcgatggcaaaacaaacctattgagttcttcaatgagggtctagcgaacgagttgagccaagatggagcctgcgaaagagcaatatttcctgactcgaacgttgttccaactcgttgcacgatgatcgccaacttgacggtcgaaggaggagatagatgcaacttggatctagttcctggatgcatggatacaaattcagaacatttcaacccatatgctaatgttgatgatggctcttgtcccctcgagttatccgattctgatgaatag

SEQ ID NO: 235 - DNA, 1182 bp, Arabidopsis thaliana
atgtcttcttcttcttccgtaagaatctctctctccttcattttcttggctctgctaatctcaccggctgtgtcacaaacatgtaagtcacagactttttccggcgataaaacttaccctcactgccttgacctccctcaactcaaagccttccttcattattcctatgatgcctctaacacaactctggccgtcgtcttctctgctccgccggcaaagcctggcggatggatcgcgtgggcgattaatccaaaggctaccggtatggtcggatctcaaacccttgtcgcttacaaggatccaggtaatggtgttgccgtggtgaagacgctaaacattagctcctatagctcgctgattccgtcgaagctggcgtttgatgtttgggatatgaaagccgaggaggcggcgagagatggaggaagtttgagaatctttgctagggttaaggttccggctgatttggtggcaaagggaaaggttaatcaggtttggcaagttggtcctgaattaggtcctggtggaatgattgggaggcacgctttcgactcggcgaatctcgcttctatgagctctcttgatttaaaaggtgacaacagcggtggcacaatctctggaggcgacgaggtaaatgccaagatcaagaacagaaatattcatgggatattaaacgcagtgagttggggaattttgtttccgataggagcaataatagccaggtacatgagagtatttgactcggccgatccggcctggttttacctccacgtttcttgtcaattctctgcttatgtcatcggtgttgccggttgggctaccggacttaagctcggtaacgagtccgagggtattcgcttctccgcccaccgtaacatcggcattgccctcttcacccttgccaccattcagatgtttgcgatgttgttgcggcctaagaaagatcacaagtacagattctattggaatatctaccaccatggagtcggttatgcgatcctcacccttgggatcattaatgtcttcaaaggtctcaacatcttgaaaccacaagacacgtacaagacggcttacattgcagtgattgccgttcttggaggcattgctttgctcttagaagccatcacttgggtcgttgtactcaagagaaaatcaaacaactcaatgaagcctcttaggacctaa

SEQ ID NO: 236 - DNA, 1781 bp, Arabidopsis thaliana
ttgtcagctttcaaactctttgtttcttgtttgttgattaacccttaattaacttgaggagttgcttaagagatggcgtcatggacttcatcccagttcctgtatgaagaaaccaagccatggggtattcagttcttggaaaagtttaagcgttcaggaagactctccttcaagcaataccaagcccttgtcttcattttgacctttgtcgcctacatcgccttccatgctgcccgaaagcccaatagcattgtcaagggaacactttctgcatcaacaatcgaaggcggttgggctccttttgatggacctgatggaacagccttgcttgggcagatcgacttggctttcctctctgtctatgcggttgggatgtttgtggcaggtcacttgggcgatcgtttggatctcaggacgtttctgaccatcggtatgatcgggaccggccttttcacagctctcttcggggtcgcattctgggcgaatttccacagcttctactatttcttggcggttcaggttatggcggggttgtttcagtcgataggttggccttgtatcgtggctgtgctcgggaattggttcgacaagaagagaagaggaatgattatgggtgtttggagcgctcacacttccctcggtaacattgcagggtctctgatcgcgtctgggctgcttagatatgggtggggttggtcatttcttggcccggcttttctcatgacttttcttgggatcgttgtttaccttttcttgccggtgaatcctccaaccgttgaggcagagagagatggaactgaaattgactctaccatgaggctcggtgacaccattacagagagcttattggaatctagaatgagtactggattcgatagaaaggcagtcgggttcatggccgcttggaaaatccccggtgttgctcctttcgccttctgcctcttcttcacaaagttggtctcatacactttcctctactggcttcctttctacgtcagccacaacagtaatgtttctcatcatctctccttccttttacctctagtgttgtagcctgactatatatgcattgtctgaattatatgtgatgcagtgatcggaggagagtacctgtcagaggagacatcaggaaacttgtcgacaatcttcgatgttggaggcgttgttggtggagtcttagccggatacatatctgatcaactcaacggcagagccatcacagcagcaggattcatgtacttggccatcccagctcttttcctctacagagtctttggacacatctcattgaccatcaatgtcatcctcatgttcacatcaggagtcttcatcattggaccatttgccctcatcacaacagctgtctcagctgatctcggaacccacaaatctctcaaaggcaatgcaagggctttggctacagtctcagctatcatagacggcacaggatccgtcggtgctgcgattggaccagtcctcactggttacatctctgccataagctgggacgcagtgttttacatgttgatgactgcagcattgatctctggattgttgctcactaaactaatcatagcagaagtcaaagcgttattgtttggatcagaagatgaagtagctgcatcatcatcatcaccaccagcatccagacctcccattgatgtcctcgtttgagttttttccttcattatttatcagtttctttgacaatttcacactttatttaaatacccagctttctaaattggagctctgcagagctttcgttcgtatcatcggtt

SEQ ID NO: 237 - DNA, 503 bp, Arabidopsis thaliana
ttaattaaatgaggaagatcatagggtttagaatcgggagacgagtctcaagatggatctttcgcaaaacccggatccaacgttcaggatacaaccggatacactcgacccagcaagcttgcatgctgatgagaccattagccaaactcaaaagttggggccaacgtctcaagcaaagtttcagacgcaggtctacgagaagatccgcatacatacccgttgatcataagaaagccgacccggttccaaggggacacttagctatctacgtgggtcaaaaagacggcgactgtcatagagttttggtacccatcgtttactttaaccatcctttgttcggtgagctgcttcgagaagccgaaaaagagtacggattttgccacgaaggaggtatcactattccttgtctgtattcagatttcgaacgggtcaagacccggatcgcatcggggtcaagttctcgggtatttccatggggccgtcattgccgcaattgaggcgcg

SEQ ID NO: 238 - DNA, 1123 bp, Arabidopsis thaliana
ttaattaaatggatttaaactcaaaccacaaatcctctgttcttaaagatccttcaccatcagttaaccaatcaagactcggcgtgtctagtagatttatgatgagtcaatggaagaaacctgcgaaactcgatgatgttagatccaatggttggttagatgcaatgatttcatcttctccaccgcgtaagaagcttgtcaaagattttaatgttgaagttgctcctgaagatgattttgctcaacgtgcttggatggtgaaatatccttcggcgattagctcgtttgcgcatattgcagctcaagcaaagaagaaaaagattgctgtatttctagattatgatggtactctttctccaatagttgatgatcctgatcgtgccatcatgtctgatgcaatgcgttctgcggttaaagatgtcgcgagttacttcccaaccgcaataattagcggtagaagccgtgacaaggtttatcagttggtaggactaacagaactttattacgcgggtagtcatggaatggacataatgacttcttctgatggtccgaattgtttcaaatccactgaccaacagggtaaggaagtgaatctgtttcagcccgcgagagaattcataccggttatcgacgaggtttttagaacccttgttgagaaaatgaaagatatcaaaggtgcaaaagtagagaaccacaagttctgtgcatctgtacattaccgtaacgttgacgaaaaggattggcctattattgctcagcgtgttcatgaccacttgaaacaataccctcgtttgcgtctaactcatgggaggaaggttttagaggttcgtcctgtgatagactggaacaaaggaagagcggtcgagtttctattagaatctctcggattaagcaataaagacgatttgcttcctatctacattggtgatgacacaaccgatgaagatgcgttcaaggtactgagagatgggaaccgaggtttcggcatcctagtatcgtctataccgaaagaaagcaatgcgttttactcccttagagatccatccgaggtgaagaagtttctaaagactttggtgaaatgggcaaagttggagaagaattctactggtttttgaggcgcgcc

SEQ ID NO: 239 - DNA, 1392 bp, Sinorhizobium meliloti
gctttcaaactctttgtttcttgtttgttgattaacccttaattaatccgggcgcgcctgatttatcacaagtttgtacaaaaaagcaggctcctgcaggaccatggaagagtttcataaagtccggcgtttgccgccctacgttttcgaacaggtcaaccgtttgaaagctagcgcgcgagcggccggtgctgacatcatcgacctcggcatgggcaatccggatcttccgaccccgcagtccatcgtggacaagctgtgcgaagtcgtccaggacccgcggacgcatcgttattcgtcatcgaagggcattcccgggctgcgccgtgcgcaggccgcctattatgcacgccgcttcggcgtcaagctcaatcccgagacgcaggtcgtcgcgaccctcggctccaaggaaggcttcgccaacatggcgcaggccatcaccgcacccggcgacgtggtcctttgcccaaatccgacctatccgatccacgccttcggattcctgatggcaggcggtgtcatccgctcgatttcggtcgagccggacgagagctttttcccgccgctcgaacgtgcggtccggcactcgatcccgaagccgctggcgctgatcctcaattacccgtccaatccgacggcgcaggtcgccacgctcgatttctacaaggatgtcatcgcctttgcgaagaagcacgacatcatcgtgctgtcggatctcgcctattcggagatctacttcgacgacgcaccgccgccttcggttctggaagtgccgggtgcgaccgatgtgaccgtcgaattcacgtcgatgtcgaagaccttctccatgcccggctggcgcatgggcttcgccgtcggcaacgaacgactgatcgcggcgctgacgcgcgtgaagtcctatctggactacggcgcattcaccccgatccaggtggcggcgacgcaggcactgaacggtgacggcagcgacatcgccgaggtgcgcgccatctacaagcggcgccgcgacgtcatggtggaaagcttcggcaaggccggtttcgaggtgccgccgccgccggcgacgatgttcgcctgggcgaagatccccgagaagttccgccatctcggctcgctggaattctccaagcttctcgtcgagaaagcggatgtcgccgttgctccgggtatcggcttcggcgagcagggggacgactatgttcgtctcgcgctggtggagaacgaacaccgcatccgccaggccgcgcgcaatatcaagcgcttcctttcttcggcggacgagacgatgcacaacgtcatctcgctcaacgcacatcggtaactcgagacccagctttcttgtacaaagtggtgataaattggagctctgcagagctttcgttcgtatcatcg

SEQ ID NO: 240 - DNA, 1257 bp, Acidithiobacillus ferrooxidans
ttcttgtttgttgattaacccttaattaatccgggcgcgcctgatttatcacaagtttgtacaaaaaagcaggctcctgcaggaccatggatgttcgcgcagcagtcgcctttgaggcgggtaaaccactggtcatcgaaaccgtgcaactggacggtcccaaggagggggaggtactggtggagctcaaggccaccggcatctgccacaccgaccattttaccctttccggtgcagatcccgagggcctgttcccgtgtattctcggccatgaaggcgccgggatcgtcgttgacgttggcccgggtgtgaagagtgtcaaaaagggcgaccacgtcattcccttgtatactccggaatgtcgcgaatgcgagtattgtctttcgcgcaagaccaatctctgtcagaagattcggacgacccaggggaagggactgatgcccgacgggacgacgcgcttttcgttcaaaggcaagccgttgttccattacatgggttgttcgaccttcgccaattataccgtgatgcccgaaatcgccttggccaaaattcgggaggacgccccctttgacaccacctgctatatcggctgcggggtaaccacgggcattggtgccgtggtgtttacggcgaaggtggaaccgggtgccaatgtggtggtttttggactgggcggcatcggcctgaatgtgattcagggcgccaaactggtgggcgccaacatgatcatcggggtggacatcaacccggcccgggaggccatagcccggaagttcggcatgacgcatttcgtcaatccgaaggaggtggaaggcgacctcgtatcccatctggtcgaactgactcatggtggtgcggattacagcttcgagtgcatcggtaatgtaaaagtcatgcgtcaggccctggagtgctgtcataaaggctggggtgtttcctgcatcatcggtgttgccggcgccggccaagagatatcgacccgccccttccagttggttaccggacggcggtggatcggcagtgcgttcggcggcgcccgcgggcgtaccgacgttccgaaaatagtcgactggtacatggagaagaagatcaatatcgacgacctgatcactcaccgcctcaagctggaagatatcaacgaagggttccatcttctggaaacggggcaatccattcgcagtgtggtggtgtattgactcgagacccagctttcttgtacaaagtggtgataaattggagctctgcagagctttcgtt

SEQ ID NO: 241 - DNA, 754 bp, Arabidopsis thaliana
ttaattaaatggcatcttccggtaacggtacaacggcggggacaggttcaccatgcggtgcatgcaagttcttgaggaggaagtgcgcatccgattgtatatttgcaccgtacttctcatcggagcaaggagcagcaagattcgcagctattcacaaggtgtttggagcaagcaacgtttctaagctcttgcttaatgttccaatccatgatcgatgtgaagctgtcgtcaccatcgcctacgaagctcaggctcgtcttcatgaccctgtttatggatgtgtctctcatatctttgccctccaacaacaggtggctttcttgcaatcacaagtcatgcaaatgaaggcacagatagctggccaccagacgtcagccgccggagatctaagacacagctcggaaagtaccaaccagtttatgacgtggcaacaaactagtgtctctccgatcggtagtgcatactcaacaccgtataaccatcatcaaccttactacggtcatgtaaaccctaacaatccggtctcgccacagagctcgctagaagaatctttcagcaacacgagcagtgacgtcaccacaacagccaacgtgcgagagactcatcatcaaaccggaggaggagtatacggtcacgatggaatagggtttcacgaaggatatcctaacaagaagagatcagtgagttattgtagtagcgatttaggtgagcttcaggctttggctcttagaatgatgaagaactaaggcgcgcc

SEQ ID NO: 242 - DNA, 1931 bp, Pseudomonas fluorescens PfO-1
gctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggccaccctgactcgtgccgactgggaacaacgcgcccgcgacctgaagatcgaaggccgcgcctatctcaatggcgagtacaccgatgccgtctccggcgagaccttcgagtgcatcagcccggtcgatggccgtctgctgggcaagattgccagctgtgacgccgacgacgcccagcgcgccgtggaaaacgcccgcgccaccttcaattccggcgtgtggtcacgcctggcgccgaccaaacgcaaagccaccatgatccgtttcgccggcctgctaaagcagcacgccgaagaactggccctgctcgaaaccctcgacatgggcaagccgatcagcgattcgctctacatcgacgtgccgggcgctgcgcaagccctgagctggagcggtgaggcgatcgacaagatctacgatgaagtcgccgccaccccgcacgaccaactgggtctggtaacccgcgaaccagtgggcgtggttggcgccatcgtgccgtggaacttcccgctgatgatggcctgctggaaactcggcccggccctgtcgaccggtaactcggtgatcctcaaaccgtcggaaaaatccccgctgaccgccatccgcatcgccgaactggcggtcgaggccggcatcccgaaaggcgtgctgaacgtgctgccgggctacggccacaccgtcggcaaggcgctcgcgctgcataacgacgtcgataccctggtgttcaccggttcgaccaagatcgccaagcaactgatgatctattccggcgaatcgaatatgaagcgcgtctggctggaagccggcggcaagagcccgaacatcgtgtttgccgatgcaccggacctgcaggctgccgccgaatccgccgccagcgccatcgccttcaaccagggcgaagtctgcaccgccggttcccgcctgctggtcgagcgttcgatcaaggacaaattcctgccgatggtgatcgaggcgctgaaagcctggaaaccgggtaatccgctggatccggccaccaacgttggcgcgctggtcgatacccagcagatgaacaccgtgctgtcctatatcgagtcgggccactccgatggcgccaaactggtggccggcggcaagcgcattcttcaggaaaccggtggcacctacgtcgagccgacgattttcgacggcgtgagcaatgcgatgaagattgcccaggaagaaatcttcggcccggtgctttcggtcattgcgttcgataccgccgaggaagcgatcaacatcgccaacgacacgccttacggcctggcggcagcggtctggactcaggacatttccaaggcgcacctgaccgccaaggccctgcgggccggcagcgtgtgggtcaaccagtacgatggcggcgacatgaccgcaccgttcggcggcttcaagcagtcgggcaacggccgtgacaagtcgctgcacgcgttcgacaaatacaccgagctgaaggcgacctggatcaagctgtaactcgagacccagctttcttgtacaaagttggcattataagaaagcattgcttatcccccaaatacccagcaaattggagctctgcagagctttcgttcgtatcatcggtttcgacaacgttcgt

SEQ ID NO: 243 - DNA, 1681 bp, Arabidopsis thaliana
ttaattaacgttaaataatatcatctttcacgagtttattaaggaaaatgaggtgtttctcttgtctcaacacgcaaactaatgacatgagaatcaacattgataccctctccgacctaaccgattatgcctcaggttttaagaaaatctctctgtttttatctgaaacatctccaaaaattttgttttcttcatcatttgtgattatttttttgtgtttgcagttgccacaaaaatcgatccaagaggaacaggctcaaaatctggcattttaggttaggacattatggattattatttaaaatccttcttttttatgaagactatgatgtaaacaatgtcttctggttttggttagttaatgggaaagtgaatagccctaaaccgggtggtggcgcacggagtttcacgttcaaggagttagcagccgccacgaagaatttccgggaggggaatattataggaaaaggaggctttgggagtgtctacaagggacgtttagattcaggacaagtaagaaatgctctgttttcactcaaaagtcaaaacgttttcagaatgttgtaaaaagatttgatgggaattgaatttgagcaggtggtggcgatcaagcaattaaatccagatggacatcaaggaaatcaagaattcatagttgaagtctgtatgcttagcgtcttccatcatccaaatctagtaactttaatcggttactgtacttctggtgctcagagacttcttgtttatgaatacatgccaatgggtagcttagaagatcatctttttggtaagtgtgtgtttcctaatcaccccaaaatcaaagagtttgtattaataaaccgctctcattcttgttgttgtttgaaacagatcttgagcctgatcagactccactaagctggtatactcggatgaaaatcgcggttggtgcagctcgtgggatagagtatctccactgtaaaataagcccgtctgtgatttaccgtgatttgaaatccgcaaacattttgttagataaagaatttagcgtcaagctctctgattttggactcgctaaggttggtcctgtggggaaccggacacatgtgtcgactcgagtcatgggtacttacggatactgtgctccagaatacgcaatgagcggaagattgactataaaatcggatatctatagctttggtgtagtgttgcttgagcttatttctggcaggaaggccattgatttgagtaaaccaaacggagagcagtaccttgttgcttgggtaagtaagattaacaattgtaaccagattaaaccggaacttaatctctcgtttaatttaaccgtgttttttttttcattttcgcgttaatgcaggctagaccgtatctcaaagatcctaagaaatttggacttctagttgacccgttgctacggggaaagttctcgaagaggtgtcttaactacgcgatttctataaccgagatgtgcctaaacgacgaagcgaatcaccggccaaaaataggagatgtggtggtggcatttgagtacatagcctctcagagcaaatcttatgaagatcgaagaacggctcgcaagtctacggactctaaccggttaagacgggaaacaaaacagagttattaattaaattgtatgagtcctaagtgaaacctctgctagaatcagaaggggcgcgcc

SEQ ID NO: 244 - DNA, 1422 bp, Arabidopsis thaliana
ttaattaaggctctcttcaaatcaaccattaaaaccgccaattccgttatgacaaagaagagaaagctcgaatctgaatccaacgaaacgtcagagccgacggagaagcagcagcagcaatgtgaaaaagaggatccggaaatcagaaatgttgataatcaaagagacgacgacgaacaagtagtagagcaagacacactaaaggagatgcacgaagaggaagctaaaggtgaagataacatagaagcggagacgtcgtccggatctgggaatcaaggaaatgaggatgatgacgaagaagaacctattgaggatctattggaaccgttttcaaaggatcaacttttgattcttctcaaggaagctgcagagagacatcgcgatgtagctaatcgaatccggattgtggcggatgaagatcttgttcatcgtaagatcttcgttcacgggcttggatgggatactaaagctgattcacttatcgacgcttttaaacagtacggagagattgaagattgcaaatgtgtggttgataaggtatctgggcaatctaaaggttatggctttatcctctttaagtcaaggtctggtgctcgtaacgctcttaagcagcctcagaagaagattggaactcgtatgactgcgtgccagctggcgtctataggacctgttcaggggaaccctgttgtggctcctgctcagcatttcaatcctgagaatgttcagaggaagatttatgtcagtaacgttagtgcagacattgatccgcagaagttgctggagtttttctcaaggtttggggagatagaagaaggtcctttggggcttgataaagctactgggagacctaaaggtttcgctttgtttgtctatagatccctagaaagtgccaagaaggcattggaggagccacacaagacttttgaaggccatgtcttgcattgccacaaagcaaatgatgggccaaaacaggttaagcaacatcaacataaccataactctcacaatcaaaattcccgttaccaaaggaacgacaacaatggttatggtgcccctggaggccatggacatttcatagctggtaataaccaagctgtgcaggcgtttaatccggccattggccaggccctcacagctttgctggcatctcagggtgctgggttgggtttaaaccaagcatttgggcaggctttgttggggacattagggacagctagcccaggagctgtaggtggaatgccaagtggctatggtactcaagcaaatatctcacctggggtctatcctgggtacggtgctcaagccgggtaccagggcggttatcagactcagcaacctggtcagggcggtgcgggaagagggcagcatggtgctgggtatggtggtccttacatgggtcgttagattagccactggcgcgcc

SEQ ID NO: 245 - DNA, 4484 bp, Oryza sativa
ttcttgtttgttgattaacccttaattaatccgggcgcgcctgatttatcacaagtttgtacaaaaaagcaggctcctgcaggaccatggagcctgtcaatgatttccaggaaggcatttcaacagagcatgcctttgaggcagagcctgtgccatcattgtcggaaacaataacgccacgatcaatggtggtgagcttcatccttagtgtaactctcagcatcgtcgccatgaaggtcaccttgagctctggcttcattccgtcgttcagcatcccagccggcctcctcggtttttgtgtatcccgtgcgtcgatccgcattcttgactacttcgcagtggcacaactaccattcacacgccaagagaacaccatcatccagacctgtgtcgtcgcatgcacctcgatcacattcaccggtggctttgggacatatattcttgcaatgggaaagaaagcagctgtaggggatgtcaatgcccaaaataacgttgaggagccaagctttgccaggatgatcaccttcctcttccttatcagctttgctggcatgttcatcatcatgcccttcaggaaggtcatgatcattaggcaccggttgacattccccagcggcacagcaacggcgcacctcatcaatagcttccatacacctcaaggtgtcaagcaagcaaggaagcaagtgacattattgtttaaatcgtttggaggaaccatcgcatggtcgctcttccagtggttcttcgcctctgggccgggctgtggcttcaaattcttccccacatttggcctcgaggcatataaacacggattcttcttcgatttcaccatggccaatgtcggcattggcatgatgtgcccgtacatgatcgtgttctccgttttcattggcaccatcatctcgtgcggtgtaatttggccgtacatcgagtcaaaggagggcatctggtacccaagcaaccttgggcccaacagccttaacggcatcagaggttacaaggtgttcatcggcttgtccatgataatggctgactgcctcttcgtcttcctctgcatcatggtccggacaacatgtgccatgatcaagcggcgtcggcaggcaatgcaaggtggtggcggtaatgcgcagccattccagggtatcgacatcgccgatcagccggtgaagagcttcgatgatcgccgcagggcgcaggtgttcctccgggacgagataccggactcggtcaccattggctgctatgtcctcctgtcgatcatctccatcgccgccatccctcacctctacccacagatgaggtacagccatgttgcgctcatctacctcgccgcgcccgtcttcgccttctgcaacgcctacggcttcggcgtcaccgacatgaacctggctagcacctattgcaagatcgccatgttcgcgttcggctcgtgggtcggcatcaagagcggcggcgtggtcgccgccctggtcgccggcgggatcaccatgtcgatcctgggcaacgcggccgacgtcgcgcaggacctcaagacgggctacctgacgctgacgtcgccgcgcgccgtgttcatcagcgaggcgatcggcacggcgctgggatgcgtcgtcaaccccaccgtgttctgggtgttctacagggtgtacaagatgggcagcggcgacatgggcgacatgccctacgccaagctctaccgcggcttcgccatgctcagcgtcggcgacggcgagcaaggcctgcccaggcacagcatgctcctcttcaaggtcttcttcgtgctcgccctggcgctcagcgtgttccgggaggtggcgagccggaaggagtggcgcatccggcgctacatcccgagcaccatcggcatggccatcaccttcttcatgccgccgcgcgtgcccgtcggcatgtgcatcggcagcctggtggcgtacctgtgggagaagatggacgccggccgcgggcggatgctctcgccggcgctggcgtcggggctcatctgcggcgacggcgtcggctcgatcttgctgtccatgctgacactcatgggtgccagggcgcccatctgcatcaagttcttgtctcgaggtgacaatgtcaagttggacgccttcttggcaacactccatgacatgagatagctactagctagctatccatgtagggaaactagatcactcgagaccagctttcttgtacaaagtggtgataaattggagctctgcagagctttcgttcgtatcatttcttgtttgttgattaacccttaattaatccgggcgcgcctgatttatcacaagtttgtacaaaaaagcaggctcctgcaggaccatggagcctgtcaatgatttccaggaaggcatttcaacagagcatgcctttgaggcagagcctgtgccatcattgtcggaaacaataacgccacgatcaatggtggtgagcttcatccttagtgtaactctcagcatcgtcgccatgaaggtcaccttgagctctggcttcattccgtcgttcagcatcccagccggcctcctcggtttttgtgtatcccgtgcgtcgatccgcattcttgactacttcgcagtggcacaactaccattcacacgccaagagaacaccatcatccagacctgtgtcgtcgcatgcacctcgatcacattcaccggtggctttgggacatatattcttgcaatgggaaagaaagcagctgtaggggatgtcaatgcccaaaataacgttgaggagccaagctttgccaggatgatcaccttcctcttccttatcagctttgctggcatgttcatcatcatgcccttcaggaaggtcatgatcattaggcaccggttgacattccccagcggcacagcaacggcgcacctcatcaatagcttccatacacctcaaggtgtcaagcaagcaaggaagcaagtgacattattgtttaaatcgtttggaggaaccatcgcatggtcgctcttccagtggttcttcgcctctgggccgggctgtggcttcaaattcttccccacatttggcctcgaggcatataaacacggattcttcttcgatttcaccatggccaatgtcggcattggcatgatgtgcccgtacatgatcgtgttctccgttttcattggcaccatcatctcgtgcggtgtaatttggccgtacatcgagtcaaaggagggcatctggtacccaagcaaccttgggcccaacagccttaacggcatcagaggttacaaggtgttcatcggcttgtccatgataatggctgactgcctcttcgtcttcctctgcatcatggtccggacaacatgtgccatgatcaagcggcgtcggcaggcaatgcaaggtggtggcggtaatgcgcagccattccagggtatcgacatcgccgatcagccggtgaagagcttcgatgatcgccgcagggcgcaggtgttcctccgggacgagataccggactcggtcaccattggctgctatgtcctcctgtcgatcatctccatcgccgccatccctcacctctacccacagatgaggtacagccatgttgcgctcatctacctcgccgcgcccgtcttcgccttctgcaacgcctacggcttcggcgtcaccgacatgaacctggctagcacctattgcaagatcgccatgttcgcgttcggctcgtgggtcggcatcaagagcggcggcgtggtcgccgccctggtcgccggcgggatcaccatgtcgatcctgggcaacgcggccgacgtcgcgcaggacctcaagacgggctacctgacgctgacgtcgccgcgcgccgtgttcatcagcgaggcgatcggcacggcgctgggatgcgtcgtcaaccccaccgtgttctgggtgttctacagggtgtacaagatgggcagcggcgacatgggcgacatgccctacgccaagctctaccgcggcttcgccatgctcagcgtcggcgacggcgagcaaggcctgcccaggcacagcatgctcctcttcaaggtcttcttcgtgctcgccctggcgctcagcgtgttccgggaggtggcgagccggaaggagtggcgcatccggcgctacatcccgagcaccatcggcatggccatcaccttcttcatgccgccgcgcgtgcccgtcggcatgtgcatcggcagcctggtggcgtacctgtgggagaagatggacgccggccgcgggcggatgctctcgccggcgctggcgtcggggctcatctgcggcgacggcgtcggctcgatcttgctgtccatgctgacactcatgggtgccagggcgcccatctgcatcaagttcttgtctcgaggtgacaatgtcaagttggacgccttcttggcaacactccatgacatgagatagctactagctagctatccatgtagggaaactagatcactcgagaccagctttcttgtacaaagtggtgataaattggagctctgcagagctttcgttcgtatcat

SEQ ID NO: 246 - DNA, 520 bp, Zea mays
aaaaaagcaggctcctgcaggaccatggcggactggggccccgtgatcgtagcgacggtgctgttcgtggtcctcacgccggggctgctctgcacgctgccgggccggggccgcgtcgcagagttcggcagcatgcacaccagcggcctggccatcctcgtccacgccgtcctctacttcgcgctcatcaccatcttcctcatcgccatcggcatccacgtttacgcgggctagctcgagacccagctttcttgtacaaaaaaaaagcaggctcctgcaggaccatggcggactggggccccgtgatcgtagcgacggtgctgttcgtggtcctcacgccggggctgctctgcacgctgccgggccggggccgcgtcgcagagttcggcagcatgcacaccagcggcctggccatcctcgtccacgccgtcctctacttcgcgctcatcaccatcttcctcatcgccatcggcatccacgtttacgcgggctagctcgagacccagctttcttgtacaaa

SEQ ID NO: 247 - DNA, 1320 bp, Zea mays
ttcttgtttgttgattaacccttaattaatccgggcgcgcctgatttatcacaagtttgtacaaaaaagcaggctcctgcaggaccatgtccaaccccggctcgttgcccgcctccgctcaccacgagcacgagcacacccctctctgccgctcctgcggggcgcccaccacgtcgccgaccccggcaccctggtcagggaccaccgactccccgccgccggcgtaccgccccatccgtctcccagccatcaacgcgcccaccaacacagccgccatagtcctctccccggtcccacagccgctccccgtgcctcccgccgcgccgccccacgccttcctggtccctgccaagcggatcacctcaccggacgatatcgcccgcttccatgcctccgtccacggccttcacttcctcgggttcgtcgccgcgctgtccgcctccgtccacggccgcaagctctcggacccgctaccgtccccgccatcccccgccatagctgcgctgctcgatctcgtctcggctctcgccgctctcgtcgcttccacccctccgcttccacacagctctcggtacggcaaccctgctttccgcctgtggcacgagaagctcaccgactccgccagcgagctgatctcgcggatcacggccaccgcgtcttcccctgcggacctcgcaggcgccgatgtcgagctagcaccgtacctcctcgactccttcggcaacgccacccgcatcgactacgggacggggcacgaaaccaacttcgccgccttcctctactgcctcgcgaggctcggcctcatcaccgagcccgactacccggccgtcgttctgcgcgtcttcacagcttacctcgatctcatgcgcacgctgcaggacacgtaccagctggagcctgcaggctcccatggcgtgtggggacttgatgattaccatttcctgccgttcgtatttgggtctgcacagctgattgaccacaagtacatgaagcccaagtcgattcacaacccagatatcttggaaaatttctccaaggagtacatgtatctggcgtgcgttgcatatgtgaagaaggtaaagaaggggccctttatggagcattcaccaatgttggatgatatcagtggagtggccaattggaagaaagttaacagtgggctgctaaagatgtacaaggctgaggtgcttgagaaagtaccgatcatgcagcatttcctctttggctcactaatcaaatgggaggattaactcgagacccagctttcttgtacaaagtggtgataaattggagctctgcagagctttcgttcgtatcatc

SEQ ID NO: 248 - DNA, 574 bp, Arabidopsis thaliana
ttaattaattcgtcagtgtgtgtattttggggaaaactttgtgagcaaagagcgagaaaatgagcggagccggtaagaaaatcgcggatgtggctttcaaagcttcaaggactatcgattgggatggtatggctaaggtccttgtcacagatgaggctcgtagagagttctctaaccttcgtcgtgctttcgatgaggttaacacacagctccagaccaaatttagtcaggaacctgaacctatagattgggattactataggaagggtattggagctggcattgttgacaagtacaaggaagcttatgacagcattgagattccaaagtacgttgacaaagttactcctgaatacaagccaaagtttgatgctttgttggtggaactgaaagaagcagaacagaaatcgctcaaggagtctgaacggttggagaaagaaattgctgatgtccaagagatcagcaaaaagctcagcaccatgactgcagatgagtactttgagaagcacccggaactcaaaaagaagtttgatgacgaaatccgtaatgacaactggggatactgaggcgcgcc

SEQ ID NO: 249 - DNA, 1056 bp, Arabidopsis thaliana
ttaattaatggaatccaaaaccataaacgacgtcgtcgtatcagagtcaaatcacgagttagcatcttcgtcgccatcagaatttgagaagaaccagaaacattaccaagaaatcatcgcaactcttcctcacaaagatggctggagaccaaaagatccgttcgttgagtacggtggtcactggtggctacaacctcttcttgaaggtttacttcacgcccagaagttcttcaaggcacgtcccaatgatttcttcgtctgcagctacccaaaaaccggcacgacttggctcaaagccttaactttcgcaatcgcaaatcgctccaagttcgacgtttcaacaaaccctcttctcaaacgtaatccacacgagtttgtgccttacatcgaaatcgacttcccgtttttcccaagcgttgatgttcttaaagacgaaggaaacacgcttttctcgactcatatcccttatgatctcttacctgaatcagttgtgaaatctggttgcaagattgtttacatatggagagacccaaaggacacgtttgtgtcgatgtggacttttgctcacaaggagagatcacaacaaggaccagtggttagcattgaggaagcttttgataagtactgtcaaggtttatcagcttacggtccttatcttgatcatgttttagggtattggaaagcttaccaagcaaacccggatcagattttgtttctcaagtatgagacaatgagagctgatccattgccttatgtgaagagattagctgagtttatgggttatgggttcacgaaggaggaagaggagggaaatgttgttgagaaagtagtgaagctttgtagctttgagactttgaagaatcttgaagctaacaaaggtgagaaagatagagaagatcgtcctgctgtttatgccaacagtgcgtatttcaggaaagggaaagttggggattggcagaattatctgactccggagatggtggctcgtattgatggtttgatggaagagaagtttaaaggaactggctttctttcttcaaaatcatgaggcgcgcc

SEQ ID NO: 250 - DNA, 2021 bp, Arabidopsis thaliana
acaagtttgtacaaaaaagcaggctcctgcaggaccatgtcttctctgatctctttcatcttccttttccttttctcatccatcacagcttctgctcaaaatactttctacctatatcataattgttcagtcacgacgactttctcaagtaacagcacttactccaccaatctcaaaacccttttgtcctctctctcttcccttaacgcttcttcttactccaccggattccaaaccgccacggcgggacaggcccccgacagggtcaccggacttttcctctgccgcgtcgacgtctcgtcggaagtttgccgtagctgcgtcacctttgccgtaaacgaaacgttgactcggtgtccaaaagataaagaaggcgtgttctattacgagcagtgtctgctcagatactctaacaggaatatagtagccactctaaacaccgatggaggaatgttcatgcagagcgctaggaatcctctatcagtcaaacaagatcagttcagagatttggtcttgacccccatgaacttagccgccgttgaagccgccaggagtttcaaaaaatgggctgtgagaaaaattgatttaaatgcatcccagagtttgtacggaatggttcggtgcactcctgatcttagggaacaagactgcttagactgtctgaaaataggcatcaatcaagtaacctatgacaaaattgggggaaggattcttctgccgagctgtgcttcaagatacgataattacgcgttttacaacgaatctaatgttggaacacctcaagattcatcaccacgtcctggaaaaggtggaaactcctctgtcataattattgcagttgttgttccaatcactgtactttttcttctattagtagctgtttttagtgtcagggctaaaaataagaggacgcttaatgagaaggaaccagtagctgaagatgggaatgatattacgactgcaggatcacttcagtttgattttaaggcaattgaggcagcaacgaattgctttttgccaattaacaagctaggtcaaggtggtttcggcgaagtttacaagggtacattgagtagtggactacaagttgcggtgaagagactatcgaagacatcaggacaaggtgaaaaagagtttgaaaacgaagttgttgttgttgcaaagctccaacatagaaatttggtaaagctgcttggttattgtttggaaggagaagaaaaaatacttgtctacgagtttgtgcccaacaagagccttgatcacttcctctttgactctacgatgaaaatgaagctagactggacaagaaggtacaagatcataggaggaattgctagaggaattctttatcttcatcaagattcacgactcacaattatacatcgagacctcaaagcagggaacatcctcttggatgatgatatgaatcctaaaattgcagattttggaatggcgagaatatttgggatggaccaaacagaagccatgacaagaagagtagttggaacttatggatacatgtctcccgagtatgcgatgtacggccaattctccatgaaatcagatgtgtacagttttggcgtcttagtacttgagattataagcggcatgaagaatagtagtctctatcaaatggatgaaagtgttggcaacttggttacatatacttggagactatggagcaatgggtcgccatcagagcttgtagatccgtcatttggagataattatcaaacaagcgaaattactaggtgcatccatatcgctttactatgtgttcaggaagatgctgaagatcgtccaaccatgtcatcgatagttcaaatgctcactactagcttgatcgctctcgctgagcctagaccacctggatttttcttccgaagcaagcaggaacaagcaggtccatctattgattcatctacgcattgttcagtcgacgaagcttccattactcgtgtaactcctcgttgaagacaaaactattcgtctcgagacccagctttcttgtacaaagtggt

SEQ ID NO: 251 - DNA, 1169 bp, Arabidopsis thaliana
ttaattaatattgatttcgtctgtgcagttttgtttctctatcagttagttttaaagatgagttcttcagagagtgtggaaaacgagtgcatgtgttgggctgcaagagatccatctggtcttctttctcctcatactatcactcgcaggtctgttacaactgacgatgtttcactcacaatcactcattgtggagtgtgttacgctgatgttatctggagtagaaaccaacatggagactccaagtaccctttggttcctgggcatgagattgctggaatagtgactaaggttgggcctaatgttcaacgattcaaagttggagaccatgttggtgttggaacgtatgttaactcctgcagggagtgtgaatattgtaatgaaggacaagaagttaattgtgcgaaaggagtttttactttcaatggcattgatcatgatggctctgttactaaaggaggctactctagtcacattgttgttcatgaaaggtactgctacaagatacctgtggactatcccttggaatcagctgcaccattactctgtgctggaatcacggtttatgctcctatgatgcgtcacaatatgaatcaacctggtaaatctcttggggtgatcgggctaggtggtcttggacacatggcggttaagtttggcaaggcttttggacttagtgttacggtttttagcaccagcatttccaagaaagaagaagctttgaatctgctaggagctgagaatttcgttatctcatctgaccatgaccagatgaaggcactagagaaatctctagactttctagttgacacagcatctggtgatcacgcgtttgatccttacatgtctctcttgaagattgctggaacttatgtattggttggtttcccaagtgaaattaaaatcagtcctgccaatctcaatcttggtatgagaatgctcgctggaagtgtaaccggggggaccaaaataacacagcaaatgttagatttctgtgcagctcataagatttatccaaacatagaggtgattcccattcaaaagataaacgaagctctcgaaagagtggtgaagaaggacatcaagtaccgtttcgtgattgacatcaagaactccctcaaatagatgttgctcaaaggaaggaataatggagtctgtaatggcgcgcc

SEQ ID NO: 252 - DNA, 1371 bp, Arabidopsis thaliana
ttaattaaacggcaattagcgaaagtgggcgggaggattcttttccggcgactcttttatgtcttctcttcctcttcgctccggtgagaagatggaatcgccttccatctccgacgccgttccacttcacgcaccagaagacgcgaccgcggatttttcccaaccgcaatcgccgttacatgaagttgattcgtttccagttactgaatcctccgatgatgttgttgttaacgtctcggagataccgaatttatctccgtctgatgatgattttgaccacgagcgaaatagcggcgaggatcgcgatcaggatcacggcgagaatccggttgagaccgatggtgttgttgttccaatcgatgagttgaatcagaagatcattagacaggttgaatactactttagtgacgagaatttgcctactgacaaatttcttctgaatgcaatgaagagaaacaaaaaaggctttgttcctatttctaccattgctacgttccacaaaatgaagaagcttactcgagatcatgctttgatagtatcagccttaaaggagtcatcgtttcttgttgttagcgctgatgagaagaaggtgaagcggctgagtcctcttcctgagatcagagatccaaagattttcactgttttggtagaaaatttgccagaggatcattcaaatgagaatattcgagagatatttggtaaagctggaagtattaaaagtgtatccatatgtgatccaaatgctgttgaagaatcagagaagggtgggaagaaggaaaatttcatcagaaccagattacatgcctttgtggagtatgaaacggtggaggcagctgaaaaagcggcagctacattgaataatgagcaagactggagaaatgggttgcgagttaagcttcttgaacaagcagcaggaaagtttgcacagagaagaccagctcggagggaagtcgataaagaaaaggacactacaggcagagttcatgatcaaactggaggagagaaaaacaaaaagacgcgtgaacatcaaaatcaccgtctccatcattctgataatcctgctgatgatgacggtggcaatcatcagaaggataaaaatggaaacaaaggcagagttgtaggacaaggaagacgacagaatcatcaaggcggcaacggcattggacatggaacagcttcatcatcttctcatcctaattatcatcctgttgaggtctcaaagcgtccacctggcccgagaatgcctgatgggacgagagggttcacaatggggcgtggtaaagcgattcctcctcccacatctactcaaaccagtcatgaagtttgatcggttccgcatcttcggttgtatcattgtgtggttggcgcgcc

SEQ ID NO: 253 - DNA, 1396 bp, Arabidopsis thaliana
ttaattaatgagtagcgatgatacgattgaggagagtttgcttgtggatcccaaattgttgttcatcggctccaagattggtgaaggcgctcacggcaaagtctaccaaggaaggtatggtcgtcagattgttgcaatcaaagttgtcaaccggggctccaaacctgaccagcaatcttctctcgagagccgtttcgtccgtgaggtcaatatgatgtcccgcgttcaacaccataaccttgtcaaggtctctctccttctttcttctctttctttgctctcgatacttcttcttgaatacacaatatccatttggcagtttattggagcgtgcaaagatcctttaatggtaatagtaacagagcttctcccagggatgtctctccgtaaatatctcaccagcatccgtcctcagttgctccatctccctcttgctctctcctttgcccttgacatcgcccgtgccttgcactgcttacacgccaatggtatcattcacagagacctcaaacctggtactactcttctatccctgcttccttcctagcacaccttttatgttttaactactggactcataagttaaccaatgtcgcagacaacttattgctcacggagaatcacaaatccgtcaagcttgctgatttcgggcttgctagggaagaatccgtgactgagatgatgactgctgagactgggacttaccgttggatggctcctgaggtttttgcccgctctgtcattcttgtaaatcataccactatttgacattataaaaaagccatatatgcatgtcttgtgttcgtgtcatccgtagctctacagtacagtgaccctgcgtcaaggagagaagaagcattacaacaacaaagttgatgtctacagctttggaatcgtgctttgggagcttctcactaatcgtatgccattcgagggcatgtccaatctgcaagccgcctacgcagcagcattcaaggttcttcttcttcttcttctacttcccgtttctcccctgtgatcatggagttatttagaaataaacctcttttcttcttcttcttgttgaaaacattgcagcaggagaggcccgtaatgccagaggggatatctccgagtctggcgttcatagtgcagtcttgttgggtggaggacccaaacatgaggccaagcttcagtcaaattatcagactgctcaatgagttcctccttaccctgactcctccgcctcctcagcctctgcctgagactgccaccaacaggaccaatggccgagccatcactgagttctccatccgtccaaaagggaaatttgccttcattcgccagcttttcgctgccaagaggaacataaactcttaggtacaagaaggggtcttctttgtctttgcggcgcgcc

SEQ ID NO: 254 - DNA, 1737 bp, Arabidopsis thaliana
ttaattaagaatggcaagtctcttctcctcacgtctcggctctcaatctctttctctcctcatcaacatcttcttcatctttctcatctttctccatttcgcttcacaaactcctcctccctccggatccatccaaaccttaaattcctttgccggcggtgacagtgacagctgcagcggaggactcgccagccttgacgaccaccgttccaagtgttcttacataagatctcaatcaaaatgtggcccacaaggttacatagactatctcaagattttcttctgcatcttcggacaatcccctgttttgggccatctagttttatccgcctggttgtttgttctgttctacttgctcggagacacggccgcgagttacttctgtccttctttagacagcttatctaaggttttgaagctgtctcctacaatggctggagtcacgcttctctctcttggcaacggtgcgcctgatttgttctcaagtgttgtctccttcacaagatcgaataatggcgattttgggctcaactctattttaggcggtgcgttcttcgtctctagcttcgttgttgggacgatttgtgtgttgattggatctagagatgtcgctatcgacagaaatagctttatccgcgacgtggtttttcttcttgtcgctctttgctgtctcggtttgatcatcttcataggcaaagtaaccatttgggtcgctctctgttatctctccatttatctcctctatgtagggtttttatcggtttcacatttctttgaccgcaagaaacgtatgtccgatcagattcttcgtagcagagaagatttggccgagatgggtgtttcgttgctaggctatatagcagaggagaagctggctttgccagagaaaacaactcaagaattcaagattgtgtttgaagattctccaaaaaggcaccgatcttgcttctcggtgctagtgagcataattggactacctctatatctccccaggcggctcacaattcccgtcgtttgcgaagaaaaatggtcaaagccttgcgctgtggtttccacggccatcgctcctgttctactaaccgaactttactgttctcattacagcgggtcacaaagaaacctaatcttgtacataatatccggatctatcgggctaatcgtcggtatcttagcttacttgacgacagaaaaatcacatccgccgaagaaattctcattagtttggcttctaggaggcttcacgatgagtgtgacatggacatacatgatagcacaagagctagtctcattgttaatatccttaggtaatatctttggtataagcccatccgtgctaggactaaccgtcctagcttggggaaattctctaggcgatcttatcgcgaatgtgaccgtggcgtttcacggaggcaacgatggtgctcagatagcactttccggatgctacgcaggcccgctattcaacacggtaattggactaggtgtgccacttgtcatctcctcgttggccgaataccccggggtctacatcattcctagtgacaattcgttgcttgagacactagggttcttaatggtaggcttgctttgggcacttgtgataatgccaaagaagaagatgagacttgataagcttgtcggtgggggcttactcgctatttacctctgtttcttgtccttgaggttggctagagttttcggagtccttgataccgaccggtgaattttaggcgcgcc

SEQ ID NO: 255 - DNA, 3610 bp, Arabidopsis thaliana
tctctcctctctcttcacattattatattctctctgtttcttccaatccaatccaatctctctctctctctctctctcagaaactaaactgaaatattgcagagttttgaatacacggccatgaaccaatcaccatctcttatcgaacagggtatttctcaacaggtcagtttttttttcttctgtgtttctcatagtaaccaaatcctctgttttatcatgttctgtttcaactctgttctgtctgttgcaatgagaattttctcaaaaatcacttttttcttctgggtttttgattttgggaacaatgcgaatttatgtggtcgagattggattttcgtatttgaagaagaagaacaagtggaagattaagggttctatttttgctctgtttttgcttcatttttggattgttttcccaagtaggattggtaggtcctcctgcttgaaccatatcgactttggtatttaccggaatttaaacaaagacgtgaacgcttttcatgtttggtgatattagattagttgttaacttgtgaaattgagccttctaattattaatgttattgttaatttgacaaaaggtttgattttgaaatttagtaaagtctctatttttaaggaaagaaatgagttggatgtgaaaagtccaacttttttttattagactgtttggtttttgtagttgacatctattggcagagtaaaggttctaagattatgtaattaggttaaatttaggtcatactttatgaaaactcaatgtttctgagtacataaatcttaaaagttcataatctttgttttaaaatgtttcagcatttgaagactttgtcttgtgccaatgttcttactttggcttaccagagtcttggagtgatctatggtgatcttagtacatcgccactctatgtttataagaccactttctctgggaaactaagtcttcatgaagacgatgaagagatctttggagtgttctctttcatcttctggacatttacactcattgctctttttaaatacgttttcattgttctctcagcagatgacaatggagaaggtaaaagctttaagcctttatatcagaattatgatatgtctacgtatgttttcgacgttgatcagtcgtttgtgttctttgtttgaaggtggaacatttgcgttgtactcgcttctttgtagatatgccaagctaagcattttaccaaatcatcaagaaatggatgagaaactatcaacatatgcaacgggaagcccaggagagactcggcaaagcgcagcggttaaatcattctttgagaagcatccgaaatctcaaaagtgtttgttgctctttgttcttttagggacatgtatggctattggtgatagtgtcctcactccaacaatctcaggtaaattttccagagaacttctctgcagtgaaccttagacaaagtatagtttccaaacattttggtatcttgcagttctttcagctgtttctggagtcaaactcaagattcccaaccttcacgagagtatgtctgactctgtttacttactttgtcaaatatatactaattcacgtctcatgtttagttttgtttctcttgtcctcaactccagattatgttgtcatcatcgcatgtatcatcttggtggcgatattctcagtccagcgttatggtacgcatagagtcgccttcattttcgctccaatctccactgcttggcttctctccatcagtagcattggagtttacaacactataaaatggaacccgcgtatagtctctgcgctttcgcctgtttacatgtataagttccttagaagcaccggtgttgaagggtgggtttcacttggaggtgttgttctttcaatcacaggtaaaaactttagttaatgaaactatatgttatataacattatcaaagtttatgttctttattcttatatattgtgtttattctcctccttaggtgttgagactatgtttgctgacttaggtcacttctcttctctgtccataaaggtaagacctttaactttataagatatgattctgatgaaaagaatcctcttttagtaacaaaactgaaatataggtggctttctcgttctttgtatacccgtgtttgatacttgcatacatgggtgaggctgcgtttctctctaaacaccatgaagatattcagcaaagcttctacaaggcgatacccggtaaattcttaactgtaatctgtatagtacgcgaataactcgagacttttgaatgggattaagtcagataagtctgtttgcagagcctgtgttctggccagtgttcattgtggctacatttgcagctgtggtgggaagccaagctgtcatatccgcaacgttttcgatcataagtcaatgttgtgcacttgattgctttcctcgggtcaagatcattcacacttcaagcaaaatacatggacaaatctatatccctgaagttaactggatgctgatgtgtctttgcctggcggtcactatcgggttaagagacactaatatgatgggtcatgcatatggtgagaccatgatcatgatcacttcagttgtttttagaaaattgaaaacttatgtttaaatctctttgtttctgcaggacttgctgtgacctctgtgatgcttgtgactacatgtttgatgactttagtgatgacaattgtctggaagcaaagaatcattacagttctcgcattcgttgtctttttcggttccatcgagcttctctatttctcgtcatgcgtctacaaagtacctgaaggaggttggattccgattctcctctctttgacattcatggcggtaatgtacatatggaactacggaactacaaagaaacatgaattcgacgttgagaacaaggtctcgatggaccggatagtttctctaggaccaagcataggaatggttagagttccaggaataggactggtctattcgaatcttgtgacgggagttccagctgttttcggacatttcgtgacgaatctgcctgcgtttcacaagattctagtgtttgtatgtgtgaagtcagttcaggttccttatgttggagaagaagagaggtttgtgataagcagagtagggccaaaagagtatggaatgtttagaagtgtggttaggtatggatacagagatgttcctagagaaatgtatgacttcgaaagccggttagtatctgcaatagtcgaattcgttgaaaccgaaccgggacttgaagaagaagaaatgtcgagtgttcggagaaagaaagaggaatgtatggagataatggaagcgaaagaagctggagtagcgtatatactgggacattcatacgcaaaggcgaagcaatcatcgtcggtgttgaagaaactagcagtgaatgttgtatttgcgttcatgagcacgaattgcagaggaacagatgttgtgcttaatgttcctcacacttctctgcttgaagttggaatggtttattacgtctaaacagagtaatacttagctttagcataagatcagtacagtttttagtagtagtacagtatataagagagctctaacttcattttcagttgttttagcagagaagtttaatgtgtaaatata

SEQ ID NO: 256 - DNA, 2252 bp, Arabidopsis thaliana
ttcttgtttgttgattaacccttaattaatccgggcgcgcctgatttatcacaagtttgtacaaaaaagcaggctcctgcaggaccgatgggttgtgtttgtggtaagccttctgctattgaagatagcaaagatagtccaagagagcgtttctcaagcaaatcctcttctgagtttagagtttcaagaccggttgcttcttctagaagggaggagccgcttaggattaaggaacggtctgatgttgttagtgtaagaccagtgttgagtaataagcaatccaatgtttcgttgcatttgcgtggagagaatttgagtagaagagagaagaggattgagaatgttgctgctacttcacctcttgcaatgagtattaccatagctaaagcaactgaaggagagtatgtagctgcaggttggcctccatggctggcttctgtagctggagaagctatcaggggatgggttcctcggcgtgcggattcttttgagaagttggacaaaattggtcagggcacttatagtaatgtatatagggctcgcgacctggatcagaagaaaattgtggctttgaagaaagttaggtttgataacttggagccagaaagtgtgcgttttatggctagagaaatccagatattacgccggcttgatcatcctaatatcataaagctagaaggcttagttacgtcaagaatgtcttgcagcttatatcttgttttcgagtacatggaacacgatttagctgggctagcctcgcatcccgcgataaaattttctgaatcacaggttaagtgctacctgcagcaactattacatggactagaccattgtcacagtcgtggtgtactccatcgggatataaaaggctcaaacctgctaatagataatagtggagttttaaagattgctgactttggattagctagtttctttgatcctcgtcaaactcagcctttgaccagtcgtgtggtaactctttggtaccgtccacctgagcttttgctcggagcaactcgctatggagcagcagttgatttgtggagtgcaggttgcattcttgctgaactatatgcaggcaagcctattatgcctggtagaaccgaggtggaacagttgcacaagattttcaagctatgtggctcgcctaccgaggactattgggtaaaatcaaggttgcctcatgcaacaattttcaagcctactcaaccatataaacgcttagtgggtgaaacattcaaggagtttcctcagccagctttagcccttcttgaaactctcctttcagtcaatcctgacgatcgtggaactgccactgcagctctcaagagtgagttcttctccaccagacctcttccatgtgatccttcaagcttgcctaaatatcctcccagcaaagagctcgatgcaagaatgcgggatgaggaaagtagaagacaagttggaggaaacagggaccaaagacaccaagaaagaagaggaactaaggaatctcgagccatcccagcccctgacgcaaatgcagagctggttgcatcaatgcagaaaaggcagagccagtctactaatagaagtcgaagcgagaagtttaatccacatcctgaagaagttgcatccggtttcccaatcgatccaccaaggccgtcatcacaagcatttgaaccaaacagagaatctcagggcaatataattcctcacaagagagcttcacattctggtcctctatcacgtagatctgcttccgcaaagggtagacggaattaccaagattctcaaaaggtttcatccatagctgattactcagcaatgcctggttttgccgcaacaagaacaggcgcaccacaacaagagacttgcagaggaatgactcggcttccaggttcattcaaggaaacgtctgaagaagcaaaccaggaagagaatggtcgaagcaacaagaaagaccctattctcttgggttatggatcaaaagggcacaagattcattactcaggaccgttagtggttccatcaggaaacatggatcaagtgttgaaagaccatgaccgacatatccaagaagctgtgagaagagcacgaatcgataaggctcgagtcaagaaacttcaagctgacgaagcttcgagccaacaagtcgcaaccaatcatccctcatctgtttctagccgttgatccatcagtgctcgagacccagctttcttgtacaaagtggtgataaattggagctctgcagagctttcgttcgtatcatc

SEQ ID NO: 257 - DNA, 2235 bp, Arabidopsis thaliana
ttaattaaatggaaggagaatccaaaggattaatcgttgggatctcactaggtttggtgattggtgttgtcttagctatctcagctttgttctgctttaggtatcatagaaaaaagtctcagattgtgaatagtggatcacgaagaagtgcaaccattcccatcagagagaatggagctgattcgtgtaatataatgtcggattcgaccattggtccggattcacctgtgaaatcttctaagaatgggaggtctgtttggcttgaagggtttagtaagaggagtaatgtcatctctgcttctggcattttggaatattcttacaggtttgtctcttcctctgacaaatcttagtttcctgattaggttattattttattgtcttaactatactcaggactagacttctcttgttatagtagttactttggttattatttcaaagtttgaaagttcattaaaaaggggaatgctgttgtggatatgagaaggtcttgcattcttggggttatattccgtttttgacatatggtctttggtgattgcttcagggatttgcagaaagcgacgtgtaatttcacgactttgataggccaaggagcatttggacctgtctacaaagctcaaatgtctactggtgagatcgtggctgtgaaagttctagccactgattctaaacagggcgaaaaagagtttcagacagaggtaagatatatctatggattcatttccgaagaacaagttagtgtgtaaaacatgtagcattaggcagacttttaagcattacaataggctttctgaaatctctaatactcaatttattagttgtgtcatctataagacaggctacatgaatgaacaatctatatatcttactctcttagtatctgcttagtttcttgaaaaactcatccactcgccttaatcttttcaggttatgttattgggaaggttgcatcaccgtaacctagtgaacttgattggatactgtgcagagaaaggccaacacatgcttatatatgtttacatgagtaaaggaagcttagcttctcatttatacagtaagtaactacctggttatacataccatattaatctgcttgtcactaaatgaactgttaatgcaatgttgagctattcggtatctttgtagaacatttattgagttgatggtttagacttcactaaatgatgagccttggtaaagatttgagatgcactaaaatggtacttttgatacaggcgaaaaacatgaaccgctgagctgggatttgagagtatatattgctttagacgtggcacgtggtctagagtatcttcatgatggggtaagctgcttgctaaaaccattcaccattttaatgcatctcttaaacaacaacttcaaaactcatgttctaatcaattgttccaggctgttcctcctgtaatccacagagatatcaaatcttccaacatcttgctggatcaatctatgagagctcgggtaaacatatcttctttctctttgaaatctcagtctattgaaccacctcaagtttctaatggtgatcttctttaacttcaggttgctgactttggcctctccagagaagaaatggtagacaaacatgcagctaacatcagaggaacatttggctacctcgatcccgaatacatttcaacaagaacattcaccaagaaaagcgatgtctatggcttcggagttttgcttttcgagcttatagcaggaagaaatcctcaacaaggtctaatggaattggttgagctggtaacataaaactaaaaagtcctcgaaatctccaattgttttgtttggagaattgcatgtaaagactaaacgttttgttgttgttgatgaacaggcggctatgaatgcagaggaaaaagtcggatgggaagagatagtagattcaagattagatgggagatatgatttacaagaagtgaatgaagtagcagcttttgcttacaaatgcatctctcgtgcacctagaaaacgtcctaacatgagggacattgttcaggttttgactcgtgttattaaagtgagacattgcagaaagcggcagaagaattctccgtcgccgtctccacggcttcctcctcctcctccgatagtggaggagtcagaaggtgagttaactgcaaacggatcattacgatcagaaattcatcggagggataattccttggacagtagtatagctgaagacgtgattttgtaaggcgcgcc

SEQ ID NO: 258 - DNA, 1545 bp, Arabidopsis thaliana
ttaattaacgtgaaacaacacaacttcgatgaaagccgccgttttccgtaacgaagacggagacgaggaggaggaagaagaagaagaagaagaagtctgtaatgttttcgacggcggcgaggtagagtctaagagaaacaacgaaaccaaaaacctcaaaggatttttcacttctttgcttttgatggaggagcacgagaagcaagaccaggaagctcgtaacgctgcttctcgccgtgaaatgtctgattttcaatctaattaccggaaaagagctagaactatgtccgattactactccgatctcaacgattactacgctgatgctgaggaaagtggagatatcaatctgaagaagtcacgcgtctcacgcgccgtcgcttccgttgctgttgctgctgcttcggagattgaggcggagagcagtgagataaccggatccggatcggttcgtggtaccggttcgggtcagcaaagacggttatgggttaaagatcggagcagagcttggtgggaagagtgtagccgattggattatccagaagaagatttcaaaaaagcgtttcgaatgtctaaatcaacgtttgagttaatctgcgatgagcttaattcagcggttgctaaagaagacaccgcgttaagaaacgcgattccagtgcgtcagcgagtcgcggtttgtatatggagattagccaccggtgagccacttcgtcttgtctccaagaagtttggtttaggaatctcaacttgtcacaagcttgttcttgaggtatgtaaagctattaaggacgttttaatgcctaagtatcttcaatggccagatgatgaatctcttagaaacattagagaacgtttcgaatcggtttcgggtattccaaacgttgttggctctatgtatactactcacattccgattatagctcctaagattagtgtagcctcttatttcaataagaggcatactgagaggaaccagaagacgtcgtattcgattacaattcaagccgttgtgaacccgaaaggtgtttttactgacttgtgcatcggatggcccgggtcaatgccggatgataaggtgttagagaagtcattgttgtatcaaagagctaacaatggaggtttgttgaaggggatgtgggttgctggtggaccgggtcatccgttgttggactgggttttggttccgtatacgcaacagaacttgacgtggacgcagcatgcgtttaatgagaagatgagcgaagtgcagggagtggctaaggaagcgtttgggaggttgaaagggcggtgggcgtgtctgcagaaacggactgaagtgaagctgcaggatttgcctaccgttttgggtgcttgttgtgtgcttcacaacatatgtgaaatgagagaggagaagatggagccagagctgatggttgaagtgattgatgatgaggttttgcctgaaaacgtattgagatcggttaatgcgatgaaggctagagatactatctcacataatctattgcatcacggcctcgcgggtacttctttcctataaggcgcgcc

SEQ ID NO: 259 - DNA, 1370 bp, Arabidopsis thaliana
ttaattaattgtgagcaatgttgttgaagatcaaaagagttccaacagttgtatcgaattatcaaaaagatgagacagttgaagaaggtggatgtggtcggaattgtctgagcaagtgttgcatcaatggggcaagacttcctttatatacctgcaagaatcttgataaatccgtcggagagaacacagaatctccggtgacgttcctcgaatccttagttattggagagtgggaagatcgtttccaaagaggtctttttcgctatgatgtcaccgcctgcgaaaccaaggttataccggggaagtacggtttcattgcgcagctgaatgaaggtcggcatctcaagaagagaccaaccgagttccgtgttgacaaagttcttcaaccatttgatggaaacaaattcaatttcactaaagttggtcaagaagagttgcttttccagtttaaagctagcactaatgatgatgatagtgaaattcagttcttggcgagtatgcctctagacgctgataattctcctagcgtcgttgcaatcaatgtgagtccgattgagtatgggcatgtgttgctgattcctcgtgttcttgattgcttacctcaaaggattgatcacaaaagccttttgcttgctcttcaaatggcggctgaagccgataatccgtatttccgacttggatacaacagtctaggcgctttcgctaccattaaccatcttcactttcaggcttactatttggcaatgcaattcccgatagagaaagcttcttccttgaagatcactaccaccaataatggcgtcaaaatctctaaactcttgaattaccctgtgagaggtcttctagttgaaggtggaaacaccattaaagatctcgcagatactgtatcagacgcatccgtttgtcttcagaacaacaacattcctttcaacattctcatctctgactctggcaaacgaatcttccttctccctcagtgttacgcagagaaacaggctttaggagaagttagctcaacgctattggatacgcaagtgaatccagcggtttgggagatgagtggacacatggtgttgaagaggaaagaagactatgaaggagcgtcagaagagaaggcatggaggttactagctgaagtttctttatcagaggagagattcagagaagttaacactatgatatttgatgccatcggttttagtagtcacgaagaagaagaagaagaggagcttgaagagcagaattcgatgaatggtggcagcttcacaatagtgcattgtccttcagtgaaagaagaggctgtctctaattgaggcgctttataactaaaagcaaaaacataactgtcgtcgtgattttgcaggcgcgcc

SEQ ID NO: 260 - DNA, 1336 bp, Arabidopsis thaliana
ttaattaatggcgagcaatattatcatgttcgaggatatcttcgtggtcgataagctagaccctgatggcaaaaagttcgataaaggtatctacttttttttttaacctcagtcacgatttgtaatgcttgtcatggcttaaatcgagtttctgatatgaatcctagtttcttgtgtttgttttaagttttagataaattggaatccaagttagtgtgaaaaagatctcaacttttaaaattttaagcctcctaaagtttgtttgttctgacttcaaattgattgcgtctctgtgtgtttgtggtaacacagttacgcgtgttgaagcaaggagccacaacttggaaatgtttatgcatttagatgttaacactgaggtttatccattggctgttggtgataagttcacgctggctatggctcccacgcttaatctcgatggaactcctgataccggatactttactccggtactgcatgctttttctatgttagatttttggtgtatattgcatactcttttttacttgcttggataaatctcatgaatggttacagtaagttaggccagttaacttttcttaaggttttggttggggcataccattaagtgctaattgctcgatatgactaattccactggcttgattcaggagataggaataagactaatcatatgaaaacttgagcaatacttagtctcttgaatattgaattaaaacctatctttgaaaaccaagactgttttctttgataatttgaacattcatttagtttccatgtcgctctattacaagaacatgtattaggatttgatctaattgcttaatagaacaattgctttggcttgattcaggaagcctatctaggaataagagtaaacatgtggaatttgagcaagacttagtgtcttgactcttgaatcatgaaaccaagattgttgttagctaatctaatctagtttccatctcgctttgttacagggagcaaagaaaacacttgcagataagtatgaatacatcatgcacgggaagctttacaagatctctgagcgtgacggcaaaactccaaaagcgtaagaatcccatatacctagaccaacaaaatcattttttcccaaagagatccaatttaacttacagatctaaccatcatgcttcggtttctatcttgcaattatgtgtttgcagagagttatatgtttcgttcggggggctcctgatgttgcttcagggagatccagctcatatttctcacttcgaacttgaccagaggctctttctactcatgaggaagctttgagatgccattgtctaatcactttccgaggcgcgcc

SEQ ID NO: 261 - DNA, 1920 bp, Arabidopsis thaliana
ttaattaacaatcggaaaaccatttccagttttccggcgagatggccaacgaaggaagtgaccctttacttcaatacatgattagcccgagattgaaaaaacctccacagctgctgtttccattaccagaagacaacgaagttgcgattccgatgccgatgacaccgtcggagttcaaagagcgtttaatcttcggacccttttcatgttcgccgcgagattcgtctcacttcatcgattccatgaaacaaccgtcaccgtcgtcttcttcaaccgccgttaataatcctttctccgattcctcaaccctagatcctctgcttccaccaccaccaccacaaccagagccatggttgtccgatcaaacttcgagtcactgtcaaggccacgctcttcaccgatccaaaacagcaccagcaatggctgtaatcaatgatcttcatcacccaattcgtcaaaaagatcctacagagacgtcacgatctgtagtaagacaagcttttgctcttctcgttgtgtatctctctctaggtgtgcttatctattggctgaatcgtgatcactacgttgtgaatcaaacccatcctgtagttgatggattgtatttttgtatcgttacaatgtgcaccattggttatggagacatcactccaaacagtgtggttactaagctgttttcgattatgtttgtgcttgttgggtttggtttcattgatattttgcttagtgggatggtctcttatgttcttgaccttcaagagagctatatgttagactctgctaagcggagagatgagcctgagaagaggagatcttatataatcgatgtcaagaaagggagaatgagaattaggttgaaagtggctttggcattaggtgttgtggttttatgcattgctgttggtgttgggattatgcatttcattgaggaaatcgggtggttggattcgttttatctctcggttatgtcggttactactgtcgggtatggagatcgggcttttaagacattgcccggtaggcttttcgctgcgatatggctgcttgtgtctacattagctgtggctcgagcttttttgtacttggctgaggcgagagtggataagaggaatagagaacgggcgaagaaagtgctttgtgaaacaatgtctgtctctcagtttttcgctgcagatattgataacaatggctgtgtgaggtaatttgactcattccttatccatattatatgctctgacacactccttaaggttttaagaatcttaaactgatatctgaattaactgtgtgatgcttatgtttgttaaaatatccattgtgacatccgtaatgtttatgcatttcttagaagtcatccaaaagattttgtctttgctatttattattagtcttttaattttcgtttgtgtagaggatctttgaaaacaaaaacattcatagctcattagctaattagattcttgaaggtgttggatttctaagttaattcatattctgcacttcttcttatgaatctttttgttcaagaacatagtttgtggtcttaggctaagttgaagatctgtgaatgtgtgatgcgaaagcatcgtgtcattgtatgttttcggcttgatataaagtttgaatgaccatgaaagggaggcttagacgcattttcggatttaacacagagaaatgctttgcttgtatactcactcaaacctgagatatcttctggtttttttctttgtttttgcagtaaagcagagtatgtgatatacaaactgaaggagatggagaaaataaccgataaggacatactaccaatctccaaacagtttgacaaactcgaccgatgcagcaacggaaagatcactcttttagatctcttggaaggtggcagtggcgattgatcaatcctctgcaactttttggcgcgcc

SEQ ID NO: 262 - DNA, 1853 bp, Arabidopsis thaliana
ttaattaagtgttgtcttctcgcgtctctcatcaacgagaaccagtttttttgttgatcctatcaacaatgacgaaaatagagcttcgagctttggggaacacagggcttaaggttagcgccgttggttttggtgcctctccgctcggaagtgtcttcggtccagtcgccgaagatgatgccgtcgccaccgtgcgcgaggctttccgtctcggtatcaacttcttcgacacctccccgtaagcacttcttcttcttttatattttctaaagattactgattcttcaatactaattgctgattctctgaatgttgagactaatttaatcgttaaagtcaaaatttttattggaaggtttcatatttacttttttatttggcatttattgtgtgtgtgaaggtattatggaggaacactgtctgagaaaatgcttggtaagggactaaaggctttgcaagtccctagaagtgactacattgtggctactaagtgtggtagatataaagaaggttttgatttcagtgctgagagagtaagaaagagtattgacgagagcttggagaggcttcagcttgattatgttgacatacttcattgccatgacattgagttcgggtctcttgatcaggtttaccactttatttctcttgggtttatcactttcgttgtttgtgtctcaaacctttactaagtgttcattcattgctgccagattgtgagtgaaacaattcctgctcttcagaaactgaaacaagaggggaagacccggttcattggtatcactggtcttccgttagatattttcacttatgttcttgatcgagtgcctccagggactgtcgatgtgatattgtcatactgtcattacggcgttaatgattcgacgttgctggatttactaccttacttgaagagcaaaggtgtgggtgtgataagtgcttctccattagcaatgggcctccttacagaacaaggtcctcctgaatggcaccctgcttcccctgagctcaaggtttggcattttacaaaagaatgtgattcttgttaacatttctgtagcacttgtattgatacaccgtataagagactagtgttaaaacgccattcgtgcagcattctctcgagcataggcaggttaaattctatagatgctatacttctgagactgacaatctttgtttcttaactcgtacaatcattgtgattagtcttcataggcaagattagagacacttcagatagttcccaatgggtattaacatgttagttggtctttgatgagtattcagtagaaaattaaacagattcacatggacgctggtatttagttgaattgatgtttggaagagtaggggatgctcttgagttagttttggtttgttctctgtttgatattttgatttagtgagaagtaaacgaagatactgacttcttaacaaattgttctcaaatatgaaagtcataacccgttgctgcttttattgtcttatgtagtctgcaagcaaagccgcagttgctcactgcaaatcaaagggcaagaagatcacaaagttagctctgcaatacagtttagcaaacaaggagatttcgtcggtgttggttgggatgagctctgtctcacaggtattcaagcttggtatttccttgtcaagtcccaaattatgtgggaagttggagttaaatatgaaagaatttgtgtgtttctgaaacaggtagaagaaaatgttgcagcagttacagagcttgaaagtctggggatggatcaagaaactctgtctgaggttgaagctattctcgagcctgtaaagaatctgacatggccaagtggaatccatcagaactaaggcgcgcc

SEQ ID NO: 263 - DNA, 1309 bp, Arabidopsis thaliana
ttaattaaccggcgaagaagataaatcagattcgatgtcggataataaagaccgtgattccgattccgatgctccggaggaattaacccaggagcaggtaagtaatatattcgtcctgtttgttgaaagattcaatcgaaatcgcatttttgcttagtggcgctatgtgttttgtttcaggcgaagctggaagaggaagcactgtggaaaatacagagagagaataagaataggtttgtcttcactctcatcacatctctttagctctgttatcattattatgggtttagttcttagtggttcgctttgaatgcctttgaaggacttaaaaaagtttaaagctttgttaattaggagtttatcaaggaagataaactattctctctttgattttgtatatctgattactttgaacttagtaaactatgcaagggttgttagctatgtgtaatccttggttcaaagtggtggtttttgtcgattcttcactccaacattaaccttatttgttgccattatgttctattgtttgatcctaaggtttgtttgtggacttgttgatctatgagcttccttagaaggtctctaagtttggaatgtgtggtttttttttaatgagattggtttctcttatgtagggtttcccgtgagaagaaagagaggcgcaagcttatggcagagcaagtaactctccgaaaatctcgaaagattgaaataattgaggatgtagtagaagaagaagaacctgaggaaaactctgaagctcttgcaaacaagggattcctttccaaagacatcatagactttcttgcggagcgagaaaagtattaaatactttatatccttatttcttgatacataaacacttttaagcgagaaagtatgtctaagattggttgatatgttacatttcacagacaaaaagctgagtcagattctgaagaagaagagatcatagacgaactcccaagaaagaaaaagcaaaaaagctcagggtatgatcgtctattcttggcttacatattttaggatcactctcagatttgctttactgaagtctctctggtgggtgcaggatcgaaacggttatttacaaggagattccaccaccagaatgcttgaaaaccgggttagatttcttgaagatgaggagagcgcaagtccccagatcgtcttcagtcatcaagaactccggccaagctctccgacttgccaccggtgctgctttagccaagaaacagcgacagagaaagtgaaaattaagatgtaaaattttcatgtgggctcaattccataacattggcgcgcc

SEQ ID NO: 264 - DNA, 1425 bp, Zea mays
ttcttgtttgttgattaacccttaattaatccgggcgcgcctgatttatcacaagtttgtacaaaaaagcaggctcctgcaggaccatggcgacgaagtacgctgccgccgcggctgatctggtcacgggccgtccgcggaagcgggcgaggcttggctgggacgtggcgtcggctgccgaggctcagataggaacattttgtgggcaagaagttggtgatgtggccagcctgctattatcagcaaatccttccgaccatacttgttcgtctctgctcccgaagggtgtggctcgaaatgcttcccctccctggagagaagacgataaagatggccattatgtatttgctgttggagagaatttggcctctcgctacaagatatacagaaaaatgggtgaaggtacttttggtcaagtactggaatgctgggaccgagaaagcaaagagatggtggctattaaaattgttcgctctgtaaagaaatacagtgatgcagcaatgatagaaattgatgtcctgcagaagcttgcaaaaaatgatgctgcaggcaaacattgtgttcaaatacggaactggtttgactatcgtagccatatttgtattgtctgcgagaagcttggcccaagcttatatgattttctgcagaaaaccggcttccatccattcccaattgatctaattcgccggatcggacagcaacttttggaatctgttgcattcatgcatcgtcttcagctaattcatactgatctgaaaccagagaacatcctcctcgtttcttcagattatgtcaagttacctgatcccaaggacggatcattctcaaggaaactgccaaaatcaagtgccattaaattgattgactttggaagtgcagcataccatcaccaggatcgcagttacattgtatctaccagacactatcgcgcccctgaagttattttgggacatggatggagctatccatgtgatatctggagtgttggttgtatacttgttgagctttgctcgggtgagacactgtttcagactcacgataacttggaacaccttgcaatgatggatagagttctaggtcctcttccacggcacatgctggaaagagccgaccagcatgcggagaagtacgtcagaaaaggaggattgaactggccacaagcaataacaacagtagagagcgttagagctgttctcaaactgcctcgccttcagaacctggtgatgcagcatgtggatcactctgcgggggacttcattgaccttctgaagcgcctcttagcctatgagccctcgggaaggttgactgctcaagaagcgttgggccatgtcttctttaccagataccggcaataactcgagacccagctttcttgtacaaagtggtgataaattggagctctgcagagctttcgttcgtatcatc

SEQ ID NO: 265 - DNA, 816 bp, Zea mays
ttcttgtttgttgattaacccttaattaatccgggcgcgcctgatttatcacaagtttgtacaaaaaagcaggctcctgcaggaccatgtcggcgggtgagctgcggttggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagcaagagaaggtggagactactttcaagccaacatcagtggatataaagtttcatgatgtcaaaggcaagaattaccggtgtgctataccaaagctgaacaaggaaattgttcctgagaaatgtaaggttgtggtgaaaccaaccagggttgttgttactcttttcaagggttctaaaggcaactggttagacttgcacttcaaggaagacaagttcaagccaaacatggacaaggaaaaagatccgatgtcaggaattatggacttaatgaagaacatgtacgaggagggcgacgaggatatgaagcgcacaatagccaaagcttggtctgatgccaggtctgggaagacgactgattcgatgagcggattacgttgactcgagacccagctttcttgtacaaagtggtgataaattggagctctgcagagctttcgttcgtatcatc

SEQ ID NO: 266 - DNA, 1721 bp, Arabidopsis thaliana
ttaattaatttcttcttccttcttccttatttcgatttcgaattttgaattttctcaatggctcaatcgtgtcttaaaattgttcgaatcaacaatctaaggaacagagtgaatcgtcggattttgattctccgacgattcacacggttgttatggagtagaatcgttgcttgtactcctggcaaatctcggagatatctcttgctttctcgcgctcttccgtctccgactgtttctcgtccttctccttctccgatccccgccgtcgatgtcgtcgtcggtggtggtggtggtggtggtgagtttgttcgtcgttcgtcggttgtttacgataatgataacagtcatcggagatcggattctgatttggtttctttgaagattagtctcttaggagatccagaaatcggaaaaactagcttcctggtaagaataatttcgaatccaacatacgttttcgattttgaatttgcgttgagattgattttgaatttgcgttgagattgattttgaatttttgggaatttgaaaggcgaaatatgttggagaagagaaagaagtagaaatgagagaattggagaaaggtataaattgtacggacaagacgttatacatgggaggtgctcgcatttcatatagtatctgggaattagaaggtacttaatcattgttgttaatccacattagtttagcagtaatgataatgtgaagactaattaacattgttgttatataggagctgagagatcacgagatcaaatccctgtggcttgcaaggactctgttgccattctctttatgtttgatttaaccagtcgttgcacgcttaatagtgtcattagctggtatcaacaagctaggaagtctaatcaggtaatattaatttcactatcatttgtcaaatttgggctctttgttaaaagtcttttaaaatttagacctgggtggtcgggtattcggatcgggtttagggtattttacccaggtctaatcttgttgtgtgaaatttagggttgattggttgtaactgggcgttcgggtattcgaatcgggttcgagtcttcgggtttcggtattttgccgaagcctagtcttgttgtatagaattttggggatgattggttgcgactgtaacgtatattttggctaagcatagacaaagaacaaaaatatggatctaaaagtgtgattgtagaaaattagagttgagacttaaaaaaaatatgatatttttcaatgttttttgtttaagatcaaatgttattgttttggtgaagctaaacactgataggtttgataaatatattacagacggcgataccagttatggtaggaaccaagtttgatgagtttattcagcttcctattgatctgcaatggacaattgctagccaggtaatgtttttaaccatatcttttgaagtcatttgaattctagtaacaaatcaatacagtgaaattcaatataatttattttacatttggaatgttttgtgtaacaggcgagaacatatgcgaaggctttaaacgcgacgctcttcttctcgagtgcttcatacaacataaacgtgaataagatctttaagtttgtgacggcgaagctcttcgacttaccatggacggtggagcgcaatctcacaatcggagaaccaatcatcgacttctagaatatgtatttgtatataatataaaagaagcgaatcctgaagaatgggcgcgcc

SEQ ID NO: 267 - DNA, 669 bp, Arabidopsis thaliana
ttaattaaaaatctaaaatggctagaaatttcgagctttctttgattctctttgttctgtatctgtccactgcagcaatagtcatggctagaaaccttgaagaggaatcaagtggtgatacagagttcattaaagcctcttgtgagacgacgtcgtacccagaccgatgcttccagtctctgtcttcatatgcaagcgagatcaagaagcagccacgtaagcttgctgagaccgcgcttgccgttagcatagcccgagcaaagtcagccaaaacctatgtatcagagatgactgattataaaggaatcacaaagaggcagcacgaggctgtagcggactgtctagaggagatgggagacactgttgacaggttgagcaattcgctgaaggaactgaagcatctggaggaaggtgacagcggagaagacttttggttctgtctgagcaatgtccggacgtggacaagcgcagcactgacagatgagaccgcgtgtatggatgggtttggagggaaggccatggctggggagctgaaaagtttaatcagaacacacattgtgagtgttgcggaagagacgagcaatgccttggctttgatcaatgactttgcttccaagcattgaaatcatttcaaaggggtttagtctttgggacaagagttggcgcgcc

SEQ ID NO: 268 - DNA, 362 bp, Arabidopsis thaliana
ttaattaaacaaaggaaaataatgagctcgtcgccgttatcttcatctctctttcatcctctgtcgaccttgtcgactcattgccatggtcggagacagaacctctgtttcaatcggaagcaacaacctttcgttgtcagagccgcaaaacttcctgaaggggtgatagtgccaaaagcacaacccaaatctcaacctgcgtttctgggattcacacaaacagctgagatatggaactcacgagcttgcatgattggtctcatcggtactttcatcgtcgaactgattctgaacaagggaatacttgaactgatcggtgtagagattgggaaaggactcgatcttcctctataaggcgcgcc

SEQ ID NO: 269 - DNA, 1235 bp, Arabidopsis thaliana
acacggaggatggcgaatcagagtacagagacgaatcaaccgtcgaatatgcagacttacggtgtaccgatttacgccgccgactggattccggaggtagatgtcagatccaaaatcataatggatccggagaaatctgaagatgatgatgagtcgtcttcttcttcttcttcttcccggagctgcatcgttttgtccggcggaggcggagagggacgaagtggaatctctaatgtcatattaatatgccgtgttgatctaaacaccaattctctctcggaacaacctctgggtaggcttgtggttggctctgatctgccttatcggatggctgttcatcctcgggaaggtggtcttatttgcgcgttgcctaacagttgcaaactgtttcattgggaagacattatgagccgagaggataatcaggctggtgagtcggaggaagtgattaaagagttaagagatgttggacaacagttggctctggcgtttaatccggaggggtctgttcttgctgctggtgcggaggatgggactttgagggtttttaaatggcctagcatgaatactttacttaatgagtcccaggctcattcttcagttaaatgccttactttcagcgaaagtggtcaatttcttgtatctcttggcggtccagtttgtcgagtttgggacgtgaatgcttctgctgctgttgccagtctatcaaaagagaaggacgagatgtttgcctcctgtagattctctgtagacagtgcaggcaatgaagttctttacattgctgcaaacactgaacgtggtgggagtattataacatgtgatacaaaattatggaaaagaaaatggtcgaagcctataaaaaagaactctatatcagcttttaatgtctcagctgatgggaagcttcttgcaataggaacccttgaaggagatgttttaatacttgaatcgacaagaatgcaaactatccaagtcgtcaagaaagcgcatcttggtttggtcacagcactgactttctctcctgattcaaggggattagtgtcggtatcttttgactcaagggcaaggctgaccatgattgaacaaaagggggacaaacctggagtaaggtggtggctactggttttattgatagtgttgctatacgtggttgcatactattatatgaaggcaaagggtatcataccttagaaaggcctttaagtgaccacacaggacgatacagcgatttaaat

SEQ ID NO: 270 - DNA, 222 bp, Arabidopsis thaliana
atgatcgaggtggttctcaacgatcgtttagggaaaaaagttagggtgaagtgtaacgatgatgacacgatcggtgatctgaagaagcttgtcgcggcacaaaccggaacacgagccgagaagatcagaattcagaagtggtacaacatctacaaggatcacatcactctcaaggactatgagatccatgacggcatgggtcttgagctttactacaactag

SEQ ID NO: 271 - DNA, 546 bp, Arabidopsis thaliana
atgcctccgaccaataattaccgaatctccggcgaaccaccgtctactacgccgtctcatccaccgccaaaaccgaaaacaaggattctctctctattcctcgttggtgtaatcatgttttcaatcttctttctcttcctcgttcttatcggtatcgcctctgttcttatcctccctctcctcctctcttctctccatcgtcaccaccgacgtcgtcgtcgtaatcgccgacaagaatcctcagatgggttatcttcaagattcgtgaaaaagcttcctcaattcaaattctccgaacctagcacatacacacggtacgagagcgattgtgtggtttgttttgatggattcagacaaggacaatggtgtcggaatcttcctggttgtggacacgtgtttcatcgaaagtgtgtggacacttggttgctcaaagcctcgacgtgtcctatttgcagagctagggttagattgtgggaggaagatccacaagaaggagaattatggagatgttttggtcatagaagaagtagtttgctagatttgtaa

SEQ ID NO: 272 - DNA, 1527 bp, Arabidopsis thaliana
atgggaactaggttccaatcattcttgctcgtgttcttgctttcatgtttaatcctcatatcaactgcctcgtgtgagcgaaatggtgatggaacgattagaattggattgaagaagaggaaactagaccggagcaacaggctagcttctcagctttttttgaaaaaccgagggtctcattggtctcccaaacactattttcgcctgaacgatgaaaatgcggatatggttccgctgaaaaactatttggatgctcaatactatggtgacattaccattggtactcctcctcagaagttcactgtgatctttgatactggtagctccaatctctggataccatctactaaatgttacctatcggttgcttgttatttccactccaagtacaaggctagccagtcatcgtcatatagaaagaacggaaaacccgcgtctatccgctatgggacgggtgctatttctggttactttagcaatgatgatgttaaagttggtgatattgttgtgaaagagcaggaattcatagaggctactagtgagcctggtataacattcttgctagcaaagtttgatggtatcctcggtttgggtttcaaagagatttctgtaggaaactcaactccggtttggtataacatggtagaaaaaggtttagttaaggaaccgattttttcgttctggcttaaccgtaacccgaaagatccagaaggcggtgagattgttttcggtggagtcgacccgaagcacttcaaaggagagcatacttttgttcctgtgacacataaaggttactggcagtttgacatgggtgatctccaaattgctggcaaaccaaccggatattgtgctaaaggttgttctgctattgctgattccggaacttctctgctcaccggtccatcgactgtcatcacgatgatcaatcacgcgataggagcacaaggaattgtaagccgtgaatgcaaggccgtggtggatcaatacggaaaaaccatgttgaattctcttctagctcaggaggatccgaagaaagtatgctcacaaattggagtctgcgcttatgatggtacacagagtgtgagtatggggatccagtcagttgtagacgatggaacatcgggtcttttaaaccaagcgatgtgcagtgcttgcgaaatggcagccgtgtggatggagagcgaattgactcagaatcaaacacaagaacgcatactcgcttatgctgctgagctatgtgaccatataccaacccaaaaccaacaatcagcagtggactgtgggagggtttcgtcgatgcctatagtcacattctcaattggtggcagaagctttgatctaactcctcaagactatatattcaagatcggggaaggagttgagtctcagtgcaccagcggtttcacggcaatggatattgctccgcctcgtggacctctctggatcttgggtgatatcttcatgggaccataccacacagtgttcgattatgggaaaggaagagttggattcgccaaagctgcttaa

SEQ ID NO: 273 - DNA, 948 bp, Arabidopsis thaliana
atgtctctcctggatttgccggacttaaccttagactgcatattagagaagctctcaccatcagagctctgtgcaatgactagtgtttgctccgagctaagagataagtgtgtaagcgatcatctatgggagaagcatatggagacaaaatggggaagattgatgggtgatgcagcgattcaagagtggaaatctcacgttgctacgataatgagatgtctcacaagtagtagtagtagtagtagaaagagtaaaccaaactggagttcgaggtttgttgcgaatttgaaaccctttgcatggttaagttcaaaccatggttgtgaaaacagaggatcatcatcatatttggcacctatagattctgtgatgtattggtactcgaatcttgaaaatggcaagttttggttccctgctcaagtctacaatcgcgagaacggacatgttggattcatgatgtcttgttacgatgctaagatcagatacgatttcaagactgatacatttcaagctagatactcggcacatggccggcgagcggcggaggaaaaggtgacgtggcagaggctgagaccgtctcaagacgacacaaagtcacgtgatctgcacgtgtcagattgtttgcacggacttcgacctggtgaccatttcgagatccaatggcgacgaaccaaagagttcccttatggttggtggttcggaatcgttggtcatctacaaaactgcgacggcgtacaaaattgtcgttgcgactctgacgagaatgtggtgatggagttcagacaattcagaccggaatcaccgtggagaagaacggtgataaagaggaaagaccaccgtgagacgggaaatgaagaaaacggtttctacggcggagtaaagaaattgggtacggaggaagagatttctacgtggaagcaattgtggccatcacaagccttggagtag

SEQ ID NO: 274 - DNA, 1904 bp, Glycine max
ttaattaaaaccacatcatcgtcttgaacgtttgaatctatggaacagcttgtcaacttcatcatccggccaccaagagctgaatatgaccccaaaagtgatttattggatcaggagttcatgctgaaaggaaaatggtatcaacggaaggatgtagagataaaaaacagtcggggtgatgttcttcaatgcagccattacttgcctatagtcagccctgaaggaaagcctctgccgtgtgtaatatattgtcatggaaatagcggatgtagggctgatgctagtgaagctgctataattttacttccctcaaacattacagtttttactctggatttttctggctctggaatttctggaggggagcatgtcactctaggctggaatgaaaaggatgatctgaaggctgtcgtcaactatttgcgggatgatggaaatgtctctttaattggcttgtggggtcgctcaatgggagctgtaaccagccttatgtatggagctgaggatccttcaattgcagggatggttttagacagtcccttttctgatttggttgatttgatgatggaacttgtagatacatataaagttcgtctgccaaagtttactgtgaagtttgcaatccagtacatgcgaagagcgatccaaaagaaggcaaaatttgacataacggacctcaatacaattaaggtggcaaaatcttgttttgttccagctctactaggccatgccattgatgatgattttatacagccccatcactctgatcgaatatttgaggcttacatgggagacaaaaacataattaaatttgacggagatcacaattctcctcgtcctcagttttactttgattccataaacatcttttttcacaatgttttgcaacctccggaagatgaggttggggaatcattttttgaccccatgaatgattactttggtaaggatgtttggagatctgtgcacgaattaggctacagcaatgaatcatcatctaaaaacaaagatgcagaaccatcaacaagcagcacgataaatgccattgagcaggtccgttcaagacgaccaatgagtaggatggaggttccatctgatatttcttcgaaagatgaacatcgtgaacatgaggagaagtgcggcaatatttccccatcatcatcatcaatgataagctttgaattgtcaaatggtgatccctttgggtcccatgttccagccacattggaagatgatcagtatgtagaatatcaactagatgaccttgcaggttttccatctactgcagaggaggaagaaagaatgttcatggaagcagtgatggagtcactgaaggacctggaagtacgaaatccaaatgcagaacaaccaacaagtagtgttagttctgtgtatgtagatgctgtagagccgtctgataaagatgcttcttcaggagagatttcgagaccggtggagacagaatcttcctcactcaaacacaccacagagtcaaaattcaaaaccacttcctcgacatcagaagaatttgagccattgaacggtgagtcaaattccatttcagtgaaacattcccaaaatgtggtgtcggagccaagtccagtaccaagtgtttcattagaaggaccagcacatctgcagctgcagccaccaccatcggcacctactgacacatcatcagtaactgagtccagcaatacaagtggttctgctagtagcgatagttctgctagtttacaaagttcatcagagactgatgtatcacataacacgaaagccacagtaactgttgttaggaatcccgcaggccatgtcatggatggcttaatgcgtcgatgggatttcaattttttcaagaacaaatagtcacaaccgatgatcagatgagagattctcatttaaat

SEQ ID NO: 275 - DNA, 860 bp, Arabidopsis thaliana
tttaattaaatgtcgaaagaagtgagcgaagaaggcaaaacccaccatggaaaagactacgtggatcctccaccagctcctcttctcgacatgggtgagctcaaatcctggtctttctacagagctctcatcgctgagttcatcgctacactcctcttcctctacgtcaccgtcgctactgtcatcggccacaagaagcaaaccggtccttgtgacggcgttggtttacttggtatcgcttgggctttcggtggtatgatcttcgtcctcgtctactgcaccgccggtatctctggtggtcacattaacccagctgtgactttcggtctgttcttggcccgtaaggtctctttggtgcgagctcttggttacatgatagctcagtgtcttggagccatttgtggtgtgggtttcgtgaaagctttcatgaaaactccttacaacactcttggtggaggagctaacaccgtagctgacggttacagcaaaggaactgctctcggagctgagattattggaactttcgtccttgtttacaccgttttctctgcaactgaccctaagagaagcgctcgtgactctcacatccccgttttggctccacttccaattggatttgctgtgttcatggtgcatttggctactatccccattactggaactggtatcaacccagctagaagctttggtgctgctgttatctacaacaacgagaaggcgtgggatgaccaatggatcttttgggttggtccgttcttgggagcactagctgcagcagcttaccaccaatacatattgagagcttcagcaattaaggccttgggctcgttccgaagcaacgcaaccaattaaatttaaat

SEQ ID NO: 276 - DNA, 1961 bp, Arabidopsis thaliana
ctgtttcttgtttttctctctcgcttaactttcacaagaaaaaaaaaagatgaaagaatcattcaaagtgtgtttctgttgtgtaagaaacttcaaggtgaaatcaagtgagccacctgaagaaatcaagaaccttttccatgattactctcaagacgacaggatgtctgctgatgagatgctcagattcgtgatccaagttcaaggagaaacacacgctgatatcaactacgtgaaggatatcttccacagacttaaacatcacggcgtttttcatcctcgtggaattcatcttgaaggattctaccgttatcttcttagtgatttcaactctccattgcctctgacccgcgaggtttggcaagatatgaatcagccattatcgcattacttcttgtacacgggacataactcttacttgactgggaatcagttgaacagtaatagcagcatcgaaccgattgtgaaagctctgagaaatggagttcgtgtcattgagcttgatttatggcctaactcttcaggaaaagaagctgaagttcgtcatggagggacgttaacgagtcgtgaagatctgcagaaatgtcttaacgtggttaaggagaacgcgtttcaggtgtctgcttatcctgttgtgcttactttagaagaccatttaactccaattcttcagaagaaagtcgctaagatggtgagtaagacgtttgggggatcattgtttcaatgtacggacgaaactacagagtgttttccttcaccagaatcactcaagaataagatcttgatctcaacaaagccaccaaaagagtatcttcagacccaaatctcaaaaggttcaacaacggatgaatccactagagctaaaaaaatttcggatgcagaagaacaagttcaagaagaagatgaggagagtgtagcgattgaatacagagacttaatctcgattcacgctgggaaccgcaaaggagggttgaagaattgcttgaatggagatcctaaccgagtcatacggttaagcatgagtgagcagtggcttgagactctggcaaaaacccgtggacccgatttagtaaagttcacgcagcggaatcttttgaggatatttcccaagactacacggtttgactcatctaactatgatcctctcgttgggtggattcatggggctcaaatggttgccttcaatatgcaaagccatgggaggtatctgtggatgatgcaaggaatgtttaaagccaatggtggatgtggctatgtgaaaaagcctgatgttttgctctccaatggtcctgaaggtgaaatctttgacccttgtagtcaaaacctcccgatcaagacaactcttaaggtgaagatctacactggagaaggatggaatatggactttcctttagatcactttgaccgatactctcctcctgatttctacgcaaaggtcggaatcgcaggggttccattggacacagcaagttacagaacagaaatagataaagacgaatggtttccaatttgggacaaggagtttgagttcccattacgtgttcctgagttatctcttctgtgtatcacagtcaaagattacgacagtaacactcagaacgatttcgctggccagacatgttttccgttgtcggaggtaaggccaggtattcgtgccgttcggctccacgatcgtgccggagaggtctacaagcacgtgagactgctcatgcggtttgtcttggagcctcgttagcgcttcgtggataatgttcatttcatcactcgtgtcaatgtcggtacacgttttttatgtttgtaatgttaaggtgtcggtatacattagtcagtcatactaagccatacgataataagagatgtgaaaagaaaaaattaaacgtaattaagatcagcaaaattatgaaacgtatgactttaatataaacaatttgtttgaacagttgataaagataattttgttt

SEQ ID NO: 277 - DNA, 2443 bp, Arabidopsis thaliana
ttaattaaggagtaaaaggaaagtaagtcggagtttaatcatcttaagatttgattgaatggctacgctcactgaaatagcaacccttgaggagaagtatatcgaattgtgcaagatgcatggaatcctacccaacactgccattttatctgctttctttgaggcggaggttaaaaagtcaaggaatcaaagatgcattatgaacctttacgtggatagagtgaagtacgatgactatctcccgcttctcgagttatgcaatgagatcaacacatctgaggtacaaggaatagatctatttgtgagatccgcttgttcgttagaagatcattatgcattgcccttaatccgttccgtcaatcaaaaactccgagttgttcatctacatgactctttcgggaaaaacttctggcaggacgttttctttcaaggtttgagctgcaaagtgttgaatgtgaggtctatgcatatccataagcttaacatcgtaggagagttcacacagctgcacacccttatactcgataagaaccgtatagttggttttggagaagactgtttttcttgcatgcccaaattgacatatctttccatgtgtgacactctagtgtcagatctttggacatcagctgctgctctcttgaaactcccttctcttaaggagctccggtttcaaatttggatctcttgcagtgattctagcccactcaattcagagtcatcaccatcatcatctaccaaggatgatataaacacatttattgaatcagaccctcccgttgaagcagatatgtgggacgttgctgaacagatggatcctagtttacctgtcgaagagactcttcatagcatggatttctcgtataaaattcctgagcaagatgatttggattcacatgtctctgtgtctgcagggttgaatggagaagtactcatgagggaaaaggttaggagagggaaaatgccgtaccaacccaaagatgtttcacccgttgatacgttcacaaggcaatttgggaatgttgggttgaaatatatatcctctaaagcatcaccgatctgttctgaaaagcattacaggatgtacatgataaactctctgcccaaattacaagtgttggacaatttggccatcagaaagagtgatagagataaggccattgaaacatattctgcaaactttgaggacttaccgtacaagagaaagaaggaaagtgtagttagagtccttgagaaccgtgaaaaaagatcaagcaaggggaaatctcagaattcctataaaagatcgctttgtgcagctaaaatgggatcgcctgcttcgcctctcttgcattcacttccttttttgagtagtaggattcagcaggaagatgataatagtagattatgtccaaggcagtttgagtatcatccactagatcctagcctaatggtatttgggactttggatggcgaggtggttgttctcaatcacgaaagtgggaaaattttccgttacatcccatctaatggatctcaaagtaccatcttgggactttgttggctcaagatatatccatctatggttatagctggctcagccaatggctcattgaagctgtacgacatccaaaaagcgtcatccacggttactactagcagtcattccacttctggttctgtcacttttgatgagtttgaccaattaacgtcggttcatgctaattcgacggaccaactatttcttgctagcggatactcgaaggatgttgctttgtatgacattggtaggggaacacgcctacaggtttttgctaatatgcatcaagagcatattaacgtggtgaaattttcgaaccattccccgtttctttttgcgacttcttctttcgataaagatgttaagctttgggatttgagacaagagccatcccgaccatgctacaccgcttctagtacgaaaggaaatgtaatggtttgcttttctccagatgatcgttatcttctagcatcagccgtagacaacgaggtgaggcagcttttgacagtagatggaaggcttcatctgaactttgagatagtcccaagagtaagctcgatgaactatactcgatcatactacatgaatggtaatgactacatcataagtggaagctgcgatgagaatgtgatccgtgtttgttgtgctcaaactggaagacgacttagggatgtaactctagagggaaacggctcggacttttccatgatgtatgttcagtctctacgcggtgaccccttcagggatttcaatatgagtgtattggctgcgtacgcacggtcaagctcactttctgaaatagtcaaggtgaatttgttagcgtcaagagattctacagcagaagaatctcatggtctccgttcctacccttcaagtagcatgggaggctgatgataaaaccaaaagagaggcttcaggcgcgcc

SEQ ID NO: 278 - DNA, 1531 bp, Arabidopsis thaliana
ttaattaaatcgagagctcactgtgaagaaaaaaactcgaaacaaatgaagaaaacactttcgccggaacccgtcaccatctacggcaatcgccaagaaaccttcgtcggtgatatggagtactacacttacttcgacgaatcttgtatccaagacatgaactatttcgtcaaaacaatcaccggcatcaaatccaaaggaatcagaccagaccttatcggttccatcatcgctcattacgcttcaaaatggctccctgatctctccggcaatgtctccgccattatttcctccacctccttagaatccaagaacaaccacaatgacacacagccagagagcgtcactgcatctgtaatgaagaaacggtttttcgtcgaaacactaatcggaatcctcccaccggagaaagactctgttccttgcaatttcctcctccgtctcctcaggacagcgaaaatggtcggagctaatccgaattatttaacggagcttgaaaccagagtatcgtggcagctcgaccaagcttctctcaaggagcttatgataccttccttcagctacacgtctggtactttgcttgacattgagcttgtgacgcgtctcgtgaacaagttttctggattggatagtgaaggtgttaaaaccgctgcggctcttgttaaagtggccaagcttgttgactcctacctcgctgaagctgccgttgacggtggtttagctttaccggagtttatttccttaatcacagctcttcctagccatgctcgtactacagaggatggcttgtaccgagccattgatacatatctcaaggtataaataaagcttgaaactttgaagttgagatagaaaattaagactgaattcaagatttggattctattgcaggcacatcctcaggtgttgaagcaagaaaggaaggaactttgtagacttattgatagcagaaagttatcaccggaagcagctcttcacgcggctcagaatgatcgtttaccggtgagagcaatcattggagtgttgttcactgagcagacaaagctaagtcgtcacattgactgtaatagtagctcgataagcagcactacgaggagtccaacaaacgcttctggttcacattacctcgagggaggttctgcagcgcggtgtttgtctaaacgtgagatgaatgttcaacaagcagagataagaaggctacgggaggatgtggtgaggctgcagagtcagtgtggcgctatgcatttccagctggagaggcttatggagaagaagagtagtggtgggagtaaaggttttttccggtggaagaggctcgggttagtaccgtcaattagaggaagtgttagtgttgaaaagggcgaggaagaatctggtgacaatggtgaaggatttgagccacggactcctggtaatatgaagacaaggcttgtcaaaggaagaacaacaccttcaaggtggagaaaatctatgtcttaatcttgaattaatgaaaacaacacaacaagctgttattacacatgggcgcgcc

SEQ ID NO: 279 - DNA, 3238 bp, Arabidopsis thaliana
ttaattaagaagaaagaagaagataacacaatgctcttcttcttattcttcttctacttactcttatcttcatcctccgatctagtcttcgccgaccgtcgtgtactccacgaaccattcttccctatagattcaccaccaccgtcaccaccatcaccaccaccacttcctaaactaccattctcttcaaccactcctccatcttcatcagacccaaatgcttctcctttcttccctttatacccttcatctccaccaccaccttctccagcctccttcgcttcttttccggcgaatatctcatctctaatcgtccctcacgccactaaatccccacctaactccaaaaaactccttatcgtcgctatctccgccgtttcctccgctgctttagtcgctctacttatcgctttactctattggcgaagaagcaaacgtaaccaagatcttaacttctccgatgatagcaaaacatacaccaccgacagtagccgccgtgtctaccctcctcctccggcaacggcgcctccaacacgacgcaatgcggaggctagaagtaaacagaggaccaccacgagctccaccaataacaacagctctgagtttctttacttaggaacaatggtgaatcaaagaggaatcgatgaacaatctcttagtaataatggatcaagctcaagaaaacttgaatctccagatcttcaaccacttcctccattgatgaaacgaagtttccgtttaaatccagatgttggttcaatcggagaagaagatgaagaagatgagttttactctccacgtggctcacaaagcgggcgagaaccgttaaaccgggtcggacttccgggtcaaaatcctagatctgttaacaatgacactatctcttgctcatcttcaagctctggttcaccaggaagatcaacatttatcagtatctctccttcaatgagtcctaagagatctgaaccaaaaccgccggttatctccacaccagaaccggcggagttaaccgattatagatttgttcggtctccgtcactgtcgttagcttctttatcgtcgggattgaaaaactccgatgaagtaggattgaatcaaatctttagatctccgacggttacatctctaacaacttcaccggagaataacaaaaaagagaactctccattatcatctacttcaacttcaccggaacgacgaccaaatgatacaccagaagcttacttgagatctccgtcgcattcttctgcttctacatcaccgtatagatgttttcagaaatctccggaggtcttaccggcgtttatgagtaatctccggcaaggtttgcaatctcagttactatcttctccttctaactctcatggaggacaaggtttccttaagcagttagatgcattacgttctcgttcaccgtcgtcgtcttcttcttctgtttgttcttcaccggagaaagcttctcataagtcaccagttacatctcctaagttatcttcccggaattcgcagtctctatcatcttctccggatagagattttagtcatagcttagatgtatcaccacggatatcgaacatttcacctcaaattttacagtctcgtgtgcctccgcctcctcctcctcccccaccgttgccgttgtggggacgacggagtcaggtgactactaaagcggacacaatctcgagaccgccttctcttacaccgccttcacatccttttgtgatcccatctgaaaacttaccagtgacttcgtctcctatggagactccagagacggtttgtgcgagtgaggcggcggaggaaactccgaaaccgaagctaaaggcgttacattgggataaagttagagcaagttcggatcgtgagatggtttgggatcatcttcgatcaagctctttcaaattagatgaggagatgattgagacgttgtttgtggcgaagtcgttaaacaacaaaccaaatcagagtcagacaactccaagatgtgttctcccgagcccgaaccaagagaacagagtcctggacccgaagaaggctcagaatattgccatcttgcttcgtgcacttaatgtcactatagaagaagtttgtgaggctcttcttgaaggcaatgctgatacactggggactgaacttcttgagagcttactgaagatggcaccgacaaaagaagaagagcgcaagttgaaagcgtacaatgatgattcgcctgttaagcttggacatgctgagaaattccttaaggcaatgttggacatccctttcgcctttaaaagagttgatgcaatgctctatgtagccaactttgagtccgaggttgaatacttgaagaaatcttttgagactcttgaggctgcttgtgaagaactgaggaacagtaggatgttcttaaagcttcttgaagcggttctaaagacaggaaaccgtatgaacgttggaacaaaccgaggagatgcacatgcgttcaagcttgatacacttctcaagctagtcgatgtcaaaggcgctgatgggaaaacaactctcttgcatttcgttgtacaagagataatccgagcagaaggcacacgtctctcaggtaacaatacacaaacagatgacattaaatgccggaaactaggtctccaagttgtatcaagtctctgttctgagcttagtaacgtcaagaaagctgctgcgatggactcagaagtactaagcagctacgtctccaagctttctcaaggcattgccaagatcaacgaagcaatccaagtccaatcaacaatcacagaagaaagcaacagtcagaggttttcggaatcgatgaaaacgtttctgaaaagagctgaggaagagatcatcagagtacaagctcaagagagcgtagcgttatcacttgtaaaagaaatcacagagtatttccatggaaactcggctaaagaagaagcgcatccgtttagaatattcttggtggttagagacttccttggagtagtagacagagtttgcaaagaagtagggatgataaacgaaagaacaatggttagttctgctcataagtttcctgttccagtgaatccaatgatgccacaacctcttcctggactcgttggacgaagacaatcttcttcttcttcgtcgtcgtcttcaacctcttcgtctgatgaagacgaacataactcaatctcattagtttcttaaggtgagatctcagctttgtctgtgcatgttgttgtaaaaagtatatttaaat

SEQ ID NO: 280 - DNA, 1034 bp, Saccharomyces cerevisiae
aactctttgtttcttgtttgttgattaacccttaattaagatgctgttcagctggccttatccagaagccccgattgaaggttattggggcaagccaacttctctgattgattggtgcgaggagaattatgtcgtatccccctatattgcagaatggtcaaatactattaccaatagtatattcttaatgaccgccttctattctacatatagcgcttggcgtaataagttagaaacaaggtatatattgataggaatggggttctcgctggttggtattggttcgtggttatttcatatgactttacagtatcgttatcaattgctagacgaactaccaatgctgtatgcgaccatcatcccgtcgtggagtatttttgcagaaactcaagaaatcttgattaaggatgagaagaaaaggaaggaaagctcatttagaatccaaatggtcatttcttttatcatgtgtggtatagtcaccattttaacctggatttacgttgtcgtccaaaaaccagcaattttccaagtcctttatggtatattgacgcttctagttgtggttctttctggctggctgacctactatcacgttcatgattcatttgcaaagaaaaatctttttattactatggttatgggcatgattccttttgtcattgggttcatttgctggcaactagatattcacctgtgttctttttggatctatatccggagaacatatttggccctgccattaggtgttctattggaactgcatgcttggtggcatcttttgaccggtactggtgtctatatcttcgtcgtgtatttgcaatatttgagaatattaacccatggaaatccaaatgacttcttatttatatggaggtggggatttttccctgagctggtaagaaagggcttaccgattggtacttcttattcactggagtatctggggccaattgtaaatacacaggtagatgatgaaacaaaaaagaataactaaattaaattggagctctgcagagctttcgttcgtatcatcg

SEQ ID NO: 281 - DNA, 1264 bp, Arabidopsis thaliana
ttaattaagttacaagcgttttaagctctcactagcaagcaagtactagcaacaatggcgtcaagcactgcgactatgctcaaagcctcaccggtgaaatctgattgggttaagggacagagtcttctcctccgtcaaccttcctctgtctcagctattcgcagccacgtggcaccttccgctctcaccgtccgagccgcttctgcttacgccgatgagctcgtcaaaaccgctaaaacaatcgcgtctccgggacacggaattatggcgatggatgagtccaacgcgacttgtggaaagcgtttggcgtcaattgggctagagaacacggaggctaaccgtcaagcttacaggacgttgcttgtgtcggctccaggacttggacagtacatctccggagctatcctgttcgaggagactctgtaccaatccaccactgatggcaagaaaatggttgatgttctcgtcgagcagaacatcgtccctggcatcaaagtcgacaagggtttggtgccacttgttgggtcttacgacgagtcatggtgccaaggacttgacggtttagcctctcgcaccgctgcttactaccaacaaggtgctcgtttcgccaaatggcgtactgttgtgagcattccaaatggaccctctgctttggctgttaaagaagcagcttggggacttgctcgctacgcagctatttctcaagacagcggtctggtgccgattgtggagccagagattatgttggacggagaacacggcattgacaggacatacgacgttgcagagaaggtttgggctgaggtcttcttctacctcgctcagaacaacgtcatgttcgaaggtattctcctgaagccaagcatggttactccaggagctgaggccacagacagagctactcctgagcaggttgcttcctacactctcaagctccttcgcaacagaatccctcctgctgtccccggaatcatgttcttgtctggtggacagtccgagttggaggcgaccttgaacttgaacgcaatgaaccaggcaccgaacccatggcacgtgtccttctcctacgcacgtgccttgcagaacacttgcttgaagacatggggaggcaaggaagagaacgtgaaggcggctcaggacattctcttggccagagccaaagccaattcgctggctcagctcgggaaatacactggagaaggcgagtctgaggaagccaaggagggtatgtttgtaaaaggctacacctactaagcggcgcgcc

SEQ ID NO: 282 - DNA, 2151 bp, Saccharomyces cerevisiae
attcatttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcacttctaatagattctgtaccaacagttgcttataaggaccaaaaaccgggtacttcaggtttacgtaagaagaccaaggttttcatggatgagcctcattatactgagaacttcattcaagcaacaatgcaatctatccctaatggctcagagggaaccactttagttgttggaggagatggtcgtttctacaacgatgttatcatgaacaagattgccgcagtaggtgctgcaaacggtgtcagaaagttagtcattggtcaaggcggtttactttcaacaccagctgcttctcatataattagaacatacgaggaaaagtgtaccggtggtggtatcatattaactgcctcacacaacccaggcggtccagagaatgatttaggtatcaagtataatttacctaatggtgggccagctccagagagtgtcactaacgctatctgggaagcgtctaaaaaattaactcactataaaattataaagaacttccccaagttgaatttgaacaagcttggtaaaaaccaaaaatatggcccattgttagtggacataattgatcctgccaaagcatacgttcaatttctgaaggaaatttttgattttgacttaattaaaagcttcttagcgaaacagcgcaaagacaaagggtggaagttgttgtttgactccttaaatggtattacaggaccatatggtaaggctatatttgttgatgaatttggtttaccggcagaggaagttcttcaaaattggcaccctttacctgatttcggcggtttacatcccgatccgaatctaacctatgcacgaactcttgttgacagggttgaccgcgaaaaaattgcctttggagcagcctccgatggtgatggtgataggaatatgatttacggttatggccctgctttcgtttcgccaggtgattctgttgccattattgccgaatatgcacccgaaattccatacttcgccaaacaaggtatttatggcttggcacgttcatttcctacatcctcagccattgatcgtgttgcagcaaaaaagggattaagatgttacgaagttccaaccggctggaaattcttctgtgccttatttgatgctaaaaagctatcaatctgtggtgaagaatccttcggtacaggttccaatcatatcagagaaaaggacggtctatgggccattattgcttggttaaatatcttggctatctaccataggcgtaaccctgaaaaggaagcttcgatcaaaactattcaggacgaattttggaacgagtatggccgtactttcttcacaagatacgattacgaacatatcgaatgcgagcaggccgaaaaagttgtagctcttttgagtgaatttgtatcaaggccaaacgtttgtggctcccacttcccagctgatgagtctttaaccgttatcgattgtggtgatttttcgtatagagatctagatggctccatctctgaaaatcaaggccttttcgtaaagttttcgaatgggactaaatttgttttgaggttatccggcacaggcagttctggtgcaacaataagattatacgtagaaaagtatactgataaaaaggagaactatggccaaacagctgacgtcttcttgaaacccgtcatcaactccattgtaaaattcttaagatttaaagaaattttaggaacagacgaaccaacagtccgcacatagaattattggtcttgaacaagcactaattttccaaagatgatttaaatacccagcaaattggagctctgcagagctttcgttcgtatcatcggtttcgacaacgttcgtc

SEQ ID NO: 283 - DNA, 1423 bp, Bacillus halodurans
tcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgattcaacaaaaacaatcgcttcttgagcacaagccagtcttaagtaaggagcttgaaaaactagtcaaccattatcgcactttaagccttaacggtcaatgtgcccaatacattcctgctctacgagaagcaaatcaaacatacctcggcctttacgtcgttcattcgaacggaatcgaaatcaaatccggtgattggcaagtccctttcacattgcaaagtatctcaaaaataatcaattttatcgcagcttgtctcgatcgcgggatcacttatgtgttagatcgagttgatgtggagcctactggggatccgttcaattccatggttcgtcttgaaatgcgcaaaacaggaaaaccgttcaacccgatgatcaatgccggtgccattactgtcgcctctctcctttcagggaaatcgccaacggaaaagctcgaatcagtttattcgctagttgaaaaaatgctcggaaggcgagcatcagccaatgaagccgtgttccactccgaatggcagacagctcatcgaaaccgctcactagcgtattatttaaaggatacaggctacttagaatctgaagtggacgacgccttgcacgtgtatttcaccctatgtgcaatcgaagtggcgacaaaggacattgccaaaatcggactcattcttgcaaacaatgggtatgatcctctcagtcatcaacagatctttccgaaagaagtggcgaaattaacgaaagcgttaatgctcacatgcgggatgtacaatgcatctggaacgtttgctgctcatattggcatccccgcaaaaagcggcgtctctggcggaatcatggcagctgtcccagcaagaggacgaagtgacgaggcgatgggcattggcatttacggcccagctatcgatgattttggtaacagcgttgccggagtcgccttattaaaacatctttctcacatgtgggatttaagtattttttaatttactaaacgaaaaaaaggtggaatgacgtatgaccattttgaaggctggagacccagctttcttgtacaaagttggcattataagaaagcattgcttatcccccaaatacccagcaaattggagctctgcagagctttcgttcgtatcatc

SEQ ID NO: 284 - DNA, 2072 bp, Arabidopsis thaliana
ttaattaaatggtagaatttcatgagttattgactgtgatggtttcactctttttagtgaagatatttcattgggtctatcagtggagaaatccaaaaactaatggaaaactacctccagggtctatgggctttccgttcattggagagacttttgagttctttaagcctcatgacgctcttcaattttcaacattcatcaaagacagagtccttaggttttttgctgatttctctagcattcatttgtcatgtatgtttaaattattttttattaattacgttgtctttcctttgtcaattgtcatattttttaatagacatggaccagtttttcggacaagcttatttggagacaaagctataatctcaatggatatggaattgaatctcgagatggcgaaggcaaattccgtccctggtgtcacgaagagcgtaatacgactatttggggagaacaacttgtttttgcagagcaaggagtcccataaacatgttcggaacttgacgttccagttgttgggtccacaaggtttaaaatcaaggatgattgaagacgtggatctcttggctcgcacgtacatggaggaaggagctaggaacggctaccttgacgtaaaggaaacatcaagcaaggtatataaaataaaagtcatacgtttcgtgttctctttaatttacctcttggcaatataatgttacaatcaactagataaagaaccttggatattggatcatcttaaaagtatatttataatcaaacgttacagattttaattggatgccttgcgaagaaagttatgggcgagatggaaccagaggcggcgaaagaactcgccctctgctggagatattttcagagtggctggtttagattctttctcaaccttcctgggacaggtgtctataaaatgatgaaggtgtgggttttctgtaacctaaatatagtatcatttatataagagtaggctttttgtgcaatacactgaggctgatatttcgtggcaggcaagaaagaggatgatgaagttactaaggaagacagtgttgacgaagagagcatcaggagaggagttaggggagttcttcaacatcatatttggagaaatggaaggagaaggagaaacgatgagcgtagagaatgcggtcgagtacatatataccttctttttggttgctaatgaaacaacaccaaggattcttgcggctacagtaaagtttataagcgaccaccctaaagtcaagcaagagttacaaagagaacatgaagaaattgttcggggtaaggcagagaaggaaggcggcctaacatgggaagactacaaatcaatgcatttcactcagatggttagtatctatccaaaatgatatatataaacaaaaagagaactcattccttattataaatgttgacatatatagtttttaatacaaatatggttcaggttatcaatgagtcgcttagaatcataagcacagcaccaacagttcttagagtacttgaacatgatttccaagttggtgattatacaattccagctggttggacctttatgggatatcctcatatccatttcaattcagaaaaatacgaagacccttacgcatttaatccatggcgctgggaggtgactataatttcatattcatccttttacttattcactccaattacactaatcaaagctataggatgtcttataaacttttgattaaataaaatttcagggaaaggatttgggcgcgatcgtctccaagactttcattcccttcggtgcaggtcgtagactttgtgtaggggctgagtttgctaagatgcagatggccgtttttatccatcatttgtttagatacaggttctcaaatttataaatcgatatcaccttgtgacttgtgatttactctagtctttttttttactacattcaaagttcttcttacttacatatgttttgcatgcaggtggtctatgaagtcagggacaacaataattcgaagctttatgcttatgtttccaggtgggtgtgatgttcaaatttcagaagacactgaagtcgataagtgaggcgcgcc

SEQ ID NO: 285 - DNA, 2771 bp, Saccharomyces cerevisiae
tttatttgtcagctttcaaactctttgtttcttgtttgttgattaacccttaattaatccgggcgcgcctgatttatcacaagtttgtacaaaaaagcaggctcctgcaggaccatgatgggagatgagaagctttcacgccacacatctttgaagagggccagatcgctctccgaatccattaagggtctatttaagccttcagggatatcaggcagtaataatgctgcggctccttcatctcgtcccggtcaggaccaagcacattctcatcaaacagcaagaataataactagcaacgtatcttccccgtctatatcccccgtacatagccctgttctacaagcggctcctaagcatcacaaactgggcgtccctaatattgcaaaactctcgttgtcacctagtagggaaccatctttgaattcagaaaatgaaatgttttcacaagaatctttcataagtgaaaaagatgaagatgaagccaatttgttagagagagaggatcttcaaaataaaaaggaagagaaagctcgtgcaaaacatgtacgttccaaggaagcttatgtgcctcatcaccgctatacagttggtagcgatgaggttgaaagacaaccaagggaacggctgaaaaacttcccacaaaacgcaggttcttcaaaccctgcaaatagtaatgccaaccatgttttggatcaggaaaataacttttctattgatgctatgcttgattatgacgaagaatcaaaacttagaaggagaaacagtctgggcgtacgtaatcatagcaatcgcacaagaagtaggaagaacagtttgtccacaccaaggtcaccaccaatgaaaaatggaaatggtggaatgaattcaaatgccaccaacaatgttggtaatggtacaggaaatagaatatacatgaggggaagaaatcactcagactctatcagtgcttccagcttaccgaaatttcaagaaatcgaatgtaaatgtattttggatttaggtcatttcaaagtctttgaaaacggataccacgaacattctttgagagtgctgccaattattacaaacaataaaaatgtggatagtggcgatgaaaaggatgctgacgcttctgtaaacagcggcgatgatggtgacaatgacagtgaggcaaatatgcataaacaaaaatctgtgttttctttaagtggattattcaaatctcataaggatggaaaccaacaacagcagcaacagcagcaacaagaagaaaacggcgaacaaatcaatctagaaaaagcattttcaataataccatcccagagattcatcaaatcgcagactttaaagaaatcgagaacgagtaaccttaaaaatggcaataatgatgaattgatgaaaaacgatggtaaaaatattccgcaaatcgtgaatcctaacgctgctgtaggtgttgaagagttgaagctaatcaatgcattatcggaaaaaatacgaaagggccttaaaagtgaaaatacaaaaggcaacaatggcgaaggcagaagcaatagcaataaacaggaggattctgatgacacagagggcaaggcaggaacaaccaatgacgatacatctcataaaccttgttcacaaaaatacggaaaatctattggggtcgtcggtgcaggtgcatacggggtggtcaaaatttgcgcaaggtgcaagactgctaaagatgtcctaccatacagtacctactctaatggaaaaaaactattctttgccgtcaaagagctgaagcccaagccaggtgaccaaattgataaattttgcacgagattaacctctgagttcattattggacactcactgagccatccgcattttgaggcaaatgcgatgatagcaggaaatgtttcaagaaccactccaccaaaacatgtcttcaatgccccaaacattttgaaaattttggacctaatggaatatagcaattccttcgtagaagtgatggaattttgtgcttcaggtgatttatattcgttgctaacaaggaataacatctcaaatgaatcgaataacgggagttcaagattgatccaaactgttaaagaaggttctgggagtccgttgcacccattagaagcagactgttttatgaaacagcttttgaatggtgttcaatacatgcatgatcatggtatagcacactgtgatttgaaacccgaaaatatccttttccaacctaatgggttgttaaaaatttgtgattttggtactagttcagtttttcagactgcctgggagaaacacgtccacttccagagtggagccatgggttcagagccatatgtggcacctgaagaatttataagggatgcagaatacgatccgcgtctggtagattgttggagttgtggtattgtttactgtacaatggtcatgggacagtatctttggaaaatcgccattcctgaaaaggattctctttttaaatcatttctcagtgaaattaaagatgatggacagttttatctatttgaggaattaagacatgttagtagcgaactgaataggttgaggaaaattgcactatatagaacgttccaggtcgaccccacgaagagaatcaccattgaacaattactacaaagctcctggatgaggaaaacaaaatgctgtgtagtttatagacacttacataccaaggttagtaaataatagctcgagacccagctttcttgtacaaagtggtgataaattggagctctgcagagctttcgttcgtatcatcggtttcgacaacg

SEQ ID NO: 286 - DNA, 1312 bp, Arabidopsis thaliana
ttaattaaatgggactttcattgagagtgagacgtcgtggaggaagtgttagcaagaaagagatcattccggtgacaagttgctcggaggaagtggagataaccataccatcgcagtttcaatgtccgatatcttacgagctaatgaaggatccggtgattattgcctcggggatcacttacgatcgcgaaaacatcgagaagtggttcgagtccgggtaccaaacttgtcccgttacaaacacggttttgacaagtttggaacagattccgaaccatacgattcggaggatgattcaaggttggtgcgggtcgtcactaggcggcgggattgaacgaatcccgacgcctcgtgtacccgtgaccagtcatcaagtctccgagatttgtgagaggttatccgctgctacgcggcgtggagactacgccgcgtgcatggagatggttacgaagatgacgagactaggaaaagagagcgagaggaatcgaaaatgcgttaaggaaaacggcgcgggattggttctttgcgtttgcttcgacgcgttttccgaaaacgcaaatgcgtcattattattggaggagactgtgtctgtgctgacgtggatgcttcccattggtttagaaggtcaatccaaactcaccacgacgtcgtcgtttaatcgtttagtggaactgttgagaaatggtgatcaaaacgctgcgtttttgataaaagagcttcttgagcttaacgtaactcacgttcacgcgttaacaaagatcaatggcgtccaagaagcgttcatgaaatcgattaatcgcgattctacatgcgtcaactcgttaatatcaatccaccatatgatcttgacaaatcaagaaaccgtatcaaggtttcttgaattggatcttgtgaatataacagtggagatgctagtggattcagaaaacagcgtttgcgagaaagcgttaacggtattaaacgtgatttgtgaaactaaagaaggaagagagaaagtgagaagaaacaagctggtgataccgattttggtgaagaagattttgaagatttctgagaagaaagatttggtttctgtgatgtggaaggtttgtaaaagtggtgatgggtctgaagttgaagaagcgttgagattaggtgcgtttaagaagcttgttgtcatgttacaagttggatgtggtgaaggaactaaggagaaagttacagagttgttgaagatgatgaataaagttatgaagatgaatggttttgttgatcgttcttattcttcttcaattgagtttaaacatgttaagaaaccattttaaggcgcgcc

SEQ ID NO: 287 - DNA, 1851 bp, Bacillus subtilis subsp. subtilis str. 168
tttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggtttcgaaacgttaaacaaaagttttatcaacggaaaatggactgggggagaaagcggacgtacggaggacattttgaatccgtatgaccagtctgtgatcacaacagcatctttggcaacgggcaaacagcttgaggatgcgtttgacattgcacagaaagcccaaaaagagtgggccaagagcacgacggaagaccgaaaagccgtgctgcaaaaagcgcgcggctatttacacgaaaaccgtgatgacatcattatgatgatcgcccgcgaaactggcggaacgatcattaaatcaacaatcgagctggaacaaacgattgcgattttagatgaagccatgacgtatactggtgaattaggcggcgtcaaagaggtgccatccgacattgaagggaaaaccaataagatttaccgccttccgctaggtgtcatttcatcgatttctccatttaatttcccaatgaatctatccatgagatccattgcgcccgcaattgcgctgggtaacagcgttgttcacaagcctgatatccaaactgctatttccggcgggaccatcattgcgaaagcgtttgaacacgccggtcttcctgccggtgtccttaacgtcatgctgacggatgtaaaggaaatcggggacggcatgctcaccaatccaatcccgagattaatcagctttacagggtcaacagcagtcgggcgccacatcggtgaaatcgccggtcgcgccttcaaacgaatggcacttgagctcggcggcaacaatccatttgccgttctttcagatgcggatgtcgatcgtgctgtggatgccgcgattttcggaaaatttattcaccagggacaaatctgtatgattatcaacaggatcatcgttcatcaagatgtatacgatgagtttgtagaaaaattcaccgcccgtgtcaaacagcttccgtacggcgatcaaaccgatccgaaaaccgttgtcggcccgctgatcaacgagcgccaaatcgagaaagcgctggagatcattgagcaggcaaagacagacggcattgagcttgcggttgaaggaaaacgcgtcggaaacgtgctgacgccgtacgtctttgtcggtgcggacaacaacagcaaaattgcccaaacggagctgtttgccccaatcgcaaccattattaaagctggcagcgaccaggaagcgattgacatggcaaatgatactgaatacggcctcagctctgcggttttcacttctgatttagaaaaaggcgaaaagttcgccctgcaaattgacagcggcatgacccatgtcaacgaccagtccgtcaatgattcgccgaatattgcctttggcggaaacaaagcaagcggtgtcggccgtttcggcaatccgtgggtcgtcgaggaatttaccgtgacgaaatggatttcgatacagaagcaataccgcaaatatccgttctaactcgagacccagctttcaaatacccagcaaattggagctctgcagagctttcgttcgtatcatcggtttcgacaacgttcgt

SEQ ID NO: 288 - DNA, 1687 bp, Xenorhabdus nematophila
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgaaccagtccgaaatgctttactctcaggcaaaacaggtgatccccggcggtgtcaactcgccggtacgcgcctttaatggcgttggtggtacgcctgtctttatccaacgcgccgatggtgcttacctttacgatgttgatggcaatgcctatatcgattatgtcggctcatgggggccaatggtactggggcacaatcaccctgccattcgcaacgccgtgattgaagccgccgagcgtggcctgagctttggtgcaccaacggctgccgaagtggaaatggcaaaacgagtgacagagttggtgccttccatggatatggttcgcatggtgaactccggtacagaagccaccatgagtgccattcgtctggcgcgtggttataccgggcgcgataagatcatcaaatttgaaggctgctatcacggccacgccgactgtctgctggtcaaagcgggttccggtgccttgactataggccagcccaattctccgggcgttcctgccgatttcgccaaacataccctgacctgcgtctataatgacctgaattccgtgcgtgaagccttcgaaaaatacccagaagagatcgcctgtatcatcgtagaacccgtcgccggtaacatgaattgtattcctccacgaccagaatttctgccgggtctgcgtaagctgtgtgatgaattcggtgcgttactgatcattgatgaagtgatgaccgggttccgtgtcgctttgggcggcgcacaagagtattacaacgttaaaccggatctgacgtccctcggcaaaatcatcggtggcggtatgccagtgggtgcatttggcggccgtcaggacatcatggaaaaactggcaccaaccggcccggtttatcaggcgggaaccctctcaggtaacccaatcgccatggctgcgggtctggcttgcctgaatgaagtcgcccaacccggcgttcacccgcgtttgagcgaactgacagacaaattagcttctggcctgaaaaacgcggcatcagcagcaggcgttcctctggtggttaaccacgttggcgggatgttcggtattttctttaccgacgcagaaagcgtgacttgctatcaggatgtcatggcgtgtgatgttgaacgcttcaagcaattcttccacttgatgctggatgagggcgtctatctggctccttctgcgtttgaagcaggctttatgtccatcgcccattcagatgaagatattcagcgtaccgttgatgccgctgcccgctgttttgccagactgaattaagtcattccgttatctgtgacgccacaatcccgtggcgtcacatctcgagacccagctttcaaatacccagcaaattggagctctgcagagctttcgttcgtatcatc

SEQ ID NO: 289 - DNA, 1735 bp, Bacillus subtilis subsp. subtilis str. 168
aaaaaagcaggctcctgcaggaccatgaaaacagaacaaacgccatggtggaaaaaagctgtggtttatcaaatttatccgaaaagctttaacgatacgacaggaaatggtgttggcgatctgaacggcattattgaaaagctggattacttaaaaacgctacaggtggatgtgctttggctgacgccgatttatgattctccccagcatgataatgggtacgatattcgtgattattactcgatttatcctgaatacggaacgatggaggattttgagcggctagtgtccgaagcacataaaagagacctgaaagtcgtcatggatcttgttgtcaatcatacgtcaacagagcacaaatggtttcgcgaggcgatctcttcaatagacagcccgtaccgtgatttttatatatggaaaaaaccgcaggaaaacggttctgttccgacgaactgggaatcgaaattcggcggctcggcatgggagcttgacgaagcatcgggccaatactatttgcatctgtttgatgtgacgcaggctgatttgaattgggaaaatgaagaggtcagaaagcatgtctatgacatgatgcatttttggtttgaaaagggaatagacggctttaggcttgatgtcatcaacctgatttctaaagatcagcgctttccgaatgcggaggaaggcgacggccgctctttttacactgacgggccgcgggtgcacgaatttctgcatgaaatgaacgaaaaggtgttttcacattacgacagcatgacggtcggtgagatgtcttcaacaaccgtagaccactgcatccggtatacgaatcctgacaataaagaacttgatatgacattcagcttccatcatctcaaggttgactatcctaacggcgaaaaatgggccttggcgccgtttgattttttgaagctgaaggagatcctatctgactggcaaacggggatgcacgcaggagggggatggaacgctctgttctggtgcaatcatgatcagccgcgcgtcgtatcaagatatggagatgatggcgcatatagggtgaaatcggcgaaaatgcttgctacggccattcatatgatgcagggcacgccttatatttatcagggcgaggagctggggatgacgaatccgaagttcactgacataagctcctatcgggatgtcgaatcgctgaacatgtatcacgcctttaaggaaaaaggaatggctgatcaagatattacagccattttacaggcgaaatcccgtgacaattccagaacccccgttcagtgggatgctacggaaaatggtggttttacaacgggcacaccatggataccggttgcaggaaattaccgggaaatcaatgctgaagcggcgctgagggatcagaattcggtgttttaccattatcaaaaattgattcagattcgcaaaatgtatgacattgtgacagagggtacgtatgagataattgcaaaggatgacccgaacatttttgcgtatctcagacacggcagcaatgaaaagctgctcgtgatcaataatttttacgggacagaggcggcctttacactgccggactctttagcgcctgacgaatggaaggcagaggtgctgttgacgaacgatgaagcaagggaagggcttcagaacatgacgcttcgcccatatgagtccattgtttatcgtttaacgaaaccgtgttaactcgagaccagctttcttgtacaaa

SEQ ID NO: 290 - DNA, 564 bp, Arabidopsis thaliana
ttaattaaacctaaaacaccgaaacaaaaacaaagagatttaaacaagaagagttattatggcgagcttgctagataaagccaaggacttcgtggcggataaactcaccgcgatccctaaaccggagggttcagttacggacgttgacctcaaagacgtgaaccgtgactcagttgagtacttggccaaagtctctgtcaccaatccttacagtcattcgattccgatctgtgagatcagtttcactttccacagcgccggcagggagattggaaaggggaagataccggacccgggttctctgaaagctaaggacatgacggctcttgatattcccgtggtggtgccgtatagtatactgtttaacctggctcgagacgttggtgtggactgggacattgactacgagctccaaatcggtctaaccatcgaccttcctgttgtaggggaatttactatccctatctctagtaagggagaaatcaaacttcctacttttaaagatttcttctgatcgacaaaacctatatataagaccacacatcgttatgatggtggcgcgcc

SEQ ID NO: 291 - DNA, 728 bp, Arabidopsis thaliana
ttaattaacggaatctctcttcttattttatttttcttccggtagatcgatccagctccgagatcaatcatgaatcctgaatatgactatttgttcaagcttttgctcattggtgattctggtgttggaaagtcgtgcttgcttctaaggtttgctgatgattcctacctggatagctacatcagcaccattggtgtcgactttaaaatccgaacagtcgaacaagatggaaagaccatcaaactccagatttgggatacggcaggccaggaacgtttcagaacgattactagcagttactacagaggagctcatggaattattgtgacttatgatgtaacagatctagaaagcttcaacaacgtcaagcaatggctaaatgaaatcgaccgctatgcaagtgagaatgttaacaagctactggttgggaacaagtgtgatctcacatcacagaaagttgtatccactgagacagctaaggctttcgctgatgaacttgggatcccattcttggaaacaagtgctaagaatgctaccaatgtcgaagaagctttcatggccatgactgctgcaatcaagaccagaatggcgagccaacctgcaggaggatctaagccaccaacggtccagatccgaggacaacctgttaaccagcaatcaggctgctgctcctcttaattcgctttggtaacacttaaccatattatgtcattcgtttgcggcgcgcc

SEQ ID NO: 292 - DNA, 261 bp, Arabidopsis thaliana
atgggaaatgagacgaagaccaacggtggtcctgcaagtatggccggaggcggaggattcagagctaaaatggaacattacgtttacagtggtgaaaagaagcacgtcttggtcgggatcggaatcgtcaccatcatcttcggagttccttggtatttgatgactcaagggtcaaagcatcaatctcaccaagattacatggacaaggccgataaagctcgaaaagcacgcctctcatcgtcttcatcagctaacaagtag

SEQ ID NO: 293 - DNA, 1035 bp, Zea mays
ttcttgtttgttgattaacccttaattaatccgggcgcgcctgatttatcacaagtttgtacaaaaaagcaggctcctgcaggaccatgccatatgcaaaaggaatgcaaattgaagtttccaagttggaagacaattctgttgttgcttggtcacctgcagttgtcgcaaagattatctggaagaataacctattagtcgactacactctttcaaagtgttacggtactacattgtctgaggagattgttgatgtgaagcatgtgaggcctcgcccaccacaagcatcagagattagtttctgcatcaatgatgaggttgaagcattccaaggtgattgctggtggctaggggtgattactaatgttcttccagaattcaagtacacatttaagtcaacgcatttagggacggaagttgaggtgaaccagaaatttctgaggcttcgatatgactgggttggtgatcaatgggaacaagaatcaaagaatgtgcccaaggcaaaatttacacaaggtgtcaaggttgaagtctgcagcgacgatgaaggttttcgtggagcctggttcgaggcgactgttgttaaagctgtcggcagcaagttcctcgtggagtatgctacgctgaaggccgatgacgggaccaagcctctgaaagaatctgtagaagcacggcacatcagaccttgccctccagatatccctgccactgatggattcaaactacttgacgaggtcgatgccttctgcaacgacgcgtggtgggtcggtgtggtatccaaggtcctcggcgagaagaggtgcacggtctacttcaggccttggaaggaagagatggagttcgagcatgcgcagctgaggttgcactgtgactggatgggcgggaggtggatgcgggcttccccggcactggagatgtgaaggctgaagagccacgcgatggcgttagacagtagctggtgatttctcgagacccagctttcttgtacaaagtggtgataaattggagctctgcagagctttcgttcgtatcatc

SEQ ID NO: 294 - DNA, 1484 bp, Glycine max
aaaaaagcaggctcctgcaggaccatgtggagttcaacttcaagcacagcagcgattccctccgacgaggaacctagcgaatcctcctcctcgtcctccttctccacctctctcttcaatttctcttctggaaacccgagaatcgaggagacccgtggcctcatgcatctcttcccagacgacactccttctactctacccgttggacggaagcctctcgtttgcgttgtcggcgtcccaaatcacatgacctatgcggatttctgccagttctgtggttccttcattcagcacatgctagagatgcgcatagtcaggatggatgggatggaggatcagtacagtgttttagttcgctttgacgatcaagactccaccgacagcttctacaagcactacaatggccgccgtttctcttctctcgaggttgaggtttgccgtgttcttttcacattagacgtgcagtacactggctccattgaacatgcacaaccctccaatgctacttcaactgaactgcctacttgtcctgtttgccttgagcgattagatcaggacaccggtggaattcttacaactatatgcaaccattctttccattgttcctgtatttctaaatgggcagattcttcttgtcctgtatgccgctattgccagcagcaagctgaaaaatctatatgttttgtttgtcaaaccactgagaacctatggatatgtgttatatgtgggtatgttggctgtggaagatacaagggagggcatgctataatacactggaaagagacacagcattgctattccctagaagtggaaacaaaacgagtttgggattatgtgggagacaactatgttcatagacttattcagtccaaaactgatgggaagttgattgagctgaacactcagtgtgcgcatgcagacaatggatgtggaagttgcagctgtgaagataatgccatgaatgaggctatacttaatagtaaagttgaagctattgtcaatgagtacaatgaattgcttgctactcaacttgaaaaccaaaaattatattttgaatccttgttacaagaagtaaaagaagaatctgagagaaaaatttccaaagctgttcagaaggctatcagtcttaaacagcagaagattcagtccaagattgacagatgtaagaaagagaagaaatttctggatgatcttaatgagaatcttgtgaaaaatgaggacatttggaaaactaagatacttgcgattgaagagagggagaaaaaaaccacgagactgatgggtgatagagtagcggacctggaaatgcagcttggtgatctcatggtttgtcttgagggtgggaggacggtagaacagctggcagcttcagatgagattaaagaagggattatcttggacaaatcaatagaatcctcgacaactagtggctctgacctggtgggaagagacgcataactcgagacccagctttcttgtacaaa

SEQ ID NO: 295 - DNA, 1065 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtggattttcaagatacctgggctttgttacatccggcgatcgccgtggttgtggttttccctctgttgggcattgtgcttaaccgtgctttactcacccgggaacggcgtttggcgatgaaggtgggcgagaaaagtaaaattcctcccatcgttggcaccgaacacgtggcgatcggaagatatcttagtatggcggtggtgggcgttacttttctagggttagcctatcctattttttctaagtttattaataaaaatctaatttctgaagagccttttcgggttttatttatcattgcgctgttcattttaagtattacttctttcatctttctttttcaagctaaaacaagaatttggcgggggatctttgccaccttaacgggaatgggactagtgctcttaggttgtcagcccgaaatttatcgtcgagaccatgaatggcttgtctcccatttttattatggaattttagccgcgctgttaatgattttttcagtggctacgattcaagatatttatcaagatcgtcgaaatcgttggcgtaatgcccacattattattaatagtttcgctttattgctctttattggtcagggcataactggggcaagggatttgctggaaattccacttcattggcaaaagccttatatttatcaatgtgattccgtcggtaaaacctgtcctcagttcaaataaatttaaatacccagcaaatacccagcaaattggagctctgcagagctttcgttcgtatcat

SEQ ID NO: 296 - DNA, 1181 bp, Nostoc sp. PCC 7120
ttcttgtttgttgattaacccttaattaatccgggcgcgcctgatttatcacaagtttgtacaaaaaagcaggctcctgcaggaccatgagtaatccccgtgttttgtgcctcggcgaagttctattcgattgtttagctgatcaattagggctaaagctggaacaggtaaagtcttggactgcttatccaggaggagcgccagctaatgtggcttgtgctttagtgaagttgggaactcccgccggatttattggtgctgtcggtgaggatgagccaggaaatgtgctggttaagctattacaagaagtaggtgtagatacaacgggtgtacaacgtcattctactgccccaactaggcaagtctatgtggtcagggatctagcaggcgatcgcactttcgctggcttcggtcagtatgatacatctgaatttgctgatacgcatttgcaagccaagcaattaccagagtcagtgtttcaagaagcggatttcctgattttgggtacattggaattagcctatcccgacagtgaaaaagctattcaccgagctttggaactggctgaacagtatgacctgaagattgtgctggatgttaactggcggccggtattttggcatgatgaaaatattgctaggcaaaaaattcaggaaattttcaaacgcgttgatttcctcaagcttgctaaagaagaagctgaatggctattcgacacctctgatccaggcgctattacttaccgtttaggctctattgagggggtattagtaactgatggcgaaaacggctgtggttattgcttgggtgagaatgaaggtaaaatacctgcttttgctgtttctgtagtagataccacgggcgcaggagatagctttctggcagggtttatccatcaactgagtgaacatggcattcacaacttgaatgatgcagagacagcaaaacgcattattacttatgctagtgctgtaggggcgttgactactactaaagcaggtgcgatcgcttctcaacctaccgcgatggaagtggaaacttttttagcctccaataaaatttagttgaactacccacactgacctatcgggtcagatgtggggcttttgtcctcgagacccagctttcttgtacaaagtggtgataaattggagctctgcagagctttcgttcgtatcatc

SEQ ID NO: 297 - DNA, 1467 bp, Arabidopsis thaliana
acaagtttgtacaaaaaagcaggctcctgcaggaccctagaaaccctaatcccaaacgaatcaatggagcgagacgaagaagcgagtggaccgatgatggagatgtgcactaacggcggcgaagagacgtctaatcgaagacctatcataagtggcgaaccgctcgacatcgaggcctacgcggctctctacaaaggtcgcacgaagatcatgcggcttctcttcatcgctaaccactgcggaggaaaccacgcgcttcagtttgacgcgttgaggatggcttacgatgagatcaaaaagggtgagaatacgcagttgttcagagaagtggtcaataagattggcaacaggcttggggaaaagtatgggatggatcttgcttggtgtgaggccgtcgatcgtcgtgctgaacagaagaaagtaaagctggagaatgagctcagttcttatcggacaaatttgatcaaggaaagcatcagaatgggttacaatgactttggagatttctattacgcatgtggtatgctcggagatgctttcaagaactatatccgaacacgcgactactgcactacgacaaagcacatcattcacatgtgtatgaatgcgattcttgtcagcatcgaaatgggtcagtttactcatgttacaagctatgtgaacaaggcagagcagaatcctgaaacccttgaacctatggttaatgcaaaactgcgatgtgcatctggattggctcatttggagttgaagaagtacaagctagctgctcgtaagttcttagatgttaacccagaacttggaaattcctataatgaagtcattgctcctcaagatattgccacctatggtggactctgtgccctggcaagctttgatcgatcagaattgaagcaaaaagtcattgacaatatcaacttccggaatttcttggagctagtgcctgatgtgagggaacttatcaacgatttctattcaagccgctatgcttcctgcctggaatatcttgcaagtctcaaatcgaatctgctgctggacatccatcttcatgatcacgttgacacactatatgatcagataaggaagaaggcactgatccagtacacattgccatttgtctctgttgatttgagcaggatggccgatgcattcaagactagcgtctctggtctagagaaagaacttgaagccttgatcacagacaaccagattcaggcaaggattgattcacacaacaaaatcctctatgcaagacacgcggatcagaggaatgcaactttccaaaaggtacttcagatgggaaacgaattcgatagagatgtcagggcgatgctgttaagagccaacctcctgaaacatgagtatcatgccagatcggcaaggaaactttgatgacatctgctttgctaaactgagaggtaatggcctattccaagatcctcgagacccagctttcttgtacaaagtggt

SEQ ID NO: 298 - DNA, 1447 bp, Arabidopsis thaliana
ttaattaaatggatcttctctttctctttttctctcttctcctctcttacctctttttcaagatctggaaactcatagactcaaagcaagacaaagattgctacattttagactaccaatgtcataaaccaaccgacgatcgaatggtgagcactcaattcagtggagagatcatttatcgaaaccaaaaccttggtttaaccgaatacaagttccttctcaaagccatagtaagctcagggattggagaacaaacctacgctccaagacttgtctttgaaggtcgagaagagcgtccttcgttacaagatgggatctccgagatggaagagttctacgtggacagcatcggaaaactcctggagagaaatcaaatatctcctaaagacatagacatcctcgtagtcaacgtctccatgctctcttcaacgccatctttagcttcaagaatcattaaccattacaagatgagagacgacgtcaaagtcttcaacttgaccgggatgggatgcagcgcaagtctaatctccgtagacattgtcaagaacatttttaagagctacgcaaacaagttagctcttgttgccacctccgagtctttgagccctaattggtatagcggaaacaaccgttcaatgatcttagccaactgtttgttccggtccggtggatgtgctattctcttgactaacaaacgtagcttgagaaagaaagcaatgtttaaactcaagtgtatggtacggactcaccatggagctagagaggagtcttataattgttgcatccaagccgaagatgaacaaggccgtgtcgggttttacttggggaagaatctaccaaaagccgctactcgtgcttttgtagaaaacctcaaggttataacacccaagattcttcccgtaaccgagcttataaggttcatgttaaagcttcttatcaagaaaatcaagattcgtcaaaaccctagcaagggctccacgaatctcccaccggggactccattaaaggcaggaatcaacttcaagaccgggatcgaacatttttgcatacataccggaggaaaagctgtgattgatgggattggacatagcttggatttaaacgagtatgatattgaacctgcgaggatgactcttcaccggtttggcaatacttcggcgagtagtttgtggtatgtgttggcttacatggaggccaagaagagattgaagagaggagatagagtttttatgataagctttggagctggttttaagtgtaatagctgcgtttgggaagttgtgagagatcttactggtggtgaatcaaaaggaaatgtgtggaatcattgcattgatgattatccaccaaaatcgattctgaatccttatttggagaagtttggctggattcaagatgaagatcctgacactttcaaggtccctgacgctttcatgtaaggcgcgcc

SEQ ID NO: 299 - DNA, 1827 bp, Arabidopsis thaliana
ttaattaaatcgattcttgattcgttttctcgcgtatagagagaaaaatggcgcttaatttatcgcatcagctaggagtactcgccggaactccgatcaaatccggtgaaatgacagattcatcgttgttatcaatttcaccaccatcggcgagaatgatgacacctaaagcaatgaatcgaaactacaaggctcacggaacagatccatcaccgccgatgagtccaattttaggtgcgacacgtgcggatctgtcggtggcgtgtaaagctttcgcggtggagaatggaatcgggaccattgaagaacagagaacgtatagagaaggagggattggtggaaagaaagaaggaggaggaggtgttcctgtgtttgtgatgatgccgcttgatagtgttaccatggggaacacggtgaatcgaagaaaggcgatgaaagcgagtttgcaagcgttgaagagtgctggtgttgaagggattatgattgatgtgtggtggggtttggttgagaaggaatctcctggaacttataattggggaggttataatgaattgcttgagctggctaagaagcttggtcttaaggttcaagctgttatgtcgtttcatcagtgtggtggcaacgttggtgactctgtcactattcctctgcctcagtgggttgttgaagaggttgacaaggatccagaccttgcatacactgatcagtggggaagaaggaaccatgagtatatatcacttggcgctgatacactccctgttctcaaaggtagaacacctgtgcaatgctatgcggatttcatgcgtgcttttagagacaacttcaagcatcttcttggagagaccattgtggaaatccaagtgggaatgggacctgcaggagagctgcgttacccttcgtaccccgagcaagaagggacatggaagttcccagggattggagccttccagtgctatgataagtactcgttaagcagcttgaaagcagcagctgagacttatgggaagccagagtggggcagtactggcccaaccgatgctggtcactacaataactggccagaagacacccagttcttcaaaaaagaaggtggtggttggaactcagagtatggagatttcttcctctcatggtactcccagatgctgttggatcacggcgagcggatcctatcctcagccaaatcaatattcgaaaacatgggtgtcaaaatatcggtcaaaatcgctggaatccactggcactacgggacccgctctcacgcgcctgagctcacagcagggtactacaacacaaggttcagagacgggtacctcccgatcgcccaaatgttagccagacacaatgccatattcaacttcacatgtatcgagatgagggatcacgaacagcctcaagacgcactttgtgcaccagagaagctagttaaccaagttgctctagccactctagccgcagaagttcctctagctggtgaaaacgcattgcctaggtacgacgactatgcacacgagcagattctcaaggcctccgcgctgaaccttgatcaaaacaatgagggagaacctcgagagatgtgtgcatttacttacctaaggatgaatccggagttgtttcaggcggataactggggaaaattcgtagcgtttgtgaagaaaatgggtgaagggagagactcacatagatgtcgggaagaagttgagcgtgaggctgagcattttgtgcacgttactcagccgctggttcaagaagctgcagtggctctcactcactagagagatagattgtggcatggttctatggtttatgtttgtatgcgggcgcgcc

SEQ ID NO: 300 - DNA, 502 bp, Arabidopsis thaliana
ttaattaaggttgaagaaaaagcttcctgtggttgaagtctctctgctcaacctaagagatgaaaatagtcaaggcaaatgcaggagcactgaccaatttcgaagtgcttgactttcttaactcgagaggtgcatcaaaagatactacaagagttatagctccaattgctagatcagaatacaaggtctatgattatttggtggagactgctgcttccactcaaacacgagagagcattaacaaattcgcagacaagtgtaaagatttcaaactcgctaaagctgagattctcaatatcatcaatctccggccttcttctatagtcgaactgttaccgatcatagagaacctggatgatcgagaaatcgacactgatgggatattagagcttgtgaaggatttgttacctcctctgcctacaactgcaagtcctaaagatgatgatgaagaagaaacagagaatggtgaacagtcgtgacgtgctaatgaagttggcgcgcc

SEQ ID NO: 301 - DNA, 1462 bp, Arabidopsis thaliana
ttaattaaatgggaaactgtctaaagcatttcaaacaacaacttccttcaattgctcccaagcctctcattatccctccaatattttcaggtatatctctgtttttgaaagcactatactttttgtttacgaataatgtctaaatacattgttcgatttatacgtatatatgaaaagtggagccagaaaacgagaatctgagagtcttcagattcgcggattgaagaaagcgacaaagaaattcagacaagacagggtcgtagaatgcgaggattactctgttcgaaaattctacaagggctacatagatgaaaccacatttgcaccatcaagagctggaaccggaatcgctgtttctgtcatggaatgtgatagttcacgctctttacaagactggatggtaagcaaagtctgttcatttttacgcaatattgatacctatctcttattccttgttagtcttgtgtacttatctgatgggtacaaaaactatgagttgcaggcagtagtgaggtctcttggacagttgtctcatcagaatttggtcaatttcttgggttactgttgtgaagacaacaaaccattcttcttggtatttgaatactcgcacaaaggaagtttggacagtcacattttcggaagttaagatcttttctagctaatgggtccattctaagatatagacaactattgcattacctatagttttacgtttccctcaacagaagaagaagaggcattgccatgggaaatacgggttaagatagccattggaacagctcaaggtctcgcgtttcttcactcgatcaagaacagccccctaaaccgagaactcaggatgcataacattatgcttgacgaggtggtaattgttttatttccatccttcttctctctttttgtttatgatcttagaaattaatatctaagtttggatttcatcagcaatacaatgcaaaaactgttctatctcgaaccaaccaaacgaagcttggtagatgaaggtctcaagaggggaagatttacatacctatctcctgaatggggatcgttaggtacacgaaagcattaactttcgttttacaaattctgaaaaatctttcgttgttcaacgttaagacaattgtgtaatgtatgtgttaggtattttggatatgacgaccgatgtttacatttttggtatgatcttgcttgaacttttaatgggttccaaggatagaaaaaagattaaggaagagcaaggcttagtagattactggacctcatctttcttgccagataattataagattgaggaaataatcgatccccgacttgggagcgattattctgcgaatgcggcgacacagatgggcacactcatcaaccgatgcacagcgcataatacaaagaaacggccattgatgcaacaagtattggatggtcttaatcatattgcagagattaaggactaaggcgcgcc

SEQ ID NO: 302 - DNA, 1534 bp, Arabidopsis thaliana
ttaattaatgagcaactcggagtcttatccaccagagtttcgacctctaatgagcgaaaaatccactgaaacgggtctagaccggagcaaagatatcgatatcccggttatcgatatggagcatttggacatggagaaactgagagaagcatgcaaagactgggggatcttccatttggagaatactgggatacccttaacgtttatgtcacaggtgaaagagataacggagtcagtgttgagtctgccgtttgaagagaaacggacgttgttcggcgttaactctccgttatcgtattactggggaacacatacggtaagtccatcgggaaaagccgtaacgagagccccacaagaatctagtggtcacttgttcgaaggcatcaatattcctcttgcatctctctctcggcttcttgcactttcttgtactgatcccaagcttgagtctttccggtacgtacggcgtcgtttaactgaattcttaactcttacttcattggtgggtttaaagaatttaatcaaatcgaaattctagttttgcacagattagatagcttcaaattttatagcttaaagttgttttaatctacacttctccgattaaagatggccggtgactagatctatgataacaccgacgtaaagtcacgagttttacgtataatctacgaatgtgaagaagaaaaaaagtgacaaaactacaaaatcattagacgataaaaacttaatttaatgtcgaaagcacatataccactagttttacaaatgacgtttcatgaatattaatgagtaaagttttaggataaattatgttattgcgcccattattcatttcttttgtcttttggtctcatagctcacaatattatcaattatcattgtgtgatgagttacgcagagtggtgatggaggaatatgggaagcacgtaactaggattattgtgaccctatttgaagctataatagaaaccttgtcccttgaattatccggtgaccaaaaaatgggctacttatcagagtcaacaggtgtgatacgtgttcaacggtatcctcagtgtaccgaatcccccggactcgaagctcatacggacagttcggtgatatcgatcataaaccaagacgatgttggtgggctagagttcatgaaagatggggaatggttcaatgtcaaacctcttgccagttcttttgtcgtcggtcttggggatatgatgcaggtaattaagtaactaacgttccatgcatgttaagatatatttcatatgagataaatcaataaaaaatcatatgatacaggtgataagtgatgaggaatacaagagtgtgttgcataaagtaggaaagaggatgaggaagaaagagagatactcgatagttaactttgtgttcccggacaaagactgtatgtttaactctactcgctataagccattcaaattctcggagtttgaagctcaagttaagcttgatgttgagacccatggtagcaaagtcggcctttctaggttcctgagcaacccctaggcgcgcc

SEQ ID NO: 303 - DNA, 1004 bp, Zea mays
acaagtttgtacaaaaaagcaggctcctgcaggaccatggacgtgagcaggaagaagaagtgggtggcctgggcggtggcggccgccatcttcgtcgtcctcatgctcgtcacgcccgccatcccgcaggacgaagcctaccacgacttcgcggaccagcgcacccttttcttagggattcccaacaccttgaatgtgatctcaaacatccctttcttctttgttggcgtcacggggctcatcctgtgccacttcaacaactatttcaggctaagctcgcagggggagctctggagttggacgctgttctttgctggtgtcacggctgttggatttggttcttcctattatcatctcaacccgaatgacgccaccctagtttgggacagactgccaatgacgattgctttcacttctgtcatggctatattcattattgaaagggttgatgatagagcaggggcaaaatcccttgcaccacttgtgattgcgggtgccttgagcatcatgtattggagacactttgatgatcttcgcccgtacgcagtagttcagtttgttccatgcattgctttacctgtgatggctatagtaattccaccgatgtatacacattcaagctactggttgtgggcagcaggattttacctccttgctaaagtggaagaggctgctgacaaaactatctacaattggactcatcagattgttagtggtcatactcttaagcatctatgtgctgcgatggtaccggttttcctggctctcatgctagctaaaaggactaccgaaccagaaaggataagcttgctccagaagtggaagaccagttgggttgcggtgagagagaggcgtttcaaagatagcagtacagttgatgtggattgcggctacgctgttgtttcaagtatatctgaacagtaaattgtcatgcatctaattaacatgcacgttgtttcaagtattagcatgcctcgagacccagctttcttgtacaaagtggt

SEQ ID NO: 304 - DNA, 1358 bp, Zea mays
ttcttgtttgttgattaacccttaattaatccgggcgcgcctgatttatcacaagtttgtacaaaaaagcaggctcctgcaggaccatggcgaaggagacggagtactacgacgttctcggcgtctgccccgccgcatccgacgaagagatccgcaaggcctactacatcaaggcgagacaggtgcatcctgacaagaatcccaacgacccacacgcggccgagaacttccaggctcttggagaggcttaccaggtgctgagtgaccctctgcagaggaaggcctatgacggctatggcaagaacagcgtatctagggagaacatactggatggtactgtggtgtttacccttcttttcgggagcgagctgttcgaggactacattggccatcttgcaatggcaacaatggcttcctccgagttgacaagcgataacgacacccccgaaaagcttcaggataggctcaagaatgtacaaagggaaagagaagaaaagctagctagattcctcaaggaattcctctctcagtatgttcgtggagacaaagaaggatttgctaatcgtgccgaagctgaggcaaagaagctctcatgcacttcatctgggttggatattcttcgcaccattggatatgtctattctcgacaggcagcaaaggagcttggcaagaaggccatgtacctaggagtgccattcgtagctgagtgggtcaggaacaagggtcatctgtggaagtcacagatcaccgcagcgaaaggggccttgcagctgttgcagttgcaagaggaggcctgccggcagagtagcaaggatggcaatgccaccgagcaggatgtcgacttgcagatgaggatgaacaaggacctgatgatgagctcactgtggaagctgaatgttgtggatattgaaatgactctgttgcatgtttgtgaaatggtgctgtctgaaaacaatgtcaagaaagatgatctgaaggcccgagcaacggccttgaaatttcttgggaaaatatttatgagggaaaaggaggcattgccagggccagcaccagcgccaggtccatcaggaccgtcgaaacgaacggttcttgacgacgacagcagctcagatgacagttcagatgatgacctgactcggacagcgccataccggactcctgcatttacccagggaatcggcaggctgttccgatgcttatgcaatccggcttatgatgttgatgatgattttgagccccacaaatgagtcctaaagaggaaggtaccaataccaatggattttccaaactcgagacccagctttcttgtacaaagtggtgataaattggagctctgcagagctttcgttcgtatcatc

SEQ ID NO: 305 - DNA, 1282 bp, Arabidopsis thaliana
ttaattaataacctcgagctccttcttcttctgttccattccaaaagaatgaagtacattcgaagcaacagcttgaaacgtctcttctccttcaaacgacgcagtttcgactccgactcctcagaaaactcttctcctctcgctgcttcttccaccaaatgcgtcgagggttttcaagaaacagaccagtttcaaagacccaaatggaaatgtttctcctttcaagaaatctatgacgcaaccaacggttttagctcagagaatttggtaggtagaggtggatttgcagaggtgtataaagggatattgggtaaaaacggtgaagagatagcagtgaagaggataacaagaggaggaagagatgatgagaggagagagaaagagtttttaatggagattggaacaataggacatgtctcacatcctaatgtcttgtctcttcttggttgttgtattgacaatggtctctatcttgttttcatcttctcttctagaggctcccttgcttctctccttcatgatttgaatcaagcaccattggagtgggagacaaggtataagattgcaattgggacagcaaaagggcttcattatttacacaaaggttgtcagagaaggatcatacacagagacattaaatcctccaatgttctcttaaaccaagattttgaaccacagatatctgattttggattggcaaaatggctgccttctcaatggtctcatcattccattgctccaattgaaggcacatttgggcacttagcaccagagtactatacacatgggattgtggatgagaagactgatgtgtttgcctttggagtgttcttgcttgaactcatttctggtaaaaaacctgttgatgcttctcaccaaagcctacacagctgggcaaaactgataatcaaagatggagagattgagaagctggtggatccgaggatcggtgaagaatttgatctgcaacaacttcatcgcattgctttcgccgcgtctctctgcatccgatcttcttctctatgtcgaccttccatgatcgaggtcttagaagtactacaaggagaagatatagagaaagagaaatggaaaatggaagaggaagaagaagttaaagaagagttttggggatatgaagatcttgaggattgtgaatgtgattcttcaatctcactttctcctcctgactctatctctaatagaagttcttcgcatcgtagtcgctagatctaaatttagttgtaaaatgttgaaaaatcaattttgttttgttgggcgcgcc

SEQ ID NO: 306 - DNA, 544 bp, Arabidopsis thaliana
ttaattaagaaccatggagctcctctctagagctcttttcttctttcttctactctcagttctttcttctttctcttcttcaagtttcatttcagatggggtcttcgaatctcagagtttggttcttggcagaaacttgcttcagaccaagaaaacatgtcctgtgaactttgagtttatgaactacacgatcataaccagcaaatgcaaaggtcccaaatacccaccaaaagaatgttgtggcgccttcaaggactttgcgtgtccttacactgaccagctcaacgacctgagctcggattgtgcaaccactatgttcagttacatcaatctctatggaaaatacccgcctggacttttcgctaaccagtgcaaagaaggtaaagaaggtctcgaatgccctgccggatcccagttgcctccagagacatcagcagaggtaaacgcagcaactacctcgtcgtcccgtctttggctgaccgtttccgcggctcttttggtttttgttaagttgttctgaggctgataaatccgaaggcgcgcc

SEQ ID NO: 307 - DNA, 951 bp, Arabidopsis thaliana
ttaattaactcgacatggatcatgaggaaattccatccacgccctcaacgccggcgacaaccccggggactccaggagcgccgctctttggaggattcgaagggaagaggaatggacacaatggtagatacacaccaaagtcacttctcaaaagctgcaaatgtttcagtgttgacaatgaatgggctcttgaagatggaagactccctccggtcacttgctctctccctccccctaacgtttccctctaccgcaagttgggagcagagtttgttgggacattgatcctgatattcgccggaacagcgacggcgatcgtgaaccagaagacagatggagctgagacgcttattggttgcgccgcctcggctggtttggcggttatgatcgttatattatcgaccggtcacatctccggggcacatctcaatccggctgtaaccattgcctttgctgctctcaaacacttcccttggaaacacgtgccggtgtatatcggagctcaggtgatggcctccgtgagtgcggcgtttgcactgaaagcagtgtttgaaccaacgatgagcggtggcgtgacggtgccgacggtgggtctcagccaagctttcgccttggaattcattatcagcttcaacctcatgttcgttgtcacagccgtagccaccgacacgagagctgtgggagagttggcgggaattgccgtaggagcaacggtcatgcttaacatacttatagctggacctgcaacttctgcttcgatgaaccctgtaagaacactgggtccagccattgcagcaaacaattacagagctatttgggtttacctcactgcccccattcttggagcgttaatcggagcaggtacatacacaattgtcaagttgccagaggaagatgaagcacccaaagagaggaggagcttcagaagatgaaaaacactcgcggcgcgcc

SEQ ID NO: 308 - DNA, 2317 bp, Arabidopsis thaliana
ttaattaaatggaagccaaaatcgtcaaggtatcggatagtagttataaagatggtcttgggaagaagagaaagcatccagggaactatactccttatgattctggaaggtcatatgcaaagctgcaatgggtgctttcacccaacagttccacccagaagcttgagaaaaggagaaatttggatggtgaaaacaaagttattgtttctgagaatcatgttgagaagtctttggtcagatacttctcttattataagaagacaggagtgccaaaacgtgtaatgttccatgagaatggtgaatggattgatttgcctgatcatattctatgcgacatcaggaatgatcttgaagcaaagagagctacaattgagttcaattggtgcggtcgccattttctcctggatttcttgcacatgtatcgactagacttggaaacaggtgtaaaaacccagcttgcttggattgatattgctggcaaatgctttttccctgaaacttttgacaccctcgaaagggacggctgccatcatatccgtggggaagatccggaacaacatgatcaacgtgagatcaagctgcacattgaaattgatgtaaatagtggggagttaccgaggctgaatttgaatgtggtcactgacgagtctggtgacaatatggatgattttcaagctgttcagagatcctcaaatgggccaaatgacgaggcatcagaggatagctgcagccgtgagcttgatgatgctgttgagaaatgggacaaaacagaaactgatcggttctctggtgtcaagcctgctgaggaggagcttgataaagatgctgtcaaacaaatgtttgctttgggtgctgccactctagggcatgtagagtcgcttgatgtgtatcagttttcaagcgagattgcaaaggctcgtctatctcttttccagaagcaagctgacatcactaagaaacaccgaggagatgcaaacattagatatgcatgggttcctgcgaagaaggaagtgttatctgccgtgatgatgcatggacttggagtgggtggagcattcattaaaaagtctatgtatggtgttggggttcacgctgcaaactgcccttatttcaggtttttattcgccctctatgccagttcctctctcatttagcctgccttatgctatttttgtttcactttatagttcatttgttttatggttttatctaagcacatgtgaaagatattgtttacagtgctagatactgtgatattgacgataatggtgtgcggcacatggttttgtgccgcgtaataatggggaatatggagcctcttcgtggtgataacacgcagtactttactggtggagaagagtatgataatggggttgatgatgttgagagtccaaagcattaccttatctggaacatgaatatgaacactcacatttacccagaatttgtagttagcttcaagctgtctatccccaatgctgaaggtgattaccatttgttatttctcctgtaatttccataaaaatcaactgatgacgcattgaatgggagacagcatatagatcttactgaagatcagctatttggatcctgaaatcttcctctataagttagaaaaggatccacatcaccttgtgacctctgggggtggtaaacatacttcatcatcccaagggtccagtgagatatccatggctaatatatatgggtatttcgatgatcacatttgttttctgtagtattcgaaacgggatgacatgttttgtttgtgcagggaatattcttcctactactcagagtaggcacgagagttcgggactcaccttggaaggacccaaaggttctccctcaaatgtaagttgaattgtacctgatcagattctcattttcaagcagtcattgttaatatttgatatggacacaaacgagtaatgttgcttgtttgtatgaagcaggagccaggaagggtatcaaatggaggttcagggagcgaaaagaatagctccagcagtagaaggcccagatctcctataatgcctttccctctgctgttcaaagcaatctcgagcaaaattgctcgtaaagacatggatttgataattgctggttaccaggaactcagggtaaataatataaaccatgtcttttaccaatagtcaaggttatcatattgtattaacataatcggtgtgctcttgcaggagaagaaggtgtcgagaaaggaattttataagacgctgagtatgattgtaggagatgatgatctgctgatatctacaataacaggccttcaaaggagtttgggttagggcgcgcc

SEQ ID NO: 309 - DNA, 1560 bp, Xanthomonas campestris
ttcttgtttgttgattaacccttaattaatccgggcgcgcctgatttatcacaagtttgtacaaaaaagcaggctcctgcaggaccatgagcgatgtccttccgatcattctttccggcggctccggcacgcgcctgtggccgttgtcgcgcgaatcgtacccgaagcagttcctgccgctggtcggcgagcacagcatgctgcaggccacctggctgcgctccgctccggtggcggcgcacgcacccatcgtggtggccaacgaagagcaccgcttcatggcggccgagcagttgcagcagctgggcgtgaagccatcggccatcctgctcgagcccaagggccgcaacaccgccccggcgattgcggttgccgcactggaagccacccgcaacggcggcgatccgctgctgctggtgctgccgtccgatcatgtgattcgtgacgaggccgccttccaggctgccgtgaccgtcgcggcagctgccgcagaacagggcaagctggtcaccttcggcatcaagccgaccgcgcccgagacaggctatggctacatcaaggccggtgtcggcaccggcgccactgcggtcgagcgcttcgtcgagaagcccgatctggccactgcacagggctatctggccagcggcgagtactactggaacagcggcatgttcctgttccgcgcctcgcgctacctcgaagaactgcgcaaattccagcccgccatcgccgatgcgtgccagaaagcctgggaaggcggcaagcgcgacgccgacttcacccgtctggacaaggatgcgttcgcctccagcccgtcggattcgatcgactatgcggtgatggaaaagactgccgatgcggtcgtggtgccgctggatgccggttggaacgatgtcggttcatggtcgtcgctgctggacgtctccgagcaggatggtcagggcaacgcgcaccacggcgatgtcatccagctggactgcaagaacacctacgcgtacggctcgcgcctgatcgccatggtcggcctggaaaatgtggtggtggtggaaaccgacgacgccgtgctggtcggccaccgcgaccgcatccaggaggtcaaggaagtggtcagccagatcaagtcggccggccgctccgaggcgacctggcaccgcaaggtctatcgtccgtggggcgcttacgattcgatcgacatgggccagcgttttcaggtcaagcgcatcaccgtcaagccgggcgccacgctcagcctgcagatgcatcaccaccgcgccgagcactggatcgtggtgagtgggacggccgaggtcacccgtggcgaagaagtgctgctgttgaccgagaaccagagtacctacatcccgctgggcgtgacccatcgcctgaagaacccgggcaaattgccgctggaactgatcgaagtgcagtccggcagctatctgggcgaagacgatatcgtgcgctttgaggatacctacgggcgtacctgactcgagacccagctttcttgtacaaagtggtgataaattggagctctgcagagctttcgttcgtatcatc

SEQ ID NO: 310 - DNA, 1721 bp, Arabidopsis thaliana
atggcgtcatcaaccgctttgatttgtgataccgaagcgtggaaggatttgaagggacatgtagaagatattaagaagactcatttgcgtgatttgatgagtgatgctaatagatgccagtccatgatgatggagtttgatgggttgctgttggattattctcgacagcgtgcaactgttgagacaatggacaagcttttgaacttggcaaaggcttctcaattgacagagaagatcagccgcatgttcaatggggagcatattaacagtacagagaacagatcagttcttcatgttgcgctccgtgctccaaaggatgcagttatcaaggctgatggaatgaatgtggttccagaagtgtggaacgttctagataagatcaaggaattttctgacaaaattcgctctggttcatgggttggagccactggcaaaccgctgaaagatgtcattgcgattggtattggtggtagcttcttaggtccactgtttgtccacacggctctccaaacagatcctgaagctctagagtctgctaaaggacgccagctgcgatttcttgcaaatattgatcctgttgatgttgctagaaatatcagtggactaaatccagaaactactctagttgtggtggtctcgaaaacgtttacaacagctgaaacaatgcttaacgccagaacattgagggaatggataacagctgctcttggggcttcagctgttgcaaaacatatggttgctgtcagcactaatcttgcgttagtagagaagtttggtattgacccgaacaatgcatttgcattttgggactgggttggtggaaggtacagtgtttgcagtgcggttggagtcttacctttgtctctgcagtatggcttctccatggttgagaagtttttgaagggagcttcaagcattgatcagcatttccagtccacaccgttcgagaagaatatacctgtgcttttagggttgttgagtgtatggaatgtatcatttcttggatatcctgctagggccatcttaccttattcgcaagcccttgagaaatttgctccacacattcaacaggttagtatggagagtaatggaaagggagtctcaattgatggtctacctctcccgttcgagactggtgagattgattttggtgaacctggaacaaatggtcaacacagcttttaccaactcattcaccagggacgcgtaatcccttgtgatttcattggcattgtgaagagtcagcaacctgtgtaccttaagggagaggtggtcagtaaccacgacgagctcatgtcaaacttttttgcacagcctgatgctcttgcatatggaaaaactcctgaacagctgcagaaagagaatgtttcagaaaatctcattccccataagacattctctggaaatcgaccttctcttagccttctacttccagaattgactgcttacaatgttggccagttgttggctatctatgaacacagagtagcagttcaaggctttgtgtggggtatcaattcgtttgaccagtggggcgttgagctaggaaaagttctggctactcaggtcaggaaacagcttcattcatcacgcactcaaggaaccgctcccgagggattcaattacagtaccaccacacttttgaaacgatatctcgagacaagttccgagccccagatgtgatgaccaagcccaagtttctctccttcgaccaaacgtga

SEQ ID NO: 311 - DNA, 375 bp, Arabidopsis thaliana
atggaggaagaagaagcgagacaagtggtgatcgacaatgatctgaagaagaagatcaaggaaacggtgaagaagatcctgaaacggtcgagtttacttgagattacagagattaaggcccgagaagaagcttcatctgagttgaatctcgatctttcgcgagatccgtacaaaatcatcgtcagagaagccgtcgatagtttcatcgagaaggcgattatgacaatcgatactgagatgggaaagcttcatactcagattgtagaagatgttgatggagaagtaaccgagaatgccacgaagacgactacgaagaagaaaaagaagaagaaggcaaagaagaaggtggaagaagaagagtcatcacctgcttag

SEQ ID NO: 312 - DNA, 501 bp, Arabidopsis thaliana
atggcgtttgtgacaactgcggaagtttgtgacgcgaatcaagagctgattcggagtggtcagctacgagctttgcaacccattttccagatttatggccgtcgacaaatattctcaggaccagttgtcactgtcaaagtttttgaagacaatggcttaatccgtcaattcatcgaggagaaaggaaacggtagagttcttgtggtggatggtggagggagtcaacgatgtgcaatactcggaggtaaccccgttgttcaagctcagaacaacggatgggcaggaatcgttgtgaacggatgcatcagagacgtcgatgagatcaacggttgtgatatcggagtgagagctttggcctctcatccgataaaagcgagtaagaaaggacttggagaacaacgagttccggtaaatatcgcagggactcggatttgtgatggtgaatggctttatgcagatactgatgggattcttgtctcccaaattgagttatccgtttaa

SEQ ID NO: 313 - DNA, 1569 bp, Arabidopsis thaliana
atgcctgccggtggattcgtcgtcggggatggccaaaaggcttatcccggcaaactcactccctttgttctcttcacttgcgttgttgctgccatgggcggtctcatcttcggatacgatatcggaatctccggtggtgtgacgtctatgccgtctttcctcaagcgattcttcccgtcggtgtatcggaaacaacaagaggacgcgtcaacgaaccagtactgtcagtacgatagcccgacgctaacgatgttcacatcgtctctatatctagcggcgctaatttcgtcgctggtggcttccaccgtgacaagaaagttcggacggcggctctcgatgctcttcggcggcatactcttctgcgccggagctctcatcaatggtttcgccaaacatgtttggatgctcatcgtcggtcgtatcttgcttggtttcggtatcggtttcgctaatcaggctgtgccactgtacctctctgagatggctccatacaaatacagaggagctttaaacattggtttccagctctcaattacaatcggaatcctcgtcgccgaagtgctaaactacttcttcgccaagatcaaaggcggttggggatggcggctcagtctcggaggcgcggtggttcctgccttgatcataaccatcggctccctcgtcctccctgacactcccaattcaatgatcgagcgtggccaacacgaagaagccaaaaccaagctcagacgaatccgtggtgtcgatgacgtcagccaagagtttgacgatttggtcgccgctagtaaagagtcgcagtcgatagagcacccgtggagaaacctcctccgccgcaagtaccgaccacatctcacaatggccgttatgattccgttctttcaacagctaaccggaatcaatgtgattatgttttacgctccggttttgttcaacaccattggtttcacgaccgatgcttctctcatgtccgctgtggtcactggctcggttaacgtggccgctacgcttgtttctatctacggtgttgacagatggggacgtcggtttctctttcttgaaggtggtacacaaatgcttatatgccaggctgtggttgcagcttgcataggggccaagtttggggtagacgggacccctggtgagctaccaaagtggtatgctatagtggttgtaacgttcatttgcatctatgtggcgggttttgcgtggtcgtggggcccactagggtggttagtaccgagtgaaatcttcccgttggagataaggtcggcggcgcagagtatcaccgtgtccgtgaacatgatcttcacgttcattatcgcgcaaatcttcttgacgatgctttgtcatttgaagtttgggttattccttgttttcgcctttttcgtggtggtgatgtcgatctttgtatacattttcttgccggagacgaaagggattccgatagaggagatgggtcaagtgtggaggtcacactggtattggtcaaggtttgtggaggatggtgagtatgggaatgcgcttgagatgggcaagaacagtaaccaagctggaacgaagcatgtttga

SEQ ID NO: 314 - DNA, 615 bp, Arabidopsis thaliana
atggagaaaagtaatgatcatgacaaggctagccacggcggctccggtggtggtgccacggagaagtgggaggagactagcctcggaatccgaactgccgagacaatgctccggttagctccggtgggcctttgtgttgcagcacttgttgtcatgcttaaggactctgagactaatgagttcggttcaatttcttactccaatctcacagcctttaggtacttggtgcacgcaaatggaatatgtgcaggctactctcttctatcagcagccattgcagcgatgcctcgttcttcttcgacaatgcctcgtgtttggaccttcttttgtctcgaccagcttctgacctacctggttcttgctgctggagctgtatcagctgaggttctatacttggcttacaatggagactcagccattacttggagcgatgcatgtagctcctatggcggtttctgtcatagagccactgcttctgttataatcacattctttgtggtttgtttctacatcgttctctctctaatctcctcttataagctctttactcgctttgatcctccttccattgttgactccgccaagaatctcgaagtcgctgtcttcggaagttag

SEQ ID NO: 315 - DNA, 838 bp, Arabidopsis thaliana
ttaattaaatgtcgtcaccagacattgtcggaattttggaaaacacgaaggaacttgatcggttaaggaaagaccaagaagaagttttggttgagatcaataagatgcataaaaagcttcaagcttctcctgagatagttgagaagcctggtgatatttcattagcaaagcttaagaatttgtacattcaagcgaaagagctctcagaaaatgaagtaaccgtatcgaacattttgcttactcagttggatttgctgcttccatatggaccaacagggcagcaaagaagaaagttaggcgtggtggcagaaggtaatgatcagaagaggaagaggatgaaagttgattcagatgtaataagactttctccttccatgagaaatcaaatcgaagcatatgcaagtcttaagggtgaacaggttgctgcaagagttactgcagagagtgctgataaggatgaatggtttgtggttaaagttattcacttcgatagagaaacaaaagaagttgaagtacttgatgaagaaccaggagatgatgaagaaggaagcggtcagaggacctataagttgccaatgttatgcattttaccattcccaaagcgaaacgatccttcgaacacccaagagtttccaccgggtaaacacgtcttagctgtatatcccgggacaacagcactctacaaagcaactgtagtaagtaccccacgaaagaggaagtctgacgagtatttgcttgaattcgacgatgatgaggaagatggagcattgcctcaaagaacagtacctttccacaaagtggtagctttaccagaaggtcatcgccagtgaggcgcgcc

SEQ ID NO: 316 - DNA, 1224 bp, Arabidopsis thaliana
  misc_feature (1071)..(1085): n is a, c, g, or t
cgcgtccgctcactgtccccttaattaatccatgtcttcaacacaagaagcgtctgttactgatttgcccgtgaagagacctagagaagcagaggaggacaataacggcggcgccatggaaacagagaacggtggaggagagataaaggagccttcttgtatgtcctctattattcctggatggttctctgagattagtcctatgtggccaggagaagcacattctctcaaggtagagaagattctattccaagggaaatcagattaccaggatgttattgttttccagtctgcaacatatggaaaggttttggttttggatggagtgattcaactcactgagagagatgaatgtgcgtatcaagaaatgatcactcatcttcctttgtgctctatctccaaccccaaaaaggtactggtgattggaggaggagatggaggagtcctgagggaagtggcacgtcatagttctgttgagcagattgacatttgtgaaatagataaaatggtggttgatgtggctaagcagtatttccctaatgtagcagttggatacgaggatcctcgtgtcaacctcatcattggcgatggtgttgctttcttgaagaacgctgctgaaggaacctatgatgcagttattgttgattcatctgatccaatcggtccagcaaaagagctatttgagaaacctttctttgagtcagtgaatagagctcttcgtcctggtggagttgtgtgcacacaagctgaaagcttgtggcttcacatggatatcattgaagacattgtttctaattgccgtgacatctttaaagggtctgttaactacgcttggaccagtgttccaacttacccgagtggagtcattggattcatgctttgttcatctgaaggaccacaagtcgatttcaagaagccagtgagtctaatcgatactgatgaaagctctatcaaatcacactgtcccttgaagtattacaacgctgagattcactcagctgctttctgcttgccctcttttgctaagaaggtgattgattcgaaagccaactagaaggcgcgccaaaaatnnnnnnnnnnnnnnnaacttcatgtggaagtgataatatgatgatacaatgatcctttggaaaaaaataaagaagttttaatttttagaatgtaatgttctttcacctgcaatgttatgtgactgcactgagctatcaatctctttttataagc

SEQ ID NO: 317 - DNA, 1561 bp, Arabidopsis thaliana
ttaattaaatgaaaatgatgatgatgatcatacttctcttatgctcaataatactcataaccattctcttcttcaaaaaacagtcgagagggaagaagagcaacgcacctccatcaccaccgagacttcctctgataagaaaccttcatcagctcgggcgccaccctcaccgatcattatgctccctcagccaccgttacggtcctctgatgctcctccactttggcagtgtccctgttcttgtagtctcctccgcagatgcggctaaagacgttttgaagacgcatgaccgcgtttttgctagccgtccacggtcaaaaatctttgataagattttttacaacgggcgagatgtggccttagctccttatggagagtattggaggcaaatgaaaagtgtgtgcgtcctccatctctttagtaacaaaatggtacgatcctttcgagacgttagacaagaagagatcagcctgatgattgagaagatccgaatatcgagttctttgcggataaatttaagcgagatcctggtgaatcttacaaacaatgtaatatgtagagttgctttgggacggaaatacggcggtaagaccgattttaaagacttaatgaaaaggctaacgaggctactaggcgagtttagtgtcgggagttatgtatcgtggctcgcatggattgactggatccgcggtttggatggtcaacttataaagataagcaatgatcttgatgaattcttggagagggttgtccaagatcatgtagatggggatggacacaagaatgattttgtggatttcttgctcacaattgagagagagaagagcgttgggtttgaaatcgaccggttaagcataaaagcaattatcttggtaaagggaagatacgaaaacaaatttaaattcactgatgagttagtatataaccatagttcttgttttggttttcaggatgtttttgtgggtgatatggacacaacatacactcttttggaatgggcaatgacagagctactatgccaccatgagtgtctagacagactccaagaagaagttcgtatggtttgtaaagacaaatcgggtgtatcagaagacgaccttcaagacatgaaatacttaaaagctgtgattaaagagacactaaggctacatcctccacttccattgatggttcctcacgaatcaacacatgatgtcaaattaagagactatcacatacctgccggtacacatgtaatgatcaatgcttgggcaatcgggagagaggctgcgacatggggaccagacgcggaagagtttagaccagagagacatttgaattcgtatgttgattaccgaggtcaggatacggagctggtcccgtttggagcagggagaaggatttgcccagcaatatcatttgctgtggtattggatgaggtggttttggctaacttagtgcatcagtttgattggacactaccggaggaatctacagaatatcagactgatgtcgctgaatcaaccggtatggcggttcatcgcatgttcccactcttcgccatgactacttgaggcgcgcc

SEQ ID NO: 318 - DNA, 3101 bp, Arabidopsis thaliana
cccttaattaagatgccatcgatgcttgttctcgtcggcacaatgccgtccttggcttctctggttagtctaggtggtgcttgtgcaagcgtttctggaacgagttcttcggatgcatcgtatgctttagttaagagggtttctttgtcaaggagaagtgttaaggggactaagaaatggctgtgtagatattctgtttcgtcttcaactactactactactgctgacttcattgctgaccaaaacaacaactcagtttctatagattctaactcgtttagggggagtaaagatggggatgatagtgaggttgtgctgaagcagactcctaaacctgtcttgaaaccccctgtggcaagggtagaaagaggtttgggggtgaatactgctccttggagtaaagatttgtcgaatgggggtaagtttgatggagaagaagagaggaataaggttattgaatctcttggtgaagttttagataaagctgagaagttggaaattccgaaaccgggtaacaaagagggtggtgaggctgttaagccgtcacagcctagtgccaacagtagtaactcaagaaatggtagctatgcgaatgcgagtgatggaggaacaaggaagacgaaaaccatgaagagtgtgtggcgtaagggcgatgctgttgctgctgtgcaaaaagttgttaaggaatcacctaaaatttttaatagaggagtgcagaccgaacctagaacgagagaagagggagaggtgaatgccaaagcaggcactccattggcaccacctcagccaccttttagacctcaaccgcctgtaagaccccagccaatgttacaagggaagcctatggtagctccacccgtaaagaaatcacccatcttaaaagatcttggtatggcagcaaaacctttagtttctgaagaagttgattctagcgttaaaagtaaagaaaggaagcctattttggttgacaaatttgcttcgaagaaaaaaggtgttgatcctgcggcctctcaggctgtgttagctcctactaagcctggaaagggtcctccctctaacaagttcagagttgagcaccgtaataaaaaaaatgcatcagctagtccaagacgaagaattgttgctgaagacgacggcgacgatgatgcatccatttctcgatcaggtagaaaagggagaaaatggagtaaagctagtaggaaggctgtaagactccaggctgcaaaagacgcagcacctgtcaaagctgaaatcttagaggtagaggaagaaggcatgtccatcgaggatttggcttacaacctagccatcggagaaggtgacatccttgggtacctatattcaaaagggattagacctgatggtgtgcacactttggaccgcgagatggtgaagatgatttgtagagattacgatgttgaggtccttgatgctgattcagttaaagtagaagagatggcaaagaaaaggcaaacttttgatgaagaagatttggacaagttagaggacagacctcctgtcataacgataatgggtcatgtggaccatggaaagaccactcttctcgactatatcagaaaaagcaaggttgctgcgtcagaagcaggaggaattacacaaggaattggtgcatataaggtgtcagtgcctgttgatggaaagttgcagtcctgcgttttccttgatactcctggacatgaggcatttggtgcaatgagagctcgcggagcacgagtcactgacattgcaatcattgtggttgctgctgatgatggaattcgtcctcaaacaaatgaagcaatagctcacgcaaaggctgctgctgtaccaatagttatagctataaataagatagataaagaaggagctagtccagatagagtgatgcaagagctttcttcaattggtttgatgcctgaagattggggtggtgatgttccaatggttcagatcagtgctttgaaaggggaaaatgtcgatgatctgttggaaactgtcatgcttgttgcagagcttcaagagttgaaagcaaatccacacagaaatgccaagggcattgtaatcgaggctggacttgataaagcaaaaggaccatttgcgacgttcattgttcagaaggggactttgaaaagaggggatgttgttgtttgcggagaagctttcggaaaggtacgagctttatttgatcacagtggggaacgagttgatgaagctggaccctccatacctgtacaggtgattggtttaaataatgtccccattgctggtgatgaatttgagatcgtctcttcccttgatgtggcgcgggagatggcagaggcacgtgcggtatcactacgagatgaaagaatatctgcaaaggctggggatggaaaggtcacgctttcctccttagcttctgctgtatcagcgaaaaagatgtcaggcttagatttgcatcagcttaatatcatcttgaaggtcgatgtacagggatccattgaagctgtaagacaagcccttcaagtcctccctcaggagaatgtcaccttgaaattcttgctacaagcaacaggggatgtgagcaacagtgatgttgatctagcatcagcgagtgaagctatcgtttttggatttaatgtcaaagcgtctggttctgttaagaaagctgcagaaaacaaaggtgttgaaatccgactatatagagttatatatgagcttattgacgatgtgcgaaacgcaatggaaggacttcttgagtctgttgaggaacaaatcccaattggctcagcagaagttcgagctactttcagcagtggaagtggtcgtgtggctggatgcatggtgaatgaaggaaaatttgtcaaagattgtggcatcagggtggtccggaagggtaaaactgtccatgtcggtgttcttgattctcttaaacgggttaaagaaaacgtgaaagaggtgagtgctggattagaatgtggtattggtatggatgactacgatgattggatagaaggagacatcatcgaggcctttaacgcagttcaaaagaggcgaacgctagaagaagcatcagcttcaatgtctgctgcgattgaagaggctggagtttaaatttaaat

SEQ ID NO: 319 - DNA, 916 bp, Arabidopsis thaliana
ttaattaaattgagggaatcgaatcgagttatgtacaaggatcggagtggaggaggaataatgggtggtggtggatcatcgagatcggagatccttggtggagctattgatcggaaacgaatcaatgatgctttagacaaacatcttaagaaatcttcaccttctacatctagggttttcacttctaaggacaaagattctgtcccttctacttcaactgctaaatctcagcttcattctcgttcccccgatgttgaatctgacacggatagtgaaggatcagatgtgagtggttcagaaggtgatgatacctcttggatctcatggttttgtaatttgagagggaatgagtttttctgtgaagtagatgaagattatatacaagatgatttcaatctctgtggtttgagtggtcaagttccttactatgattatgcacttgatctcattttagatgttgaatcatcaaatggtgatatgtttactgaagaacagcatgagatggtggaatcagctgctgagatgttatatggtcttattcatgttcgttatattctcactactaaaggaatggctgctatgatggagaagtataagaattatgatttcgggagatgccccagagttttctgttgcggacagtcttgtcttccggttggccaatctgatatcccgaggtcgagcactgtgaagatatactgcccaaaatgcgaggatatttactacccgcgatctaaataccaaggcaacattgatggagcttactttggaactactttccctcatttgtttctcatggcctatgggaacatgaaaccgcagaagccggctcaaaactacgttcctaagatctttggctttaaggtacacaacaaacaatgatactctctcctctcaacagtcttgtgggcgcgcc

SEQ ID NO: 320 - DNA, 1501 bp, Arabidopsis thaliana
ttaattaacgatggaaacccaaacacacgttttgtttctcttcctactcatcactctattgttaaacaccaccaacaaaacccaagcaagacaacataaaaaccctagttcctcctcatcttcctttcttgtccttaccttgaccaaatcaagtgtttctcttcccacaccaaagtctcaaacccaagaaaggatcaagaagccattatcatcagtagatgttgtaatggaacccttgagagaagtgagagatggttatttgataaccttaaacattggaacacctccacaagcagttcaagtgtacttggacacaggaagtgatctcacatgggtcccatgtgggaatctaagttttgattgcattgaatgttatgatctcaagaacaacgatctaaaatcaccatcggtcttttctcctcttcattcatctacatcttttagagattcttgtgctagttccttttgcgtcgagatccatagctcagacaatccttttgacccttgtgcagtcgccggctgctctgtgagtatgcttctcaagtctacttgcgtaaggccttgtccttcctttgcttatacttatggtgaaggtggtcttatctctgggatactaaccagggatatactgaaggctcgaactagggatgttccaaggttttcttttggctgcgtaacgtccacttaccgggaacctattggcattgctggatttggaagaggtttactctctctcccttcgcaactaggctttcttgaaaagggattttcccattgtttcttgcctttcaagtttgtcaacaatcctaacatctctagccctttgatcctaggagcctctgctttatcgataaatctaaccgactctttgcaatttactcccatgttgaatactccaatgtatcccaacagctactacatcggtttagaatcaattacaataggcacaaatatcactcccacacaagttcctttaaccttaagacaatttgattcacaaggaaatggaggaatgttggtcgattcgggtacgacttacacacatttacccgaacctttctactcacaactcctcacaactctccaatcaacaatcacatacccaagagccactgaaactgaatcaagaacaggctttgatctctgctacaaagtcccgtgtcctaacaacaatctcactagcctcgaaaacgatgtaatgatgatatttccttcaattacattccatttcttgaacaatgcaaccttacttctcccgcaaggtaactctttttacgcaatgagcgcccctagcgatggttccgtggtgcaatgcttgttgtttcagaacatggaagatggagactacggaccggccggagtttttgggagctttcagcagcagaatgtgaaagttgtgtatgatttggagaaagagagaattggcttccaagctatggattgtgtcttagaagctgcttcacatggactcaaccaaggctcatgaacaaaaaggcgcgcc

SEQ ID NO: 321 - DNA, 1253 bp, Arabidopsis thaliana
ttaattaattgaatttttatacgatgatgtttcaatatggaagaaactagaggaatttctgatccagagaatgggagttcgagttacggcggtaaaccgccgaatccactctccttctcttcttcctccgccgctgctgccgtttacaggcaaaccttcgacggcgagcgatcgttggcgccgtgtaataagaggtcactggttcgacactcatctctcgtgaagacaatggtgtcagatatatctgttgagaatgagtttactatagagaagaacaagtctgagtttgttcctgctacgcgttctggagcttggtctgatattggctccaggtcaagcatggaagatgcttatctatgcgttgataatttcatggatagctttggccttctgaattctgaggctggtccaagtgccttctatggggtatttgatggacatggtgggaagcatgccgctgagtttgcatgtcaccatataccgaggtacattgttgaagatcaagagtttcctagtgaaatcaataaggtgttatcttcagcatttcttcaaacagacactgccttcttagaggcgtgttcattggatgggagccttgcttcaggaactactgctttggcagctattctttttggaaggtcgttggtggtagcaaacgctggagattgcagagcagtcttatcccgtcagggaaaagccattgaaatgtcaagagaccacaaacccatgagcagtaaggaaaggagacgcattgaagcatcgggtggacatgtattcgatggctatctaaatggacaacttaatgtggctcgagcgctaggtgactttcatatggaaggcatgaagaagaagaaagatggttctgattgtggacctctaattgcagagcctgagctcatgacaacaaaactaacagaagaggatgagttccttataattgggtgtgacggggtttgggatgtgttcatgagccagaatgctgtagattttgccagaaggagactacaggagcacaatgacccggtcatgtgtagtaaggagctggttgaggaagctttgaagaggaagagtgctgataatgtgacggcagtggttgtgtgtcttcagccacagccaccaccgaacttggtagcgccgaggttgagagttcacagaagcttctcggcggagggtttaaaagatttacagagctacttggatggcttgggaaactaattgggggacatgaggatggtgacgaatgatggcgcgcc

SEQ ID NO: 322 - DNA, 1593 bp, Arabidopsis thaliana
ttaattaagtgtaaaccaagctcctaactctctcatatggcttctgtaagcttacttgacgttgccatagccatcatttgccttttcttcttctattacatgtacttcaagaaacctcatggtcaggtttttcgaaactggccagttattgggatgcttccaggcttcctgatggttctccaccgcatctacaacttcggcgtggaggctcttgaaatgagccacttaacctttctatttaagggaccgtggttcgctgaaatggatatgttgttcacagttgatccagctaatattcactacatattgagctcaaacttctccaactataccaaaggtgccgactttaaagaagtctttgatgtttttggagaaatgatctttagttcggactcggagctatggaagaatcaaagaaaagctgctcaattcatgcttaatcatcaaggctttcaaaagctatcattgagtgcaacgaggagtaagctttacgatggtcttgttcctcttttcaatcaatgttgtgaggaagagaaggtcgtggatttgcagcaagtgtttcaaagattcacttttgatacaactttctttattgttaccgggtttgatcctaaatctctctctattgaaatgccggaagtggagtatgctaaagctcttgacgatcttggagaagggattttttataggcacattaaaccgaagttcttctggaagctgcaaaaccggtttgggttagggcaagagaagaggatgactgaagctgatgccacttttgatcgcgtttctgcgaaatacatattagctaagagagaagagataaggtcacaggggattgatcatcatgcaaatggtgaaagtgaggatcttttgacatctcacataaagcttgatacaaccaagtacgagctcttgaacccgagtgatgataagttcctcagagacaccatcttagctttcaatcttgctgggagagacacaacgtcttctgctctctcttggtttttttggcttctctctgaaaaccctcaagttgtaacaaagattcgtaaagagatcatcgacaaaaatatttcaaaagacggaagaaatggccaagagaacttagacaagttggtctacttacatgcggcgttgtatgaatcaatgaggctctatccaccggttgccttccaacgcaagtctcctataaagccagatgtgctgccaagtgggcataaggtagaagcaaactcagtcatcataatttttcttttcgcgttgggaaggatgagagcggtttggggagaagatgcaacagagttcaagccagagagatgggtttctgagtccggtgggttgagacatgcaccttccttcaagtttttatcatttaacgccggtccgagaacttgtcctggtaagcaattagctatgactctaatgaagaccgtagttgtggagatattacaaaactatgatattgatgttatcaaaggacagaagattgagccagaacctggtcttatgttgcacatgaagcatgggcttagagtcacaattactaagagatgttcagcttgaaatttgtatgtataatgcttaaggcgcgcc

SEQ ID NO: 323 - DNA, 859 bp, Arabidopsis thaliana
tttaattaaaaaaacccttcaaaacatttccttattctttcttcttcatctacaacaatggctggagttgcctttggttcctttgatgattcattcagcttggcttctctaagagcttacctcgctgagttcatctccactttactctttgttttcgctggtgttggctctgccattgcctacgcaaagctgacgtcggacgctgctcttgatacaccgggactagtggccatcgcggtttgtcatggttttgctctcttcgtggccgttgcaatcggagccaacatctccggtggccatgtgaacccagccgtcacttttggtcttgctgtcggtggtcaaatcacagtcatcaccggagttttctactggatcgctcagcttctcggctccaccgccgcttgtttcctccttaaatacgtcaccggtggattggcggttccaacccacagcgttgcggctggactaggatcgatagaaggagtagtgatggagatcatcatcaccttcgctttggtctacactgtctacgccaccgccgctgatcccaagaagggttctctcggaaccatcgctcctctcgccattggtcttatcgttggtgccaacatcctcgccgccggtccattctccggtggatccatgaacccagcacgttcctttggaccagctgttgctgccggagacttctctggtcactgggtctactgggttggaccactcatcggtggtggacttgccggacttatctacggaaatgtcttcatgggttcttccgaacatgttcctcttgcttctgctgatttctaaggaaacaagtgatgattcttgattcatgtttctgtgtttggatttaaat

SEQ ID NO: 324 - DNA, 1625 bp, Pseudomonas fluorescens PfO-1
aaaaaagcaggctcctgcaggaccatgactaccacgcctaaacctttggtcctgatgattctcgacggcttcggtcacagcgacagccccgagtccaacgccgtctatgcggccaagaagcctgtgctggatcgcctgtgggccaccgtgccgaacggcttgatctcgggcagcggcatggacgtcggtctgccggacggccagatgggcaactccgaagtcggccacatgaacctcggcgccgggcgcgtggtgtatcaggacttcacccgtgtgaccaaagcgatccgcgacggcgagttcttcgagaacccgaccatctgcgccgccgtggacaaggccgtggctgccggcaaggccgtgcacttcatggggctgctgtcggatggcggcgttcacagccaccaggatcacctgatcgccatggccgaactggccttcaagcgcggcgccgaaaaaatctacctgcacgccttcctcgatggccgtgacaccccgccgaaaagcgctgcctcgtcgatcgaactgctcgacgcgaccttccaggcgctgggcaagggccgcatcgccagcctcattggccgctactacgccatggatcgcgacaaccgttgggatcgcgtggcccaggcctacaacctgatcgttgatggcaagggcgaaatcaacgccgccaccgcccaggaaggtctggaagccgcttatgcccgtggcgagagcgacgaattcgtcaaagccaccagcatcggcgagccggtaaaagtcgaagacggcgacgccgtggtgttcatgaacttccgcgccgaccgtgcccgcgagctgagccgcgtgtttgtcgaagacggcttcaaggaattcgagcgcgcacgccagccaaaagtgcagtacgtgggcctgacccagtacgccgaaagcatcccggcccccgccgccttcgcgccgggcagcctggaaaacgtgctcggcgactacctggctaaaaacggcaagacccagctgcgcatcgccgaaaccgagaaatacgcccacgtgaccttcttcttctccggtggccgcgaagaaccgttcccgggcgaagagcgcatcctgatcccgtcgccgaaagtcgccacctatgacttgcagccggaaatgagcgcgccggaagtcaccgaccgcatcgtcgaggccatcgagaaccagcgttacgacgtgatcgtggtcaactacgccaacggcgacatggtcggccatagcggcgtgttcgaagccgcggtgaaagccgtggaatgcctggacacctgcgtaggccgcatcgtcgaggctctggaaaaagtcggcggtgaagcgctgatcaccgccgaccacggtaacgtcgagcagatggctgacgaatccaccgggcaagcgcacaccgcacacaccaccgagccggtaccgttcatttatgtcggcaagcgcgatctgaaagtccgcgaaggcggcgtgctggcggacgtggcgccgaccatgctgaaactgctgggtctggaaaaaccggcggaaatgactggcacttcgattctggtctgatatcaaaaacgccctgtaatcagcctgaaacggctttttatgacgaacctcgagacccagctttcttgtacaaa

SEQ ID NO: 325 - DNA, 3199 bp, Sinorhizobium meliloti
aaaaaagcaggctcctgcaggaccatgatggaggctgttcccatgaatgtagacctctcacggcgcagctttttgaagctggctggagcaggggctgcggcaacgtcactcggtgcgatggggtttggtgaggctgaggcggcggtcgtcgcgcatgtccggcctcacaagctgacgacgaccaccgaaacgcgcaacacctgtccctactgttccgtcgcctgtggcgtcatcatctattcgaagggcgacctccgcaagggtgaggctgccgacatcattcacatcgaaggcgatgcggatcatccgaccaaccgcggtacgctctgtcccaagggggcggcgctcaaggacttcgtgaagtccccgacccgtctccagtatccgatgcaccgcaagccgggctcggataagttcgagcgtatctcttgggaggatgctttcgaccgcatcgcacggttgatgaaggatgaccgcgacgccaatttcatcgcggcgaatgccgcaggcgttccggtcaatcgctggacgacggtcggcatgctcgccgcgtcggcgaccaccaatgaaacggcttgggcgaccttcaaattcgccaaggctctgggaatagtcggtttcgataatcaggcgcgcgtctgacacggccctacggtgtccagtttgggcccaacatttggccgtggagcgatgaccaactcctggaccgacatcaaaaataccgacctcgtagtcgtcatgggcggcaatgcggccgaagcgcatccctgcggcttcaaatgggtgaccgaggcgaaggccacgcggggcgcgaagctgatcgtggtcgatccgcgctatacccgcaccgcgtccgtatccgactattacgctcccatccgtcagggaaccgacatcgccttcctcaacggggtgatgaagtattgcatcgacaacgacaaggtgcagtgggactatatgaaggcgttcaccaacgcctcctatctcgtcaaggacggcttcggctaccaggacggcctcttcacgggctacgacgcggaaaagcgcgactatgacaagtcgacgtgggactatgtcctcggcgacgacggcttcgtcgtgactgacccggcgctccagcacccgcgttgtgtctggaatctgctgaaggcgcacctcgccccctatacgccggaaatggtggaacggatctgcggcacgcccaaggacaagttcctcaaggttgccgagatgatctcggaatgctcgtctccgacaaagacgatgacgtcgatgtatgcgctcggctggacccagcattccagcggttcgcaaaacatccgcgccatggccatgctgcagctcatcctcggcaatatcggcgtgcgcggcggcggcatgaacgcgcttcgcggccactccaacatccagggactgactgacctcggtctaatgtcgcatctgctcacggggtatctgacgatgccgacggaaaaggacgtggatttcacgacctatatgtcgacacgccagttcaaaccattgcgtccagggcagacaagttactggcagaactacaggaagttcatggtctccttccagaaggctatgtggggggatgccgcccggatcgacaacgactgggctttcaattacctctccaagctcgacgtgccggcctatgatgtgcttcgcgtgttcgagctgatgtatgccggcaaggtcaatggctacatctgccagggcttcaacccacttcttgccttcccgaaccgggacaagaacaccaaggcgctgtcgaacctgaagtggctcgtcacgatggacccgctcgacacagagaccgcacggttctgggaaaaccatggcgacttcaaccctgtcgataccgcatccatccagaccgaggtgttccagctgcccacgacctgctttgcggaggaagagggctcgctgacaaactcgggccgatggttgcagtggcactgggcaggtggaacaccccccggcgaagcaaagcacgacacttacatcgtcgcccagatattcctcaggatgaaggagatgtatcgcaacgagggtggcgcgttccccgatccgatcctgaacttgtcatgggactatgccgatccgaacgaacctacgccggaggagctggcgaaggaaatcaacggtcgggcactgacggacctcatggatcctgccaacccgatgaaggtgcaggtcgcggccggcaagcagatcctgaacttctcgcaactcagggacgacggttcgaccatgtgtggttgctggatctattccggcaacttcaacgagcagggcaacaatatggcccgccgcgacaaccacgatccggacgacactggcgcttatctcggctggtcattcgcctggccgcttaatcgccgcacgctctacaatcgtgcttcggccgatttgcagggcaagccgtgggatccctcacgtaagctgctcgagtgggatggcacgaagtgggcgggctacgatgtgcccgatattgctcctacggcaaagccggacgaaatcggcccgttcatcatgaaccaggaggggactgcacgcctgttttcacgcggtttgatgcgggacgggccgttcccggcccatatggagcctttcgaatcccccgtcgccaacgtcttcaatccgaagatgcggggcaacccggtcagccgcgtctttcagacggacgtggcgcagatggggctgtcggacgagttcccttacgcggctacttcctaccggctgacggaacacttccactactggaccaagcataaccgcgtgaattccgcgcttcagccggaattcttcgtcgagatctccgaggaactggcagaggagaagaatatagaaaacggcggctgggtccgggtgtggtcgaagcgtggttcggtcaaggcgaaggcggtggtgaccaagcgcatccggccgctgatgtgcgacggcaagccggtccatgtggtgggcatcccgcttcactgggggttcaccggctcggcgaaaaagggcctcggccccaactcgcttgcgcctttcgtcggtgacgccaatatcgaaacgccggaatacaaagcattcctggtcaatatcgaaccatcgacggcgcccgaggaggctacagtatgatggacagtcctcgcaccgccgtcagcaatccgccggtttagctcgagacccagctttcttgtacaaa

SEQ ID NO: 326 - DNA, 528 bp, Arabidopsis thaliana
ttaattaaggattaatgtctcaatcacttttcaatctcaaaagtttatctcgctcgatcaacaacacaatcagaatgtaagtctatccatttgtataaaccttatggttttagaaaatactgtatattggttaattcttttgaatatgttgcgttgtaaactaaatgagaattcttttttttttataaatattattctaggagaagatacattgtgatcacaaaagcctctcaaagggcatatacaattggaagtagtcaagagaagccatcgtgggcatcagaccctgataccggatactttagacccgagaccgctgcaaaagagttagatccatacattgcaaaaacctctcaagttcaaggtaaaatgatgagaggagaagagttatggtggatgcctgatcctcagaccggatactatagaccagacaattttgccagagagcttgacgcagttgagctacggtctttgcacttcaacaagaatcaaaagacgtacgtagtgagctaaaggcgcgccaaaaat

SEQ ID NO: 327 - DNA, 2287 bp, Nostoc punctiforme PCC 73102
ttcttgtttgttgattaacccttaattaatccgggcgcgcctgatttatcacaagtttgtacaaaaaagcaggctcctgcaggaccatgtatgtagctgtatggcctgggaatgtatatcccttgggtgctaattgggatggaaaaggtacaaattttgctttgttttcggaaaatgcaacaggtgtagaactttgtttatttgatgctgataatcatgaaattcgcttgcctttaacagaaaaaaataattttgtttggcacgcttatctaccaggagtaggtcctgggcaacgctatggatttagagtacatggcccttgggccccagaacttggtcatcgctttaaccctaataaactattaattgatccctatgccaaggcaattgatggggaaattagcgataccgcagctatttttggctactctttagatgcgccagagcaagacctagctttttccgatttagataatgccgaaattatgccgaagtgtattgttgtcgatcagtcttttgattggggagatgacaaactactttctataccgtggcacgaaactattatttatgaaactcacgttagaggttttactaaattacacccagaaattccagaagaattacgtggtacctatgcagggctggcacatccagttgctattcaatatctacaacaactaggaatcacatctgtggaattgatgcctgtgcatcactttttatcttctccaggatttctggtaaataaaggactgaaaaactattggggttacgattccattaattatttcaccccctattctggttacagtgctaatggctcagtcggacaacaagtgaccgagtttaagcagatggtcaaggacttacactctgctggcattgaagtaattttagatgtagtttataaccacactggcgaaggcaatcatttagggccaacattatcgctacgaggcatcgataatgctgtgtactatcgcttggtcaaagataattctcgctactacatggacttcacaggctgcggcaactctctaaatgtgcgtcatgcccaagttctgaagttaatcatggatagcctgcgctattgggtaacagaaatgcatattgatggctttcggtttgatttagcttcggcattagcgcgagaactatatgaagtagatagtctcgcagctttttttgatattattcatcaagatccagttctggcagatgtaaagctaattgctgaaccttgggatttaggagaaggtggttatcaagttggcaattttcctttacgttggtctgaatggaatggcagatatcgtgatactgtaagggatttttggcgtggtgaggatgatagcctcggacaatttgcttactgttttactggtagccctgacctttaccaagcaaacgggcgtaatcccagtgccagtattaatttcatcactgctcatgatggcttcacgctcaatgatttggtcagctataacgaaaaacataatcaggacaacggcgaagatagccgggatggggaaagccataaccgctcttggaattgtggtgtagaaggagaaactaatgacccagatgtaatccgcttacggcaacgtcagcgacgcaactttttagcaactctaatgttgtctcaaggcatacctatgctattaggaggagatgaaattggttgcactcagaagggtaacaacaatgtatactgccaagataatgaaattgcctggcgtgattggagtttacaaaagtctaattccgaactactagattttgcccgcgaactgatttattttcgtcatcagcatccagtatttcggcggcgtaagtggtttcaaggccgtcctattcacggttttgggatcagtgatattggttggtttaatgacgatggcagcgaaatgactgaaaagcagtggctagttagttatgccaaagctatggaaattttcttgaatggcgaaggcattgttactcctggccgccgtggtgaacggattattgatgaaagctttttgctattttttaatgctcactacgaaacgattgagtttgctttacccaatgttttccaggatagggaatgggaaatagttattgacaccaacgaacctcgcttccttagcccaggaaagttggttatgggtgagcaaactgtgccagttacagatcgctctctcatagtgttacgtcgtcttgcttcataactcgagacccagctttcttgtacaaagtggtgataaattggagctctgcagagctttcgttcgtatcatcg

SEQ ID NO: 328 - DNA, 1798 bp, Arabidopsis thaliana
ttaattaatcatcgtagatttgtttgaaattcttcaaattgagccggtatcaagacatggcgggaagtgaagcggtagaagataaggagataaaatcggcggtttcaagctgtgaagcgtatttcgagaaagtacaatcaaggaagaatctacccaaatctcttcaagaaaccctaaactctgctttcgccggaatcccagtctcctccttccctcaagtccccggcggcagaggtaaaaattagaaagatcccatttttttcgattcctccaaatttcctgatttctcgtttaaagtttgagacttggcaatggtttagattcaattagtgttttgtttgatcgtagtgatagagattcaagcggaaacacctgtatcagaagcagtaaagatcttatcagatagcaagattctatcagctcctgtgattaacacagatcacgagagttctttagattggagagaaagatatttaggaatcattgactactcttcaatcatcttatgggtgctagagagtgctgaactcgctgcaatcgcgttgtccgctacgtcagcaactgctgctggtgttggtgctggagctgttggagctcttggtgttgcagcgctcgggatgaccggtccggttgctgctgcggggctagccgcagctgcggttggagccgcggttgctggtggtgttgcagctgaacgtgggattggaaaagatgctccaactgctgctgataagttggggaaagatttctatgaagttattcttcaagaagagccttttaaatcaaccactgtaagttttttaacagaacattaagttatttgtgttgtgatggtcctgattgatcatggatatatgtttatgttgtcaggttagaacaatacttaagtcgtttagatgggctccttttcttccggtttcaacagagagttcgatgttgagtgttatgttgttactctcgaaatatcggttaagaaatgtgccggttattaaaacaggagaaccggatatcaagaactacgttactcaatctgcagttgttcatggtcttgaaggttgcaaaggtagagattggtttgatcacatttccgctctcccgatttctgatctcggcctcccgtttatgtcacccaatgaggtaataaaataaactttaagaagtcatgacattaggctcgtaaaccggtgaaattgaacatgttggtttcaggttattagcattgagagtgaggaacttatccttgaagcatttaaaaggatgagagacaacaacattggtggtctccctgtagttgaagggttgaataagaagattgttggtaacattagcatgagagacattagatatttgcttttacaacctgaagtcttttccaatttcaggtttatttttactcacttgtttctcattacaacttctctggtaacaatgatgactgaatgatctctttgttgatgataaagacaactcacggtgaagagtttcgcgacaaagattgctacagcgggagaggaatacggtttagcgattcctgcaataacttgtaggcctgattcgactttagggagtgttataaacagtttggcttcgaggtcggtgcatcgggtttatgtagcggctggagatgagaatgagctttatggggttataacactgagggatgtgatctcttgtttcgtatcagaacctccaaattactttgagaactgtctcggtttctcggttaaggaaatgcttaaccgatgatctcttgtttctcagcttttttttggctttgttgtttgttctttggcgcgcc

SEQ ID NO: 329 - DNA, 1153 bp, Arabidopsis thaliana
ttaattaaatggaaacaagaaacgagacaaaagcttcaccggaaaacaacctcagaaacagaggagctgatggaaacaatagcaagaaagacatgattttccgagctgataagattgatttgaagaatttggatatccagctagagaaacatctgagtagggtttggtcaagaagcattgagaagcaccctaagcctaaggaggaatgggaaattgaattggctaaattagagatgaggaatgtcattgctcgtggtgcttatggtattgtctacaaaggcatatatgatggtcaagatgttgctgtgaaagtacttgattggggagaagatggttacgcgacaacggctgagacatctgctctacgtgcttcatttcgtcaagaagttgcggtttggcataagcttgaccatcctaatgtcacaaggtttgtgggagcatcaatgggaacagcgaatttgaagataccttcatcagctgagacggagaactcgttgcctcaacgagcttgttgtgtcgttgtggagtatatccctggaggaactcttaagcagtatttgttccgaaacaggcgaaagaaactcgcttttaaagtcgtggttcaactcgctctcgatctctcccgagggttaagttatttgcattcagagaggattgttcatcgcgatgtgaaaacagagaatatgcttttggattatcagaggaatctaaagattgctgattttggggttgctagagttgaagctcagaatccaaaagacatgactggagaaactggaactcttggatacatggctccagaggttcttgatggcaagccatacaacagaagatgtgatgtttacagctttgggatatgcttgtgggagatttattgttgtgatatgccttatcctgatctcagctttgctgatgtttcttctgctgttgttcgtcagaatctgagaccggatattccaagatgttgtccaacagcattggcgaccataatgaagagatgttgggaagctaatccggagaaacgaccagagatggaggaagttgtgagtttgcttgaagctgtcgacaccaccaaaggcggtggaatgatcccggaagatcagagacctggctgtttctgctttgtctctggtcgtggtccctaaggcgcgcc

SEQ ID NO: 330 - DNA, 1298 bp, Arabidopsis thaliana
ttaattaagcttgtggtctacttgagaaattcataaattttggagtagataatgttttgtgatagttttgcatttgcccaagtgatgagttgcttcgggtgttttggtggctctgagagatcaagacattcaccaaatccatatgatgatgatacatattcccatgatagtggtgaaaccagcaatccgggaggagatgatgaagaaggagaagaggaagaggaagtagaggagctaagtcgttccaaacgatctgaagaaattttgaaatgtaaactacaaaatggactagtctgcaggcagtttccagtcaaggaaactaataaacttacacgcggagaggatgaagatggaaacaagacaataaatgagtttgttcgtgagcgtaaaattggatctggtagttatgggaaagtggttctctatcgaagcactgtcgatgacaagcattatgctattaaggcttttcacaagtcacatttatcgaggctacgggttgcaccttcagaaactgctatgggtgatgttcttcgtgaggttatgattatgaaaaccctggagcatcctaatatcgttaatctcattgaggtgattgatgaccctgagtttgatgatttttacatggttctcgaatatgttgatggaaaatgggcctatgatgattctggaccaccgggtgctctcggagaaattactgctagaaagtacttgcgcgatgtagttgccggcctcatgtaccttcatgctcataatgtaattcatggtgacatcaaacctgacaatttactggttactagtaccgggagagtgaaaataggagatttcagtgtcagccaagtattcaaagatgatgatgatcaactccgtagatcacccggcactcctgtctttactgccccagaatgttgtttaggtataacatacagtggaagatctgcagatacgtgggcagtaggagttactttgtattgtatgattttaggacaatacccatttctgggtgatacacttcaagatacttatgacaagattgttcacaacccgttgataataccggaaggactcaatcctcgtctaagggacttgatcgaaggtctcctttgcaaagatccaaaccagaggatgacgttgaaagctgtggcggagcatccatggatcacaggagaagacggggctatttcggaatactgttgttggtgcaaacgcaaagctgaagaagaagaagatcaaaaccatagctgaaagctagtacgggtatatacttgattgaacatagcaatcatctcgttgggcgcgcc

SEQ ID NO: 331 - DNA, 826 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtatattttatcttatgtagacttttgaaaaaaacaagtccccgcaatcaagcatcattcaacggaaaaaataatcctatgccaaacgcctccaccgcactaaccggcaaagcattactcaataaagttaaagaactatcccatctgccccgtcgagaaacggcaaaagcctgtggttactactctacttctaaggaaggacaagtacgcgtaaatttgaccgacttctatgacgcagtgctagcggccaaaggggttcccctcgatccctctggtaccaaagatggtcggggtcgtgaaccgacatttcgtgttagtgtccacaaaaatggacagattgttatcggatccacctacacccaagaaatgggtcttaagtccggtgatgagttcgagatcaagctcggttacaagcatattcatctgaagcaaattaccgatagcgatgacgaagaggaagtataaatttaaatacccagcaaatacccagcaaattggagctctgcagagctttcgttcgtatcatc

SEQ ID NO: 332 - DNA, 1919 bp, Arabidopsis thaliana
gtttcttgtttgttgattaacccttaattaagatggtgaagaagaacaaaacactcatttttttcaatagtaatgttttcatattcaaatacttataaaatctttatctcttgtgtaggtttttttataccacaggcttaccaagtgacatagaaatcgaagttgatgatataacatttcatcttcataaggtctcatcttcttctctgtttttttttcttctttcagagtttactcttaaaaactaaaactgatatgttgatcattctttcttcagtttcctctaatgtcaaaaagcaaaaaacttcaccaactaataacagagcaagaacagagtaaagtttattctcacatcaagctcgggaattttccaggaggttcagagattttcgagatggtgataaagataagctacggtttcaaagtcgacatctctgtttccacagctgttccactccgttgcgccgccgagtatctagaaatgacggaagagtactcaccggagaatctcatttcaaaaacagagaagtttctttcagagttcgtcttcactaacgtacaagaatccatcaaagcgttgaaagcttgtgaatcagtctcgtctttagctgaatcactctgtataacggaacagtgtatagactccatcgtcttccaagcttcctcaaccgatccgtcgtcgttttacggttggccaataaacaacggaggtatattcaccgttgaccggaagaaacagagcaaagattcgaaaacagagctttggttcgaagatctaacggagttgagttttccaatcttcagacgtgtgatcttatccatgaagtcgagtgtcctgagtcctgagattgtagagagatctctacttacttacgcgaagaaacacattccaggaatctcgcgttcatcgtcagcatcttcatcttcttcttcttcttccaccaccatagcttccgagaatcaacaaagagaattattagagacgataacttcagatcttccattaactgcgacgactacgagatctctcttcggtttgttacgagccgcgatcattctcaacgcctccgagaattgcaggaagtttctagagaaaaaaatcggatcgaatcttgagaaagctacgcttgatgatcttctcattccaagttactcgtatctcaacgaaacgttatacgatattgatttggtggagagactcttacgtcgttttctcgaaaacgtcgccgtgtcgtcgtcgtcattgacggtggttgggagattgatcgacggagttctcggtgaaattgcatcggacgctaatcttaaaccggaacagttttataatctggcggttttgcttccggttcaagcacgggtttacgatgatggactatacagagccgtcgatatatatttcaagactcattcatggatattggaggaagagaaggagaagatttgtagcgtgatggattgtagaaaactgactgttgaaggatgcacacacgcggcacaaaacgagcgtttaccactacgagccgtcgtacaagttctgtttttggagcagctacagctccggcaagtaatcactgggactttactgacggaggaagacggtgataaaacggtggtggacttgggtagatggaaggaagcggtgaaggagaatcaggtgcttcgtttggatatggatacgatgaggacacgagtgaaccagctagagaaagaatgcttgtacttgaagaaagtgatcgcgaagatcgacaaagaaagtttgttgaaggcgaagcatggggcggggaaatggtcaatcgggaagaagttcggatgcaaattttcggctcaagtttgtgattcacaggaggcaacgatggtcgatagaagatcacgacgttttcttagttagatttaaatacccagcaaattggagctctgca

SEQ ID NO: 333 - DNA, 1521 bp, Arabidopsis thaliana
ttaattaaaaaaccacgcgttgaggaccatgcccgtcctttacgagcaagataagcacgtctcctctgctattttgaccggacaggagagaggtgtgcttagatgtcaggagcgaacttcattgcttcatcactggaagcttacaaaggagcagatagcattggttgaaaaagctggttttggttggtttaggctagtaggatcaattagtttgaacaattcgcttatctctgctcttgtcgagagatggcgtagagaaaccaacacgtttcacttcccctgtggcgaaatgacaattactctcgatgaggtatcgttgattctcggtcttgctgttgatgggaaacctgtggttggtgttaaagaaaaagatgaagacccttctcaagtatgtttgagacttttggggaagctaccaaaaggagaattaagcggtaatcgagtgactgctaaatggttgaaggagagttttgcagagtgtccaaaaggagctaccatgaaagagattgagtatcacactcgtgcgtatcttatatacattgttgggagcacgatatttgcaactacagatcccagtaagatctctgtggattaccttatcctctttgaggattttgagaaagctggagaatatgcttggggtgctgccgcgctagctttcttgtatagacaaattggtaatgcctctcaacggtctcagagtatcattggtggttgcttgactctcttacagtgctggagttacttccacctcaatattgaccggccaaagagaaccactcgtcagtttccactggcacttttgtggaaaggaaggcaacagagtcgatcaaagaatgacttgtttaagtatcgcaaggcacttgacgatttagatccatcaaatgttagttggtgtccctttgaaggagaccttgacattgtgccacaaagtttcaaagataatctactacttggaaggtccagaacaaaactgattggtccaaaagtagtagaatggcacttcccagatcgatgcatgaagcagtttgggctgtgccaagttatccccggagaagttcctcccaggaaaaacgagaaaaaccatgatgaagacttactggaagacatgaacacagcagatgaggaatggatgagacgaagggaaaacatcgtggagaatggaggaggtaacggtgatgaaagtgaatatatgcagtggttcaatagcatcacagtcccaaagcttcacagagatacaagtctcgaagctgatataatgaacgtgcaagctgctatactacaatttgacgaggtggcctcaacgttatcattagaggatctacatccagaggagagagaagcaattgaagaagcagtgatgtctatgtccaatgccttgagagtaggagattggtacgaggcatcaacaactaataaacgaaaacggagagaggaacaacaacaaacggattggagtgaatgagaaaaaagaagaagatccttctgttttctggctgatcagttagcttctggcgcgcc

SEQ ID NO: 334 - DNA, 2182 bp, Cupriavidus metallidurans
cagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcccatctaaaaatcaccggcatgacttgcgactcgtgcgcggcgcacgtcaaggaagcgctggaaaaagtgccaggcgtgcagtcggcgctggtgtcctatccgaagggcacagcgcaactcgccatcgtgccgggcacatcgccggacgcgctgactgccgccgtggccggactgggctacaaggcaacgctagccgatgcgccactggcggacaaccgcgtcggactgctcgacaaggtgcggggatggatggccgccgccgaaaagcacagtggcaacgagcccccggtgcaggtagcggtcattggcagcggtggagccgcgatggcggcggcgctgaaggccgtcgagcaaggcgcgcaggtcacgctgatcgagcgcggcaccatcggcggcacctgcgtcaatgtcggctgtgtgccgtccaagatcatgatccgcgccgcccacatcgcccatctgcgccgggaaagcccgttcgatggcggtattgcggcaactgtgcctacgattgaccgcagtaagctgctggcccagcagcaggcccgcgtcgacgaactgcggcacgccaagtacgaaggcatcctgggcggtaatccggccatcaccgttgtgcacggtgaggcgcgcttcaaggacgaccagagccttaccgtccgtttgaacgagggtggcgagcgcgtcgtgatgttcgaccgctgcctggtcgccacgggtgccagcccggcggtcccgccgattccgggcttgaaagagtcaccctactggacttccaccgaggccctggcgagcgacaccattcccgaacgccttgccgtaatcggctcgtcggtggtggcgctggagctggcgcaagcctttgcccggctgggcagcaaggtcacggtcctggcgcgcaataccttgttcttccgtgaagacccggccatcggcgaggcggtgacagccgctttccgtgccgagggcatcgaggtgctggagcacacgcaagccagccaggtcgcccatatggacggtgaattcgtgctgaccaccacgcacggtgaattgcgcgccgacaaactgctggttgccaccggtcggacaccgaacacgcgcagcctcgcgctggacgcagcgggggtcactgtcaatgcgcaaggtgccatcgccatcgaccaaggcatgcgcacgagcaacccgaacatctacgcggccggcgactgcaccgaccagccgcagttcgtctatgtggcggcagcggccggcacccgtgccgcgatcaacatgaccggcggcgatgcggcgctcgacctgaccgcaatgccggccgtggtgttcaccgatccgcaagtggcgaccgtgggctacagcgaggcggaagcccaccacgacgggatcgagaccgacagccgcaccttgaccttggacaacgtgccgcgtgcgctcgccaacttcgacacacgcggcttcatcaagttggttatcgaggaaggcagccatcggctgatcggcgtacaggcggtcgcgccggaagcgggtgaactgatccagacggcggctctggccattcgcaaccgcatgacggtgcaggaactggccgaccagttgttcccctacctgacgatggtcgaggggttgaagctcgcggcgcagaccttcaacaaggatgtgaagcagctttcctgctgcgccgggtgagaaaaaggaggtgttcaatgaacgcctacacggtgtcccggctggctcttgatgccggggtgagcgtgcatatcgtgcgcgactacctgctgcgccgggtaatttaaatacccagcaaatacccagcaaattggagctctgcagagctttcgttcgtatcatcggtttcgacaacgttcgt

SEQ ID NO: 335 - DNA, 1359 bp, Chloroflexus aurantiacus
ttcttgtttgttgattaacccttaattaatccgggcgcgcctgatttatcacaagtttgtacaaaaaagcaggctcctgcaggatcatgaccggcgaacgcgccgcagaactgattcaagccgatcaccaatatctgttgcagagctatgtacgcgccgatttcgtcattgaacgtggcgaaggggtgtatctttacgatagtgaaggtcggcggtatctcgattttgtcgccggcattgcggtgaatgcgcttggctatggtgatcgtgacgttctgaaagcgatcaatgatcaggctgaacgcctcatccacgtttccaatctctaccacacgcaaccggcaattgaactggcaaagctcctggtgcagagcagcccggcgtttgccaaggcgtttttctgcaacagtggagctgaagcgattgagggggcgattaagttctcacgtcgctacgctcgtgcccatgttggcgaaggcaagacaacgattgttgccttcgacggcagttttcacgggcgtactatgggagcagttgccattaccgcccgtgaaaaataccgggagccgtttatgccggtgatgcccggtgtgcgctttgctcgctacaacgacctggactcactggcagccgtgatgggcgatgatgtctgtgccgtggtggttgagccggtgcagggcgagggtggcctgcgtgccgctgaaccggcctttatgcagggagtgcgcgaactgtgccagcgctatggcgcattgctggtctttgatgaaattcagtgcggggttgggcgtaccggcacgctctgggcacacgagcagctcggtgttcagccagacatgatgacggtagccaaaccgttagccggtgggctgccgattggtgcggtgcttatgggccaacacgttgccgataccattcatccaggcgaccatggcacaacctttggcggtaatccgctggcaactgcagttggcaccgtcgtgttccgcaaaattagcgatccggctttcctggcccatgtccagcaggtaagtaattatctcgatgaagcgttgcaggatttcgctaatgaacacgccgatcaggtgatcgaattgcgcggacgtggcctgatgcgtggtgtgcgcattgccggttctgcgagtgctgtacgtgaagcggctcatcgccatggtctgttagtcgctacggctggtgaagatgtcattcgcctgctcccgcccctgatcatcgagccgcagcacgttgatgaggcattgtctggtctgcgagcggcactgcgcgcttgactcgagacccagctttcttgtacaaagtggtgataaattggagctctgcagagctttcgttcgtatcatc

SEQ ID NO: 336 - DNA, 1792 bp, Arabidopsis thaliana
ttaattaagaagagaacgagagaatcattgagaaacgaaacaacaatggccgtctcatcattccagtgccctaccatcttctcctcctcctcaatctccggctttcaatgccgttctgatccagatctcgtcggttctcccgtcggtggatcatctcgccgtcgtgtccatgcctccgccgggatttcttcctcattcaccggggacgctggattatcctccaggatcttaagatttcctcctaatttcgtccgtcagctgagcattaaagcccgtagaaactgtagcaacatcggtgttgcacagatcgtggcggctaagtggtccaacaacccatcctccgcgttaccttcggcggcggcggctgctgctacctcgtctgcatctgcggtttcttccgccgcatctgcagccgcagcctcgtccgccgccgccgcccctgtggctgccgcgcctcccgtcgtgctgaaaagcgtcgatgaggaggttgtggtggccgaggaggggatcagggagaagataggtagtgtacagctgacggattccaaacattctttcttgagctccgatgggagcctcactgttcatgccggtgaaagattaggccgtggtatagtgacggatgctatcactactcctgtagtcaacacatctgcctacttcttcaagaaaactgctgagcttattgacttcaaggagaaaaggagtgtgagtttcgagtatggtcgttatggtaaccctacgactgtggtacttgaagataagataagtgcacttgaaggggctgaatcaactttggttatggcatctgggatgtgtgcaagcactgttatgcttttggcattggttcctgctggtggacacattgtcactactactgattgctacaggaagactaggatcttcatggagaattttcttcccaagttggggatcactgtcactgtgattgatcctgctgatatcgcagggcttgaagctgcagtgaatgagttcaaggtatctctgttcttcactgagtccccgacaaacccattccttagatgtgtcgacattgagctagtttcaaaaatatgccacaagaggggaactctggtttgcattgatggcacctttgcaacacctctgaatcagaaagcccttgctcttggtgctgatcttgtcgtgcactctgctacaaagtacattggaggacacaatgatgttcttgctggatgcatctgtggttcactgaagttggtttcagaaattcgcaatctgcatcatgtgttgggaggaacacttaacccaaacgctgcgtacctaatcatccgaggcatgaagacattgcatcttcgtgtacagcaacagaattcgaccgcttttagaatggccgaaattttagaggcacatcctaaggtgagtcatgtgtactatccaggccttccaagtcatcccgaacatgaactcgccaagcgacaaatgactggttttggaggtgtggtcagtttcgagattgatggagacattgaaacgacaatcaagtttgtggattctctaaagattccttacattgcaccatccttcggtggctgcgaaagcattgttgaccaacctgctatcatgtcctactgggatctgccgcaagaggagagactaaagtatggaatcaaagataacttggttcgtttcagctttggagttgaagactttgaagatgtcaaagctgacattcttcaagctctcgaagccatctgaaaatgacacatcacacaaaaacgctgtcgtttctttgtcctttatttggcgcgcc

SEQ ID NO: 337 - DNA, 1406 bp, Arabidopsis thaliana
ttaattaatggatcctcaagctttcattcgtctttcggttggctctcttgctttgagaattcccaaggtccttataaactctacttcaaaatctaatgagaagaagaacttttcttctcaatgctcttgcgaaataaaactacgaggctttcctgttcaaacaacatctatccctttgatgccgtcccttgatgcagctcctgaccatcacagtatttccactagcttttatcttgaagaatctgatttaagagctcttttgacacctggatgcttctatagtcctcatgctcacttggaaatctcggttttcacgggtaaaaagagtttgaattgcggtgttggtggcaaaagacagcagattgggatgtttaagttggaggtaggtcctgaatggggagaaggaaaaccaatgattcttttcaatggttggatcagtattggaaagaccaagcgggatggtgctgcagagcttcatttgaaagtgaaacttgatcctgatcctcgatatgtttttcagtttgaggatgttactaccttgagccctcagatagttcagctccgtggctcggtcaagcaacctatcttcagttgcaagtttagcagagacaggtgacatttgagttcttcatatatgcataaatctctctctctgtactgtttgtttagttactaatggtggtattgattcttcagggtgtcacaggtggatccgttgaatgggtactggtcaagttcaggcgatggaactgagcttgagagtgagagacgtgaaagaaaaggatggaaggtgaagatacatgatctctctggctctgcagttgctgctgctttcataacaactccttttgttccatccactggatgtgattgggtcgcaaagtccaacccgggtgcttggcttgtggtccggcctgacccatctcgaccaaacagctggcagccatggggaaagctcgaagcttggcgggaacgcgggatcagagactccgtgtgttgcagattccatcttctatcaaacggtctagaagttggagatgttttaatgtctgaaatcctcatcagcgctgagaaaggtggggaatttttaatcgacacggataaacagatgctaacagttgcagctacaccaattccaagcccgcagagtagtggagacttctcagggttgggacagtgtgtctctggaggtgggtttgtaatgagctcgagagtgcaaggggaagggaaaagcagcaagcccgttgtacaattagctatgagacatgtaacttgtgtggaagatgcagccattttcatggcacttgctgcagctgttgatcttagcattcttgcttgtaaaccttttaggagaacgagtcggagaaggttccggcattactcctggtgaagaaaggaggcgcgcc

SEQ ID NO: 338 - DNA, 1596 bp, Arabidopsis thaliana
ttaattaagtggtcgtgtaagtaagagtcgtcagcgagttttcttctccgagagtaatggagccatctcaacgcaacaccaaaccgccgtcgttttcagattccactatcccggttgattccgatggtcgagccaccgtcttccgaccattctctctctcctcgccacactcacgagcctttcacctagcttggctctcactcttctcatgcttcttctccaccttctccatccctcctctggtccccgtcatctcctccgacctcaacctctctgcctccaccgtatccgccgccggaatcgcttccttcgctggctccatcttctctcgcctcgctatgggaccactctgtgatctcatcggaccacgtacttcctcagcgattctctcttttctcaccgctcctgtaatcctctccgcctcactcgtctcctctccgacgtccttcatcctcgtccgtttcttcgtcggcttctcgctcgctaatttcgtagccaatcaatactggatgtcctccatgttctccggtaacgtcattggtctcgctaacggtgtctcagccggttgggctaacgtcggcgccggtatctctcagctccttatgcctctcatatactccaccatagccgaattccttccacgcgccgtcgcctggcgcgtgtccttcgtatttcccgccatttttcaggttacaacggccgtcctcgttctcctctacggccaagatactccccacggtaacagaaaaaactcgaaccagaacaaactcacaattcctgaagaagaagaagtactagtagttgaagaagacgaacgttccagtttcgtcgagatcctaatcggcggacttggaaattacagagcgtggatcttagcgctgctctacggatactcgtacggcgtcgagctaacgacggacaacgtgatcgccggatatttctacgagagatttggagtgaatctggaggcggcggggacgatcgcggcgagtttcgggatatcgaacattgcgtcgcgaccggcgggagggatgatatcggatgcgctggggaagagattcggtatgagagggaggctgtgggggctatggatcgtgcaatcggtggctgggttgttgtgcgtgttactcggacgagtcaactcgctctggggatcaatcctcgtcatgtgggtcttctctgttttcgttcaagctgcttctggccttgtatttggcgtggtccctttcgtctccacgcgatcgttaggagtggtggcgggaattacgggaagcggcggtacggttggtgcggtggtgacgcagtttctgttgttttccggtgatgatgttcgaaaacagagaagcatttcacttatgggtttgatgacttttgtgtttgctctttctgttacatcaatttactttccacaatggggtggaatgtgttgtgggccttcgtcatcttccgaagaagaagatatttctcggggactccttgtagaagacgaagatgaagaaggtaaagtggttagtggtagtctacgtcccgtttgttgatgtcgcatttgaactgctggcccatttggccaaagcaaaagcaatagcaaggcgcgcc

SEQ ID NO: 339 - DNA, 746 bp, Arabidopsis thaliana
ttaattaatgggatctcatgagcaatcgcctgagaataacggttcgagcactgtatcgaagaaagttgctgatatttggcaacgaatgaacgaaggagttccaaataaacgtgtcaatttcgtctcaaccgctttgcccgctaaaaactcagctaatagcaattggaaaagttatctcggtgtgaatgtgaagaagaaggatacttgtgtttctgatgtacagaagagtgttttgaatcatagctgtagtgaggaggctaagagtattgctgcagccgctttagctgcggtgcgaaacgcaactgtaacggctgcagctgcatcgagccggggcaagattgagataaccgaggtcaaagattttgcgggtcaagaaatcgaagtaaagcggttagttgaagcggattcaaaggaagcattggagaggggaaacaaaggctcctcttcctcctcagcagcgccttcagcggttgatgcggttcttgagcagataaaaaagaaacaaaagctgagtgttttggacaagacgaagaaagattggggagagtataaggaagaacacaaaggtgttgaagacgagctagataagtacaagaaaagctcggatcagtatctcgacaaagttggtttcttggagagagctgattacagacagtttgagaaagagagagacgctcgtttagctcttcagtccaagagaagacacgatgatgtatgaaatgaaatgtgaccgaccctggcgcgcc

SEQ ID NO: 340 - DNA, 525 bp, Zea mays
ttcttgtttgttgattaacccttaattaatccgggcgcgcctgatttatcacaagtttgtacaaaaaagcaggctcctgcaggaccatgaactcgagaagggacttccgtagccatagagctgctttatttgatggcattgaagaaggtggggtgagagctccagcttattcttctcgtgaaattcatgagcacgagaatgatcaagctctggacagtttgcatgatagggtcagcgttctcaaaagactgactggcgatatacatgaagaagtggagaaccataaccggatgctggacagaatgggtaatgacatggatgcttcgagaggatttctttcagggacggtggacaagttcaagatggttttcgagacgaaatcgagcaggaggatggcgaccatggtggcatccttcattgctgtcttcttgctcatatactaccttacaaagtagctcgagacccagctttcttgtacaaagtggtgataaattggagctctgcagagctttcgttcgtatcatc

SEQ ID NO: 341 - DNA, 1933 bp, Arabidopsis thaliana
ttaattaaatggagacagacgaagcataccaaaagaaagagcgagctgcattagtagccatcgttgtccttgcttgtcttgctttatcttctttgttcgtcgcctttagctactactgctatattcgtaacaaggtttctaagcgtcacagaattagcaagagtaagctcaacaattcacacttcatttctccttcttatctttttacctgtatttcttgttcttacgccggatgctgaaatttggttctaattaaggaataattttggaagataattgttcaattagggttcgatttatgttctgggtattgaatctgttattgttttacctgtcgatttttagggtttgattgtgaggaaaaaggcgattgtcagaaagtacaagatgttactgaaaatgggttgcaaattttcacctttaagcaattgcattcagcaactggtggatttagcaagtctaatgtggttgggaatggtgggtttggcttggtttatcgtggtgtgcttaacgatggcagaaaagttgctatcaagctcatggatcatgcaggaaagcaaggggaagaagaattcaagatggaggtttgattatttttagcttactctttgatctttattttttcaaagcttatgcacattttgctgtttgcagcgtttttgattacttgattgatcaattttttgtatctggtgccaggttgagttactgagccgtctgcgttcaccatacttgttggcacttcttggttattgctcagacaatagtcataagctgcttgtgtatgagttcatggcaaatggtggtctgcaggaacacctgtatcttcccaacagtaagtttctttttccagtagagttagaagttgctgcatgtttgaagttgtcatctgaagactccaaatttagtctatctgtctagatgctaacaatttgaacatgaatcctagatagtgtataataattacgaattggtgaatatacgtctggaattcttgttggatttgatagaaaaatctctttttcttgcatttagggtctggttctgtcccaccaagattagattgggaaactaggatgagaatagctgtggaagctgcaaaaggcttggaatatctccatgaacaagtatcacccccggtgattcatagagactttaagagcagcaatattctgctggacagaaacttcaatgccaaagtttcagattttggattggctaaagtcggatcagataaagctggtggacacgtttctacccgtgtattaggcacacaaggatatgtagctcctgagtatgtttttcactcaatcatctctttgttcttgtttccatcagttaactttgataggttggatactaataccaatattttcaatatcttatgtcaggtacgctttaactggtcacttgacaacaaagtcggatgtctatagctacggtgttgtcctgttagagttactaaccggtagagttccagtagatatgaagagagctacaggagaaggtgttcttgtctcttgggtacgcgttcctttcacaaactgctcttgtgtcatttcttcttgtctttgctctaataacttaacttttcctatctccaggctttgcctcaattggctgatagagacaaagtagtagacataatggatccaacactcgaaggacaatactctacgaaagaagttgttcaagttgcagcaatagcagcaatgtgtgttcaagcagaagctgactacagacccttaatggcagatgtggtgcagtcactggttccattagtgagaaaccgtaggtcagcttcaaagcttagtggctgctctagtagctttagcttggctcggtctcctaactctccgggtaaagcaagcataggttctcaatgaataaatcaatcagagaagacgaaatgtgaggcttttattggcgcgcc

SEQ ID NO: 342 - DNA, 1458 bp, Zea mays
ttcttgtttgttgattaacccttaattaatccgggcgcgcctgatttatcacaagtttgtacaaaaaagcaggctcctgcaggaccatgggcagcttaggagggagcgccggtgctggggacggcggcaaggtcgggctgccggcgcttgacgtgacgctcgcgttcccgcaggccacgcccgcatcgctcttcccgccagccgtttcggactactaccaatttgatgatttgctgactgatgaagagaaggcactcaggaagaaggtccgaggtatcatggaaaaggaaatcgcgcccattatgactgagtactgggagaaggctgaattcccattccatgccattcccagccttgccagtcttggtttagctggtggtacaataaaggggtatgggtgccctggactctcgcttacagctagtgctatttcgatagcagaggttgcacgggtcgatgcgagctgctccacatttattctagtgcactcctcgttggctatgtccactattgccctttgtggatctgaggctcaaaagcagaaatacttaccatctcttacccagttcaaaactattggttgctgggcattgacagagccagattatggaagtgatgcaagctccctaaggactgcagcaaccaaggtacctggtggttggcatttagatggacaaaaacgctggataggtaacagcacttttgcagatgtcctcatcattttggctaggaatgcagatacaaaccaactaaatggatttattgtaaagaaaggagctcctggtctaaaagccacaaaaattgaaaataaaattggactcagaatggttcaaaatggagacataattctaaataaagtatttgtccctgaggaagacagattaacaggcatcaattcatttcaggatataaacaaggtcctcgctatgtctcgaattatggtggcatggcaaccaataggcatatcaatgggagtttatgacatctgccatcggtatttgaaagaaagaaagcaatttggagctccactggcagcttttcagctcaatcaagaaaagcttgtccgcatgcttggcaacattcaggctatgcttctcgttggatggcgactgtgcaagctgtatgagtcaggcaaaatgacaccaggccggtctagtttaggcaaggcatggacgtccaagaaggccagggaggtggtttctcttgggcgagagctactgggtggcaatggcattttggttgattttcttgtcgccaaggcattttgtgacgtggaacccattttctcgtacgagggcacctatgacattaatagcctggtggctggcagagagatcaccgggatcgcgagcttcaagcctgctgtgtcagcaaaatcacgcctgtgactcgagacccagctttcttgtacaaagtggtgataaattggagctctgcagagctttcgttcgtatcatc

SEQ ID NO: 343 - DNA, 1434 bp, Zea mays
ttcttgtttgttgattaacccttaattaatccgggcgcgcctgatttatcacaagtttgtacaaaaaagcaggctcctgcaggaccatggggtgtggcccatcgatccccgacaagtacacgataggtgggaaggggcgcaagcgccggagcgtcatacaggaggttgccgtgttcgtgcccaccatccgcatcccagtggcctctgacatagctcatccactcaggggaatagtttccaaggatcttgtcgaccgactctccacactccgtgcccatgtcgcctcgctggctgaagaaatctatcacgcggacgtatcagctgttcaagaactgcagcatgcgctagaggagtacttgccagttgttcttggtttaacaacgaaagagagccgccttgaatcgtcagtacagttcagatggaagaccttagacgacgaccaggagtgttgtctggcgagcgcgtggtatgaggtgctctcggtggtccacatgatggccatgcttgcgttgtttgaggctaacctattgctcatcccaaagaacagccaaggtggtggtgaaaggaaggtagcagaagacgcaaagaaggatgtcgtcgattcgttgctcagggcgtcgggatgcttagactactccgtgcatcgcatacttgttcagatacctgcgcaagtcaagaagggttttcccagttacttgcaggagggcatgcttgaggccatctcaattcaggcattggctcagtgtgtggaaatacagcttggcttggcttctgaatgtgagaaggcaacgctgtcagtaaagaggaggctagcttgtgagcaagtcagctatttttctcaggctcactattgtctgtcgggatgcgatacgagtgactcgtacgggaagaagcttctgctgttcctcaagtggaagtggatggaggccaaggctgtagcgtattactaccatggtctggtgctcgacaagggcggcgaaccggcaaaccataccagtgcagtctgctgcctctctgcagctgatgacctgctctcagacagcaaaagggcttgcttgagtttttgcttggcaaatcctgtcacgagggtgcctcctccttggggtgtcatgaaaaacatgcacaaaaagatcccagatgtcgctaacaagaagttccaagcgcacgggcatctgtttgagcaaaacaagaacagcgcactccaatccgttcctgacctaccagagtttgcgctgtcgctgagaccggatggatacgagttgccaatcactgattcgatctgggagaatgttgatggccaacctcagattcaaagcctcaaggagcatatgatagatgacgaagatgaagtaggcacaaaatgactcgagacccagctttcttgtacaaagtggtgataaattggagctctgcagagctttcgttcgtatcatc

SEQ ID NO: 344 - DNA, 705 bp, Zea mays
ttcttgtttgttgattaacccttaattaatccgggcgcgcctgatttatcacaagtttgtacaaaaaagcaggctcctgcaggaccatggaggctggcggcgaggagttcgcgatcggcgtggtgatctccgcgaagaccaccctgggggaggagttcgagggccagatcgtcgccttcgaccgcccctccaacctcctcgttatccaggagggcgtgggtagggcggagaggggggagcggaggaacgtgagggtcctcaaagcgaactacatccgggagttctcggtggtcagtaagggtgacgaccctctcgatcctgccagctgcatgctggacctcaactccatttatgcccgggaggatgctgcactcaggcaagcagagattgaagctgagagaattggtgttggtgtcaccccagaagctcaaagtatatttgatgcgctgtccaagacgcttccggttcagtgggacaagactgacattgtcgtaatgaaggaggttcgtgtacgcagtccgtacctgcctgaaaatgttaatggaggaacagctgcagcaaatgaacgcgttaagaaagtgattgactttgaaaggaaaagattacattcacgtgtacctggccaattctcttgactcgagacccagctttcttgtacaaagtggtgataaattggagctctgcagagctttcgttcgtatcatc

SEQ ID NO: 345 - DNA, 270 bp, Zea mays
ttcttgtttgttgattaacccttaattaatccgggcgcgcctgatttatcacaagtttgtacaaaaaagcaggctcctgcaggaccatgtttgacgatcaagacctgggcttctttgccaatttcctgggcatcttcatctttgtcttggttattgcgtaccacttcgtgatggcagacccgaagtacgaaggaaactgactcgagacccagctttcttgtacaaagtggtgataaattggagctctgcagagctttcgttcgtatcatc

SEQ ID NO: 346 - DNA, 1197 bp, Zea mays
ttcttgtttgttgattaacccttaattaatccgggcgcgcctgatttatcacaagtttgtacaaaaaagcaggctcctgcaggaccatgatgggcgggttcctctccagggtcctcctgttggcttttggctatgcctatcctgcctacgaatgctacaagactgttgaactgaacaaaccagagattgcgcagctcatattttggtgtcagtattggattttagttgccttgttgacagttttggagagattcggagatttcacaatatcatggttaccgttttactcggaagcaaagctgatgttctttgtatacttgtggtaccctaagacaaagggaactacgtatgtttatggaactttctttaaaccatatatttctcagcatgagaatgaaatcgaccggaatctccttgagctgagagctcgagccaccgacacggttgtcctttattttcagaaggctgcttcggcaggacaaagtactttctttgacgttttaaaatatgttgctgcccagtcaccttctcagaaatccaggcaacgccttcatcgggaatcacagcagccgccacaacaacagcaaccacaagtgcaggtgcagcaggcgcaaccacaaaaacaagcggcacctgttatgcgcagagcatcatctattgctgctcggcaagcagcaatggcacaacaatctcaggagactaaacccatttcatcttcgcccaagatcaagcgtcaaacatcagcgagatctggttcagtggcatccacaaagcctccggtagctgcatccgcgctaaaacctggtggtagcccaaagaaaggcgaggtcaaacctgctgccgacccagttcaaactccaaccacaggtgccgattcaccgaaacccgagcctagcgccccatcactccctggagccgaaggggtggataagatggccatcgacgaggccagtggtgacgccctagagggtgcagaagagcttgaccctgcgctcgaagaggagacgccgatggaggagacgatacgtgtgacgcgcgccaagctaaggaggcgcacggccaccgaagatcctgctgggaattagctgcaggccattgtttttcctttccctgcacattgtgttgatctcgagacccagctttcttgtacaaagtggtgataaattggagctctgcagagctttcgttcgtatcatc

SEQ ID NO: 347 - DNA, 1029 bp, Arabidopsis thaliana
atgggttgcttcagcagtaaacaccggaaaactcaaaacgacggcggagaaaaatcaatcccgatcaatccagttcaaacccatgtagtccccgagcatcgtaaacctcaaaccccaacaccaaaacccatgactcaaccaatccatcagcagatttcaacaccgtcttcaaatccagtctcagttcgagatccagatacgattttaggtaaaccattcgaagacatcaggaaattttacagcttggggaaagaattaggtcgaggtcaatttgggattacgtatatgtgtaaagagattggtactggtaacacttatgcttgcaaatcgattcttaagaggaagctaattagtaagcaagataaagaagatgtgaagagagagattcagataatgcagtatttgtctggacaacctaacattgttgagatcaaaggtgcttatgaagatagacaatctatacatttggttatggagttgtgtgctggtggtgagttgtttgataggattatagctcaaggtcattactctgagagagctgctgctggtatcattaggtctattgtcaatgttgttcagatttgtcattttatgggtgtggttcatcgagatctcaagcctgagaatttcttgctttcgagtaaagaggagaatgctatgcttaaagctactgatttcggtttgtccgtcttcatcgaagaaggaaaagtttaccgggatatagttgggagtgcttactacgttgctccagaagtattaaggcgaagttacggaaaagaaatcgacatttggagtgcaggtgtcattttatacatcctactcagcggtgtacctcctttttgggccgaaaatgagaaaggaatattcgatgaggtcataaaaggcgaaattgattttgtaagtgagccatggccttctatatctgaaagcgcgaaagatcttgttaggaagatgctaaccaaagacccgaagagacgaatcacggctgcacaggttcttgaacatccttggatcaaagggggagaatag

SEQ ID NO: 348 - DNA, 315 bp, Arabidopsis thaliana
atggaagttaatggagaagaagagagaagaagtagaagagaagatgaagaaaaagaagattactactactctcttctcaactctccatgttctgtttgtaacaaatttgttcaagccatattgaagtgtcttggtcttgagtcatcatcaataccaccatcttcatcatcatcatcaccatccttagtagaagaagaagattcaggaactgaaactgttgaagaaacaggatttatggcgaggataacagcagtgttaagaaggagaccaagaccaccaccttatagctcaggacgacctggtcaaaacaattga

SEQ ID NO: 349 - DNA, 1017 bp, Arabidopsis thaliana
atggaatcaaagacaacccaaaacggatccgaagtcgtcgaactcacagagttcgagaaaacccagaagaagtatcaagatttcatcgctacacttccaaagagcaaaggctggagaccagatgagatcttaacccaatacggtggacactggtggcaagaatgtctcctcgaaggtctttttcacgctaaagaccatttcgaagcacgaccaactgatttcctcgtctgtagctacccaaaaaccggtacaacttggctcaaagcactaacttacgcaatcgtcaatcgttctcgttacgacgacgccgcaaacccactcctcaaacgaaaccctcacgagtttgtcccttacgttgagatcgacttcgcgttttaccccaccgttgatgttcttcaagacagaaagaacccacttttctctactcatatcccaaacgggttattacccgattcgattgtgaactctggttgtaagatggtgtacatatggagagacccgaaagatactttcatctccatgtggactttcttacacaaggagaagtctcaagaaggtcaattagcgagtcttgaggacagctttgatatgttttgtaaaggtttatctgtgtatggtccttatctggatcatgttttgggttattggaaagcttaccaagagaatccagataggattttgttccttaggtacgagaccatgagggccaatcctttgccttttgtgaagagattggctgagttcatgggttatggattcactgatgaggaagaggagaatggtgttgctgagaaagtggtgaagctttgtagctttgagacgttgaagaatcttgaagctaacaaaggtgataaagaaagagaggatcgtcctgctgtttatgcgaatagcgcgtattttaggaaaggaaaggttggagattgggctaattatttgactcctgagatggctgctcgtattgatggcttagtggaggagaaattcaaagatactggcttgcttcaacatgataactga

SEQ ID NO: 350 - DNA, 498 bp, Arabidopsis thaliana
atggagaaagagacgaaggagaagatcgagaaaactgtgatagagatactcagtgaatcggatatgaaagagataacagagttcaaggttcgtaaactcgcttcggagaaactcgcaatcgatctctcggagaaatctcacaaagcatttgtacgaagcgtcgtggagaaattcctcgacgaagagagagcgagagaatatgaaaactcacaagtgaataaggaagaagaagatggagataaggattgtggtaaaggaaacaaagagtttgatgatgacggcgatcttatcatttgcaggttatcggataagagaagagtgacgattcaggaatttaaagggaagagtttggtttctatcagagagtattacaagaaagatggcaaagaacttcctacttctaaaggaataagcttaacagatgaacaatggtcaaccttcaagaaaaacatgccagccatcgaaaatgctgtcaagaaaatggaatcgcgtgtctga

SEQ ID NO: 351 - DNA, 617 bp, Arabidopsis thaliana
ttaattaacaacacagagaaaccacctgtttgttcaagatcaaagatgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttagatggcttcttcctttataaccaattgatattgcataatttaaat

SEQ ID NO: 352 - DNA, 502 bp, Arabidopsis thaliana
ttaattaaatggcggaagaacatcgatgcgagacgcctgaaggtcaccgtctctgcgttaacaactgcggtttcttcggaagctcagcgacaatgaatctatgttcaaactgttacggcgatctctgtctcaaacaacaacaacaagcttccatgaaatcaaccgtcgaatcatctctctctccggtgatcgcacctgttctcgaaaactacgcggcggagttagagatcccgacgacgaagaagacagaggagaaaaaaccgattcaaattccgacggagcaaccgtctccgccgcaacggccgaatcgatgcaccgtatgtaggaaacgggtcgggttaaccgggtttatgtgtcggtgtgggacgactttttgtgggagtcataggtatccggaggttcatggttgtacgtttgatttcaaatcggcgggacgtgaagagatcgcgaaagctaatccgttggttattgcggcgaagcttcagaaaatatgaggcgcgcc

SEQ ID NO: 353 - DNA, 604 bp, Arabidopsis thaliana
ttaattaattttgcagtaagatttcgactttggaattgggagatctttccattatgggttctgagcaaaacgacagcacaagcttctctccttcagagccaaagctctgcgtcaaaggatgtggcttcttcggatctccatcgaacatgaacctctgctctaaatgctacagagacatccgagccacggaggaacaaaccgcttccgctaaagccgccgtcgagaaatctctaaaccctaataaacccaaaactcaaccacaacagagccaagaaatcactcaaggcgtcctcggatctggatcgtcttcctcatcaacgagagggggtgattcggctgctgctccgttggatccaccgaaatcgacggctacgagatgcttgagctgtaacaagaaagttggcgtgacgggtttcaagtgtaggtgtggaagcactttctgtggaactcatagatatccagagagtcacgagtgccaattcgatttcaaaggagttgcgagagaagctattgctaaagctaatcctgtggtgaaggctgataaggttgataggatatgaattggtgaagaaactgttgtgttctcttttgtttttggcgcgcc

SEQ ID NO: 354 - DNA, 525 bp, Arabidopsis thaliana
ttaattaaaaacaagctatggcgccctttccactctctttgatttttggaaagaaaaaacgtcgtcgcgacgacgagatacgaagacaaaagccgacgctcaagggtgttatgacggctttttttgccactgaagctgcaatatgcctcttgttgctggccggtatatctctaaccggcacagccgtggcactattcgcgtccatgccgctattcctcgtttttagccccgttcttgtacccgcgggtattgccaccactattcttgcttcaggtttaatggccggaggcacctctggtgtgtcgggtctcaccatcttaatgtggctctacaagaaatatacgggtagagactttccaattaaaattccaggtgctgccgcagcaggtggagctgccccagccgctcccgctgcccctgcccctgctgcacctgccgctaaaccagcagctaaaccagcagctaaaccgggcgcgtgaaaattagtcaaggacatagacaaggatgcatgacgataggcgcgcc

SEQ ID NO: 355 - DNA, 1350 bp, Arabidopsis thaliana
ttaattaaaaaaatggtgggttctcacaaagcaagcggagtgcttcttgtgctactagtggttatggccaccacaatagcaaacgggacacctgttgtcgatacagcaaaaaatgcagctacagcagttgaagatacagcaaaaaatgcagctacagcagttggcggtgcagctgcatcagttggtgctaaagtaacaggtgccaaaccaggcggtgcatcacttgatgttaaagcatcaggagccaaaggagacggcaaaactgatgatagtgcggcatttgcggctgcatggaaagaagcttgtgcagcagggagcacgattacagtgccaaaaggtgagtatttggtagagagcctagagttcaaaggtccatgcaaaggtccagtcactttggaattgaatggcaattttaaggctccggctacggtcaagaccactaagcctcatgccggatggattgatttcgaaaatctcgctgatttcactttgaatggaaacaaagctatttttgacggtcaagggtccctcgcttggaaggccaatgactgcgccaaaaccggcaaatgcaactctctccctatcaacatccgattcactggtctaacaaactcaaagattaacagtattacatcaacaaacagcaagcttttccacatgaacatccttaactgcaagaacataactcttacggatatcggtattgatgcacctccggagagtctcaacaccgatggtatccacatcggaaggtccaatggagtcaacttaattggggcaaagattaaaaccggagatgactgcgtttccattggagatggtaccgaaaatctcattgttgagaacgtagaatgtggaccaggacacggaatttccattggaagtcttggaagataccctaatgaacaaccagtaaaaggagtcaccgtgaggaaatgcctcatcaagaacactgacaatggtgttcgcatcaagacatggccaggatctccccccggtatcgcctccaacattcttttcgaagatatcacaatggacaatgttagccttcccgttctcatcgaccaagagtactgtccttatggccactgcaaagctggggtaccatcgaaagtgaagttgtcagacgtgactatcaagaacattaagggaacatcagcaacaaaggtagcagtgaagctaatgtgcagcaaaggcgttccttgcaccaatattgctctctctgacatcaacttggtccacaacggcaaagagggaccagctgtctcagcatgttctaacatcaagcctattctcagcggaaagttggttccagcggcttgcactgaagtcgctaaaccgggtccttaa

SEQ ID NO: 356 - DNA, 2213 bp, Arabidopsis thaliana
ttaattaatagaaacccgttggaaacatggcgatgagagaccttgttaacggcggagccgcttgtgccgttcctggttcgtcttcttcttctaatcctctcggagctctcaccaacgctttacttggttcgtcttccaaaacccaggaaaggctcaaggagatacctaatgcaaaccggtcaggtcctcggccacaattttactctgaagaccaacagataaggtcacttcctggttctgagttagatcagccacttctgcaaccgggtgctcaggggtcagagttcttccgtggttttcgctctgttgatcagaatggtttgggtgcagcttgggatgaggtacagcaaggtggacctatgcctccaatgggacctatgtttgagccagttcagcctacatttgaaggacccccacagagagttttatcaaactttctgcattcatttgttgagagtagccgtggtggtattccatttcgtccagcacctgttccagttctaggattgtcacaaagtgacaaacaatgtatacgtgatcgtagtagcataatggcccggcatttttttgccgataggggagaggaatttattaattctcaggtaaacgcattattgtcatctttagatattgatgatgggatacaagctcgaggtcatgttcccgggagatttcgggagctagatgattactggaatgagtctcaagctgttgtgaaacctaatttacatcctgctgacaattgggcggctgaatttaaccaacatgggatggatcatggtggtcctgattcatgggtccagtcttttgagcaacaacatggtgtgaatgggtgggctactgagttcgagcagggtcaatctcaattgatgtcaagccaaatgagaagtatggatatgcaaaatatagctgcaatggagcagactcgtaagcttgcccatacactatctcaagatgggaatccgaaatttcagaattcaagattccttcagtttgtttccaagatgagccgtggtgaacttattattgatgagaatcaggtcaagcaagcttcagcccccggggaatgggctactgaatatgaacagcagtatctggggccaccaagttgggctgatcaatttgcaaatgagaaactttcacatggaccagaacagtgggctgatgagtttgcttccgggagaggacagcaagaaacagccgaggaccaatgggttaatgagttttcaaagttgaatgttgatgactggatagatgaatttgctgaaggtcccgtgggtgatagttcagctgatgcatgggcaaatgcttacgatgagtttctgaatgagaaaaatgctggaaaacaaaccagtggtgtctacgtcttctctgacatgaatccttatgtgggtcaccctgaacctatgaaagaagggcaagaattgtttcgaaaaggacttctgagtgaagcagcgcttgctctagaagctgaggttatgaaaaaccctgagaatgctgaaggttggagattacttggggtcacacacgcagagaacgatgatgatcaacaggcaatagctgcaatgatgcgtgcacaggaggctgatcccacaaatctagaggtgcttcttgcgcttggtgtgagtcataccaacgagttagagcaagcaactgctttgaaatatctatatggatggctgcgaaatcacccaaagtatggagcaattgcgcctccggagctagcggattctttgtaccatgctgatattgctagattattcaatgaagcttctcagttgaatcctgaggacgccgatgtgcatatagtgttgggcgtgctctacaatctgtcgagagagttcgatagagcaatcacatccttccaaacagcattacaactaaaaccaaacgattattctctgtggaataagctaggtgcaacgcaagccaacagtgtccagagtgctgatgccatatctgcttatcaacaggctctagatttaaaaccaaattatgttcgtgcttgggcaaacatgggaatcagttacgcaaaccaggggatgtacaaagaatcaatcccgtattatgtccgtgcccttgcgatgaatcctaaagctgataacgcatggcaatacttgagactctcgttaagttgtgcatcaaggcaagacatgatagaagcttgtgagtcaaggaatctcgatctcttgcagaaagaattcccgctgtga

SEQ ID NO: 357 - DNA, 340 bp, Arabidopsis thaliana
ttaattaaatggctaaggccgaaggtctttttcttcttggtttagtagttatttcaagtttagttatgttaaccgagagccgactcgcaagaaaagacttggggattgacctaggtgggattggaatcggtttgggcgttggattggggattggtcttggcggcgggtcgggctccggtgctggtgcaggttctggatcaggttcaggttccagatcatcatctagctccagctcatcatcaagttcgagttctagtggttcgggtggttcagctggttcatctgccggttcatttgctggctctagagctggatcaggatctggtaactaaggcgcgcc

SEQ ID NO: 358 - DNA, 721 bp, Arabidopsis thaliana
ttaattaactctcttaaacctccgaaagctcacatggcgtctcgaaactatcggtgggagctcttcgcagcttcgttaaccctaaccttagctttgattcacctggtcgaagcaaactccgaaggagatgctctctacgctcttcgccggagtttgacagatccagaccatgtcctccagagctgggatccaactcttgttaatccttgtacctggttccatgtcacctgtaaccaagacaaccgcgtcactcgtgtggatttgggaaattcaaacctctctggacatcttgcgcctgagcttgggaagcttgaacatttacagtatctagagctctacaaaaacaacatccaaggaactataccttccgaacttggaaatctgaagaatctcatcagcttggatctgtacaacaacaatcttacagggatagttcccacttctttgggaaaattgaagtctctggtctttttacggcttaatgacaaccgattgaccggtccaatccctagagcactcacggcaatcccaagccttaaagttgttgacgtctcaagcaatgatttgtgtggaacaatcccaacaaacggaccctttgctcacattcctttacagaactttgagaacaacccgagattggagggaccggaattactcggtcttgcaagctacgacactaactgcacctgaaacaactggcaaaacctgaaaatggcgcgcc

SEQ ID NO: 359 - DNA, 445 bp, Arabidopsis thaliana
ttaattaaatgtatcctaaacaatttagtttatacaattattccctagagaccatgagcaaggatgagaatgtggagagcaaagagacgatcagggttgataagagagtaagagaagacgaagaagaggaagaagagaagaagattgatacgttctttaagcttatcaaacactatcaagaagcacggaaacgtagacgagaagagttagctgaaaattctggcgtcgtgaggaggaaatctaacggcggagaaaggtccggtatagtagttccggcgtttcagccggaggatttctctcagtgtcgtacgggtttgaagccgccattgatgtttgtttcggatcacaaggaagaaaatacaaaggtggaacaagaagaagatcaaacagaagagcgaaacgaagacaaggctttagatcttaatcttgcattgtagggcgcgcc

SEQ ID NO: 360 - DNA, 537 bp, Arabidopsis thaliana
ttaattaaaaaagacaagagtccgaggagacatggagaatctggtgggacttcttagaatcagagtgaaaagagggattaatcttgttagtcgtgattctaataccagcgaccctttcgtcgtcgtaaccatgggttctcagaaattgaagacacgtggtgtggaaaatagctgcaaccctgagtgggacgatgaattgacgcttggaatcaatgatcctaatcaacatgtgactctcgaagtgtatgataaagatacgttcacttcccatgacccgatgggagatgcggaaatagacatcaagccgtttttcgaggttcaaggaacggatattcaagaactcactaatggaaccgagatccgtagagtgaagccgagtggagataactgtttggctgaagagagtaggatcatcttcagtaatggaaagattcttcaagacatgattctccagctgagaaatgtagagagtggtgaggttgagatccaaatcgagtggatcaatgttactggttcaagcgatttttgaggcgcgcc

SEQ ID NO: 361 - DNA, 959 bp, Escherichia coli K12
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggttagagatatgaaacatactgtagaagtaatgatccccgaagcggagattaaagcgcgtatcgccgaactgggtcgtcagattactgagcgttacaaagacagcggcagcgatatggtgctggtgggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagatctggatgaagatatccgtggcaaggacgtgctgattgttgaagatatcatcgactcggggaatacactgtcgaaagtgcgtgagatcttaagcctgcgcgaaccgaagtcgctggcgatttgtacgctgctggataaaccgtcccgtcgtgaagtgaacgtcccggtagaatttatcggtttctcgatcccggatgagtttgtggtgggttacggcattgattacgcacagcgttaccgtcatctgccgtatatcggcaaagtgattctgctggacgagtaagtcgagacccagctttcttgtacaaagttggcattataagaaagcattgcttatcccccaaatacccagcaaattggagctctgcagagctttcgttcgtatca

SEQ ID NO: 362 - DNA, 994 bp, Synechocystis sp.
tttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgacgatcgccaaattaccccgtcaaattctgcccaacctgtatcgttttgcacccaatcgggacaccctggggggaacagcctatttattaatcactggggagggcaatgtgttgatcgattgtccggcttggcatgaagacaatgaagcatggttgggggaacaaggcccggtgcgttggctatgtctgacccatcgagatggccatggccccaaagtgaaaacaatccaggaaaagttaagctgtcaggtggtggtacaggaacaggaggcttaccttttgcccggggcaaggatatgtcgttttcgggaacaattggcgatggccccgttcctcacggccatctggactcctggttattctcccggtgctagttgctattactggggagagaacggcggtattcttttcaccggccgtcatttactgcccgatggggaaggtaatctaagggccattaagcaggctaaaacattccactggccccgtcagcaagccagtgtggaaaaaattcatcgctatttggatgaaaaaaatctgcccctcagagcggtttgcccagggggaaatgtgggttatttgcggggagaagattggtgcttaaatccgagggaatcactggagtcaatgctcagggagtttcaggcaaaagtctaaatttaaatacccagaaatacccagcaaattggagctc

SEQ ID NO: 363 - DNA, 1373 bp, Arabidopsis thaliana
ttaattaagtcctgcattggagaaactaatttaaggtaaggtttgactacttagatggtatgcagcagtttcataaggagtttcattgttcaagctggttgtcgtattggggtgttggctcaaggaagacatcagtttattcatattaagaagactttgagtgtgggttttggatttagaactagtgtgattggatttagaacaaccagtggaattggatttagaactagtgcgaagatgatggttgatacttctgctggagagaaacgtatatccttagttgatatgccgcctgagaaagttgatgatggtggatacatcggtggtgggtggaaaaatgatgatggaagcttgagctgtgggtactgtagtttcagagggaaaagatctacgatggaagatttctatgatatcaaagcttccactattgaaggccaagcagtttgcatgtttggaatatttgatggccatggtggttcacgtgctgctgaatacctgaaggaacacctgtttaacaatctcatgaagcatccacaatttttgacagacaccaagctggcattaaatgaaacatataaacaaactgatgtagcattcctcgagtccgaaaaggatacttacagagatgatggctccacagcatctgctgctgtgttggtggggaaccatttgtatgttgcaaatgttggagactcgaggacaatagtttctaaagctgggaaagcgatcgcgctatctgatgaccataagccaaatagaagcgatgaaagaaagcgaattgaaagtgctggtggtgttatcatgtgggcaggaacatggagagtaggtggggtgttggctatgtcccgggcctttggtaacagaatgctgaagcaattcgttgttgctgaacccgagatacaagatctagagatagatcatgaggccgagttgcttgtgcttgcaagtgacggtttatgggatgtggtaccaaatgaggatgcggtagcccttgctcagagcgaggaagagcccgaagcagctgcccgcaagttaactgacactgccttcagccgtggcagtgcagacaacatcacgtgcattgttgttaaattccgtcatgataagacagaatctcctaaaatcgaaacaaacgccatggctgaatcggaacctgaactgaaccccacaactgaactggaacctgaatcaaaccccagtactgcattggaaactgaatcaatccccaaagctgaactggaatccgaacctgatgctatacctgatccaaaacctgaaaccgaaccagagaccaagggtgagaaagctggtgagtaaggtagcagccggggaaaggtgtccatactgttggggacatgtggaaacggcgcgcc

SEQ ID NO: 364 - DNA, 1179 bp, Arabidopsis thaliana
ttaattaaaacaacatcaatggcaatgcacactgttcgattgtcgccggcgactcaacttcacggcggtatctctagcaatctgtcaccacccaatcgaaaacctaataattccatcgtccgatacggatgcggatcttcgaagcgtttccgtatcgtaacggtcttggcgtcactccgggaaaacgatgcaaacggaagggataactccgtgagagctatggaagtgaagaagatctttgaagactcgcctctgcttcctaagccgttatcatcgaaccagctcacggaatctgtctctaatggctcccgcgttcgtgttgcgtatcagggagtacgaggtgcatacagcgaatcagctgctgagaaggcttatccaaactgtgaagctgttccatgcgaagagtttgacactgcttttgaggcggttgagcggtggcttgttgacagagctgttttaccgattgagaactctttaggtggaagcatccatagaaattatgatcttctgctgcgacacaatttgcatattgtaggcgaagtcaagctagctgttcggcactgtttgttggctaaccacggtgtaaatattgaagatttgagaagggtgcttagccatccacaggctcttgcccaatgtgaaaacacgttaaccaaattggggttggtcagagaagcagtagatgatactgctggcgctgcgaagcaaattgcattcgaaaatttaaatgatgcagctgcagttgccagtgaaaaagctgcaaagatatatggtttgaacatagtcgctaaagatatccaggatgactgtgataatgttacaaggtttctaatgctcgcaagagaacccattatccctggaactaacagactctttaagacaagtatagttttctcgttagaggaagggcctggagtacttttcaaagcgcttgctgtgtttgcccttcggcaaatcaacctcacaaagattgaaagccgccctttaaggaaacatcctctccgagcatctggaggactaaaatactttgactatcttttctatgtggactttgaagcatctatggctgatgaagttgctcaaaacgcacttaggcatctcgaggagtttgctacctttttgcgggtactgggaagctacccagtggacactacaatgctctaaacatttcggcgcgcc

SEQ ID NO: 365 - DNA, 775 bp, Arabidopsis thaliana
ttaattaatctgacctcactgatctccaatggcgaaaaccctagctcgctccacagcgtcacgcatcaccaagcgcttaatctccacctccggagccaccactccttccccttcttatatcctctcccgtcgatcaaccccggtgttctcccatgccgtcggattcatctcttccttgaatcgtttcacaacgattcgaactcgaatggataggtccggtggatcgtactctcctctaaaatccggttcgaatttcagcgaccgagcacccactgagatggcgccgttgtttcctggctgcgattatgagcattggttgattgtaatggacaaacctggaggcgaaaacgctactaagcagcaaatgattgattgttatgttcaaaccctagctaaaattatcggcagtgaggaagaagctaagaagaagatttataatgtatcgtgtgaaaggtattttggatttggttgtgagattgatgaagagacatcaaacaaacttgaaggacttcctggtgttctcttcattttaccagactcttatgttgatcaagagaacaaagattacggagctgagctgtttgtgaatggagaaatagttcaacgtcctccagagagacagagaaagatcattgagttaacgacccagagaaccaatgataaaccaaagtaccacgacaagaccagatatgtccgaagaagagagaacatgcgttgaatccaaatctgatatcagaccatacagaagttgttgttcaatgttcatgggcgcgcc

SEQ ID NO: 366 - DNA, 416 bp, Arabidopsis thaliana
ttaattaagatcttaaatgggttcatctgagaagagatcaaaggatatcatgagtgacataccaactttcagtgcagagaatttgcagaacaatttgaaagtcattcaaaacagccggacgtttctgtctatcatagctggtgtcttagcaggaataattggattcaatggcttgattggttttgtattttactttgtggtgatgttgatcacatctgttgggctcatggctaaggcaggattctcagctgacttgtactttgattcgtggaatcgggttctttttgacggttttcttggtggccttatgtcgtttgtgctgttctggacatttgcgtatgacttggtgcacatattctgagggaacttctgctccagatgaggatggtgaaacggcacacaagattgagttcggg

SEQ ID NO: 367 - DNA, 633 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggatgtcggcgatcgtgttcgagtcacctcctccgttgtggtttaccaccatccagaacataaaaaaacagcctttgatttacaaggtatggaaggggaagtggccgccgtattgaccgaatggcagggcaggcccatcagcgctaatttgccggttttagtcaagtttgaacagcgttttaaggcccatttccgtccggatgaagttaccctgattgaagattagtcgtcctatcttcaatgtagcgccgttgctttctcgattacctgcttatttaaatacccagcaaatacccagcaaattggagctctgcagagctttcgttcgtatcatc

SEQ ID NO: 368 - DNA, 1332 bp, Glycine max
ttcttgtttgttgattaacccttaattaatccgggcgcgcctgatttatcacaagtttgtacaaaaaagcaggctcctgcaggaccatggaattcaacaagttcagaatcagaagctatgaggggcaatctgatagggctcaagtggaagatcttgagagaagatgcgaggtagggccatcagaaagcgtgtttctcttcacagacactatgggtgaccccatttgtaggatccggaacagtcccatgtacatgatgctggtggcagagttggacaatgaattggttggtgtcattcaagggtctataaaagtggtcacagttcatggtcaccctccaaaggatttggcaaaggtggggtacgtccttggcctaagggtatcacctcagcacaggagaaaagggattggctcaagccttgtgagaacactagaagaatggttcacttcaaaagatgtggactatgcatacatggcaacagagaaagacaaccatgcctcagtgagtctcttcatggacaagtttggctacaccaagttcaggactccagctattcttgtcaaccctgtgaaccatcattgctttcaaatatcacccaacattgagatagcaaggttgaagattgaccaagctgagtacctctatagaagattcatggggtccacagagttcttccctaatgacatagggaatatacttaggaacaagctaagtttggggacatgggtggcatatttcaaaggagatattgcttggggtgattttgggtcagatggacaagtaccaaatagttgggctatgcttagtgtatggaatagtggggagatattcaagttaaggctagggaaagcacctttttcttgcttggtatgcactaagagttggtggttgattcataagatcttcccatgtttgaaattgccaaccatacctgatttcttcaacccatttgggttctatttcatgtatggggtgcaccatgaagggccattttcagggaagctagtgagggccttgtgccaatttgtgcacaacatgggtgctgagtccaaggatgagagtaattgcaggatcattgtgactgaagttggaggaagagatgagctcaaccaccatatcccacattggaaattgctctcatgcccggaggacttgtggtgcataaaggcgttgaaaaatgaagggacaaataacaagttccatgaattaacaaccaaaaccccaccaacaagagctctttttgtagacccaagagaggtttaactcgagacccagctttcttgtacaaagtggtgataaattggagctctgcagagctttcgttcgtatcatc

SEQ ID NO: 369 - DNA, 1778 bp, Synechocystis sp. PCC 6803
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgaatactgctaaaactgttgttgctgagcaaagggacttttttcgtcagggcaaaactaaatcagtccaagatagattaacagctctagcaaaattaaaaacgcaaattcaagcccaggaagaggaaattattaaggcccttaagcaagattttggtaagcccacctttgaaagctatgtaaacgaaattttgggggtaattagggaaattaattattatcaaaaacatcttcagcaatggtctaagccccaacgggtaggtacgaatctgatggtttttcctgccagtgcccagttaagaccagaaccccttggtgtagtgctaattattagcccctggaattatcctttttatctttgtttaatgcccttgatcggggcgatcgccgctggaaattgtgtggtggtaaagccgtcggaatatactccagctattagtggggtaattaccagattaatccaaaatgtattttccccggcttgggcaacagtggtggagggagatgaaaccattagccaacaattgttacaggaaaaatttgaccatattttctttaccggcagccctagggtgggtcggttaattatggcagctgcggcagagcaattaaccccagttacgttggaattggggggtaaatctccctgtgtggtggatagggaaatcaacctccaggaaacagccaaacgcattatgtggggcaagctagtcaatgctggccaaacctgtgtggcaccggattatttattggtggagcaatcctgcttagaacaacttttaccagctttacaacaggcaattcagatgcttttcggggaaaatccagcccatagccctgactacactcgcattgttaaccaacaacaatggtcacggttagttagtttattaagccatggcaaagtaattacaaggggagatcataacgaaggcgatcgctacattgccccaactttaatcatcgatccagatttaaattctcccttaatgcaagaggaaatatttggcccaattttgccaattttaacttatcagagtttgtcagaagcaatagattttattaacatcaaacctaaaccattggcactttatttttttagcaataatcggcaaaaacaggaggaaattttgcaatctaccagttccggtagtgtttgtttgaacgatattttgcttcatttaactgtgacagacttaccctttggtggggtgggagaaagtggtatgggacgctaccatggcaaggctacttttgacacattgagcaattataaaagcattttacgacgacccttttggggggaaactaatttacgctattctccctatggcaaaaaaatgaatttaatcaaaaagttgttctcctaggattattcatggccgaccgtccccagttgagtattattattcccgtgctcgagacccagctttcaaatacccagcaaattggagctctgcagagctttcgttcgtatcatc

SEQ ID NO: 370 - DNA, 265 bp, Arabidopsis thaliana
ttaattaagaagaaatggcaggacacaaggttgcgcatgccacattgaaaggcccgagtgttgtcaaggaattgattattggtttgacgcttggtttagctgctggtggtctctggaagatgcaccattggaatgagcagaggaaaactagaactttctatgatttgcttgagagaggtgagatcggtgttgtcgcctctgaagagtgaatgggaatgcctctctctcactctcaatgttgttggctcgatttttctggcgcgcc

SEQ ID NO: 371 - DNA, 942 bp, Arabidopsis thaliana
ttcttgtttgttgattaacccttaattaatccgggcgcgcctgatttatcacaagtttgtacaaaaaagcaggctcctgcaggaccttctctgaacactcaaatcgaacagagagtttaataaataaatggcgatgtctcatctctttctttcttcttcgcctcaatcttcactggctctgcgacttcactcgacgacccagttcacgttgagctactctaagaacaataaagattgttcctttcagagtgcaaatgaagctaaagtatcaaagagatcgttgctctgtcgtgcaattcatatggaatctggacattcaggggaacaaccaaagaagcttaatttcgataatctgttgaggagaaccaaacatgtttgggataattctccacagccggttaaggaatttccttggaatagagcattcggaaacttcatacagctcgttcttgatctcgctatatcagtcgttaagttcttgttcgttcctatattggcggtttcttccattagtgagatgtcttattgtgctcatgagaggaaacttgctttagtcccatttccattagtcatcggtatggttgtcgctggcgttctacaagaaaccgctttgaagatctcgcctcgtcttaaggaagcggaagtaccgtggcatttgatagctatgatgatgttcttcactctgattaagcttcctggaccatattacccgtattgggggcgtttattagttccacattttgcaaatggagtattacttagagcactttggtccatgttcttttggtataagaagactagaaacacatcaggaaatcctctgcagaatcacagtttggaaacagaatgagcatcttcatcaaaaggtacacctcgagacccagctttcttgtacaaagtggtgataaattggagctctgcagagctttcgttcgtatcatc

SEQ ID NO: 372 - DNA, 523 bp, Arabidopsis thaliana
ttaattaaatgttggtgtaccaagatcttctcaccggtgatgagcttctgtctgactctttcccttacaaggagattgagaatggaatcctctgggaagtagaaggaaagtgggttactgtgggagctgtagatgttaacattggtgccaatccatctgctgaagaaggtggtgaggatgaaggtgttgatgactctactcaaaaggttgttgacattgtcgacaccttcagacttcaggagcaaccaacttatgacaagaagggattcatcgcttacattaagaaatacattaagcttttgacacccaagctcagcgaagaagatcaagctgtcttcaagaagggtattgagggagctaccaagtttttgctccccaggctcagtgacttccaattctttgttggggagggtatgcatgatgacagcactttggtctttgcttactacaaggagggttcaactaacccaacatttttgtacttcgctcatggtttgaaggaggtcaagtgctgaggcgcgcc

SEQ ID NO: 373 - DNA, 1420 bp, Arabidopsis thaliana
ttaattaatttttacaaaattctctaatcatcgttgtaaagtaaaaaaccatggtcggagcaaaaccggtggagaatggatctgacggtggtagtagtacggggctgcttcacggccgttacgagctagggcgtcttctaggtcacggaacattcgcgaaggtgtaccacgctcgtaacatacaaaccggaaaaagcgtggcgatgaaagtcgtcggaaaagagaaagtggtgaaagttggtatggttgatcagatcaaacgagagatctctgtgatgaggatggtgaaacatccaaacatcgtcgagcttcacgaagtcatggcgagtaaatccaagatctatttcgccatggagcttgtacgaggcggtgagttattcgctaaggtggctaaaggaagactacgtgaagacgtagctcgtgtttatttccagcaattgatctcagccgttgatttctgtcatagccgtggtgtttatcaccgagatctgaaaccggagaatctcttgttagatgaagaaggtaatctcaaggtgactgattttggtctctctgctttcactgagcatttgaaacaagacggacttcttcatacaacttgtggaactccggcttatgttgcgccggaggttatattgaagaaaggatacgacggagctaaggcggatctgtggtcttgtggtgttatactttttgtgcttcttgctggttatttgccgtttcaagatgataatcttgtgaatatgtataggaagatttacagaggagatttcaaatgtcctggttggctttcttctgatgctagacggcttgtgactaagcttcttgatccgaatccgaatacgaggattactattgagaaggttatggattcgccttggttcaagaaacaagcaacgagatcaagaaacgaaccagtggctgccacaatcacaaccacggaagaggatgttgatttcttggtgcacaagtcgaaggaagagacggagacgttaaacgcgtttcatataatcgcgttatcggaagggtttgatttgtcgccgttgtttgaggagaagaagaaagaggagaaaagagagatgagattcgcgacgtctcggccagcgagtagcgtgatttcgagtttggaagaagcggcgagagttgggaataagtttgatgtgaggaagagtgagagtagagtaaggattgaaggtaaacagaatggtcggaaagggaaattggcggtggaagcggagatattcgcggtggctccgtcgtttgttgtcgtggaagtgaagaaagatcatggagatacgcttgagtacaacaacttctgcagtactgctcttagaccagctctcaaggacattttctggacctctacacctgcttgaatttgatgaattcttgcgtgtttcaaatttttatgtggcgcgcc

SEQ ID NO: 374 - DNA, 1602 bp, Zea mays
ttcttgtttgttgattaacccttaattaatccgggcgcgcctgatttatcacaagtttgtacaaaaaagcaggctcctgcaggaccatgacggaccaccgcgacgtgatgttgcccttgtccctccaatacatagccacccgtgccctcctcctgctcgtcatcgcgtccgccgtttcctgctcttccttgccgccggaggacggcatccgggtcgtctctgcagagaaaagaatcgacctcacgggtcccatcgtcaaagtcttcctaacattgaaggttgagaatgctcccacggcctctgaagcatcacgagttctcctcgccttcacgcccacagagtttcaacatctctctattgtcaaggccacaagagcggaggggaagcgcaagaagaaggcattcgtacccctctcggtccaagcctctgagctcgccaccaccgctcccgacgcccctcgcctctactctgttctgctcagcactcctctgaaaccgggcgatgcaaccactctagaagtgctatacatgctcactcactctttagagcccttccccgctgagattagccagtcagagtcccagttggtttactaccgtgacagtgcggtgcttctctcgccctaccatgtcctggagcaggttacctacatcaaaatgccaagcaataggatcgaatccttcacaagggtcgatcctaccacacgagctggttctgaagtgaaatatggcacatacagtaaccagatgccaaactcctatttgccagttcttgtgcattatgagaataaccgcccatttgctgttgttgaggagcttgtacgcaaggtggagatttctcactggggaaacatccaaatcaccgagcagtataaactgaaacacggtggtgctcgtcacaaaggagtcttttccaggcttgagtatcaatctaggccatctatcagtggagcttcgtcctttaagaatcttcttgcaaggctgccacctcgggttcattcagtttactatcgtgatgagattggtaacatctcctcatcccatctgcgcactgattcacacaagtccgatctagaaattgagcccagatatccgttatttggtgggtggcactgcacgttcaccattggctatggtcttccattgcaagattttgtctttgagtcagttgatggccggcgctacatcaaccttacttttggttgccctctattggatactgtggttgacgatcttacagttaaagttgtgcttcctgaaggatcaaaaaatccagagcatgtagttccttttgtgacagagaaacatcttgagactagttattcataccttgacgttgttggaaggacgacggttgtactgaagaagaaaaatgttgtaggggagcacaacgttcctttccaggtgtactatgaattcaatccgatcttcatgctggcggaaccattgatgctgatatctgcagtgttgctgtttttcgttgccttcattgcgtatcttcacatggatctttccatcagaaaatcatcatagctcgagacccagctttcttgtacaaagtggtgataaattggagctctgcagagctttcgttcgtatcatc

SEQ ID NO: 375 - DNA, 2159 bp, Arabidopsis thaliana
atgaaggcgttacggagaagctatacttcaacgtcttctgggaattcatcttcttcgtcttcgttaccttcttcgtcttcttcttcgttaccatcttcttcttcttcttcacctccttcttctaattctaattcttattcgaattctaattcttcttcgtcttcgtcgtcgtggatccatctacggtcggttctctttgtggctaatctttcgtctccgtcttcagttacttcttccgatcggtgagtagcctaaagcttttagatttggaatattttagatggcatctaaaagattctcttttttgatccaataatagagttcggattgaatgttcacaacttggaaagtatgataaagattaacaagtttctatgtttgttcggattgtttatttgttttgctgttagattgattttggcaatcaatgttgttgattttgatattgtaaaagcttctaatgttgactcttgacttgtttatagccggcggaaatcaccgtggtctcgccggaaaagaaaatgggcattgacgccacatcaatggaggagtttatttacaccggagggaaaactccgtgatggtggagttggattcctgaagaaagttagaagcagagtgagtcttttgaacaaggaccatatgtatgtcttgtttcttacttgtctctttactggttctgatttatgttcttatggttctgtagggtgttgatccaagtattcgtgcagaagtgtggctgttcttactcggagtgtgagtgtttgttcttgttttgactttatggtcttggttatttttattcactctgttgagattctcaacttgttttctcttatggcagttatgatttgaatagtactagtgaagaaagagaagcagtgaaaactcaaaaaaggttagtatttagtttgatctatatatagtcaatgtttgtatttagatgctgatagataatttcattgttgggatctttgaattgtaggaaggagtatgagaaactacagagacgatgtcagatgcttctcaagtgcggtaatggaagtaccgataatcttgaggagcttccatctgatgaggcaaacagtcaatgtgttcggttcgtggatgattataagattacaggaccaatgacaagtcaagatgttgtttctgctttgaacactgattcttctgatacagactcttgtgaagataatgaagatgttttactactctcatcttttgcacacagcgatgaaaaaaagccggaggaggataatagtaataacaattctgaagagaatagttctcttcttgtagctgctgcttctgaggtccaagtagaagttgcggtacacgaagatttctctacgtggcaacgtatcatccggcttgatgctttacgagcggattctgaatgggcaaattattctccatattcaacagcaatcacagaaagcaaagctcgcaggttagccgaatctgtcgggttaaaagactatgatcacttagaaagctgcaggctataccacgcagcacggttagttgcaattcttgaagcttatgctatgtatgatcctgagataggctactgtcaaggaatgagtgatctgttatctccaatcctcgctgtgatctcagaggatcacgaggctttctggtgctttgttggtttcatgaagaaagctcggcacaatttcaggcttgacgaagcagggattcaaagacagctaagcattgtatcaaagatcataaaaaataaagactctcagctttataaacacttggagaatcttcaagcagaagattgtagtttcgtttacaggatggtgcttgttatgtttaggagggagttgagttttgaacagacgctgtgtctctgggaagtgatgtgggctgatcaagctgccattagagctggagttgggaagtcgccatggagcagaatccggcaacaagcaccgccaacggatgatttgttgctctatgcaatcgcggcgttagtactacgtaggaaactgatcatacagaaatacagtagtatggatgagattgtggaagagtgtaatagcatggctggtcagcttaatgtctggaagcttcttgatgatgcccatcatcttgtcgtgacgcttcacgacaagattgaaactctttctcaatcacagagtatttga

SEQ ID NO: 376 - DNA, 1742 bp, Arabidopsis thaliana
cttagatcttttgatctcctaattatataaaatattttcttctaccgtttgtctatataaccatatgtgttgtctagtgcatgtattcagccacgaataagagaatagtctactaaatcaatggcaactttacgtataagttcagctcttatttaccaaaataccctcacccaccattttcgtcttcgacgtcctcaccgtttcgtatgcaagtccatgaccaaaacgacgccggatactactcttgttgaactcagtcgacgctccggaaactatcaaccttcaccgtggaaccattgttatctcctctccatcgagaataaatatgcggtaaagttttgtactatattttcataattttttattgttgcacctaagtttcacttttatttatgaattcttttattaacaagttgttactacgtgcatgtttaaacatatgtatgtatatacagagtgaaacagaagtaataactagagatgtgttgaagaaaaaagtgaagagcatgcttgatgatgagaagaagagccgtctcgagcaattagagctcatcgatgatctgcaaaaacttggggtttcgtatcattttgagatagaaataaatgatactttgacagatcttcatcttaaaatgggaagaaattgctggaaatgtgacaaggaagaagatttacatgcaacctcactcgaattccgacttcttagacaacatggttttgatgtctcagaaagttagtataatataatgaaattttaaatttctatatataataaattttgttgtgtgatcaatatcatatattaactgaaacaaccgtttatttcagatatatttgatgtgatcatcgaccaaatagaaagtaatacgttcaagaccaacaatataaacggtatcatttctttgtacgaagcgtcgtatctttccacgaaatcggatactaaattgcataaagtcatcagaccttttgcaacagaacaaataagaaaatttgttgatgatgaagatactaaaaacattgaggtacgagagaaggcgtatcatgccttagaaatgccgtaccattggagaatgagaaggctagacacgagatggtacatagatgcatatgagaagaaacatgacatgaatcttgtcttgatcgagtttgcaaaaattgatttcaatatcgtacaagctgctcatcaagaagatctcaaatacgtttcaaggtaatactatcaaagaaatatagatactagtctttcgttgttaattattgtatacataattcgttctaatcctctttcgttaatgatatgaagatggtggaaggatacatgtttgactaaccaacttccctttgtaagagatagaatagtcgagaactatttttggaccgttggattaatatacgaaccacaatttggatatatccgacggatcatgactatagttaatgcccttgttacaaccattgacgacatctacgatatctatggcactcttgaagaactagaactattcacttccatggttgaaaagttaagaaatattctacctttttttggtcaatcaattggttattttgcagctgtaccatggtctaccactagaccattattacagaaatcttctacttaagcttcttcattttcttggtatattattataaaataataactgatcacacacacacacatatatatatatatatatatcaaataattttttgcttttcgtattattgcggttgttaatgta

SEQ ID NO: 377 - DNA, 522 bp, Arabidopsis thaliana
atggctgaaacatctgatgtatcgccattgaagcgttacagagaacaagaaaccctagtcgaggaagaaacgaacaaacgacaaaagccaacttcgtcatcatcctctgcctcttacaaccaaattctctgtcttctcaacgattcagacgaacaaaaccaacacaacaatgacctaacttccttcataaacgctcttcagcaagaaatatcatcggatgaccaatacgccgtcgtttcagaaacctccaacgtcgaagactcgttttcttcatgtgtttcctcaaaggaagaagaagtggaagatgacagcaaggagaaagtgatgcagcatcttttggaagcttccgatgacgaacttgggatccctaacacagattttggcgagagtaattatgaaaaggctaatgacggttacgtttatggagatagtttgttagatgggtttggtgatgcgttttgggagcttgaagacgaagctgctaattattacacgttgctgcagtctgagctgttcatgtag

SEQ ID NO: 378 - DNA, 3264 bp, Arabidopsis thaliana
ttaattaagtctctcctcaaacccaaaagatgaacctgcaaactcctcgtaaaagctcactttcaggatctaggaaagatttgtggtttgctatacgggaaggttcgttggttgatgtggattcagcacttagcatactcaagaagactggtggcaatataaatttaaggaatgcctatggtctcactcctctgcatattgctgtatggagaaatcacattcctattgttaggagactgcttgctgctggcgctgatccagatgctagggatggagaatctggttggagtagtcttcaccgagctttgcattttggccatctcgcggtagctagcgtattgattgactcaggtgcttcttttactctagaagacataaaactgcgaacaccggttgatttggtctcaggtccagtggctcaggttattggcgagcaacaaagttcggtggctacagaggttttcagctggggaaatggtgcaaactaccaacttggaactggcaatcaacatgttcagaaggtaccagggagagttgattcactgcatggttgttttattaagttggtctccgctgcaaagtttcatagtgttgccattagtactcatggagaagtctacacgtggggatttggaaggggtggccgccttggacatcctgaatttgacattcatagtggtcaagctgcagtgattactccccgccaggtgatatctggtttaggatctcgccgtgtaaaagcagttgcggcagctaagcaccacactgttattgctacagaaggcggggatgtgtacacatggggttccaatagagagggtcagcttggttatacctctgtggatactcaggcaacaccccgcaaagtgacttcattgaaggcgaagattgtagctgtttctgcagcaaacaaacacaccgccgtagtttctgactgcggtgaagttttcacttggggatgcaacaaggaaggtcagcttggttatggaacctccaactcagcatcaaactactctcccagattggttgattacttgaaaggaaaagtgttcacggctattgcatcttcaaaatatcacactctagtgctgcgaaatgatggagaggtgtacacctggggtcatcggctggtgactccaagacgtgttatcatttcccggaatttaaagaaagctgggaacacactattgaattttcatcgaaggagacctcttcgattgactgcaatagctgcgggaatggtacacagcttggctctagcagaagatggtgcattcttttattgggtttcctctgactccaatcttagatgccaacagttgcattcgctgcacggtaaaacagttgtgagcatttcagcgggtaaatactgggcatctgctgttactagtacaggtgaagtttacatgtgggatgggaagaatggtaaagatattgcaccatctctttctcgcctccacaacttgaaaagggcaaccacagttgctgttggcgaaactcatcttctggttgttggttctctgtatcatcctgcatatgctcctattgtgcttaagaagtctcagacactgcaagctgataaatgtagggaagaagaaaatgaagaactggatgagggttttatgtttgacgatgtggaatccgtgaacgtgttgcaatccgtgcaatacgataatcctaaggagaggatagtgcctagcttgaaaagtttatgcgagaaggtggccgcggagtgtattgtagagccacgaaatgctattcaattgcttgaaattgcggattcgcttggagcagaggatcttaagaagtactgtgaggacattgtgattcgaaaccttgactttattttgacattttctccccaatctattgcaaatacatcacctgatgttcttgccaatcttgagaaattactggatgacagatcatctgaaacatggagctcccgaccacttccaaccccaacagccacatttcctgttgttattgacagtgaagaggaggaaagtgagagcgacattctaagaactcgtgacagccatgtgaaacacttttccagtattggtggtactcgaatggattcattcttgcaaccagaagatgagctgactcaacacaattccaaagaagtccgagctttgaggaaaaagttgcaacaaattgagatacttgaagcaaaacaatcgagaggacaacttcttgatggtcagcaaatagcaaaacttcaaaagaaactagatatcgaaagttcactggtagaacttggtattcctgtggaagagtttccagaggcaaaagcaacaacagctttaccgctagaaggaaaggccaacaagaagggaaaaaagaagaaaaagggtaatcagagatttgtacaagttgagacattccctgaatttggtgaagttaaagtggaaatagatacgatgcaagacaaagaaattgaagaaatctgtgaagctatcaagccaaagggtggcaaaaccatgttggatacgacgatgattagtgggttccccaaagaatcagactttgtctcactctcgcaaaagaaagataatccacccgattcgccgagaagcaagaaacttgcaacggcagcaaacaagaagaagaacagaaagggtgggctttccatgttcttgactggtgctcttgatgatgtccctaaacctgttgttgctcctccaccaaggcctaagattgaaggtcctgtgtggggtggggctaagatttctaaaggattatcttccctgcgggatattcaagatgaacaaagcaagacccgctctcatgaacctgttaggactactaaaaatcagtcaggggatgattctcctggtaaaagtgaaggaaagatattactgagttccttcttgacttcgaagccgattccgatggaaccagccaaaagtttgcagcaatctgatgtggaaaaaggaactcctccttgggcttcctctgaaactccgcgtaaactgtctcgaccttctctcagagatatccagatgcaggaggtgaagaagcaacagtctctgtcccacagtccaaagacaaaaacatcaggcttcacagtcgcaaccgggcaaggatctccatcagattcgcctggaactaatcgctggttcaaaccagagatagatgctccatcagcaatccgatcaatccagatagaagaaaaagccatgaaggatctccgccgcttctacagtagcgtgaaggtagtcagaaaccagccttgatgatgtgagtgaatgagacatt

SEQ ID NO: 379 - DNA, 646 bp, Arabidopsis thaliana
ttaattaaatggcggcggttaggagacgagaacgagatgtggttgaagagaatggagttacgacgacgacggtgaaacgaaggaagatggaggaggaagtggatttagtggaatctaggataattctgtctccgtgtgtacaggcgacgaatcgcggtggaattgtggcgagaaattcagcaggagcgtcggagacgagtgttgttatagtacgacggcgagattctcctccggttgaagaacagtgtcaaatcgaagaagaagattcgtcggtttcgtgttgttctacatcggaagagaaatcgaaacggagaatcgaatttgtagatcttgaggaaaataacggtgacgatcgtgaaacagaaacgtcgtggatttacgatgatttgaataagagtgaggaatcgatgaacatggattcttcttcggtggctgttgaagatgtagagtctcgccgcaggttaaggaagagtctccatgagacggtgaaggaagctgagttagaagacttttttcaggtggcggagaaagatcttcggaataagttgttggaatgttctatgaagtataacttcgatttcgagaaagatgagccacttggtggaggaagatacgagtgggttaaattgaatccatgaatttaaat

SEQ ID NO: 380 - DNA, 1579 bp, Arabidopsis thaliana
ttaattaaatgaagcagaagaaccagcataagaagaagaagaagcgatcctgcgccgcgaaaccttccggtgatggaacgacgtcggacgggaacaaaaaagatgtggaggaagagaggaaggacggtgaaggaaagagggagatagaaaacgttggaaaaaattttatcgaatcgttaatggaagccttttgctcggtttcaatggaggaagcgatggctgcttataaggaagcaggcggagatctgaacaaagccgctgagattttatcggatctggtggaaagcggtgatgatccgtcgacgagttcggtggcgagtggttcttcgggtcaggaaacagcgtctacctctgagtatggggcagggtcaagttctagctgtagcgaagatttgactagagatagatggtttaagggaagcaagcagagtagagttattgctgctacagggatggtttcttctgtgattgcgaaggattacttgaagccaaaccctgtgcgaaaagagtttcctatgatggaacggtctaaagagctctgtgggaacgggaaaaaagctgcggatagagagaaagctgaacagttcttaagttcaatgcttggagatgattgcgagcttagcatggctgttgttagagatgttttgtgtcaatgtggctatgatgtcgacatggctttgaatgtcttgcttgacatgtcttcttcatcaactgatgattcattgagtggtaaatgtttcggcataggagtcagcgatagtctggcagagtcatcttttgatactgatacttctgattgtgaacttttctggggtggagactatagtcaaagggactacgcaaaagctctcatgagttctcaagatccttttgcaactacccaaggaattgatgagcttggtcttccacaaaaagtgttggagtctctgttcaacattcgccagaatcctaaacatgaatcaaagacaacgagttggaggaatgtggcaaagaaaatgcagtcacttggcattgatgcttcttcatctagtggggaagagcctcaccctaatacgtttgtgaaggatgacagttatcatgaacttagaaaaggtgcaaatgaccagtggaatgttacgaagtcctactatcaaaaagctgccgaagcatattcgaaaggagggagggctcatgcggcttacctttctgacaagggaagagtggcatctaaacaagctcaacgggctgatgagagggcaagccaagatatattcgttgcaagaaacaaaggtatagagaatgtggtaaccattgatctgcatggtcagcatgttaaaccagcaatgaagctactgaagctacatctcttatttggatcatatgttccttccattcagactctacgagtgatcacaggatgtggagcttctgggtttgggaagtctaaggtgaaacaatcagtggtaaagctgctagaaagagaaggagttaggtattgtgaagagaacagagggacactgctgatcaagcttgacggaggtagtagagagttcagtttcttagacacagagagtgactctgatgaataagtgataactaa

SEQ ID NO: 381 - DNA, 1568 bp, Glycine max
ttaattaaaaaaatggcatcggataaggtggtggaaacggtcatagcagggaactacgtggaaatggaaactgaagggaagcccaaggacgtaaaaaccaagctatcaagcttgttgtggcatggaggttctgtttatgatgcttggtttagctgtgcttctaaccaggtggcccaagtgctgcttacgttgccatactcattctcccaactgggaatgctttctggcatacttttccaaatcttctatggtttactcggaagttggacagcttacctcattagcattctctacgttgaatacagaacaagaaaagagagagaaaaagttaacttcagaaaccatgtcatccagtggtttgaagttcttgatggactcctcgggaagcactggagaaacgtgggtttggcctttaactgcacatttcttctgtttggatctgttatacaattgatagcttgtgcaagcaacatatattacataaatgacaacctggacaagaggacttggacttacatcttcggagcttgctgtgccaccactgtctttattccttcctttcacaactacagaatctggtcctttttgggcctccttatgaccacttacactgcttggtatctcacagttgcctctctccttcacggtcagatggaaggagttaagcattcgggtccgaccaaattggttctatattttacgggggccacaaacattctctacacattcgggggacatgctgttactgtggagataatgcacgcgatgtggaagcctcaaaagttcaaggccttatacttactggcaaccctgtatgtgctgacactgacgcttccatcggcagcagcagtgtattgggcatttggagacatgcttctaaatcactccaatgcttttgctctccttccaaaatcacccttccgtgacatggctgtcattttaatgctcatccaccagtttataacattcgggtttgcatgcaccccattatacttcgtgtgggagaaagcaatagggatgcacgagtgcaagagcctatgcaagcgtgcattggtgagattaccagttgtgatccccatatggttcttggccatcatattccccttctttggtcccatcaactccaccgttggctctctccttgtcagcttcaccgtttacatcatccccgccctcgcccacatcttcaccttcagatcaccctcttccagacagaatgcagtggaacaacctcccaaatttgttggaagatgggtgggaacctttattatcaacacttttgtggtggtgtgggtcctagtcgtaggatttggatttggagggtgggccagcatggtgaacttcatacgccagattgacacatttggactcttcacaaagtgttaccaatgccctccaccgcttctaccacctatgccgccgcatcagctcaacgccaccgcgccttccccacttcaccaccctcatcatgcacactaaggattgcactctttaaagttcaaattgagacccatctatgaagcggcaccctaggctctttggtgaaattattaacggtgcatttaaat

SEQ ID NO: 382 - DNA, 1612 bp, Arabidopsis thaliana
gtttgttgattaacccttaattaagccatgtataccgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtatagcgctacatgctatactgctgtgccgaccattcatcagatcatattggaccgccacgcgagccaccctgagacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaaacacaatttaaatacccagaaattggagctctgcagagc

SEQ ID NO: 383 - DNA, 2414 bp, Arabidopsis thaliana
ttcatttatttgtcagctttcaaactctttgtttcttgtttgttgattaacccttaattaagcacagtcatggcggtgatgaacggtggtcgtgcgacgaagcgagcgaggcgtagcaacagaatctcagctgatctttacgatttctctactttcccgacggcggagatcaacggcgagtcgacgactttgccgccgttccgagacggtgtgagaaccttcctcgcgacccacgcgcgtgtcactttccctccttcgacgctcttctcgagtttgatgacgtggcagatcatgcttagacctggagattcgacggacggttcagatctctcttctaaactcgtctctctcgacgttgtggaggaggatgtgacgagatcctctagatctgtttactgtgaacactgctgtgtcgttggtgagtctttgtccctctttaaatttcaaaaagtttcaaccttttatctcttacctcttgatatggtgcatgcatagactgagaaaatctgttggttttgaaggttggagtagtcatccagtgtgtagaaagaggtaccgcttcatcataaggtcaggaggagacactaaggcttgcacgaggtgtggtaatactcagaatttgtctgaaggtagcaattgcaaatggtgcagcatggctttagacattgaaaactgggtttactctcagctagaggataacactcacctccttcacggcgttatccactctaatggctacgctcatctactgtgtcttaatggaagagaaggtggctctggttttttgactggtcgtgccattatggacttctgggataggctttgttcctcccttgctgttcgaaaagctagtgtgatggatgtgtcaaggaagtatgggatggactaccggttgcttcatgggattactagagggtgttcgtggtacagtgagtggggttatgaattcaaatcggggagctatgcactcaccaaagaagcttaccagagtgcagtggatactttatctgcgattcctctctctgagtttttgttccaggggaggaaaccaagaactcagctccactccattattagcttctaccaatcactctcgtgttcagagcttgtgactgtcaaagacctcttctcctttctcctacagatgattcgtgagaacagttccaaacctgcatctaagtcgtctgtactgtgtgcttggtctaaaagtgatgtggaacgtgtacagcaaaccatggttaagatactgaaagcttcaggacgcccacaagccaactgggttacaaggtgggctctcaagaggtctatttgcaaatcagcctctccacaactgattgattactgtctcaagcattttggaggggttttggtggatgatggatctcgagtagtcagctcacgttgcaatcctggttcaaacgactttgagtacaggtaaacttacaagagatgtttcttcttattctgattggttggtttccagtgtgcataataatcttaacctttgcatatgaactccaggcttgaatctgtcaacaatgtgcaccgcttatctaatcaagatgtaaataatgcatcagtggagcatgtcaaacaggatttaagatatttgtatgaaactttattgcacccacaaaccatggccgagtttaggtctcgagctacaagagaaaaaatgattgacgcagccacaaaaatactggactgtaagcatttcataaaagattacctgtctagcacagtgaaccccgttgcaatcaacctctggtgctgtgttgagctttcggatgaactcaaagaatccccagcccctccacctgaacggttggttttgccattgaacgctactgtttccgaccttaaaatcgaagctgctaaggcttttcaggaagtgtatgcaatgttcaagaggtttgaagttgaggagctcctaggttacggttctatagatgactctattaccctgaaatttctagttggcacaaacggggtcatacggattaaagggagatgctcaaaacacgggctccttagataccgcatggagagaggggtggataattggaaagttgattgcaagtgtggcacaaaggatgatgatggcgagaggatgttggcctgtgatggatgtggtgtgtggcaccacactagatgtattgggatcaataacgctgatgccctaccttccaagttcctttgtttcagatgcattgagttgtacagcaagaaaccaaagcaatctaaaaaagagcgtggatctagtcaagtgcccaaagctggctttgtttgtagaggtgagtcagctgctatgggcagtggatctaatttatccgtaacacttagagtaggctgactgtatttatttaaatacccagcaaatacccagcaaattggagctctgcagagctttcgtt

SEQ ID NO: 384 - DNA, 1114 bp, Arabidopsis thaliana
ttaattaaatgggaggtgtgacttcttcaatggcggcgaagttggcgttttttcctccgaatccgccgtcgtacaagctggtcagagatgaaacaacggagctttttctaatgagcccttttccccatcgagaaaatgtcgacattttgcggctgcccacgcgccgaggcaccgaaatcgtggccatgtacatcagatacccaatggccgtcaccacccttctctactctcatggaaatgctgccgacatcggtcagatgtatgagctcttcatcgagctcagtattcacctccgcgtcaatttgatggggtatgactattcagggtatggccaatcatcagggaagcccacagaacaaaacacttatgctgatatcgaggctgcttacaaatgtctggaagagaattatggggctaagcaggagaacattattctctatggtcaatctgttggtagtggtccaaccgtggacctagctgctcgtttgcctcgactaagagcttccattcttcatagtccaattctttctgggcttagagttatgtatcccgttaagcgaacttattggtttgacatatacaagaacattgacaaaattacgctggtgaggtgtcctgtcctcgtgattcatggaacagcggatgatgtggttgacttctctcatgggaagcagctttgggaactctgccaagagaaatatgaaccgctatggctcaaaggtggaaaccattgtgatcttgaactctttcccgaatacataggccatctcaagaagtttgtgagcgctgtggagaaatctgcatcgaaaagaaacagttctttctcaagaagaagcatggaagggtgtgaacaacctcctcgtcatagtgtagatgctccaaggaagagtaaggacggacgagaaaaaccgaggaaaagcatagacagactaaggttccagggatacaagttgagccacatagagaaaccggagaagctgaaggttccatttgaagaaatggagaggtcaaggagaagcgtggacatatacagagataagtctcagccgatggagagagcacgtaagagtgtggattggttggacagaagtcgagctaccgaatgaggcgcgcc

SEQ ID NO: 385 - DNA, 1985 bp, Arabidopsis thaliana
ttaattaacgaagaatttacacggtttttgaagaagaagaagaagatgaagtataagcgtaagctaagtctctctgttgtcttcctctttgtcttctatctcgctgcggtgacttcagatctagagtctgaccggagagctttactcgctgttcgtaacagtgtccgtggccgtcctttgctatggaacatgagtgcttcttctccttgtaattggcacggagtccactgcgatgcgggtcgggtcacggctctccgattacccggatctggtttattcggttctttaccaatcggtggtattggtaatctaacccagcttaagactctttctctccggttcaattctctctctggtcctatcccttcggatttctccaaccttgttctcctccgttacttgtatcttcaaggtaatgccttttccggtgagattccgtcgcttctcttcacgcttccgagcataatcagaatcaatctaggggagaataaattctcgggtcggatcccggataatgtcaattctgcgacccggttggttactctgtatttggagaggaatcaactctctggtccgatccctgagatcacgcttcctcttcagcaattcaatgtttcttctaatcagttaaacgggtctattccgagttcgttgtcgtcttggcctcgaactgcttttgaaggtaacactctctgtgggaagcctttagacacttgtgaggcagagagccccaatggtggtgacgctggaggacccaatacgccgccggagaagaaagatagcgacaagttatccgccggagctattgtcgggattgtgatcggatgtgttgttggtctgttactgcttcttttgattctgttctgtctctgtagaaagagaaagaaagaagagaacgttccatctaggaatgttgaagctcctgtcgctgctgcgacttcctccgctgctataccaaaggaaacggtggttgttgtcccgccggctaaggctacggggtcggagagtggtgcggtgaataaagatttgacctttttcgtgaaatctttcggggaattcgatttggatggattgttgaaggcttcagctgaggttcttgggaaaggaacagttgggtcgtcgtataaggcaagctttgagcatgggttagtggtggctgtgaaacggttaagagatgttgtggtgcctgagaaagagttcagagagagattgcatgttttgggatcaatgagtcatgccaatctcgtgactctgatcgcttactatttcagccgtgacgagaagcttcttgtctttgagtacatgtctaaaggaagcttgtctgcgatattgcacgggaacaaaggaaacgggagaactccgttgaactgggaaaccagagccggtatagccttaggagctgcaagagcgattagctacctacattcgcgtgatgggacaacttctcatggaaacattaagtcctcgaacatactattatctgactcctatgaagctaaggtctctgattacggtcttgctcccatcattagttctacatctgcacctaaccgtattgatggctaccgtgcccctgaaatcactgatgctcgcaaaatatcccaaaaagctgatgtctatagctttggcgtcctaatccttgaattactcacaggtaagtctccaacgcatcagcagttgaatgaagaaggcgtagatttgccgagatgggtccaatctgttaccgagcaacaaacaccgtccgatgtgcttgatcccgagctcacaaggtaccaacctgagggcaatgagaacatcattcgtttattgaagatcggtatgagctgtacggctcagttcccagatagtcgtccttcgatggctgaagtcaccagactcattgaggaggtttctcattcatctggctccccaaatcctgtatccgactgattttttgggggtctaaattgattgatttgaatattgtttggggtcaagggcgcgcc

SEQ ID NO: 386 - DNA, 771 bp, Arabidopsis thaliana
ttaattaatctctctctcagaaactctttctccaataatggcagaggcaagtttctatatcggagtcataggaaatgtaatctccgtactagttttcctctcaccagtggagacgttttggaaaatagtgaagcggagatcaacggaggagtacaaaagcttgccgtacatttgcacgttgttaggatcatcgctatggacatattacggcatcgtcactcccggagaatatcttgtctccaccgttaatggctttggtgctcttgttgaaaccatctacgtttcactttttctcttttatgcccctcgacatctcaagctgaaaacagtggtagtggtagcgatgttgaacgtgttttttccaatcgcggcgattgtggcaacgagaagtgcgtttgaagatgagaagatgcgttctcaatcaataggtttcatatctgctggtctaaacattataatgtatggttctccactttcagcaatgaaaacagtagtgacaacaaagagcgtgaaatacatgccgttttggttgtcgtttttcctcttcttaaacggcgcgatttgggctgtctatgctttactccaacacgacgttttcttactcgtgccaaatggagtggggtttgtgtttgggacaatgcaactcatactttatggaatttacagaaatgccaaaccggttggtttaagcaacggtttaagtgagattgctcaagatgaagaggaaggcctcacatcacgtgttgaacctctcctctcttaaggcgcgcc

SEQ ID NO: 387 - DNA, 1536 bp, Arabidopsis thaliana
atgatcacggttgatcacaagagcgacactgtattgttaccaatatacggcaggatggttccattcaacgtgactacaataagaacagtcttaggcaatcaaaacaccatccgtgtaatattcaatgtcccgggtacacccttaaaccctaatgactctttgaaaaacaaggacgctatctacctcaaggaggtttcattccggaccaaggattcaaggcatagcagcgatgtagttcaacaggttaagagcctcagacggaaagtcatggcacgggagtcagagagagctgagagaacttcactggtgaaccaagaaaaacttcagattgtaaggaacaactcaaaacccttaagtttgtccaatctgtggatccgtccgccttttagtggacgcaagaagaatcgtgggacacttgaagctcatgtcaatggttttaggtattcaacgaccaacgagcgcgttgatgtcctgtttgcaaacataaagcatgcgttttttcagccggcggagaaggagatgaccaccctcttacattttcatctccacaaccacatcatggtaggaaccaagaaaacaaaagacgtacagttttatgtggaggtaatggatgttgtgcagtctttaggaggtaggaggagatcatcagcttatgatgcagatgagattgttgaagaacagagagagcgcgataggaaaaataagatcaacatggatttcaatcactttgcaaatcaggtcaacgatatgtggcaactaccccagtttgcaagtttgagcttagagtttgatcaacctctgagagagtttggtttcaatggtgtcccccacaagacatctaccttcataataccgacctcaagctgcttagttgagctgacagaatccccgttcttggtggtctgtctaagtgagattgagattgtgaatcttgagagagttgggtttggtcaaaagagctttgacatggctatcatcttcaaggacttgaagaaagatgttcttagggttgactcagttccaacaagttagttagaggggataaaggaatggcttgacactacagatataaagtactacgagagcaaactgaatctgaactggagacagatcctgaagacgatcacggatgatccgcagagctttacagatgctggaggatgggagtttttgaatcaggacggaagcgattcagagtctggcggctctgaggactcagacaaagggtatgaaccatcagatgtggaggttgagtctgagtcagaggacgagacatcagagagtgagtcagacgatgaagaagaagaagaggactcagagcaagagtcagaggaagagaaaggtaagacttgggctgagctggagagagaagctactaatgcagacagagagcatggagttgagtctgatagtgaggaagagaggaagagaaggaagatgaaagcgtttgggaaatcgcgtcctggaagtagcggtgcaggcggtagtagcagcatgaagaacatgccaccatctaaacgcagcaggcaccggtga

SEQ ID NO: 388 - DNA, 2253 bp, Arabidopsis thaliana
ttaattaatggtgtgatgaatgctaatgaggagggggagggttcacgttacccaatcactgatcgaaagaccggagagacgaaattcgatagggttgagagtcggacagagaagcatagtgaagaagagaaaactaatggaattactatggatgtgagaaatgggagttcaggtggactgcaaattccattgtcgcaacaaacagcggcaactgtctgttgggaaaggtttcttcatgtgagaaccattagagttctgcttgtcgaaaatgacgactgcactcgttatatcgttactgcacttcttcgcaattgtagctatgaagttgttgaggcgtcaaatgggatacaagcttggaaggtgttagaagatctaaacaatcatattgatattgtgctaacagaggtgatcatgccttacttatctggtatcggtctcttgtgcaagattttgaaccacaaatctcgtcggaacatccctgtcatcatgatgtcatctcatgactcaatggggctggtctttaagtgcttatcgaaaggagctgttgactttcttgttaagccaataagaaaaaatgagcttaagatcctttggcagcatgtttggagaagatgccaaagttctagtggtagtggaagtgagagcggaacgcatcaaactcaaaagtctgtgaaatcgaaaagtattaaaaaatctgatcaagattcaggaagcagtgatgagaatgaaaatgggagcattggcctgaatgctagtgatggaagtagtgatgggagtggcgctcagagctcttggacgaaaaaagctgtggatgttgatgacagtccacgagcggtatctctatgggaccgagttgatagcacttgcgcccaagtggtacattctaaccctgagtttccaagtaatcagttggttgcaccacctgctgagaaggagactcaagaacatgatgataaatttgaagatgtcacaatgggtagagacttggagattagcattcgtagaaactgtgatctggccctggagccaaaagatgaacccctatctaaaactactggcattatgagacaggataattcgtttgaaaagagctctagtaaatggaaaatgaaagttggaaaaggaccattggacctcagtagcgaaagtccttcaagtaaacaaatgcatgaagatggaggctcgagtttcaaagctatgtctagccaccttcaagataacagagaacctgaggcgcctaacactcacttgaaaactttagatacaaatgaagcttctgttaaaatttctgaagagctaatgcacgtggaacatagttcaaagaggcatagaggaactaaagatgatgggacactagttagggatgatcggaatgtgctgaggcgttcagagggctcagctttctcaaggtataatccagcctcaaatgccaataagatttctggtgggaacttaggaagcacttcgcttcaggataataatagtcaggatcttataaaaaagactgaagcagcatatgattgtcactcgaacatgaatgagagtctcccccataatcatcgctcacatgtcggtagcaataactttgatatgagttccacgactgagaacaacgctttcacaaaaccaggagctccaaaagtaagctcagcaggatcttcatcagtgaagcattcatcgtttcagcctttaccctgtgatcatcataataatcatgcctcctataaccttgtccatgtcgctgagaggaagaagctaccgccacaatgtggatcctcaaatgtgtacaacgaaacgattgaaggtaacaacaacacagtgaattacagtgtgaatggaagtgtatcaggtagtggtcatggaagtaatgggccatatggaagcagtaacggtatgaatgctggaggaatgaatatgggaagtgataatggtgctggcaaaaatggaaatggcgatggtagtggaagcggaagtggaagtggtagcggaaacttggcggatgaaaataagatctctcaaagggaagctgctttgacaaagttccgtcagaagagaaaagagaggtgcttccgaaagaaggtacgataccaaagccggaaaaaactagcagaacaacgccctcgagtgcgaggccaatttgtgcgtaaaacagccgctgcaactgatgataacgacataaaaaacattgaggatagctaacggaaaatcaacaaaacccactatttctcagcccaaaaacatgagtggcgcgcc

SEQ ID NO: 389 - DNA, 1806 bp, Synechocystis sp. PCC 6803
attcatttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgatacaagccaaagcagggtttaaggcgggcgtacaagattatcgcctgacctactatacccccgactacacccccaaggataccgacctgctcgcctgcttccgtatgaccccccaaccgggtgtacctgctgaagaagccgctgctgcggtggccgctgagtcttccaccggtacctggaccaccgtttggactgacaacctaactgacttggaccgctacaaaggtcgttgctatgacctggaagcagttcccaacgaagataaccaatattttgcttttattgcctatcctctagatttatttgaagaaggttccgtcaccaacgttttaacctctttggtcggtaacgtatttggttttaaggctctgcgggccctccgtttagaagatattcgttttcccgttgctttaattaaaaccttccaaggccctccccacggtattaccgttgagcgggacaaattaaacaaatacggtcgtcctctgcttggttgtaccatcaaacccaaacttggtctgtccgccaagaactacggtcgggctgtttacgaatgtctccggggtggtttggacttcaccaaagacgacgaaaacatcaactcccagcccttcatgcgttggcgcgatcgtttcctcttcgttcaagaggcgatcgaaaaagcccaggctgagaccaacgaaatgaaaggtcactacctgaacgtcaccgctggcacctgcgaagaaatgatgaaacgggccgagtttgccaaggaaattggcacccccatcatcatgcatgacttcttcaccggcggtttcactgccaacaccaccctcgctcgttggtgtcgggacaacggcattttgctccatattcaccgggcaatgcacgccgtagttgaccgtcagaaaaaccacgggatccacttccgggttttggccaagtgtctgcgtctgtccggcggtgaccacctccactccggtaccgtggttggtaaattggaaggggaacggggtatcaccatgggcttcgttgacctcatgcgcgaagattacgttgaggaagatcgctcccggggtattttcttcacccaagactatgcctccatgcctggcaccatgcccgtagcttccggtggtatccacgtatggcacatgcccgcgttggtggaaatcttcggtgatgattcctgcttacagtttggtggtggtactttgggtcacccctggggtaatgctcccggtgcaaccgctaaccgtgttgctttggaagcttgtgttcaagctcggaacgaaggtcgtaacctggctcgcgaaggtaatgacgttatccgggaagcctgtcgttggtcccctgagttggccgccgcctgcgaactctggaaagagatcaagtttgagttcgaggccatggataccctctaaattaaatacccagaaatacccagcaaattggagctctgcagagctttcgttcgtatcatcggtt

SEQ ID NO: 390 - DNA, 1966 bp, Synechocystis sp. PCC 6803
attcatttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggataattctactgtctctagtattgacattactccccaagatagatacaaccaacaattactagcccatgttcatcctccggactggattaatccttctcctaaagatcaatatgacctggtagttattggagctggcaccgctggtttagtcgtagctgctggggcagcgggtttaggtattggtcttaaagttgctttaattgaaaagcatttgatggggggcgattgtctcaactttggttgcattccttctaaggccctaattagctccgcaagggtggtaggagtaatgaataatgctaatagtttaggcatcaaaaaaccagacagcattgaaattgattttcccgctgtgatggcgagaatgcgtcaaattaggaccggcattagccaccatgactctgctcaaagatttcgggatttgggcattgatgtttttcttggagaaggacattttgttcgtaataatcaaattgaggtgggaggggctattcttaactacaaaaaagccataattgccactggagcgaaagcggttaaacctaacattcctggcatagaagaagtcggatttttaactaatgaaacagtgttttccttaacggcatgccccgatcgcctaggggtcattggaggtggcccgattgggtgtgagttagcccaagcttttcaacgattgggggcgcaagttacgctctttcatcggggtagtcatttgttgaacaaagaagatccggaagcggcggcgattgtacaggaatccttaatcaaagatggcattgaactaattttaaacgccaaattggaacgggcagaattaactgatcggggtaaagttttgcattacagggctaatggcgattctggcaccattgtagtggatgaaattctggttggtgcagggcgagcccctaatgtggaggaattaaacttagaggctgtgggggtaaaatttgatcgccgaggagtgaaagtcaacgattatttgcaaactaccagcccgcaaatttatgccgccggggatatttgtatggactggaaattcacccatgccgccgatgccgccgcccgcattgtgattaaaaatactctcttttctcccttcggtttaggacgcagtaaactaagcagtttaaccatgccttgggtaacctacaccgacccagaaattgcccatgtaggattaaatgaaactatggctgaggccttagacataggctataaaattattaaaattcccttttcccaggttgaccgggcgatcgccgctgacgagacagagggatttttgaaaattatccacgtagccaacagtgatgaaattttaggtgctaccattgttgcctcccatgccggggaaatgatttctgaaattaccacggctattgttaataaaattggcttaagcaaattagccggggtgatccatccctatcccacccaggccgaagcgattaaaaaagccgccgatacttaccgccgtactttgctcactaataatacgaaaaatttactaaaacttctaactaaatttcccagtaaattattctagatttaaatacccagcaaatacccagcaaattggagctctgcagagctttcgttcgtatcatcggtttcgacaacgttcgt

SEQ ID NO: 391 - DNA, 1669 bp, Arabidopsis thaliana
ttaattaaatgggtagatccaacgagcaagatctgctctctaccgagatcgttaatcgtgggatcgaaccatccggtcctaacgccggctcaccaacgttctcggttagggtcaggagacgtttgcctgattttcttcagtcggtgaacttgaagtacgtgaaacttggttaccactacctcataaaccatgcggtttatttggcgaccataccggttcttgtgctggtttttagtgctgaggttgggagtttaagcagagaagagatttggaagaagctttgggactatgatcttgcaactgttatcggattcttcggtgtctttgttttaaccgcttgtgtctacttcatgtctcgtcctcgctctgtttatcttattgatttcgcttgttacaagccctccgatgaacacaaggtgacaaaagaagagttcatagaactagcgagaaaatcagggaagttcgacgaagagacactcggtttcaagaagaggatcttacaagcctcaggcataggcgacgagacatacgtcccaagatccatctcttcatcagaaaacataacaacgatgaaagaaggtcgtgaagaagcctctacagtgatctttggagcactagacgaactcttcgagaagacacgtgtaaaacctaaagacgttggtgtccttgtggttaactgtagcattttcaacccgacaccgtcgttgtccgcaatggtgataaaccattacaagatgagagggaacatacttagttacaaccttggagggatgggatgttcggctggaatcatagctattgatcttgctcgtgacatgcttcagtctaaccctaatagttatgctgttgttgtgagtactgagatggttgggtataattggtacgtgggaagtgacaagtcaatggttatacctaattgtttctttaggatgggttgttctgccgttatgctctctaaccgtcgtcgtgactttcgccatgctaagtaccgtctcgagcacattgtccgaactcataaggctgctgacgaccgtagcttcaggagtgtgtaccaggaagaagatgaacaaggattcaaggggttgaagataagtagagacttaatggaagttggaggtgaagctctcaagacaaacatcactaccttaggtcctcttgtcctacctttctccgagcagcttctcttctttgctgctttgctccgccgaacattctcacctgctgccaaaacgtccacaaccacttccttctctacttccgccaccgcaaaaaccaatggaatcaagtcttcctcttccgatctgtccaagccatacatcccggactacaagctcgccttcgagcatttttgcttccacgcggcaagcaaagtagtgcttgaagagcttcaaaagaatctaggcttgagtgaagagaatatggaggcttctaggatgacacttcacaggtttggaaacacttctagcagtggaatctggtatgagttggcttacatggaggccaaggaaagtgttcgtagaggcgatagggtttggcagatcgctttcggttctggttttaagtgtaacagtgtggtgtggaaggcaatgaggaaggtgaagaagccaaccaggaacaatccttgggtggattgcatcaaccgttaccctgtgcctctctaaggcgcgcc

SEQ ID NO: 392 - DNA, 1322 bp, Arabidopsis thaliana
ttaattaatcgaataacttgaaaaggttttggttttgcagaagaaaatgaaggagaaggcggagagtggtggaggagtaggatacgtgagagcagatcagatagatttaaagagtctggacgagcaattgcagagacacttaagtaaagcatggacgatggagaagaggaagagtttgagtgatggtgaagataacgtcaataacacccgacataaccagaacaacttcggacatcgacagcttgtgtttcagaggccgcttcttggtggtggatatagcaacaacaacagcagcaagaacgacataattaggtcgaccgaggttgagaagtcgaggagagagtgggagattgatccttctaagcttataatcaaaagtgtgattgctagaggtacttttggtacggttcaccgtggaatctacgatggtcaagatgtcgccgtaaaactactagactggggagaagaggggcacaggtcagacgcagagatagcttcgcttagagctgctttcactcaagaagttgctgtgtggcataagctcgaccatcccaatgtcaccaagttcataggagcggcgatggggacatcggagatgagcatacaaacggaaaacgggcaaatgggaatgccgagtaacgtttgctgtgtcgtggttgagtattgccccggcggcgctctcaagtcattcctcatcaaaactcgccgccgcaaactcgccttcaaagtcgttatccaactctcccttgatcttgctcgcgggttgagttacttgcactctcagaagattgtgcatagagacgtgaaaacggagaacatgcttttagataagtcacgcaccttaaagattgcagattttggtgtggctcgtctagaggcttcaaaccctaacgacatgaccggtgagaccggaaccttgggctatatggctcctgaggtgctaaacgggagtccctacaacagaaagtgcgatgtgtatagctttgggatatgtctttgggagatttactgttgcgacatgccttatcctgacctcagcttctccgaagtaacctccgccgtcgtccgccagaatttgagaccagagatacctagatgttgtccaagctcgctggcgaacgtgatgaagaggtgttgggatgcgaatccggagaagcggccggagatggaggaagttgtggctatgttggaggctattgatacttccaaaggcggaggaatgattcctcctgaccaacaacaaggctgtttctgtttccgccgacaccgaggcccatgaagtacacacacatgcactacgttcccatattattaggcgcgcc

SEQ ID NO: 393 - DNA, 1077 bp, Arabidopsis thaliana
ttaattaagaaagaagaagaggacttgaatacggaagcttgagagaatgaaagcgatcgtgatctcggagccaggtaagccggaggttctgcaactccgtgatgtggcagacccagaagttaaagacgatgaggttctcatcagagttctcgctactgctttgaatcgtgcagatactctccaaagacttggcctttataatccaccacctggctcaagcccttaccttggtctcgaatgttctgggaccattgaatccgtcggtaaaggcgtctctcgatggaaagtcggagaccaggtgtgtgctcttctttctggaggaggttatgcagagaaagtttctgttcctgctggacaaattttcccaattcccgctggtatctctctaaaggatgcagcggctttccctgaagtggcatgcactgtttggtctactgtcttcatgatgggccgtctctctgttggtgaatcattcttgattcatggaggttcaagtgggattgggacatttgctattcagatagctaaacatctgggagtgagagtatttgtcacagctgggagtgatgaaaagctagctgcgtgcaaagaactcggggctgatgtttgtataaattacaaaaccgaggattttgttgcaaaggtaaaagcggaaaccgatgggaaaggagtggatgttatcttggactgcattggggcaccgtatttgcagaaaaatctcgacagcttaaactttgatggaaggttatgtattatcggtttaatgggaggagccaatgcagaaataaaactaagtagtctgcttccaaagcgtctcactgtcttaggagctgcattaagaccaagaagccctgaaaacaaagcagttgttgtaagggaagtcgagaagaatgtctggccagcgatagaagcagggaaggtaaaaccagtgatttacaagtatttaccattgtcacaagcagcagaaggtcatagccttatggagagtagcaaccatattggtaagattctccttgagacttgattctctgcaaagggagaaatgttcagagacaagagtcatggtcaaggcgcgcc

SEQ ID NO: 394 - DNA, 1792 bp, Nostoc punctiforme PCC 73102
ttcttgtttgttgattaacccttaattaatccgggcgcgcctgatttatcacaagtttgtacaaaaaagcaggctcctgcaggaccatggatgctagggcactttggcaacgataccaaaactggttatatttccacgagggattgggactgtacttagacataagtcgaatgcggttcgatgatgccttcgtggaatcgttgcagccgaagtttgacaaggcgtttgcggatatggctgaactggagaagggcgcgatcgcaaatcccgacgagaaccgcatggttggacactactggctgcgaaatcctgatttagcaccaactccagaacttacacaagaaatagtccaaaccctagaacaaatcgaagcctttgcggaaaaagtccaaacaggtgctattcatcctcccagagcaagccgcttcacggatattatctccattggcattggtggttccgccctcggcccccaattcgtcgcagaagctctcgctcctgatttcccacctctgaaaattcactttatcgataacaacgatccggcaggtatagatcgcgttctgaatcatctgcgaaatagcctcgccagcactttggttttggtaatctccaaatctggaggaacaccggaacctcgtaacggcatgattgaagttaaaaaagcctacgccggacacaatttggaatttgctcaatatgcggtagcaattaccagcgttgacagcaacctcgataaactggccaaagacgaaggttggctggcgagatttcccatgtatgactgggtaggaggacgcacctccgaaatgtctgctgtggggctagtaccagccgcattgcagggcattgatgttcgtgccatgctagatggcgcaaaagaaatggatgacgctacccgcgtcccagatgtgaaaaataacccagcagccttgcttgctttgtcttggtactttgctggcaatggaaagggtgaaaaagatatggttgtcttaccttacaaagacagcttatttttattcagtcgctatttgcaacagctggtgatggaatccttgggcaaggaaaaagacttagacggtaatgttgtccatcaaggcatcgccgtttacggcaacaaaggctcaacagatcaacacgcttacgttcagcagttgcgtgagggtgtagcgaatttctttgctaccttcgttgaagtgttggaggatcgtcagggcccatcgactgaaatagatccgggagttacatcaggcgattatctttccggttttctccaaggaacccgacaagcgctttatgaaaatcaccgcgattcgattacagttaccattccccaagttaacccccgaactgtaggggcattaatagctttgtatgaacgtgctgttggtttatacgctagcttggttaacgtcaacgcctaccatcagccaggggtagaagctggcaaaaaagcagccgcctccattctcgatttgcaaacacgagtggtagcagtcctgcaaaaagaaaaaactcccatttctcttgacgaactcgcaaagaaagcaggcgcatcagaccaaattgaggcaatttacaaaattttgcgtcatatccatgccaatcagcgaggtgtggttttgcaaggcgatcttcacaaacccggcagtttaaccgtttctgctagctgatagctctagtataaacatcacattttttccctaattgttgtatcagcagctcgagacccagcttcttgtacaaagtggtgataaattggagctctgcagagctttcgttcgtatcatcg

SEQ ID NO: 395 - DNA, 1772 bp, Bacillus subtilis subsp. subtilis str. 168
aaaaaagcaggctcctgcaggaccatgaaaacagactggtggaaggatgcagtggtgtaccaaatttacccgagaagctttcaggacagcaatggagacggaattggggacttgcgggggattatttcccgtcttgactacataaaggagctcggggcagatgtgatttggatttgcccgatctatccttctccgaatgttgattacggctatgatgtgacaaaccataaggcgattatggattcttacggaacaatggacgattttcacgagctgctggaccaggtgcatcagcggggattaaagctggtgatggactttgtgttaaatcacacctcggtcgagcatccgtggtttaaagaagcggagctggacaaaaacagcaaataccgtagctattattattggcgtcccggcacaaagaacggcccgccgacggactggctctcaaactatggatgcccggtctggcaatacgaagagcacaccggagaatactatctccatatgaatgccgtcaaacaagctgatttaaactgggaaaatcccgaagttcgccaggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacgaatccatgactatttaaaagaaatcacagatgaagtgttttctcattatgatgtcatgtctgtcggagaggtcggcagtgtcacaccggaagaaggcctgaaatatacgggaacagataagcatgagctgaatatgatttttcactttcagcatatggagcttgatcagcagcccggaaaagaacattgggatttgaagccccttgagctttctgatttaaaatcggttttgacaaaatggcaaaagaagcttgaacatcaaggctggaatacattgttttggtgcaaccacgaccagccccggattgtgtccagattcggagacgatggggaataccgcaaagcatcagcgaaaatgctggcagccgtaatttattttatgaagggcacgccgtatatttatcagggagaagaaatcgggatgacaaacgcgccgttcacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaatccgaacttcaccgcaatcaatgtggaggaagcgcagggagatcctgattctgtcttaaactattacaaaaagctgatcagcctgagaaagcagtacgctgacctcatgaaagggagctttgatcttttgcttccggacgatccgcagttgtttgtatacatgagagaaaacagtaaacaacagcttttgtcggtcaataatttttcaaaagagcaggctgtttttcagtggcctaagaactgcggcaaagctcaggcctcactgcttctcagcaattataacaacgatgatcttgatgacgaaatggtgttccggccttatgagagcagggtctatcttctggacaaaacaaactaatgattgaagtagcccggcatttttagccgggtttttctcgagacccagctttcttgtacaaa

SEQ ID NO: 396 - DNA, 743 bp, Arabidopsis thaliana
ttaattaaagttccttaaacttctgggttttgagttttgttcttggactaagagaatgagtgcttcgaagttcataaaatgtgttactgttggagatggggctgttgggaagacatgtatgcttatctgttacactagcaacaagtttcctactgattatataccgactgtgttcgacaatttcagtgccaatgtagctgtggatggacaaatcgttaatttagggctatgggacactgccggtcaagaagattacagtaggttaagaccattgagttatagaggagctgatatcttcgtcttagccttttcgcttattagcaaggcgagttacgaaaatgtactcaagaagtggatgcctgaacttcgtcggtttgcgccaaatgttcccatagttcttgttggtacaaagctagatctccgggatgacaagggatacctcgcggatcacaccaatgtcattacctctactcagggagaggaattgaggaagcaaattggtgcagctgcttatattgagtgtagttccaagactcaacaaaatgtgaaagcagtgtttgatacagcgatcaaggtggttcttcagcctccaaggaggaaagaggtcccgaggaggaggaagaatcatagaagatccggttgctccattgcgagtattgtctgtggaggttgcaccgctgcttaagacacaacaaaagtttcaacaacaatgtattcgtgactctctttctgtggggcgcgcc

SEQ ID NO: 397 - DNA, 803 bp, Arabidopsis thaliana
ttaattaattcttttggaaatagctctgatcggagtgttgctcgaacagcttgaagaagacgacgaagatatggctacttcgaagaaaatgatcacacgtgaagaatgggagaagaaactaaatgttgtgaagcttaggaaagaagatatgaatactttggtgatgaattttcttgtgactgaaggatatgttgaagctgctgagaaattccaaagggagtctggaaccaaaccagagatagatcttgcgaccattactgatcgaatggctgttaaaaaggctgttcaaaacggaaatgtcgaggatgcgattgaaaaagttaatgatttgaatcctgagatactagacacgaatccggagctcttttttcatcttcagcagcaaaggttgatagaattaattcgacaagggaagacagaagaggccttagagtttgctcaggaggaacttgcaccacgtggcgaagaaaaccaagcgtttctggaagaattggaaaaaactgtagccctacttgtttttgacgatgcctctacctgcccggttaaagagcttcttgatctttcccaccgtcttaagacagcaagtgaagtaaatgcagcgattcttacaagccagagccacgaaaaagatcctaaacttccaagcttgttgaagatgttgatttgggctcaaactcaactggacgagaaagcagtgtatccgcacattaatgatttgtctaccggtaagctcgaagacccgtcagaatgattccgtacttctttcagccattggaaatcagtagcaaaaaggaaggcgcgcc

SEQ ID NO: 398 - DNA, 1842 bp, Arabidopsis thaliana
ttaattaaatgaagtgttttcacttcaccaatggcgacaagagaacaacaacaacaatcgaagaaggagtaggaggaggagacagtgttgtttcaagagcttcaagactctcatgggctcgttctctaagcgtagcatcatccaccacttcagacccaactcgccggtccgagtttgactcagactggagtttctcaccggaaagacttacttttcccaagccattaagtcaacgttggatcggtggacttgttcctgagaatgatctaaaggtgtttactttcaaagagctgaaaatagctactaaaggtttcaatagaggtcttttgattggcgaaggagggtttggttgcgtttatagaggtgttgttgatgtttcagactctaatggttttgattcgaagattaatgttgctgttaaacagcttaatcgtcaaggtttacaggcatgactctaatctttttttgtttactctgttctgctttcaattagtctcgaaaatgtttcaactttgagccagtttggttcaagaaactttactttgtggtttgtgattgatttctcgaagtgggtctgttgttatgtgtgtgtatgactctgttaaagtttcaagtttagtgagctactaccaaatttgaacttaaaaggagaaactttactttatggtttgtgattgaattttgaattatgtgttgtgattggtttgtgtgtgtggctttgttctagtgttcaggggcataaggaatggatcaatgaggtgaattttctaggagtagtgaatcatccaaatcttgtgaagttagttgggtattgtgctgatgatgatgaaagagggatgcaaaggcttctagtctatgaacttatgtgtaataagagcttggaggatcatctcgtaggccgagttgtgtcggtatctctaccgtggatgatgaggttgaagattgcgcaagatgctgctcaaggcttagcttatcttcatgaagaaatggattttcaggttaagcatttcattgccatttatatgatttaagagtgttttgtgttttggttttgaatttgcttctgttgatcttttagttgatatttcgagatttcaagtcttcaaacatcttgcttgatgagagattcggtgcaaagctctcggattttggattagctaggcaaggacctcctgaaggacttggtcatgtctcaacttcagtatgtctctattggagcactctttaacataacatctcttgaagtctttaactttgtcttgtatggaaggttgtaggtacggttggttacgcagctcctgagtatgtacaaaccgggaaattgacggcaaagagtgatgtatggagctttggggtagtgttgtatgaactgatcacgggaagacgagcagtggatagaaatcgacctcgaggtgaacagaagcttttagaatgggtgaagccttatgtatcagactcgaagaagttccatctgattgtcgatccacggctcgaaggccagtactactgtatgaagtctgttcaaagagtagctgctttagcaaacaaatgtctaatgaagcaaccgaaatctcggcctaaaatgagcgaagtcgtatcactacttggacgcatcatcgatgaagaagcggaaaacgttcctccgccagttgctgatgaaacagaagagataatcaaagctgagctcaatggagagagtgagcctgagctaaagaagcaaggtagtagttatcgtaagaaggttcttgatcttagggataagatgaacttaaacaagtcgctttcgaagctagactggcgaaactggacaccaggactggtcagaacatggtagggcgcgcc

SEQ ID NO: 399 - DNA, 855 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggttttaactgctctgcggtctttccttctttttctggcggtaacctgtctgtccctggcgatcgccatgcccgcctgggctctaacggaggtgcccctgacagaaattgactataaaccctgtccagcagacttagcggaaggcaatgtgggcagtggttcgagcagcccggctaactgttttttggtaaccggcattgccaacaatcggacggggaaaacagtgtatgatgccgatgtttttggacgcatttacgatgctaaccacgaaccagccatgcaaaaccggactcgcttgggtaacattgccgaaattcctcctggaaaaagcgattttgaggtgcgcatcagtgtacccgcccagcaacctctacctttgcagttggagcagtttaaagcctcgggtttttccgctaaaatccgtggccaggcactgtaagctttgttgattgccctccgactggattacagtaaggtttcagatttaaatacccagccaaatacccagcaaattggagctctgcagagctttcgttcgtatcatcggtttcgacaac

SEQ ID NO: 400 - DNA, 967 bp, Arabidopsis thaliana
ttaattaaatgtggttttttggatcgaaaggagcatctggattctcttctcgttccacagcagaggaagtcacacatggtgttgatgggactggtctcactgccattgtcacaggagcatcaagtggtataggtgtagaaacagctcgtgttcttgcactgcgtggtgtgcatgtggttatggcggtgagaaacactggcgccggtgctaaagttaaggaagatattgtcaagcaagtccctggagctaaagttgatgtcatggagttagaactcagctcaatggaatctgtcaggaaatttgcatctgagtacaaatctgctggtcttccactcaacctcttgatcaacaatgccgggattatggcatgtccttttatgctctctaaggacaacatcgagctgcaattcgcaaccaaccatttaggacattttctgcttaccaaacttctgttagatacaatgaagaacacatcacgtgaaagcaaaagagaaggaaggattgttaacgtatcatcagaagctcatcgttactcgtacccagaaggagtccgctttgataagatcaacgacgagtcaagttacagtagtatacgtgcttatggacaatctaaactctgcaatgtattgcacgccaacgagcttgcaaagcaactgaaggaagatggagtcaatataacagcaaattcacttcatccaggagccattatgacaaatctatggggctacttcaactcctatttggctggagctgttggtgcagtggctaaatatatggtcaagtctgttccgcagggggcggcaacaacttgctatgtggcattgaatccacaggttgcaggagttacaggggaatacttctcagatagcaacattgctaaaccaatagaacttgtcaaagatacagaattggcgaagaagctttgggatttcagcactaagcttactgattcgcaatgaggcgcgcc

SEQ ID NO: 401 - DNA, 654 bp, Arabidopsis thaliana
ttaattaagaggattgattttaagggcttttttgtttgtttccgatcttgcggcagagatggcgtcaaggtttataaagtgtgtgaccgtcggagatggtgccgtcggaaaaacttgcatgctcatttcttacactagcaatacttttcctactgattatgtgccaactgttttcgacaacttcagtgctaatgtggttgttgatggcaacactgtcaatcttggattgtgggatactgctggtcaagaggactacaacaggttacgacctttgagttaccgtggtgctgatgttttcattcttgctttctctcttattagcaaggctagctatgagaatatagccaagaagtggattcctgagctcaggcattatgctcctggtgttcccattatccttgttgggacaaaactcgatcttcgagatgacaagcaattctttatagatcatcctggtgctgtgccaattactacaaaccagggagaggaactgaagaaactgattggatctgctgtctacattgaatgtagttcaaagacacagcagaacgtgaaggcagtgtttgatgcagctataaaagtggtgcttcagccaccaaagcagaagaagaagaaaaagaataagaaccgttgcgcgttcttgtgaggcgcgcc

SEQ ID NO: 402 - DNA, 1546 bp, Arabidopsis thaliana
ttaattaaatgacattgacgatcccaaacgcacctgggagctccgggtacttggatatgttcccagagagaaggatgtcgtattttgggaattcttacattctgggtttgactgtcactgccggaatcggtggccttctgttcggttatgatacaggtgtaatttccggtgcccttttgtacattaaggatgatttcgaagttgttaagcagagcagtttcttacaggaaactattgtaagtatggctttagttggtgccatgattggtgctgcagctggaggttggatcaatgactactacggtcgtaaaaaggcgactctttttgcagatgttgtctttgcagctggagctatcgttatggctgctgctcctgatccgtatgttttgatatcgggtcgtctcttggtcggtttaggagttggtgttgcttctgtgactgctccggtttatatagcggaagcatctccatcggaagttagaggtggacttgtgagcaccaacgtattgatgatcactggtggacagtttctttcatatctcgttaattctgctttcacacaggttccaggaacatggagatggatgcttggtgtttcaggcgttcccgctgtgattcagttcatcctcatgcttttcatgccagaatcccctcgatggcttttcatgaaaaatcgtaaagcggaagccatccaagtgctcgccagaacctatgacatctcgcggttagaagacgagattgatcatctttcagcggctgaagaggaagaaaaacaaaggaagcgcactgttggctacttggatgttttcagatccaaagaattgagacttgcatttcttgccggagcaggacttcaggcgtttcagcagttcactggtatcaatacagttatgtactacagccctacgatagtccaaatggctggatttcactcaaaccagctcgctttgttcctgtctctcattgttgctgccatgaatgctgctggaacagtcgtggggatttacttcatcgatcattgtggaaggaaaaagctagctctctcaagtttatttggcgtcattatatcactcttaatcctctcagtctcgtttttcaaacaatctgagacatcatctgatggagggctctatggttggctcgctgtgcttggcttagctctatacattgttttctttgcaccgggaatgggaccagtcccatggacggtgaactcagagatataccctcaacaataccgaggcatatgcggaggcatgtcagctacagttaactggatcagcaatttgattgtggcacaaacattcttgacaatcgcggaagctgctggaacaggaatgactttcttgattttggcgggaattgcggttcttgctgtaatctttgtgattgtgtttgtccctgagactcaagggctaacgttttcggaagttgaacagatttggaaagaaagagcttatggaaatatcagtggctggggcagtagcagtgatagcaacaacatggaagggttactcgagcagggatctcaatcttaaggcgcgcc

SEQ ID NO: 403 - DNA, 1254 bp, Glycine max
ttcttgtttgttgattaacccttaattaatccgggcgcgcctgatttatcacaagtttgtacaaaaaagcaggctcctgcaggaccatgagtttccttcgttcttttgcaagaaacaaggatatatcaaaagtaggacgcagaggtatccattgcatgcagaaactatgtgcagaaaaaatatctcctgattcactagagaaggcccaaaatcgtgtgatagatgctgcactcacacttgttcgagaaaatacaaggcttaagaaagaactcgtgcatagtttgggaggtgctgtggcaacttcaactcttcttggagttcctttgggtcataattcatcgtttcttgaagggcctgcatttgcacctcctttcattagggaaggtatttggtgtggtagcgcaaactccacaactgaagaaggaaaggatttaaaggacttgcgaatcatggttgatgttggtgatatccctattcaagaaatgcgagattgtgggataggagatgagagactcatgaaagttgttagtgattctgtcaagctagtgatggaagaggatccattacgtcccttaattttgggtggtgatcactcaatctcatatccagttgtcagagccatatctgagaagcttgggggaccagttgatgttcttcattttgatgcacatcctgatctctatgatgaatttgaaggaaattattattcgcacgcttcttcttttgctcgaatcatggagggtggttatgctcgtcgactcttgcaggtcggtataagatcaataaacaaagaagggcgtgaacaagccaaaaagttcggggtagagcagtttgaaatgcgacatttttcgaaagatcgtccatttttggaaaacctgaatctaggagaaggtgctaaaggagtatacatttcaatcgatgtggattgtcttgatccagggtatgctgtaggagtgtcccactatgaatcaggaggtctttctttcagggatgttatgaacatgctgcaaaatctcaaaggtgacattgttggtggagacgtggttgaatacaacccacaacgtgacactcctgatcgtatgactgccatggtagctgctaagtttgtgagagaactcgctgcaaagatgtcaaaatgataactattaattctgcctcgtgtgtgtgacatttagtttacttcactcgagacccagctttcttgtacaaagtggtgataaattggagctctgcagagctttcgttcgtatcatc

SEQ ID NO: 404 - DNA, 1845 bp, Zea mays
ttcttgtttgttgattaacccttaattaatccgggcgcgcctgatttatcacaagtttgtacaaaaaagcaggctcctgcaggaccatgagtgaggtgaataatactcagctggaccttgagaaaggattttctcaagtgtctcatgataatgattcgagtagccctgtaacggtgcacaagatgaaagttgagacagaaggtggaagtgaaatcgaatcacccactccagaaaaacgtgaatctagaagcaaaggggtcgttgtgagttcactggcaaggaatttgcttgcagagaggtacaaagacagacttgcaaatcagctggtggaagatgagagtgagacagatgatgaagactataatgaaagtgtttcgcctagtggtagccgatctctttttttagaaagcattgaacttcttgagaaacacaaggatttgctgaatcttttcaatagaatggagagttctataagattgcttcacctacggaagaagatggctacatttaataatattgccacccaggtggagatactcacaaaaaggaagttattatacagccatttggcccagatgaagcatttgttcccagaagcaatccagataaagaggatactagtacatgacgagaagagcatatgcatgtatgctgatatggaaatcacacttgtaatggatgttgtggaatgcacaagccctgatcactctctatccatgacaatttgtgaggctttttactcaaagcttttgagatttttggatgctcatcataagggtgcagacattcctgaggcaatcctaccggaaccctttaactcaaggccaagggagaagttatatcttgaggcagtacataacggacatgctgctgagccacctctgcatggtgccgttgaggagggattctcaaatgcttcccacttcccacaatcttttcaaaaattcatgtcgaaaaaaatcattgctgatggaactgaaaagactcaattgctatccgacccagcagaactgagctctgtgagtgcttatggtacaaaagggtcaaacagaaaccctaaaaagcaagatgaacatgctccagttccagtgaactctgaaatttctgctactccaagccgccatttgatctcttgttgtcaagagagtacgccaaaacaacagacctcagagtcaccattgttgtctggaacacctgcaatgcagacaccaaaaaggccattgctggctccgcttgagaaacccaaggccacatgtggacacattagtgaaccacgttcagccagttctgcccgcagatcactaaatacatccttaacatatgaaggaggaagcccttcttattatgatggaatggaacatacggctacagctaaaaagtgcatgatctcagaagacttgtcaagttttaacaagtcatttgaggaagatagccatgtcttctttactgataaagacaaaatcaatgaagtggagtcagtggatagccaggaaaggatagcttctctacgtaccacatttgacattgtctatgatatttctcattctaccaagaatccacttatcacgaaacaggaacttttccacaatattcttgccaacaacttggagatagaagagattggggagatagaagagcagctgcatattttagaggatctggctcccgatttgatatcaaagaaggtgataaatggaggagaaatactttatagcatcgaacctataacagataagaattcagttcgggctaggcttgtagtagaacctgtatgactcgagacccagctttcttgtacaaagtggtgataaattggagctctgcagagctttcgttcgtatcatc

SEQ ID NO: 405 - DNA, 1469 bp, Zea mays
ttcttgtttgttgattaacccttaattaatccgggcgcgcctgatttatcacaagtttgtacaaaaaagcaggctcctgcaggaccatgaacattctacttgagcttaagcacctcaagccctttagcatccctgcaaggcttgtcatctgtaaaggccttctgatagtgattgcccttattttgttgagagcaattgtgtctccttttcttgctatagattcatctgagaagaaagagttttacgagtcaacagcccctgacttgcttcctagaattagacgtgacaagtttcttgaggtcccacagatcatatgggggttgaacaatcaaaagattgcattcgccagagcatgcttgactgcaagattcctgaacagatcccttctcatgccaagcttgagtgcttctctcttctacaaagaggttgacttgcttcagcctatcaattttgacaaagtgtttgactttaacaagttcaatgcgcgttgccatggcttcgtaaggttagctcagtattcagaagtttcaaatcgaaccgagcctttcaaactccaaaaggggactggtagaaggtggacggcagacagagatttggatcaactgcagcaatccatagggagcaatgcggatgactctgaagtcattgaaattgttgggaaaaatccatttctgtggcctgaccactggccagtcaaagactatgccaaaatctttgattgccttgtcttagttcctgagatagaaaccgaagtggttaatgtgatatccaagattagagaggcaggccaaagagcaagacatgaagctgggagttctcatagtaagcagaggagagatagctcaacgaatccgcctgtaccgtatgttgctgttcacatgaggatagaaaaagattggatgatacattgcaagaagtgggagcaacggtccaagtcgcatgaaatctgcagtagtaaagaagagatcattcataaggtctcacagatcactgatctacatcggccggttgttgtttatcttgcggtagctgacagccttcttgaagatgattcaataaccagtgggtggagagtgggtatggttgcttacgagaagaagaagcttggtgttactgacgtctacgatcggcagccatatcttataaagtctgccatcgactttgaggtgtgctcaagagcagatgtgtttgttggcaatagcttctcaacattctccaacctcgtagtgctgtccagaacagaaaggctgtataacctaggaaaggcgagctcatgtggcgagaacatcgggctttcatcgtatgcatacaatgtcatgggcggcgatggtggaccgcagagatggatgacggatatgtcggatggaagcctgcagaggttaagttacggaacaaataacgtctcatgccactgactcgagacccagctttcttgtacaaagtggtgataaattggagctctgcagagc

SEQ ID NO: 406 - DNA, 1137 bp, Arabidopsis thaliana
ttcttgtttgttgattaacccttaattaatccgggcgcgcctgatttatcacaagtttgtacaaaaaagcaggctcctgcaggaccatgtcggcggttctcacagccggcggaggcttaactgccggggatcgcagcattattacggcgattaacaccggcgcttcgagtctctcattcgtcggctcagccttcatcgttctctgctactgcctcttcaaagaacttcgaaaattctctttcaagctcgtcttctaccttgctctctctgatatgctttgcagtttcttcctaatcgttggggatccttcaaaggggttcatttgttacgcacaaggctacactactcatttcttctgcgttgcttcgttcttgtggacaactacaattgctttcactcttcatcgtactgttgtcaagcataaaactgatgtggaggatttggaagcaatgtttcatttgtatgtatgggggacttccttggttgtgactgtcatacgttcttttggtaacaaccactcacatttggggccatggtgctggacgcaaactggtcttaagggaaaggctgttcattttttaactttctacgctcctctttggggagccattctttacaatgggtttacttacttccaagtgatacggatgctaagaaatgctagacgtatggcagttggaatgtcagaccgagtcgatcaatttgataatagagcagagttaaaggtgttgaacagatggggatactatccactcattctaataggatcatgggcattcggcactattaaccgtatccatgatttcatcgagccagggcataagatcttctggctctcagttcttgacgttgggacagctgcactaatgggcttgttcaattcaatagcctatggtttcaacagctcagtgcgtcgagcaatccatgagagactggagctattcttgccagaacggctatatcgatggcttccaagcaatttcagaccaaaaaaccatctgattctacatcagcaacaacaacagcgaagcgaaatggtatcactcaagaccgaggaccagcaatgactcgagacccagctttcttgtacaaagtggtgataaattggagctctgcagagctttcgttcgtatcatc

SEQ ID NO: 407 - DNA, 621 bp, Arabidopsis thaliana
ttcttgtttgttgattaacccttaattaatccgggcgcgcctgatttatcacaagtttgtacaaaaaagcaggctcctgcaggaccaaaatgtccgaacaagaaggcaaaaatgagaagaaagtaactgaagggcaatggactaccggtttatacgactgtctctctgaagatatctctacatgctgctttacatgggtttgtccttgcgttgcatttgggaggatcgctgagatccttgataaaggagaaacaagtcgaggacttgctggattaatggtggtcgcaatgtctagcattgggtgtggatggtactatgcttcaaaatacagagccaaattgaggcatcaatacgctttgcccgaggcgccttgtgccgatggcgccattcactgcttctgctgtccatgtgctcttactcaagaacaccgcgaactcaaacatcgaggtcttgatccctctctagggtggaacattgagaatggaggattaaacagcaacacgcccccgtttgtagcgtcaggcatggaccgttaaggaacatcacaaattctcgagacccagctttcttgtacaaagtggtgataaattggagctctgcagagctttcgttcgtatcatc

SEQ ID NO: 408 - DNA, 234 bp, Arabidopsis thaliana
ttaattaatttttgggtttctctgaattggagcagaaaaaaaaaagatggaatcggatctggggaagctcttcattggtgggatttcgtgggatacagacgaagaaaggttaagagactactttagcaactatggtgatgttgttgaagctgtgatcatgagagatcgtgccacaggtcgtgcacgtggcttcggcttcattgtctttgcagacccctgtgtctcagagagagt

SEQ ID NO: 409 - DNA, 500 bp, Arabidopsis thaliana
ttaattaagaagaaaagatgccttcaagcacattctccgggactgttagcacgccgaagctgtcggtggcagtggacatgggaaacccttttctcaatctcaccgttgatgccttcctcaagatcggagctgttggagtcactaaatctcttgcagaagacacttacaaggccatcgacaaagggagtctctccaagagcactttggagcatgcgcttaagaagttgtgtaaagaaggtgtttactggggagctgctggtggagtgtacattggaacagaatacggaatcgaacgtatccgtggcagcagagattggaaaaacgcaatgttagcaggcgcggcgacaggagcagtgctctcagcggttggtaagaaaggcaaagacactattgtgatcgatgccattcttggtggcgcgcttgcaaccgcttctcagttcgttaacaatcattatttctactgattctccatcttcctttagggaccaatttggcgcgcc

SEQ ID NO: 410 - DNA, 1434 bp, Arabidopsis thaliana
ttaattaactcatattcagataagtcaaacttgaaaaaatggaagggactgtgttcacgccttgtttggaaggaatgaagcatgtcaaatctgatcaaggcgagatgcttactaagccatttttagagctttgcaagaccatcttgcctgttataggtaataaagggagaagctttttctaattgtttctttgtctgtcttaatacttttaatgaggttattgacatttgttattgtgattgttccttgttcttcaaaacttcgaagttcacgtatagcttgtgattgttcatttttcctatgtaacacaaatgttgtgtttcctacatgatgacttcatttttctgtggttatctattttccagataaatttggagctgctatgactctcgtgaaatctgacattggtggcaacataacggtaaaaaatgcattgtctgcccctttgataatcgaatagcacaaatctattttacattcacagtacaaactactgacaaaaatgcattgtctgccccttttctcgctcttcttagattgtaatgtgtacctctgatggcggagaataggctagtgaaaatgtcctgtagactgtagtagtgatatgacctctctgtattggattattgtcttcttacaatataactttattggtccgtctcttgtgtagaggttggagaagaactacttatctgatcccgacaagttcaagtacttgtacacctttgttcaagtcgaaattgagtctaagatagcaaaaggatcgtctagctgtacaaacggtcttctctggttaaccaggtaaacgatgacaacatgtcaacaatacacacctttatttcgaagagagcagcttctcaaaaccatatatatcacctatgagtgaatctttcagagcaatggatttcttagtggagctgttccgaaacttggtagcacatcaagactggtcaatgccacaagcttgtgctgactcataccaaaaaacactcaagaaatggcacggatggctcgccagctctaccttctctgtatgtactcactagtgcttctctgtgtaatcagcatattctgcaaaccaatctcattttgatttcctgagacacggtaaactttgtttttatcagatggctttaaagctagctccggacaggaagaagttcatggatgtcatatctggttctggtaacatccaagccgacatggaaaggttttgtgctgagtttggtccgtttcttcatgataatcataagtttctggtaaacaaagactttaaaaacttttgagtctttacactttcttcaatttcatcacacaggctttgattattttgttcttgttttctttttggcaggctagcgtcggtatggatgacatgaaagcttcttaagtcatcatatgattatcgccggtatcaaatcttcttggcgcgcc

SEQ ID NO: 411 - DNA, 757 bp, Arabidopsis thaliana
ttaattaacgagaaagatcctaagatggcgaccgcaagcgagagttcttcatctaagagatggcttccacttgaatctaacccagatgttatgaatcagtatctctggggacttggtcttgcccctgatgaagcagagtgcaatgatgtgtatgggttagacgatgaacttctagagatggttccaaagcctgttcttgctgttctcttcctttacccaatcaccaaaaagagtgaagaagagagaatcgagcaagacaaggaaattaaggaaaaggtgcatagcgataaagtttactttatgaaacaaactgttggtaatgcttgtggaaccattggtcttcttcatgctattgggaatattacctctgaaatcaaactctccgacggatcgttcttggatagattcttcaaatccactgccaacatgactcctatggagcgtgccaagtttctcgagaatgacagtcaaatagaagatgctcattctgtagctgttatagctggtgatacacctgcttcagaagacgcagacacgcatttcatttgtttagcttgtgtagaaggtgagctctatgaacttgatggaagaaaggcaggaccgatttcacacggtgcttcctctccagctaccctcctgaaggacgcaacaaaagtgataaagaagatgatcgagaagaatccgggctctctcaacttcaacctgatagccatctctaagagaacctgagggtcttttaaataaccgaaggcgcgcc

SEQ ID NO: 412 - DNA, 3150 bp, Arabidopsis thaliana
aaaagagaagtttccccgtgttgctttgtcacaagcttcatcactatttataactaccttgccaagaagaaagcctaaaaaggtataacagtttctttgtctttagagatcatcaaaaagatgtcgatctcttggactcgaaatttcttcgaaagattctgcgtcgaggaatacaatatagacaccataaaacagagtagtttcctctctgccgatcttctaccatctcttggagccaggatcaaccaatctactaagctccgcaaacacataatctctccttttaatccacgttacaggtaattttctcatctactaaactctgttttaagtactctgttttcaactatgttttcaactattcaggttataagtagttttaactactctgtttttactcacgttataagtatatttaaagactctgttttcaatcctctgtttgttgaaacagagcgtgggagatgtggctagtattactagttatttactcagcttggatttgcccatttcaatttgctttcatcacctataaaaaagacgcgattttcatcatcgacaacattgttaatggcttcttcgccattgatattattctcaccttcttcgtcgcttatctcgatagccactcctatcttctagttgacagtcctaagaaaatagcaataaggtgagaaaccttttttcttaacttgaaaccttttataagtgaatgagaatctcaaagtatgttttgaaattgtaacattttcaggtacctttcgacgtggttcgctttcgatgtttgttccacagcaccatttcagccactaagcctcttgtttaactacaacggaagcgaactaggattcagaattcttagcatgctcaggttatggcgtctccggcgagttagctcgctatttgcaaggtttgcttctatgctaactaagagaccatactcttcttagggtttaactaagaaagtgcttactcaagtctaactaactcttacctttgcttcaggcttgagaaagatatccgtttcaactatttctggatacgttgcacaaaactcatttcggttagttccaaaacagagcaaaactaatctcacttataataaagcattttaagcttagggctgtccatttaggtgatctattcttagggtttatttgtcttttaaatggacaccatattaaagctagtgacttacacgtgcttgttgatctcaggtcactttgttcgctatacattgtgctggatgtttcaactacctgattgcagatagatatcctaatccaagaaagacatggattggagctgtgtatccaaatttcaaagaagcaagtctatggaatagatatgtgactgctctttactggtccattacgacattaacgaccacgggatatggagattttcatgctgagaacccaagagaaatgctttttgacattttcttcatgatgttcaacctcggtttgacagcttacctcattggaaatatgaccaacctcgtcgttcattggactagccgaaccagaacctttgtaagtttgatcactttcttttagtctaggcatgttcatttcggataaaggttcgggtaatagcgtggggtttacgtacttttgagtattttaagttgactaaaataatattgagtattactaatctgtaatgctttattgctttgtgttaaacagagggattcagtgagagctgcttcagagtttgcttcaagaaatcaactcccacatgacatacaagatcaaatgttatcacacatttgcttaaagttcaaaacagagggcttgaaacaacaagagaccttgaacaatctgccaaaagcaatccggtcaagcattgcaaactatttattcttccccattgttcacaacatttacctctttcaaggagtttctcgtaacttcctctttcaattggtaaaattgtattctctaaccttttttcttaacgtttaatatgtaagaggtgaccaactccatgtaccttttcatgttcaaggtttcagatatagacgctgagtatttcccaccaaaagaagatataattctacaaaacgaagctcctactgatctttacattctggtgtcaggagcagtggtgagtgaaatatatcggttatatgtaaatatgtgaataacagttaggaatcttgtaacattgtgtattgtacaggacttcactgtctacgttgatggacatgatcagtttcaagggaaagcagtaattggagaaacatttggagaggttggagttttatactatagaccacaaccattcacagtaagaacaaccgagctatctcaaatactgcggataagcagaacatcgctgatgagtgcgatgcatgctcatgctgacgatggacgagtcatcatgaacaatctcttcatggtatgtgagttattatagaaatgtttctatagttaaaacaaactctaaactcatttttggctataaaactttcagaaacttagagggcaacagtcaatagcaatagatgattcgaatactagtggtcacgaaaacagagatttcaaaagcatgggatgggaagagtggagagattcaagaaaagatggctatggtttagatgttacgaatccgacttccgacactgctctaatggatgcgattcacaaggaagatactgaaatggttaagaagatacttaaggaacaaaagatagagagagccaaagtggaaagatcaagtagtgaaaccgctggaagaagttacgctaacgattcatcgaaaaaagatccatattgcagctcaagcaaccaaatcatcaagccatgcaaacgagaagaaaagagagttaccatccacatgatgtctgagagcaagaacgggaagttgatactcttaccatcatccatagaagagcttctaagacttgcaagtgagaagtttggaggctgcaacttcacaaagatcaccaatgcggacaacgctgagattgatgatttagatgtcatttgggatggtgatcatttgtatttttcatcaaattgagtttgaaaactcgacttcatttatagagcatgtatatctgcagataatgtatttttacccggtttcatagaaaagtctagattatcaaaagcagagtatacaaaactgacattaattgac

SEQ ID NO: 413 - DNA, 850 bp, Arabidopsis thaliana
ttaattaatgacgaaggattttccaattccaccggttgttttccccaccagtggatcatctccggccaccgcaaatgttcagcaacgccgagttcccacagctccttaccaaccaccacgtcaatcctccgcttcatcttcaatccctttcattccatttgaaatcggatccgccgccgtttcaatgccggcgggaccattcgacggaacaatcgcttcatctgcatctttcggtagaggagtctctgcttcgtttgaggatgaggagcctttactcgacgaactcggtatccatccagatcaaatctggaagaaaactagatcgattctcaatccttttcgaatcaatcagactgttcacaaagattcagatctctctggtccgatcttcttataccttgcgctttgcttatttcaattgctcgctgggaagatacagtttggtgttatacttggttgggttgttgtttcttctatcttcttgtacattgtcttcaatatgcttgctggtagaaatgggaatcttaatcttcatacttgtacgagtttagttggttactctctgcttcccgttgtgattttgtccgcggtgtccttgtttgtgccacaaggtgctggtcccgttcggtttgtgctcggtgcggctttcgtgttgtgggctactagagcttgttctaatctggtggtgtctcttgctgatggaggagaagagcaccgtggattgatttcgtacgcctgtttcttaatctatactctgttttcgcttctcgttatcttttgattccttgctttcgaatattgatagattgttgaactttccggtgccattactgagtagcttaggcgcgcc

SEQ ID NO: 414 - DNA, 1088 bp, Arabidopsis thaliana
ttaattaatcaaatctgattcaaccgtgtcgtagatttgcttcaatggagtggattcgaggagaaactatcggatacggaactttttctacagtaagtctagcgacgcggtctaataacgattccggcgagtttcctccgttaatggctgtgaaatctgcagactcatacggcgctgcttctctggcaaacgagaaatcagttctagataatctcggagacgattgcaacgagatcgtacggtgtttcggcgaggatcggacggtcgaaaacggtgaagagatgcataatttgttcttggaatacgcttctagaggaagcttagagagttatcttaagaaattagccggtgaaggtgtaccggaatccaccgtgcgtcgccacacaggatcggtgcttagaggtctacgacacatccacgctaacggattcgctcactgtgatttaaaactcgggaatattctgttgttcggtgacggcgccgttaagattgcggattttggattggcgaagagaattggggatttaacggcgttaaattacggtgtgcagattagaggtacgccgttgtacatggcgccggaatctgttaacgataacgagtacggatcagaaggtgacgtgtgggctttaggatgcgtagtagttgagatgtttagtggtaaaacggcatggagtttaaaagaagggtcgaacttcatgtcgttgttgttacgcatcggtgttggtgacgaggttccgatgattcccgaggagttgtcggaacaaggaagagattttttgtcaaagtgtttcgttaaagatcccaaaaagagatggacggctgagatgcttctaaaccatccatttgtaaccgtcgatgttgatcacgacgttttagtcaaagaagaagatttcgttgttaatatgaaaacagaggacgtctcgacatcgccgagatgcccattcgaatttcccgattgggtttcggtttcttccggttcacaaacgatcgattcgccggatgagagagttgctagtttggtgactgatatgatccctgattggtctgttaccaatagctgggtcaccgtacggtgacggcgcgcc

SEQ ID NO: 415 - DNA, 276 bp, Arabidopsis thaliana
ttaattaacggagataaagataaaggaatggcgtccctgaaatttccgttggagattctcgccgtcttcgtcatcatctccgtgattcttttgccgattgctcaatctcattcttcttcgccagctcccgcacccaccagcgatggaacatcgatagatcaggggatagcgtatgttctaatgatggtggctttggcgttgacttatttcattcattgacgtgatggatccgatctatttgttcttcctccataatggtttgtctttcggcgcgcc

SEQ ID NO: 416 - DNA, 1276 bp, Arabidopsis thaliana
ttaattaagtgtttgttgaatggaccttcttcgattgagagaaaagggtatatttttatctcagagaagaaggaaatggctgatttttatggcgatctctggagtttctggctatggagcttacaaggtttatcatttgccatctgttgccagaaaaaggaagcgtctttttaagcttttcggagccattgtctctgtagctgaattgatctctgattcagctgagaccttaagtatggtatcacgagacgtgaaggattttctcaattcagattcagatgaaatccctaacagcttgaagcagatcgcgaagatcacaacttcgaatgagtttacggattcgctttctagggtttctcaggctgtgactattggtgcctttcgtgggtacaaatccgaatcgtctattggtgattcaggaattgagaaatcatcagactcgagtgttgttgatagagtgattgataaggttttctcagaggctggaactggttttgtttcagttgttgttggtagctttgctaagaatcttgttcttggattttactctggtaaggtagagagtggtgtgaaatgtgagggttctgattcttctgagacacctagatgggtgactttgcttggtgatgacaagtgtagagagcttttagctgattgtattgagagattcaccagcactgcaattggtgtgtatcttgacaagacgatggatatcaatacttatgatcaaatctttgaaggcttgacgaatccgaaacatcaggatagtgtcaaggacgttcttgtttcggtttgtaacggtgctctcgagactattgttaggacatctcacgacgtgtttacatcttcaaggtctaagaatgtgatagaagagatcgaagatgatgatttcaagagtaatggttccgcgagaagcaagatggtttcggaatcaggagatggggtcaagagtaatgggtggactgaggctattgcaactacattggcagttccgagcaatcggaggtttatgtttgatgtaacaggaagagtaacactagaaacgacgagatcaatcatcgcatttataatggtgaagacatttcaagggttcagaaaaagtatcaatgtggttcatgaagaggttacagacagaggacgccaagcagttgaatatgttggagccaaatcttctgttataatcactgtatgccttgcgttgtacttgcacatcataagcggctgtgttcggaattctcccataggcgtaagccagcatttttagttctggcgcgcc

SEQ ID NO: 417 - DNA, 1449 bp, Zea mays
ttcttgtttgttgattaacccttaattaatccgggcgcgcctgatttatcacaagtttgtacaaaaaagcaggctcctgcaggaccatgtccgtggcggccggcgtgagcgacgcggccatcgcggtgcgcgacaagctccgtggaaagattggtcagaccaaggtcaaacggtactggccggggaaggcgcctgagtgggccgatgacgtcgatgaggacgtcgacctcaggacggcacgggtctccctcgacaaggcgttccccagggacgaggacggcgatgttcccgccaaggatgaccgccggctccgccggctcgcggagacccgcgcggagaataaggaggagctgagggcggatcaccgccgcatacggcaggcggagatcgtgtcaaccgcggaggaggagaacgagaggcaggaggctgacgccgacgaggaggatgaggaggcccaagaggagaggaggaggagaataagggcaaggcagctgctgagggagcaggaagagctgcttcctcaggaagaggaggaaccggtggaggccgaggagtctgaggaggaatctgagtacgagacagactctgaggatgagcagatgggaatggccatggtgaagcccgttttcataccaaagtcacagagagacaccatcgcggagcgcgaacggctggaggaggaggaacggcagcttgaggagctggtcaagaagaggctggaggctaggaagatcgagactagacagattgtggtcgaagagattagaaaggaggagcacatcgagaaggcactgaacgaagaggccaacatcgaggatgtcgatacagacgacgagttgaacgaagcagaggagtacgagtcgtggaaaaacagagaaatagcaaggattaagagggacagggaggaaagagatgcgaggttgaaggagaaggaggagatcgagaaagtcaggaatatgaccgaggaggagcgtcgcgaatgggagcggaagaatccgaagccgcttcgtcagacgaaacagaagtggaagtttatgcagaagtattaccacaaaggcgccttcttccaggaaggtgctgatgatgttatccagtcagcgggtaaagaggatatctacacccgtgatttctctgagcccactggagaagataagatggataagagcatcctgcccaaggtcatgcaagttaaacatttcgggcgcagcggcaggacgaaatggacgcatcttgttaatgaagacactacagattggaatgcaccatggtcaacaaatgggcctctgcgagcaaagtataatgcaaaaatggcaggcatgaatgcacctattgctaaaccaaagggaagtaagaagctgaaggattgggatgcaaaatgactcgagacccagctttcttgtacaaagtggtgataaattggagctctgcagagctttcgttcgtatcatc

SEQ ID NO: 418 - DNA, 803 bp, Zea mays
ttcttgtttgttgattaacccttaattaatccgggcgcgcctgatttatcacaagtttgtacaaaaaagcaggctcctgcaggaccatggagggccagttccaggttggcaaggaggaggtcatccaagcatggtacatggacgacagtgaagaggaccagaggcttcctcatcatcgtgagcccaaagaattcattcctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggctaagataaagaatttctttgaagaacacttgcatactgatgaagagatacgatattgccttgagggtagcggctaccttgatgtgagggaccaagatgatcagtggatccgtgtagcggtaaagaaagggggcatgatcgttttgcctgcaggaatgtatcatcgctttacgttggatagtgacaactacatcaaggcaatgcgtctatttgtgggtgagcctgtctggacaccatacaatcgtccgcatgaccatctcccggctaggaaggagtacgtcgagaaaatcatcaaccgaggtggaaaccaagccgtcgaagctcgttgagcgtgtccactctacatgtcctcctgccgtctcagcctcttgtgttttacctcgagacccagctttcttgtacaaagtggtgataaattggagctctgcagagctttcgttcgtatcatc

SEQ ID NO: 419 - DNA, 669 bp, Zea mays
ttcttgtttgttgattaacccttaattaatccgggcgcgcctgatttatcacaagtttgtacaaaaaagcaggctcctgcaggaccatgcagggcggcggcggcgtggaccagccgccgatgcagatggtgctgcgggtgaggcacccgtcgtcgctgggcggcagcggggcggacgaggacgacggcgaggggtcctctaggtcggcgctctcggtgttcaaggccaaggaggagcagatcgagcggcgcaagatggaggtccgggagaaggtgttcgcccacctcggacgcgtcgaggaggagtccaagcgactcgccttcatcaggcaggagcttgaagggatggccgaccctacaaggaaggaggtggagtcgataaggaagcggatcgacacggtgaaccgtcagctcaagcctctcagcaagagctgcgtcaagaaggagaaggagtacaaggaggtcctggaggcgtacaacgagaagagcaaagagaaggctctgctagtgaacaggctaatcgagcttgtgagcgaaagcgagaggatgcggatgaagaagctcgaggagctcaacaagacggtcgactcgctctactagctcgagacccagctttcttgtacaaagtggtgataaattggagctctgcagagctttcgttcgtatcatc

SEQ ID NO: 420 - DNA, 1564 bp, Arabidopsis thaliana
ttaattaaattttgaaatggcagatgggaacacaagattcacggtggatgaagctcttgtggcgatgggatttggcaagttccaaatttacgtccttgcttacgctggaatgggttgggttgcagaggccatggagatgatgcttctctctttcgttggacctgctgttcaatctctctggaatctctctgcacgccaggaaagcttaataactagcgtcgtttttgctggcatgctcattggtgcttactcttggggcattgtttctgataaacatggccgcaggaaagggtttatcataactgcggtggtgacttttgtagctggtttcttgagcgcattttcacctaactacatgtggttgatcattcttcgctgtttggttggtcttgggttgggaggaggtcctgttcttgcttcttggtatcttgaattcatacctgcaccaagccgagggacttggatggttgttttctcagctttctggaccgttggaaccatatttgaggcttcccttgcttggttagtcatgccaagattgggttggaggtggttacttgcattctcttcggtaccttcttcgttacttcttctgttctataggtggacatctgagtctcctcggtacttaattctacaaggccggaaagccgaagctcttgccatattagagaagattgcgaggatgaacaaaacccaactacctccgggtgttctcagttcagagttggagaccgagctggaagagaataaaaacattccaacagaaaatactcatcttctcaaggctggagaaagtggagaagcggttgctgtgtctaagattgtactaaaagctgataaggaaccaggtttctcattactagctcttctatctccaacgctaatgaagcggactttgctactatgggttgtgttctttggaaatgcgtttgcttactatggcgttgtccttctcaccaccgagctgaacaattcccataaccgctgctatccaaccgagaaacagttgcgaaattcaaacgatgttaactacagagacgttttcattgccagtttcgcagagtttccaggtctactgatatcagcagcaatggtggatagacttggacgaaaagcttcaatggcatcaatgttgttcacatgttgcattttccttctccctctgttatcccatcagtctccattcataaccaccgttcttctcttcggcggccgtatctgcatctcggcagctttcacagtggtttacatatatgctccggagatatatccaacggcagtgagaacaaccggagtaggagtagggagctcggtaggaagaattggaggaatcttatgtccactcgtagccgttggattagttcacggatgccatcagacgatcgctgttcttctgtttgaggttgtgattcttgtgtcaggaatttgcgtttgtctcttccctttcgagacaagtggtcgtgacctgacagatagtatctctgcgtccaaagaaccaccttcagcctccgtatagcaaaattcttctgaccatcgtagttgtttagttgttgggcgcgcc

SEQ ID NO: 421 - DNA, 1770 bp, Corynebacterium glutamicum
ttcttgtttgttgattaacccttaattaatccgggcgcgcctgatttatcacaagtttgtacaaaaaagcaggctcctgcaggaccatgactgcagcacagaccaaacctgacctcaccaccacggctggaaagctgtccgatcttcgctcccgtcttgcagaagctcaagctccaatgggcgaagcaactgtagaaaaagtgcacgctgctggcaggaagactgcccgcgaacgtatcgagtatttgctcgatgagggctctttcgtagagatcgatgctcttgctcgtcaccgttccaagaacttcggcctggatgccaagcgtccagttactgacggtgttgtgactggttacggcaccatcgatggccgtaaggtctgtgtgttctcccaggacggcgctgtattcggtggcgctttgggtgaagtttatggtgaaaagatcgttaaggttatggatcttgcgatcaagaccggtgtgcctttgatcggaatcaatgagggtgctggtgcgcgtatccaggaaggtgttgtgtctctgggtctgtactcacagatcttctaccgcaacacccaggcgtctggcgttatcccacagatctctttgatcatgggtgcctgcgctggtggtcacgtgtactcccctgctctgactgacttcatcgtcatggtggatcagacttccaagatgtttatcaccggccctgatgtcatcaagactgtcaccggtgaagatgtcacccaggaggagctcggtggcgctcacacccacatggctacctccggtacctcccattactctgcttctgatgattcagatgctttggattgggttcgcgagctgacctcttatcttccatccaacaaccgtgcggaaactcctcgccaggaggccgacatcatgatcggttccatccaggaaaacatcaacgatgtggatctggaattggacaccatcatcccggattccccgaaccagccttatgacatgaaggaagttatttcccgcatcgtcgacgacgccgagttcttcgagatccaggaagactacgcagagaacatcctgtgtggcttcgctcgcgttgagggccgttctgttggcatcgtggctaaccagccaacccagttcgctggctgcttggatattaaggcatctgagaaggctgcccgtttcatccgcacctgcgatgccttcaacatcccaatccttgagttcgtggacgttccaggcttcctgcctggcaccaaccaggaattcgacggcatcatccgccgcggcgcaaagctgctttacgcttacgctgaagcaaccgtcggcaagatcaccgtcatcacccgcaagtcctacggcggagcgtactgcgtgatgggttccaaggatatgggcgctgacctcgtattcgcttggcctaccgcacagatcgccgtcatgggcgcttcaggtgctgttggatttatctaccgtaaggaactcaagcaggctgccaccgaaggcaaggacgttgctgaggtcatgaagggctacgagcaggagtacgaagaaactctggtcaacccttatgtcgcagctgagcgtggcctggttgatgccgttatcccaccttctgagacccgcggccagatcattgagggtctgcgtctgctggatcgcaaggtggtcaatgttcctgctaaaaagcacggtaacattccactatagctcgagacccagctttcttgtacaaagtggtgataaattggagctctgcagagctttcgttcgtatcatc

SEQ ID NO: 422 - DNA, 1653 bp, Zea mays
ttcttgtttgttgattaacccttaattaatccgggcgcgcctgatttatcacaagtttgtacaaaaaagcaggctcctgcaggaccatgacgatcgcgcgacgcctgctccgatccaatgcctccgcccaggcaatcagcttactgaagcatgtaactggcactgcaagtttgcaaggccatgcacatagtccgttggatgcgtcagtcagacattttagttcagctccatctgcccagtctgacacaactgaagaaaatgggttcaagggccatggcatgttggcaccttttacagctggctggcagagcaatgatttgcatcctctaattattgagagatctgagggttcctatgtttatgacatcaatgggaataaatacctggattctcttgcagggttatggtgcacagctttaggtggtagcgagcctcgattagtcaaggcagcaactgagcaattaaacaatttgcccttctaccattccttttggaaccgcacaaccaaaccttcattggaccttgcacaggagatccttagcatgttcactgcaagggaaatgggaaaagttttcttcacaaacagtggttcagaagcaaatgactctcaggtcaaactagtatggtattataacaacgcattggggaggccagacaagaagaaatttattgcacgatcaaaagcataccatggatctacactgatatcagcgagcctaactggtcttcctgccctgcaccagaagtttgatctaccagcaccttttgttctgcacactgactgccctcactactggcgatatcatcttcctggtgagacggaagaagaatttgcgactagacttgccaccaatttagagaatcttattctcaaagaaggaccagaaacaatcgctgctttcattgctgaacctgtgatgggtgccggtggtgtcatccctcctccaaagacctattttgacaaggtcatcactgcatttggaaggttgggaactatgtttggatgcgattattataacatcaagccagatctagtttccttggccaaggctctttcaaatgcctatgtacccatcggggcaactcttgttagcccagagatatcagaggtgattcactcccagagcaataagctcggctcatttgctcatgggtttacatactctggtcatccagttgcctgtgcagtggcaatagaagctttgaaactttaccgcgaaagggatattcctggtcatgtcaagcaaatcgctccaaagttccaggacggaattagggcgttggcagacagcccaatcatcggggagatacgtggcttagggatgattatgggaaccgaattcaccaacaacaaatcaccggctgatctattccctgccgaatggggggttggtgccatctttggagaggagtgccagaagcgcggcatgctggtcagggttgctggcgacgccatcatgatgtcgcccacgctgatcatgacgcccggcgaggtcgacgagctggtgagcatctacggggaagccctcagggccacggaggagagggtgtcagacctgaagatgaaatccgagaagaactaactcgagacccagctttcttgtacaaagtggtgataaattggagctctgcagagctttcgttcgtatcatc

SEQ ID NO: 423 - DNA, 1251 bp, Zea mays
ttcttgtttgttgattaacccttaattaatccgggcgcgcctgatttatcacaagtttgtacaaaaaagcaggctcctgcaggaccatggcgtcggagccggtggcgcgggcggtggcggaggaggtgggccgctggggcagcatgaagcagacgggggtgaccctgcggtacatgatggagttcggctcccgccccacccagcgcaacctgctcctctccgcgcagttcctgcacaaggagctccccatccgcttcgcgcgccgcgcgctcgagctcgactcgctgcccttcggcctctccaacaagcccgccatcctcaaggtgcgggactggtacttggactcattccgggacatcagatacttccctgaagtgaggagccggaacgacgagctcgctttcacgcagatgatcaatatggtcaaggtgcggcataacaatgtggttccaaccatggccttgggagtgcagcagctgaagaaggagctgggccgctcaaggaaggttccattcgagttcgatgagatcgacgagttccttgaccggttctacatgtcaaggattggcatccgcatgctgatagggcagcatgtggctttgcatgaccctaaaccggagcctggtgttataggcctcatcaatacaagattatccccaatccaggtggctcaagctgcttgtgaagatgcccgttctgtctgtttaagggaatatggatcagctcctgatattaacatttatggcgatccaaattttacgtttccatacgtcacattacacctacacctgatgttatttgaattggtgaagaactctctccgcgcggtgcaagaacggtatatgaactctgataaagatgttcccccggttagaattatagttgctgatggagaagaggatgttactatcaaggttagcgatgaaggtggcgggataccaagaagcggcctcccgagaattttcacgtatctgtacagcaccgcaaagaatcctcctgagctagatagacctaatactgaaggggtaactatggctgggtatggtttcgggctcccgatcagccgactctacgctcggtattttggcggcgacctgcaaatcatctcgatggaaggatacggtaccgatgcttacctccacttgtcgcggctgggagattcagaggagcccttgccttgactcgagacccagctttcttgtacaaagtggtgataaattggagctctgcagagctttcgttcgtatcatc

SEQ ID NO: 424 - DNA, 1314 bp, Bacillus halodurans
ttcttgtttgttgattaacccttaattaatccgggcgcgcctgatttatcacaagtttgtacaaaaaagcaggctcctgcaggaccatgttcggacggaaagttttatcctttctcatgataattattttattagggacgatgctgcaagtaaaccaagcgtatgcattggaaagtgtgacactatttacgccacatactggtacgtccgccgcaccaggagatacaatacgctataacgtagatgtgatgaataacggctcttcgattcaaagcatgtcatttgcaatggaagggttacctaaaggatggaattataacataaagtctgacgaagcagacgttcgtgagctatctgtaaaagggaatagtgaggcttccataactgctgaaatctccgttcctctagatgcagataaaggggaatatcagtttgcattagtcgctacagatggcaacagtcaatcgactttagatttagcggtttctgtgacagagcaagggtcatttgaaacagaactaacgacaaaacaagggaacctagaagggcatgcagactctactttttcttatacggtgacgttaagcaataaaacggcagaggcacaaaattatgcgttaagcaattctgccgatgatggatggggagttcgctttttatctgaagggaattcggttacatctctatcattagacccgaatacctcgacagatttaaccgttgaagtaactccacctgaaaatgtggaagcggacacctatgagattccgattacagcctcgacgacagattcgaactcagagctcgtgttagaagcagttgtgacgggatcttatgggattgaagtgacgacaccgacgggtgtattaaatacagatatgactgctggagatgatcagactattgaattagttatcaccaatactggaaccgctccattgacagatattaacctttcagtagacgcaccttcagagtgggaggttgaatttgacgaaaataccattgctgatcttgaaccaggtgattcgaaaacagtaaaagcaactgtcacggcaccaaaagacgcaattgctggtgactatgttgcaaccttcacggcatcaacagatgaaacatcttcagatgctacatttcgaatttcagtggggacctccacagtttggggaattgtttcgatcgccattattttaggagtagtgggtggactgtattccatcattcggaaatttgggaggagataactcgagacccagctttcttgtacaaagtggtgataaattggagctctgcagagctttcgttcgtatcatc

SEQ ID NO: 425 - DNA, 2292 bp, Arabidopsis thaliana
ttcttgtttgttgattaacccttaattaatccgggcgcgcctgatttatcacaagtttgtacaaaaaagcaggctcctgcaggaccgtgattctactcattgcatttccgcgtttgtgaggagaaagaggagaagatgttgtgtgcttgttcaggcgaacaattccggttcgaggatcagcccggttcgccggaatccctagctacaagagatttctcagctagtggactttcttctcgaaacggaggaggcgattgggattccaaattggaagatattcaagtcgatgaagctgaatcgactttaaaggaagctctctcactcaactatgaggaagctagggctttgttggggagacttgaatatcagagaggtaattttgatgcagcacttcaagtgtttaaagggattgacattaaggtcttaactccaaggataatcaaagccattgttgagaaaactcttccttgcaaaccacgctctaaagctgttattgtgcctcccaccacaatgtcaatgcattcagtcagtttacttcttgaagcaatcttacttaaagctagatcacttgaagaacttggctcttacaaagaggctgcagaagaatgcaaaataatcctggacgtggttgaaaatgcactgccaagcggcatgcctgacggaatcagcggattcgctaaactgcaggatatctttcagaaggccctggaattgcttcctttactatggaaaaaagcggggaatcatcatgaaactattgcttcatatcgccgtgctttatccagaccatggaatttggatccccagaggttagctgttacgcagaaatccttagctttggttttactttacgggagtgttgaggcatgtccaaaagacaacatcgaggaagcaattgtgttgctaatgttacttgtaaagaagatggtggttggggacatacagtgggatccagaactcatggatcatctcacttacgccctttccatgactggacagtttgaagtgttagcgaactatctagagcagactcttccgggtgtttacacccgcggggagagatggtaccttctctccctttgttacagtgctgctgggatcgataaagcggccattaatctattaaagatggccctaggcccatctgaatcaagacaaataccacacattccgttgttattgtttggagcaaagctgtgctctaaagatccaaaacactcaagggacggcataaattttgctcataggctgctcgacttgggaaacagtcagagtgaacatcttttgagccaagcacacaagttccttggtgtatgctatggaaacgctgcaagaagttctaaattagactctgaacgggtttttcttcagaaaaaatctctgttctctttaaatgaagcagcaaagaggggtaaggctgatccggaactagacgttatatttaacctaagcgttgagaatgcagttcaaagaaatgttcaggcggctttggatggtgcggttgagtattctagtatggtgggaggagtttcaactaaaggatggaaacatttagctattgtcctttcagcggagaaacggctcaaggatgctgaatcaatactggacttcaccatggaagaggctggtgacattgaaaagatagagcttctgaggttaaaagctgtgcttcagatggctcaagaacaacctaaaaaggcaatgaagacatgcagcagcttactgggactaattcgagcgcaagagaaatctgaacaatccgagagtctgctacagaaatttgaaacggaagcttggcaagacctggcctctgtctatggaaagctaggttcatggtcagatgcagaaacatgtctcgagaaggcaagatccatgtgctattattctcccagaggctggaatgaaacaggtttgtgtctagaagctaaatcacttcatgaagaggctttaatatccttcttcctttcgctctcgatcgaaccagatcacgtacctagcattgtttctatagcagaggtcatgatgaaatctggagatgaatcacttccaaccgctaaaagttttctgatgaatgccttaaggttagacccgagaaatcatgatgcatggatgaagctagggcacgttgcaaagaagcaaggcttgtcacagcaagctgcagagttttaccaagctgcatatgaactagaactatccgctccggtacagagtttcatttgacgctcgagacccagctttcttgtacaaagtggtgataaattggagctctgcagagctttcgttcgtatcatc

SEQ ID NO: 426 - protein, 153 aa, Arabidopsis thaliana
MDSGTKVKKGAAGRRSGGGPKKKPVSRSVKSGLQFPVGRIGRYLKKGRYSKRVGTGAPVYLAAVLEYLAAEVLELAGNAARDNKKNRIIPRHVLLAVRNDEELGTLLKGVTIAHGGVLPNINPILLPKKSEKAASTTKTPKSPSKATKSPKKS

SEQ ID NO: 427 - protein, 115 aa, Arabidopsis thaliana
MPCLNLSTNVNLDGVDTSSILSEASSTVAKIIGKPENYVMIVLKGSVPMSFGGTEDPAAYGELVSIGGLNADVNKKLSAAVSAILETKLSVPKSRFFLKFYDTKGSFFGWNGATL

SEQ ID NO: 428 - protein, 378 aa, Arabidopsis thaliana
MAVVDVHRFAESITCHAWSPDLSMVALCPNNTEVHIYKSLSQGHWERLHVLQKHDQIVSGIDWSSKSNKIVTVSHDRNSYVWSLEGAEWVPTLVILRLNRAALCVQWSPKENKFAVGSGAKTVCICYYEQENNWWVSKLIRKRHESSVTSVAWHPNNVLLATTSTDGKCRVFSTFIKGVDTKDSKAGSPAETKFGEQILQLDLSYSWAFGVKWSPSGNTLAYVGHSSMIYFVDDVGPSPLAQSVAFRDLPLRDVLFISEKMVIGVGYDSNPMVFASDDTGIWSFIRYIGEKKAASSNSSYSSQFSEAFGKFYGSQSKSTTANDAPESRGGVHDNCINSIVSLSKAGSPKVMRFSTSGLDGKVAIWDLENMEQELGNQF

SEQ ID NO: 429 - protein, 143 aa, Arabidopsis thaliana
MNAENNQTTTTHSKVISHVFCTGTAKLGSVGPPIGLVDIGVSEVAYIFRVSLPGIEKNQDKIKCEIQREGRVCIQGVIPEIAIPSDTGCLYRMQVQQLCPPGPFSITFNLPGQVDPRLFSPNFRSDGIFEVVVVKLGVRIPTS

SEQ ID NO: 430 - protein, 571 aa, Arabidopsis thaliana
MKFMKLGSKPDTFESDGKFVKYAVSDLDSDVTIHVGEVTFHLHKFPLLSKSNRMQRLVFEASEEKTDEITILDMPGGYKAFEICAKFCYGMTVTLNAYNITAVRCAAEYLEMTEDADRGNLIYKIEVFLNSGIFRSWKDSIIVLQTTRSLLPWSEDLKLVGRCIDSVSAKILVNPETITWSYTFNRKLSGPDKIVEYHREKREENVIPKDWWVEDVCELEIDMFKRVISVVKSSGRMNNGVIAEALRYYVARWLPESMESLTSEASSNKDLVETVVFLLPKVNRAMSYSSCSFLLKLLKVSILVGADETVREDLVENVSLKLHEASVKDLLIHEVELVHRIVDQFMADEKRVSEDDRYKEFVLGNGILLSVGRLIDAYLALNSELTLSSFVELSELVPESARPIHDGLYKAIDTFMKEHPELTKSEKKRLCGLMDVRKLTNEASTHAAQNERLPLRVVVQVLYFEQLRANHSPVASVAASSHSPVEKTEENKGEEATKKVELSKKSRGSKSTRSGGGAQLMPSRSRRIFEKIWPGKGEISNKSSEVSSGSSQSPPAKSSSSSSRRRRHSIS

SEQ ID NO: 431 - protein, 97 aa, Arabidopsis thaliana
MSVEEDATVREPLDLIRLSIEERIYVKLRSDRELRGKLHAFDQHLNMILGDVEEVITTIEIDDETYEEIVRTTKRTVPFLFVRGDGVILVSPPLRTT

SEQ ID NO: 432 - protein, 216 aa, Arabidopsis thaliana
MALYRPLLLHHPTSPSVTTFLRNYPSKPIKFSSLPFLHRCRKSRVSSSSARCCSSMESPPEGYRRNVGVCLMNSSKKIFTASRLDIPSAWQMPQGGIDEGEDPRVAVMRELKEETGVHSAEILAEAPHWITYDFPPDVREKLKVRWGSDWKGQAQKWFLLKFTGKDEEINLLGDGTEKPEFGEWSWTSPDQVVENAVEFKKPVYKEVMSAFASHLQ

SEQ ID NO: 433 - protein, 766 aa, Arabidopsis thaliana
MASEPVNGGEGIDGAREKQIIKVYKRKGKGQRKQSSFFALEAAIEKPEGLLENENDNNDVSPAETLAPEFEDPIVVVKNSIEEAALGTNSHGDKNLTEAPSENLPGDDSDKVIDKPLVEAFSQAQPQDDASLAAMDKSEEVPSQIPKAQDDVNTVVVDENSIKEPPKSLAQEDVTTVIVDKNPIEAPSQTLSLEDGDTLVVDKNPIEVSSEEDVHVIDADNLIKEAHPENFVERDTTDAQQPAGLTSDSAHATAAGSMPMEEDADGRIRIHVASTTKQQKEEIRKKLEDQLNVVRGMVKKIEDKEGEIGAYNDSRVLINTGINNGGGRILSGFASAGLPREVIRAPRPVNQLSISVLENTQGVNEHVEKEKRTPKANQFYRNSEFLLGDKLPPAESNKKSKSSSKKQGGDVGHGFGAGTKVFKNCSALLERLMKHKHGWVFNAPVDVKGLGLLDYYTIIEHPMDLGTIKSALMKNLYKSPREFAEDVRLTFHNAMTYNPEGQDVHLMAVTLLQIFEERWAVIEADYNREMRFVTGYEMNLPTPTMRSRLGPTMPPPPINVRNTIDRADWSNRQPTTTPGRTPTSATPSGRTPALKKPKANEPNKRDMTYEEKQKLSGHLQNLPPDKLDAIVQIVNKRNTAVKLRDEEIEVDIDSVDPETLWELDRFVTNYKKGLSKKKRKAELAIQARAEAERNSQQQMAPAPAAHEFSREGGNTAKKTLPTPLPSQVEKQNNETSRSSSSSSSSSSSSSSDSDSDSSSSSGSDQT

SEQ ID NO: 434 - protein, 92 aa, Arabidopsis thaliana
MEDQKKPPTTEQEVKEVKNDDLESIKTPYLDYDNLEDYKMKGYGAQGHQEPKLGMGGGATDAPTPSGGLGRGGGAASTDLSSTDAINRQGVP

SEQ ID NO: 435 - protein, 585 aa, Arabidopsis thaliana
MRFRSLISLLFLLFFTSSAYARFVSLNPSSTSLISDGIDGGSNLAGSGSVIKSVVSAPAEEKEEACEQTYGFMPCTKTALGNVFLILVYGFLMFTAATYLSAGSELLLEILGPGIVGGLFLPMLGALPDAMLIMVSGLSGDAATAQSQVSVGMGLLAGSTVMLLTVIWGTCTVVGKCDLRDSIAVNNQDTKGFHLKDSGVTVDIWTSYAARIMAISVIPFVIVQLPQMLGSTSGRQLSVLIALILSVLMLISYCVYQVFQPWIQRRRLAFAKHKHVISGILRHLKQHALGRLLDDEGQPDEHVIRKLFLTIDANNDGHLSAAELKALIIGISFEDIDFDKDDAVGKVLQDFDKTLDEQVDQEEFVRGIKQWLIQAMGGAPSGPEAGPRTMKFLDNFHVQTKREHALLGDNENGENDEEGGEVADPKWITIKAALLLLLGAAIAAAFADPLVDTVNNFSAATGIPSFFISFIALPLATNSSEAVSAIIFASRKKIRTASLTFSELCGGVTMNNILCLSVFLAIVYVRGLTWNFSSEVLVILIVCLVMGGFASFRTTYPLWTCFIAYLLYPFSLGLVYILDYWFGWS

SEQ ID NO: 436 - protein, 167 aa, Arabidopsis thaliana
MAEDKILKKTPAAKKPRKPKTTTHPPYFQMIKEALMVLKEKNGSSPYAIAKKIEEKHKSLLPESFRKTLSLQLKNSVAKGKLVKIRASYKLSDTTKMITRQQDKKNKKNMKQEDKEITKRTRSSSTRPKKTVSVNKQEKKRKVKKARQPKSIKSSVGKKKAMKASAA

SEQ ID NO: 437 - protein, 174 aa, Arabidopsis thaliana
MKEDAGNPLHLTSLNHVSVLCRSVDESMNFYQKVLGFIPIRRPESLNFEGAWLFGHGIGIHLLCAPEPEKLPKKTAINPKDNHISFQCESMGVVEKKLEEMGIDYVRALVEEGGIQVDQLFFHDPDGFMIEICNCDSLPVVPLVGEMARSCSRVKLHQMVQPQPQTQIHQVVYP

SEQ ID NO: 438 - protein, 419 aa, Glycine max
MEHLPVEVIGNTLSLLGSARDVVVASVTCKKWREAWRNHLHSLSFNYCDWPLFHDFTSARLEILITQTIFQTKALQSLTIFLDDEHKFSAAPVIAWLMYTRDSLRQLLYNVRTTPCFNIIEKCSRQRLEVLALARNPITGVDPSYLKFPCLKSLSLSFISISALDLTLLLSACPKLETLAMVGVEIAMSDSQASVELSSVSLKFFDLELFSSDKFILEADLLEKLHLKDCSFEAFELIGKGTLKVLKIDDVNIIHLDIGDSTENLEIIDVCNFTVMWPKFYHMISKASKLYKLRLWGVVFDDEDEVVDIETISVCFPQLTHLSLSYDLRDGVLHYGLQGLSCLMNVVVLELGWTVISDLFSVWVAGLLEGCPNLKKLVIYGFVSEVKTHEECQILARFSEFILQLGRKYGHVKFEFEYE

SEQ ID NO: 439 - protein, 443 aa, Glycine max
MMKMGSSPSRCSFFLFLLLLVALFPSSLSEIRFSEIRNDDRSIVPFDQFGFTHKGRLELSVSKISLSNSNLDLSKVGFFLCTLDSWLHVFQQLEDGEIRCALQSDLVKSVYTFNSLNGKDSFSTLYKEETDADQYNLVFANCHSPQLKVTMDVKSAMYNLDGKSDVRDYLSAGRTILPRVYFLFSLVYFTLAALWISVLYKKRLTAFRIHYFMLAVVILKALNLLCEAEDKSYIKRTGSAHGWDIIFYIFSFLKGISLFTLIVLIGTGWSFLKPFLQDKEKKVLIVVIPLQVIANIAQVVIDENGPYGHDWATWKQVFLLVDVVCCCAVLFPIVWSIKNLREAARTDGKAAVNLMKLTLFRHYYVVVICYIYFTRVVVYALETITSYRYSWTSVVAAELATLAFYFFTGYKFKPEAHNPYFVIDDEEEEAAAEALKLEDEFEL

SEQ ID NO: 440 - protein, 111 aa, Arabidopsis thaliana
FSSKYEPFDSICFYLLILGEKKLSKVIVPDKWKDGARNVTEGGGRKINENKLLSKKNRWSPYSTCTTKCMICKQQVHQDGKYCHTCAYSKGVCAMCGKQVLDTKMYKQSNV

SEQ ID NO: 441 - protein, 669 aa, Arabidopsis thaliana
MFAPATQPQQQHEQKKQSETVSSAEEDALKWNTDCVYFLASPLTCKKGPECEYRHSEYARMNPRDCYYWLNGNCLNPKCGFRHPPLEGLLGNQGGAPAVSVQPIHATAQHPSVAKQPVPCLFFQKGMCMKGDMCSFLHTPNPAAYKKQHPVEAKPATDPQCSKKPIENNTEEKKLPDVNLSKVVKGHTDISAAPRVASTGLRDSRSVEGYIPNHVGYEPVVQRKGPGFPSFTEGGHSTQLLQKYGSDDNNSFHNGKDADDVLRESSPGFDVLVDNEAGDSEYYHVEDRYGRRSQERGNSEYDPDFSAIADGDKEALREQRFDSYDRREDRGWGHRRVSSEREDRLDRRVYAEDERSENILESDLRYRLAKQRKGNGMRLSVGGHDYAAPDSSMDRGYRESRRDTPRENSISSSRLQGRIKLRERSNGEEGHHFDRRSERGRDRSELPSQGRLRDRIKGRLEENHSGNQERGFGAPWARRREMEDERKSAPKSSREESKPEPSLGKRKSFEEDHHSHKRSRDSFAAPLPFSEILKRKKAAASGGSRNNNKDETISKEEAGDEIKLITEEKTEVVSEPKAEVEEEGTVMEEEEIVGEEVYEGNEDEQAYEGDELNGEYYYEEGYEEEGGEYAYEEGEEVVYAAEEGEEEATEGGEGEGEEDIEKKTVEMLS

SEQ ID NO: 442 - protein, 409 aa, Arabidopsis thaliana
MSVITTPIETLHLKSTLRLLPRAVYRSQRIQVFPPNIFSNTSLSSPLRIDPISQVGGSRNLWRRYASDNFSEMGLDPGADPFKVIEKPSIVDRMKKANSILPHVVLASTILALIYPPSFTWFTSRYFVPALGFLMFAVGINSNEKDFLEAFKRPKAILLGYVGQYLVKPVLGFIFGLAAVSLFQLPTPIGAGIMLVSCVSGAQLSNYATFLTDPALAPLSIVMTSLSTATAVLVTPMLSLLLIGKKLPVDVKGMISSILQVVIAPIAAGLLLNKLFPKVSNAIRPFLPILSVLDTACCVGAPLALNINSVMSPFGATILLLVTMFHLSAFLAGYFLTGSVFRNAPDAKAMQRTLSYETGMQSSLLALALATKFFQDPLVGIPPAISTVVMSLMGFTLVLIWSKEKSNTF

SEQ ID NO: 443 - protein, 295 aa, Arabidopsis thaliana
MEANSGGGGGAEGGRAVTGGGGGGGGSDVELVSKTLQVEHKLFYFDLKENPRGRYLKISEKTSATRSTIIVPSSGISWFLDLFNYYVNSEEHELFSKELQLDSKVFYFDIGENRRGRFLKVSEASVSRNRSTIIVPAGSSPDEGWAAFRNILAEIHEASGLFVMPNQKPSDGQEHLVDDVGAGFIPGHGSQQPSSSEHNVDRTIDSPGQEETGMTGVSKVIRADQKRFFFDLGNNNRGHFLRISEVAGSDRSSIILPLSGLKQFHEVIGHFVEITKDKIEGMTGANVRTVDPPQR

SEQ ID NO: 444 - protein, 386 aa, Glycine max
MEGEEGSQQPQLVLGDKLFLLRQPDVQDIDKVRYKEDVFTHINQNDMVPLYETLVADSVLDLDRALLDSMRAKIHDELANLDEKIADAEENLGESEVREAHLAKSLFFIRIMDKEKALEHLKVTETKTVAVGQKMDLVFYTLQLGFFDMDFDLISKSIDKAKNLFEEGGDWERKNRLKVYEGLYCMSTRNFEKAAKLFLDSISTFTTYELFPYDTFIFYTVLTSIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTEDFIDVELSRFIAAGKLHCKIDKVEGVLETNRPDAKNALYQATIKQGDFLLNRIQKLSRVIDL

SEQ ID NO: 445 - protein, 441 aa, Glycine max
MSQPKIKRRVGKYEVGRTIGEGTFAKVKFARNSETGEPVALKILDKEKVLKHKMAEQIRREVATMKLIKHPNVVRLYEVMGSKTKIYIVLEFVTGGELFDKIVNHGRMSENEARRYFQQLINAVDYCHSRGVYHRDLKPENLLLDTYGNLKVSDFGLSALSQQVRDDGLLHTTCGTPNYVAPEVLNDRGYDGATADLWSCGVILFVLVAGYLPFDDPNLMNLYKKISAAEFTCPPWLSFTARKLITRILDPDPTTRITIPEILDDEWFKKEYKPPIFEENGEINLDDVEAVFKDSEEHHVTEKKEEQPTAMNAFELISMSKGLNLENLFDTEQGFKRETRFTSKSPADEIINKIEEAAKPLGFDVQKKNYKMRLANVKAGRKGNLNVATEIFQVAPSLHMVEVRKAKGDTLEFHKFYKKLSTSLDDVVWKTEDDMQMRETK

SEQ ID NO: 446 - protein, 510 aa, Arabidopsis thaliana
MATIWFLPLLFLSCLLLAALRLKKRRQHQRKPPSPPGFPIIGNLHQLGELPHQSLWSLSKKYGPVMLLKFGSIPTVVVSSSETAKQALKIHDLNCCSRPSLAGLKQKSYDYLGPRALSYNYLDIVFSPFNDYWKELRRMCVQELFSPKQVHLIQPIREEEVKKLMNSFSESAAQKTPVNLSEKLASLTVGVICKAAFGVSFQGTVLNSDNFDKLIHDAFLFLGSFSASDYFPNVGWIIDWLTGLQGQRERSVRGLDAFYEQMFDLHKQGNKEGVEDFVDLLLKLEKEETVLGYGKLTRNHIKAVLMNVLLGGIGTSAITMTWAMTELMRNPRVMKKVQSEIRNQIGGKSMICLDDIDQLHYLKMVINETWRLHPPAPLLVPREVMSEFEINGYTIPAKTRLYVNVWGIGRDPDTWKDPEEFLPERFVNSNIDAKGQNFELLPFGSGRRMCPAMYMGTTMVEFGLANLLYHFDWKLPEGMVVEDIDMEESPGLNASKKNELVLVPRKYLNL

SEQ ID NO: 447 - protein, 376 aa, Arabidopsis thaliana
MAIRKEEESREEQSNSFLLDALYCEEEKWDDEGEEVEENSSLSSSSSPFVVLQQDLFWEDEDLVTLFSKEEEQGLSCLDDVYLSTDRKEAVGWILRVNAHYGFSTLAAVLAITYLDKFICSYSLQRDKPWMLQLVSVACLSLAAKVEETQVPLLLDFQVEETKYVFEAKTIQRMELLILSTLEWKMHLITPISFVDHIIRRLGLKNNAHWDFLNKCHRLLLSVISDSRFVGYLPSVVAAATMMRIIEQVDPFDPLSYQTNLLGVLNLTKEKVKTCYDLILQLPVDRIGLQIQIQSSKKRKSHDSSSSLNSPSCVIDANPFNSDESSNDSWSASSCNPPTSSSSPQQQPPLKKMRGAEENEKKKPILHLPWAIVATP

SEQ ID NO: 448 - protein, 725 aa, Arabidopsis thaliana
MEIEKSNNGGSNPSAGEEFKDMIKGVTKFLMMVIFLGTIMLWIMMPTLTYRTKWLPHLRIKFGTSTYFGATGTTLFMYMFPMMVVACLGCVYLHFKNRKSPHHIDRETKGGVWSKLRKPMLVKGPLGIVSVTEITFLAMFVALLLWCFITYLRNSFATITPKSAAAHDESLWQAKLESAALRLGLIGNICLAFLFLPVARGSSLLPAMGLTSESSIKYHIWLGHMVMALFTVHGLCYIIYWASMHEISQMIMWDTKGVSNLAGEIALAAGLVMWATTYPKIRRRFFEVFFYTHYLYIVFMLFFVLHVGISFSFIALPGFYIFLVDRFLRFLQSRENVRLLAARILPSDTMELTFSKNSKLVYSPTSIMFVNIPSISKLQWHPFTITSSSKLEPEKLSIVIKKEGKWSTKLHQRLSSSDQIDRLAVSVEGPYGPASADFLRHEALVMVCGGSGITPFISVIRDLIATSQKETCKIPKITLICAFKKSSEISMLDLVLPLSGLETELSSDINIKIEAFITRDNDAGDEAKAGKIKTLWFKPSLSDQSISSILGPNSWLWLGAILASSFLIFMIIIGIITRYYIYPIDHNTNKIYSLTSKTIIYILVISVSIMATCSAAMLWNKKKYGKVESKQVQNVDRPSPTSSPTSSWGYNSLREIESTPQESLVQRTNLHFGERPNLKKLLLDVEGSSVGVLVCGPKKMRQKVAEICSSGLAENLHFESISFSW

SEQ ID NO: 449 - protein, 662 aa, Arabidopsis thaliana
MGNGVTKLSICFTGGGGERLRPKDISVLLPDPLDEGLGHSFCYVRPDPTLISSSKVHSEEDTTTTTFRTISGASVSANTATPLSTSLYDPYGHIDRAAAFESTTSFSSIPLQPIPKSSGPIVLGSGPIERGFLSGPIEKGFMSGPLDRVGLFSGPLDKPNSDHHHQFQRSFSHGLALRVGSRKRSLVRILRRAISKTMSRGQNSIVAPIKSVKDSDNWGIRSEKSRNLHNENLTVNSLNFSSEVSLDDDVSLENQNLQWARGKAGEDRVHVVVSEEHGWLFVGIYDGFNGPDAPDYLLSHLYPVVHRELKGLLWDDSNVESKSQDLERSNGDESCSNQEKDETCERWWRCEWDRESQDLDRRLKEQISRRSGSDRLTNHSEVLEALSQALRKTEEAYLDTADKMLDENPELALMGSCVLVMLMKGEDIYVMNVGDSRAVLGQKSEPDYWLAKIRQDLERINEETMMNDLEGCEGDQSSLVPNLSAFQLTVDHSTNIEEEVERIRNEHPDDVTAVTNERVKGSLKVTRAFGAGFLKQPKWNNALLEMFQIDYVGKSPYINCLPSLYHHRLGSKDRFLILSSDGLYQYFTNEEAVSEVELFITLQPEGDPAQHLVQELLFRAAKKAGMDFHELLEIPQGERRRYHDDVSIVVISLEGRMWKSCV

SEQ ID NO: 450 - protein, 496 aa, Arabidopsis thaliana
MSLWYIIVAFVFFSTIIIVRNTRKTKKNLPPGPPRLPIIGNLHQLGSKPHSSMFKLSEKYGPLMALRFGSVSTVVASTPETVKEVLKTFDAECCSRPYMTYPARLTYNLKDIGFCPYTKYWREVRKMTVVELYTAKRVQSFQHTRKEEVASLVDFITQAASLEKPVNLNTKLMKLSGSVICRVVFGINLKGSKLENLYEEVIQGTMEVVGSFAAADYFPIIGRIIDRITGLHSKCEKIFKAMDAFFDQSIKHHLEDESIKDDIIDLLLKMERGEIELGEFQLTRDNTKGILFNILNAGIDTSAQVMTWVMTYLISNPRVMKKAQAEVREVIKNKDDIIEEDIERLEYLKMVVKETFRVLPLVPLLIPREASKDVKIGGYDIPKKTWIHVNIWAIHRNPNVWKDPEAFIPERFMDNQIDYKGLNFEFLPFGSGRRMCPGIGMGMALVHLTLINLLYRFDWKLPEGMEVEDVDLEESYGLVCPKKVPLQLIPVLTQWS

SEQ ID NO: 451 - protein, 321 aa, Arabidopsis thaliana
MDLQPEELQFLTIPQLLQESISIKKRSPRTFYLITLSFIFPLSFAILAHSLFTQPILAKLDKSDPPNSDRSRHDWTVLLIFQFSYLIFLFAFSLLSTAAVVFTVASLYTGKPVSFSSTLSAIPKVFKRLFITFLWVALLMFAYNAVFFVFLVMLLVALDLNSLGLAIVAGVIISVLYFGVHVYFTALWHLGSVISVLEPVYGIAAMRKAYELLKGKTKMAMGLIFVYLFLCGLIGVVFGAVVVHGGGKYGTFTRTLVGGLLVGVLVMVNLVGLLVQSVFYYVCKSYHHQTIDKTALYDQLGGYLGDYVPLKSNIQLEDLDI

SEQ ID NO: 452 - protein, 487 aa, Arabidopsis thaliana
MATETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWPEGEMKQIIDLGNTGLLPLEIRFLHDPSKDTGYVGSALSSNMIRFFKNSDDTWSHEVVISVKPLKVENWILPEMPGLITDFLISLDDRFFYFVNWLHGDIRQYNIEDPKNPVLTGQIWVGGLLQKGSPYKAVGEDGNTYQFDVPQIKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 453 - protein, 544 aa, Arabidopsis thaliana
MGNSCRGSFKDKIYEGNHSRPEENSKSTTTTVSSVHSPTTDQDFSKQNTNPALVIPVKEPIMRRNVDNQSYYVLGHKTPNIRDLYTLSRKLGQGQFGTTYLCTDIATGVDYACKSISKRKLISKEDVEDVRREIQIMHHLAGHKNIVTIKGAYEDPLYVHIVMELCAGGELFDRIIHRGHYSERKAAELTKIIVGVVEACHSLGVMHRDLKPENFLLVNKDDDFSLKAIDFGLSVFFKPGQIFKDVVGSPYYVAPEVLLKHYGPEADVWTAGVILYILLSGVPPFWAETQQGIFDAVLKGYIDFDTDPWPVISDSAKDLIRKMLCSSPSERLTAHEVLRHPWICENGVAPDRALDPAVLSRLKQFSAMNKLKKMALKVIAESLSEEEIAGLRAMFEAMDTDNSGAITFDELKAGLRRYGSTLKDTEIRDLMEAADVDNSGTIDYSEFIAATIHLNKLEREEHLVSAFQYFDKDGSGYITIDELQQSCIEHGMTDVFLEDIIKEVDQDNDGRIDYEEFVAMMQKGNAGVGRRTMKNSLNISMRDV

SEQ ID NO: 454 - protein, 146 aa, Arabidopsis thaliana
MEVFGKSPMVVTSANVIYLSAILGRDCDGHKCDWKCENENVCGNMYRCKLTGLTHVCDKNCNQRILYDNHSSLCRASGRIFPLSSVEEQAVKGVRRKLDAAESHPSESCSFKRRRRDAQFHASPFERSFTAVSPICSPAGDGMELV

SEQ ID NO: 455 - protein, 221 aa, Arabidopsis thaliana
MSLTIPANLVLNPRSNKSLTQSVPKSSARFVCSDDKSSSSTPQSMKAFSAAVALSSILLSAPMPAVADISGLTPCKDSKQFAKREKQQIKKLESSLKLYAPESAPALALNAQIEKTKRRFDNYGKYGLLCGSDGLPHLIVNGDQRHWGEFITPGILFLYIAGWIGWVGRSYLIAISGEKKPAMKEIIIDVPLASRIIFRGFIWPVAAYREFLNGDLIAKDV

SEQ ID NO: 456 - protein, 416 aa, Arabidopsis thaliana
MANSWDQLGEIASVAQLTGIDALKLIGMIVNAANTARMHKKNCRQFAHHLKLIRNLLEQIKNSEMNQRSEILEPLQGLDDALRRSYILVKSCQEKSYLYLLAMGWNIVNQFEKAQNEIDLFLKIVPLINMADNARIRERLEAIERDQREYTLDEEDRKVQDVILKQESTREAATSVLKKTLSRSYPNMGFCEALKTEEEKLQLELQRSRARYDADQCEVIQRLIDVTQTAATVEPNLEKVLTKKEELTSSKKRDDLYDTDSSSIRADSRSTSYVSSGHELLSGRSLQHRGNWHADLLDCCSEPCLCLKTLFFPCGTLAKISTVATSRQISSTEVCKNLIVYSLILSCCCYTCCIRKKLRKTLNITGGCIDDFLSHLMCCCCALVQELREVEIHRASYGTEKSNKEMSPPTPQFMEE

SEQ ID NO: 457 - protein, 319 aa, Arabidopsis thaliana
MISDSITNASATSAPTARDFGKKKRTNRSAKLKQSKLGLRREQWLSQVAMINKGDKEEMESNRRIGSEKPDQRDLPRPVENLDEDNNGTHRHESFIESLSNSPNSILSGMNSIPNFSSSSSSGSGGSCSGNITEEEDADDDGCLDDWEAIADALAADDEKHEKENPPESCQEHEDIKQSALIGGADVVLRDAKADSQRRKQKSNQAWRPDDKLRPQGLPNLEKQRSFPVMNLHFSSVTVVPSSCPICYEDLDLTDSNFLPCPCGFRLCLFCHKTICDGDGRCPGCRKPYERNTIKFEASVQGGGLTIRLARSSSMFCRS

SEQ ID NO: 458 - protein, 432 aa, Arabidopsis thaliana
MALRPCTGFTISSLRNASAANNNLFSLLSFSSSSPAKRNLLLSSLQDNLRRFASSASLYRQHLRNQQQQHQQQQQSRVKEKSETLAQKIGKSIRRAGAPSKARVYADVNVVRPKDYWDYESLAVQWGVQDDYEVVRKVGRGKYSEVFEGIHATDNEKCVIKILKPVKKKKIKREIKILQNLCGGPNIVKLLDIVRDQQSKTPSLIFEHVNNKDFKVLYPTLSDYDVRYYIFELLKALDFCHSRGIMHRDVKPHNVMIDHEQRKLRLIDWGLAEFYHPGKEYNVRVASRYFKGPELLVDLQDYDYSLDLWSLGCMFAGMIFRKEPFFYGHDNYDQLVKIAKVLGTDELNAYLNKYRIELDPNLTSLVGRHSRKPWTKFINSENQHLAVPEAVDFVDKLLRYDHQERPTAKEAMAHPYFYPIRNAESSRTPRSQ

SEQ ID NO: 459 - protein, 670 aa, Arabidopsis thaliana
MALCGVCSTPNLPNLQVFRSVRNSSIGYKRNHSLWQLRSSSFRAKSVIFHCSSSLRQSPSNVEEIDDNPSVSLEDESAHVMQFKWSDFRILDRVSIGHGGRADELVFEAIVQVPDSPLFNQGVVLRKLNTTRAQRRGRRAIEVFKKLVRRRLLYHSYSMQVHGYITNNLSDDQYSFTLVHGCHGSFSIRHWLQQSDWIPTLEATLALDEESFRRVGDDTTGGPAVSRQLRLIRTLMRDILIGVNYLHSHGLAHTELRLENVHISPVDRHIKVGILGNAADFNGDVPSTSNAYSTMDRRQMMIAFDMRCVGFMMAKMVLQELMDPLIFAKLKSFLAKGNDPSSLREFFVTTLNTNSESGNTGVQILDRNWGAGWHLLSLLIATRPSERISCLDALKHPFLCGPRWRVAPSMDIIRWGLGSTAVKISEEYIYRMPQRQRLAHFIGLMEMLNPYPKPNCWLELLPGRWRLLYSTGKHIGLTLRQPSTRALIGNVHLTITRASESINNTSLSFTSDIRFTAITSKDWPHNKIGAAGKLQTLSQFRLIAGKRLYLKEEKKNIGKFSMGEPDAEEGLAEKLETEKWKKVVPFKEFPSSLPVAKLVSGEIEVTMNMNDHIDSPGSVIGEVRKQIPPEMFDLSKLVCGTYIDSRLLVLRCVNGSALLFTRSSLDHKSM

SEQ ID NO: 460 - protein, 425 aa, Pseudomonas putida
MSKTNESLMQRRVAAVPRGVGQIHPIFVDTAKNSTVIDVEGRELIDFAGGIAVLNTGHLHPKVVAAVQEQLTKVSHTCFQVLAYEPYVELCEKINKLVPGDFDKKTLLVTTGSEAVENAVKIARAATGRAGVIAFTGGYHGRTMMTLGLTGKVVPYSAGMGLMPGGIFRALFPSELHGISVDDAIASVERIFKNDAEPRDIAAIILEPVQGEGGFLPAPKELMKRLRALCDQHGILLIADEVQTGAGRTGTFFAMEQMGVAPDLTTFAKSIAGGFPLAGVCGKAEYMDAIAPGGLGGTYAGSPIACAAALAVIEVFEEEKLLDRSKAVGERLTAGLREIQKKYPIIGDVRGLGSMIAVEVFEKGTHTPNAAAVGQVVAKAREKGLILLSCGTYGNVLRILVPLTAEDALLDKGLAIIEECFAEIA

SEQ ID NO: 461 - protein, 427 aa, Xenorhabdus nematophila
MAESMLAKRRSAAIAKGVGVTTQVYVERAENAEIWDAQGQRYIDFAAGIAVVNTGHRHPRVIAAAREQLEQFIHTCHQVVPYENYVALAERLNRLVPGNFVKKTVFVTTGAEAVENAVKIARAATGRSGVVAFSGAFHGRTFLGMSLTGKVVPYKMGFGSLVSDVYRVPFPVALHGISVEQTLNALDNLFKTDIEPTRVAAIIIEPVQGEGGFYPAPPELLKSLREIADRYGIVLIADEIQTGFARTGKLFAMEHHEVAADLTTMAKGLAGGFPLAAVTGRAELMDAVAPGGLGGTYGGNPVAIAAGHAVLDVIEEEKLAARATQLGERLKQCLNELRPRVPQIADVRGLGLMIAVEFNRADSQEPDAGFTNAVRQKALERGLILLACGIHGNVIRFLPPLTIQNDVFDEALNVLESVLLDLNRTAV

SEQ ID NO: 462 - protein, 472 aa, Xenorhabdus nematophila
MGQNVYQFIDLQRVDPPKKPLKIRKIEFVEIYEPFSEMQVEAQADRCLSCGNPYCEWKCPVHNYIPNWLKLANEGRIIEAAELSHRTNSLPEVCGRVCPQDRLCEGACTLNDDFGAVTIGNIERYINDTAIAMGWKPDMSDVIPTGKRVAVIGAGPAGLACADVLTRNGVQAVVYDRHPEIGGLLTFGIPAFKLEKDVMIRRREIFSDMGIEFRLNTEIGKDITLAELTEQFDAVFLGVGTYQSIHGGLENEGADGVYDALPFLIANTRHLMGYPALPEQPYVDMKGQRVLVLGGGDTAMDCLRTSVRQGATHVICAYRRDEGNMPGSRREVKNAKEEGVDFQFNLQPLSIEINSAGQVCGVKVAKTQLGEMDEKGRRRAEIIQGSEFRIETDAVITAFGFKPHNLHWLNAHQINLDQQGRIVAPEASNLPFQTSNPKIFAGGDAVRGSDLVVTAIAEGRKAASGILDYLEV

SEQ ID NO: 463 - protein, 528 aa, Arabidopsis thaliana [sequence omitted]

SEQ ID NO: 464 - protein, 500 aa, Arabidopsis thaliana
MNGGDDAATSGPPPSLEWRFSQVFGERTAGEEVQEVDIISAIEFDKSGDHLATGDRGGRVVLFERTDTKDHGGSRKDLEQTDYPVRHPEFRYKTEFQSHEPEFDYLKSLEIEEKINKIRWCQPANGALFLLSTNDKTIKYWKVQEKKIKKISEMNIDPSESSNIPPQLVTNGLPADKGHDYLSKDFSFPPGGIPSLRLPVVTSQETNLVARCRRVYAHAHDYHINSISNSSDGETFISADDLRVNLWNLEISNQSFNIVDVKPTNMEDLTEVITSAEFHPIHCNMLAYSSSKGSIRLIDMRQSALCDSHTKLFEEPEAPGSRSFFTEIIASISDIKFSKDGRYILSRDYMTLKLWDINMDSGPVASYQVHEHLRPRLCDLYENDSIFDKFECCLSGDGLRVATGSYSNLFRVFGASQGSTEAATLEASKNPMRRQIQTPARPSRSIGSMTRVVRRGSESPGTEANGNAYDFTTKLLHMAWHPTENSIACAAANSLYMYYA

SEQ ID NO: 465 - protein, 482 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMDKKTLKDIDVKGKVVFCRVDFNVPMKDGEVTDDTRIRAALPTIKHLADQGAKVLLASHLGRPKGEVVEELRLTPVAARLGELLGKEVKKADEAYGDAVKAQISEMKDGDVLVLENVRFYPGEEKNDPELAKAFAELADVYVNDAFGAAHRAHASTAGIAEHLPAVAGFLMEKELDVLGKAVSNPDRPFTAIIGGAKVKDKIGVIESLLDKVDNLIIGGGLAYTFVKALGYEVGKSLLEEDKIELAKSFMDRAKEKGVNFYMPEDVLVADDFSNDANVKIVPISEIPSDLEAIDIGTKTRETYADVIKNSKLVVWNGPMGVFEIDLFAQGTKAVAEALAEAKDTYSVIGGGDSAAAVEKFGLADKMSHISTGGGASLEFMEGKELPGVAALNDK

SEQ ID NO: 466 - protein, 533 aa, Arabidopsis thaliana
MVLVLYETAAGFALFKVKDEGKMANVEDLCKEFDTPDSARKMVKLKAFEKFDNTSEALEAVAKLLEGAPSKGLRKFLKANCQGETLAVADSKLGNVIKEKLKIDCIHNNAVMELLRGVRSQFTELISGLGDQDLAPMSLGLSHSLARYKLKFSSDKVDTMIIQAIGLLDDLDKELNTYAMRVREWYGWHFPELAKIISDNILYAKSVKLMGNRVNAAKLDFSEILADEIEADLKDAAVISMGTEVSDLDLLHIRELCDQVLSLSEYRAQLYDYLKSRMNTIAPNLTALVGELVGARLISHGGSLLNLSKQPGSTVQILGAEKALFRALKTKHATPKYGLIFHASLVGQAAPKHKGKISRSLAAKTVLAIRVDALGDSQDNTMGLENRAKLEARLRNLEGKDLGRLSGSSKGKPKIEVYNKDKKMGSGGLITPAKTYNTAADSLLGETSAKSEEPSKKKDKKKKKKVEEEKPEEEEPSEKKKKKKAEAETEAVVEVAKEEKKKNKKKRKHEEEETTETPAKKKDKKEKKKKSKD

SEQ ID NO: 467 - protein, 544 aa, Arabidopsis thaliana
MMNTSNGMISGPSSSSASAANPQSPGIKTYFKTPEGKYKLHYEKTHPSGLLHYTHGKTVTQVTLAHLKDKPAPSTPTGTSSSSTASSGFRSATARLLGGGNGNRALSFVGGNGGAKNVGASSRIGASFAASSSNTSATNTNFDGKGTYLVFNVGDAIFISDLNSQDKDPVKSIHISNSNPMCHAFHPDAKDGHDLLIGLNSGDVYTVSLRQQLQDVGKKLVSAQHYNKDGSVNNSRCTSIAWVPGGDGSFVAAHADGNLYVYEKNKEGATDSSFSAIRDPTQFSVDKAKYSKSNPVARWHIGQGAINSIAFSNDGAYLATVGRDGYLRIFDFSTQKLVCGVKSYYGALLCCAWSMDGKYLLTGGEDDLVQVWSMEDRKVVAWGEGHNSWVSGVAFDSYWSSPNSEGSGENVMYRFGSVGQDTQLLLWDLEMDEIVVPLRRPPGGSPTYSTGSQSAHWDNIVPMGTLQPAPCMRDVPKLSPVVAHRVHTEPLSGLIFTQESLITACREGHLKIWTRPDTQPSSSSEATNPTTSKPSLTSKVGGSS

SEQ ID NO: 468 - protein, 174 aa, Arabidopsis thaliana
MEKTEEEVEMKELVGLVRILVKRGIDLARRDALSSDPFVVITMGPQKLKSFTVKNNCNPEWNEELTLAIEDPNEPVKLMVYDKDTFTADDKMGDAQIDMKPFLDVHKLGLKELPHGKELKRIVPTRDNCLSEDSIIVSDNGKIVQDMILLLKNVECGKVEIQLEWLKNPGGSGL

SEQ ID NO: 469 - protein, 517 aa, Arabidopsis thaliana
MAAMNMIDFQNCFIFILLCLFSRLCYSHFFKKPKDPRLHFDLPPSPPSLPIIGHLHLLLSVLLHRSLQKLSTKYGSILYLRVFRFPVVLISSASIAYEIFRAHDLNISYRGFTPTDDSLFAGSFSFISAPYGDYWKFMKKVLVTNVFGPQAHEQSRGVRADVLERFYGNLFDKAIKKQSVEICAEALKLSNSSICKMIMGRSCSEERFRALATELDVLTKKLFFANMLRAWFKKLVVSLFKKETTVISYRFDELLESILVEHEKKLDVHHQRTDLMDALLAAYRDENAEYKITRNHIKSIIADLLFAGTENQVQTIQWAMAEIINNPNVLERLRGEIDSVVGKSRLIQETDLPKLPYLQAVVKETIRLHPPGPFFLRFTKEGCRIRGFYVPENTSVVVNVYAVMRDPDAWEDPLVFKPERFLASSRAEQEEERREKEIKYLPFGSGRRSCPGENLAYVIMGTAIGVMVQGFEWRTTEEKINMDEAVVGLSLTMAHPLKIIPVARTSNSLTSSLQKCL

SEQ ID NO: 470 - protein, 454 aa, Arabidopsis thaliana
MGRTETGDESSARKMRRKVPTSIESLDADILCIIFSFLDLFDLVHCTVVCNSWNAVIKRLKLLQASCRKMHHLGSDSPSSSTSLDRPAEIDVEDFAMKHHKMALLRGRIEIERWEAHSHRVSQCRMKKGLLLTGVGDKVMRLWSLKSYKCMEEYSLPDASSLIDFDFDESKKLEVVSLAWEYFDSVVVVVVEIVGLVGTRISIWRRNGQRSIFPSRAGTFPKGLCMRYIDPEAVVGCEDGTARVFDMYSKTCSQIIRTQGGPITCLSLSDNQLFLSGSSLGRVTVSDPLMDQPVATLKSTITAGGIQTICFNQGTNLAFIGTTGGYVSCWDLRKMDRLWEKRVSPNVVYSIQQLRNDTSVMVAGGIDGVLRMIDQKSGRVLSRVIMDDKFSTTSTRNNQVVIEKRRGKRVSQDMEIDKIERKVRPQISCIAMGMKKMVTAHNGKCISVWKFNLS

SEQ ID NO: 471 - protein, 288 aa, Arabidopsis thaliana
MGKTTGNRDWTQIYAIYGIEQWQTLVFLLFHAFFFSLLSLLFLIYFDQICFFLDSFFLSGAARLAAGFTGAVTALSAVCLLFAAANFVYSDVPLQYEMAQRMVSSVGDWSCVKTALDLGCGRGILLNAVATQLKKTGSSGRVVGLDRSKRTTLSTLRTAKLEGVQEYVTCREGDVKTLPFGDNYFDVVVSSVFVHTVGKEHGQKSVEAAAERMRVLGEIVRVVKPGGLCVVWDLLHVPEYVRRLQELKMEDIRVSERVTAFMAGSHIVSFRKPSELVAGPREVRLDWR

SEQ ID NO: 472 - protein, 465 aa, Arabidopsis thaliana
MAVKKKSSWRSLMVLCFQDPDNIYSPKKTKKDDGERVITKQKSFLGLSILDISNPSSTTLSEDLSISLAGSDLHVFTQAELRVITQSFSSSNFLGEGGFGPVHKGFIDDKLRPGLKAQPVAVKLLDLDGLQGHREFMTEVMCLGKLKHPNLVKLIGYCCEEAHRLLVYEFMPRGSLESQLFRRCSLPLPWTTRLNIAYEAAKGLQFLHEAEKPIIYRDFKASNILLDSDYTAKLSDFGLAKDGPQGDDTHVSTRVMGTQGYAAPEYIMTGHLTAKSDVYSFGVVLLELLTGRKSVDIARSSRKETLVEWARPMLNDARKLGRIMDPRLEDQYSETGARKAATLAYQCLRYRPKTRPDISTVVSVLQDIKDYKDDIPIGIFTYTVPTKPRREVKETSLQNFDKPRRETKVTSLQNFDKTRREPRNVSTTDNHQKFRSPAHTARNHRITLRNGYNSPMRNEAGGERY

SEQ ID NO: 473 - protein, 660 aa, Arabidopsis thaliana
MGLFKFIFLLSLLWSFYSLGSSQLQASQAQVLLQLKKHLEYPQQLESWYDHRTNFCYLQATPSMNITCFSNSVSELNIFGDKSSEKAKSFDGFAISNVTLSDGFSIESFVTTLSRLKSLRVLTLASLGIWGRLPEKLHRLSSLEYLDLSNNFLFGSVPPKLSTMVKLETFRFDHNFFNGTLPSWFDSYWYLKVLSFKSNKLSGELHSSLLSLSTIEYIDLRANSLSGSLPDDLKCGSKLWFIDISDNKLTGKLPRCLSSKQDIALRFNGNCLSLEKQQHPESFCVKEVRAAAKAEAKAEAEAANESGKRKWKKGALIGLIVGISMSVLVLVCCVFILLRRKGVTKKHVHHNTVQDNHPTTGFSSEILSNARYISETSKFGSEDLPVCRQFSLEEIVKATKNFDKTMILGESSLYGTLYKGNLENGTKVAIRCLPSSKKYSIRNLKLRLDLLAKLRHPNLVCLLGHCIDCGGKDDYSVEKVFLIYEYIPNGNFQSCLSDNSSGKGMNWSERLNVLTGVAKAVHFLHTGVIPGFFSNRLKTNNVLLNQHRFAKLSDYGLSIVSEATRHNTEIAKSWQMSRLEDDVYSFGLILLQSIVGPSVSAREEAFLRDELASLESEEGRRRMVNPTVQATCRNGSLIRVITLMNKCVSPESLSRPSFGA

SEQ ID NO: 474 - protein, 336 aa, Arabidopsis thaliana
MTEATGLRRFFSKFICCDADDSTIEYEPYVYIPANSYSYAEVTKITNKFNRVHGKGGFGVVYRGVLNKQQVAVKMLNRASIYNIVQFTKEVHDFVKVRHKNLVSLIGYCDDGEHLALIYEFVANGDLNDQLSGKFGNVPSWETRLKIIIGVAQGLEYLHSELRILHRYVKPTNILLGENFEAKLADFGLSRSSPTNPDIQASNKIYVKPGRDPYLHHQYFNSNRLNQTSDIYSFGIVMLEMITNQPVVDNKRESPHISKWVDLKVAKGDTLEIVDLRLNNDFERDSVRKAMDIACSCAARAHNRPSMSQVVIELNECLALEMARSNGRTGETTQTQ

SEQ ID NO: 475 - protein, 311 aa, Arabidopsis thaliana
MEIIEDLKESSLETVSVLGKLGTFGFVSLQSDSNLGKSYVKKTSTLEQSKNLEKELRIMLRFHNNPFIVRASSDHLHFATNTKSMSLCYIYMEYASLGNLNKMISDAGGRLSEDSVRRATRMILQGLKALHSEGFVHCDLKPSNVLVFPSNTRGEPWDLKLAGFGLSKEPTMDSSLLFPGTLEEYMSPEAIERDRFVGKDKLIGPARDIWSLGRIVLRMFGGIPVEVRGSNTWRLYEDISPEATDFVRRCLAWRPSNRATVDELLDHPFAAEKLPLLLSFLRVPSFVRRNVNEKLNVRQEELIPKPQGLLW

SEQ ID NO: 476 - protein, 334 aa, Arabidopsis thaliana
MATATSHQSVVSFASLRSSPSSTISQCGFKIDSSLSFTSKKTNFCKIKAMASSVSYDNTLLSPSKTIPDNSQKKSNEAALILIRHGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 477 - protein, 487 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMTFKTLDDLTDIAGKRVLVRVDLNVPVKDGQVTDTTRIERVAPTIRELSEKGAKVVLLAHFGRPKGEPVADMSLKAIASAVEEILDQRVYFAADCIGDKAANAIAELNDGEVLLLENTRFHKGEEKNDSDFVTALAANGDIYVNDAFSAAHRAHASTEGLAHHLPAYAGRTMQAELEALEKGLGNPKRPVVAIVGGAKVSTKIDLLQNLVKKVDALVIGGGMANTFLAAQGVDVGKSLCEHDLAETAKAILAAASEAGCAIVLPVDGVVAREFKAGADNEVVDIKAIPADAMVLDVGPKSIEAINEWISRAETLVWNGPLGAFEIAPFDRATVAAAKHAAARTRAGSLVSVAGGGDTVAALNHAEVADDFTYVSTAGGAFLEWMEGKPLPGVDVLRQRN

SEQ ID NO: 478 - protein, 546 aa, Pseudomonas fluorescens PfO-1
MASSMLSSATMVASPAQATMVAPFNGLKSSAAFPATRKANNDITSITSNGGRVNCMQVWPPIGKKKFETLSYLPDLTDSGGRVNCMQAMTVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKEGKNIFASEDPEQNAALRHAIGGVLETLPAQMAFLCPNVNSYRRFGAQFYVPNSPSWGLDNRTVALRVPTGSADAVRLEHRVAGADANPYLLMASVLAGVHHGLTNKIEPPAPTEGNSYEQNEQSLPNNLRDALRELDDSEVMAKYIDPKYIDIFVACKESELEEFEHSISDLEYNWYLHTV

SEQ ID NO: 479 - protein, 376 aa, Arabidopsis thaliana
MSAESCFGSSGDQSSSKGVATHGGSYVQYNVYGNLFEVSRKYVPPLRPIGRGAYGIVCAATNSETGEEVAIKKIGNAFDNIIDAKRTLREIKLLKHMDHENVIAVKDIIKPPQRENFNDVYIVYELMDTDLHQIIRSNQPLTDDHCRFFLYQLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFDPSRRITVDEALCHPYLAPLHDINEEPVCVRPFNFDFEQPTLTEENIKELIYRETVKFNPQDSV

SEQ ID NO: 480 - protein, 495 aa, Bacillus halodurans
MGKPTGFMEYKRETPPKKDPFERSKNWQEFTLLMPESALRQQGARCMDCGVPFCQTGTSMDGSGEIGCPVYNLIPEWNDLVYRGHWKEALERLHKTNNFPEFTGRVCPAPCEGSCTVAISDDAVAIKSMEFHIVERGFQEGWIVPNPPRSRTGKKVAVVGSGPAGLAAAAQLNKAGHWVTVFEREDRIGGLLTYGIPDVKLPYHVVERRINLLKEEGIEFRTNVEIGKDVSAKQLKDDFDAVVLCTGATKPRDVNVKGRELKGIHFAMDFLTANTKSLLNSNHQDGNYISAKGKHVVVIGGGDTGADCITTSVRHGAKSITQFDINREKSNERPDNNPWPLFPIVHTVEDGHKEAAAVYGKDPRAYQVMTTKFVGDAEGHVKEIHTISVETTVHPDGSKTRVEIPGTEKVWPADLVFLAVGFTGPEEQLVRELELETDTRSNIKAEYGKYETSLEGVFAAGDNRRGQSLVVWAIHEGREAARECDKYLMGASNLP

SEQ ID NO: 481 - protein, 401 aa, Bacillus subtilis subsp. subtilis str. 168
MTALSKSKEIIDQTSHYGANNYHPLPIVISEALGAWVKDPEGNEYMDMLSAYSAVNQGHRHPKIIQALKDQADKITLTSRAFHNDQLGPFYEKTAKLTGKEMILPMNTGAEAVESAVKAARRWAYEVKGVADNQAEIIACVGNFHGRTMLAVSLSSEEEYKRGFGPMLPGIKLIPYGDVEALRQAITPNTAAFLFEPIQGEAGIVIPPEGFLQEAAAICKEENVLFIADEIQTGLGRTGKTFACDWDGIVPDMYILGKALGGGVFPISCIAADREILGVFNPGSHGSTFGGNPLACAVSIASLEVLEDEKLADRSLELGEYFKSELESIDSPVIKEVRGRGLFIGVELTEAARPYCERLKEEGLLCKETHDTVIRFAPPLIISKEDLDWAIEKIKHVLRNA

SEQ ID NO: 482 - protein, 418 aa, Arabidopsis thaliana
MEQTKDDSDFEDDCETKKMETDTSAQEARNGKDIQGIQWEGFKYNRDEFRETRLKQYDNFVNILRPSSREKLDKEHGQVVEKGKNFYDFQFNTRLVTSTIVHFQLRNLVWATSKHDVYLMQNYSLMHWSSLLQRGKEVLNVARSVTPTQKLPGLFSEPLSRVQVSSMAVKENLILLGGFDGELLCKCVNQPGVAFCTRLSTEDNAITNTVDIYRDPSGSLRLITANNDCKIRVFDAQSFTRVSEFALDWSVNNTSVSPDGKLLAVVGDSTECLISDSHSGKVISSLRGHKDYSFASAWHPNGLILATGNQDTACRLWDIRNPSESFAVLKGNMGAIRGLKFTPEGRFLAMAEPADFVHIFDTQSGFLQSQEIDLFGEIAGISFSPDTEALYVGVADRTYGSLLEYKRRKDNHYMDSFY

SEQ ID NO: 483 - protein, 344 aa, Arabidopsis thaliana
MQPKTEFVKFLRKGAYGSVDLVKYIKRDDNALPLYAAVKTAECEDYNSLEREIQILSKLEGCRRIVQCYGNYTLEEDFDVGGFRVYKMVMEYAAAGSLFSFMDSYKDRKLPETMIKDFTRMILQGLVSVHRLGYVHCDLKPDNLLVFPCRQSYELKISDFGSSRKVGEYSDCWDVDLPFVGTPVYMSPESVRSGVAEKALDLWSLGCIVLEMYTGVIPWSEVEFEDLAPALSKGKAPEIPKSLPCDARKFLETCFSRNPKERGSASDLLSHQFLRGEVVSGFSLPPLKLKIKLAPEKPTNVSKKPLKLKIIPPKPPQFKKGGIKPLKLKIMPLKPPASSFVSVQ

SEQ ID NO: 484 - protein, 442 aa, Arabidopsis thaliana
MDHVIGGKFKLGRKIGSGSFGELYIGINVQTGEEVALKLEPVKTKHPQLHYESKVYMLLQGGTGVPHIKWFGVEGNYNCMAIDLLGPSLEDLFNYCTRSFSLKTVLMLADQLINRVEYMHSRGFLHRDIKPDNFLMGLGRKANQVYIIDYGLAKKYRDLQTHKHIPYRENKNLTGTARYASVNTHLGIEQSRRDDLESLGYVLMYFIRGSLPWQGLKAGTKKQKYEKISEKKMLTPVEVLCKSYPSEFTSYFHYCRSLRFEDKPDYSYLKRLFRDLFIREGYQFDYVFDWTILKYPQSGSISKPRPNPKPALDPPGPSAERNEKPIVGQDLRERFSGAVEAFARRNVPSHGIRPKHIFSDDASKEVQVSEKTRNEIATKMAVMSSSQPGSSGELSENRSSKLFSSSAQKIQPVQETKLSARLGRDDGLRSFDMLTIGSGKRK

SEQ ID NO: 485 - protein, 414 aa, Arabidopsis thaliana
MYSLILHGRRLVQSQKCLSLSVSVQNAFVLSNSFSSARAADVSIRDGRKGKNFTVSYLVDSLGLSKKLAESISRKVSFEDKVNPDSVLSLFRSYGFTDSQISTIITDYPLLLVADAKKALGRKLQILQSRGASSSEITEIVSTVPRILGKKSITVYYDAVKDIIVADTSSSYELPQGSQGNKIRNVSALRELGMPSRLLLPLLVSKSQPVCGKENFDASLKKVVEMGFDPTTTKFVLALRMLYQMSEKTIEEKVVVFRSLGFTVDDVWEIFKKTPSVLKVSKKKILKSAETFLDLGYSRAEFLMMVKRYPPCIEYSVESVKKKNEFLVKKMKWPRNALVLHPQVFGYSMEKRIIPRCNILEALLSKGLLRKGSELPAVSSVLSCTDEGFLDRYVMKHNELVPTLMAIFTKGSVS

SEQ ID NO: 486 - protein, 213 aa, Arabidopsis thaliana
MTDPHTARTIVGIVGNVISFGLFCAPIPTMVKIWKMKSVSEFKPDPYVATVLNCMMWTFYGLPFVQPDSLLVITINGTGLFMELVYVTIFFVFATSPVRRKITIAMVIEVIFMAVVIFCTMYFLHTTKQRSMLIGILCIVFNVIMYAAPLTVMKLVIKTKSVKYMPFFLSLANFMNGVVWVIYACLKFDPYILVNPHIYLYCLELKSLHLKKD

SEQ ID NO: 487 - protein, 445 aa, Arabidopsis thaliana
MGCVSSKQTVSVTPAIDHSGVFKDNENECSGSGRIVVEDPPRPTLKKLVSWRSRSGKRRSQKSGSELGSESGRASDSLSFRLGNVSRYLEAEQVAAGWPAWLSNVAGEAIHGWVPLRSDAFEKLEKIGQGTYSNVFRAVETETGRIVALKKVRFDNFEPESVKFMAREILILRRLNHPNIIKLEGLITSKLSCNIQLVFEYMEHDLTGLLSSPDIKFTTPQIKCYMKQLLSGLDHCHSRGVMHRDIKGSNLLLSNEGILKVADFGLANFSNSSGHKKKPLTSRVVTLWYRPPELLLGATDYGASVDLWSVGCVFAELLLGKPILRGRTEVEQLHKIFKLCGSPPEDYWKKSKLPHAMLFKPQQTYDSCLRETLKDLSETEINLIETLLSIDPHKRGTASSALVSQYFTTKPFACDPSSLPIYPPSKEIDTKHRDEAARSVISFIT

SEQ ID NO: 488 - protein, 520 aa, Arabidopsis thaliana
MAQALAQPPLVVTTVVPDPPPPPPPPHPKPYALRYMADLLGRIGIMDTDKDGNISPQSPRSPRSPRNNILMGKYELGKLLGHGTFAKVYLAQNIKSGDKVAIKVIDKEKIMKSGLVAHIKREISILRRVRHPYIVHLFEVMATKSKIYFVMEYVGGGELFNTVAKGRLPEETARRYFQQLISSVSFCHGRGVYHRDLKPENLLLDNKGNLKVSDFGLSAVAEQLRQDGLCHTFCGTPAYIAPEVLTRKGYDAAKADVWSCGVILFVLMAGHIPFYDKNIMVMYKKIYKGEFRCPRWFSSDLVRLLTRLLDTNPDTRITIPEIMKNRWFKKGFKHVKFYIEDDKLCREDEDEEEEASSSGRSSTVSESDAEFDVKRMGIGSMPRPSSLNAFDIISFSSGFDLSGLFEEEGGEGTRFVSGAPVSKIISKLEEIAKIVSFTVRKKEWSLRLEGCREGAKGPLTIAAEIFELTPSLVVVEVKKKGGDREEYEEFCNKELRPELEKLIHEEVVVEEALYLPSDTE

SEQ ID NO: 489 - protein, 488 aa, Arabidopsis thaliana
MGRAFVYVILGGGVAAGYAALEFTRRGVSDGELCIISEEPVAPYERPALSKGFLLPEAPARLPSFHTCVGANDEKLTPKWYKDHGIELVLGTRVKSVDVRRKTLLSSTGETISYKFLIIATGARALKLEEFGVEGSDAENVCYLRDLADANRLATVIQSSSNGNAVVIGGGYIGMECAASLVINKINVTMVFPEAHCMARLFTPKIASLYEDYYRAKGVKFIKGTVLTSFEFDSNKKVTAVNLKDGSHLPADLVVVGIGIRPNTSLFEGQLTIEKGGIKVNSRMQSSDSSVYAIGDVATFPVKLFGEMRRLEHVDSARKSARHAVSAIMDPIKTGDFDYLPFFYSRVFAFSWQFYGDPTGDVVHFGEYEDGKSFGAYWVKKGHLVGSFLEGGTKEEYETISKATQLKPAVTIDLEELEREGLGFAHTVVSQQKVPEVKDIPSAEMVKQSASVVMIKKPLYVWHAATGVVVAASVAAFAFWYGRRRRRW

SEQ ID NO: 490 - protein, 236 aa, Arabidopsis thaliana [sequence omitted]

SEQ ID NO: 491 - protein, 513 aa, Arabidopsis thaliana
MAGGSFGPTGVAKERAEQYQGKVTSYVIIACLVAAIGGSIFGYDIGISGGVTSMDEFLEEFFHTVYEKKKQAHESNYCKYDNQGLAAFTSSLYLAGLVSTLVASPITRNYGRRASIVCGGISFLIGSGLNAGAVNLAMLLAGRIMLGVGIGFGNQAVPLYLSEVAPTHLRGGLNMMFQLATTIGIFTANMVNYGTQQLKPWGWRLSLGLAAFPALLMTLGGYFLPETPNSLVERGLTERGRRVLVKLRGTENVNAELQDMVDASELANSIKHPFRNILQKRHRPQLVMAICMPMFQILTGINSILFYAPVLFQTMGFGGNASLYSSALTGAVLVLSTFISIGLVDRLGRRALLITGGIQMIICQVIVAVILGVKFGDNQELSKGYSVIVVIFICLFVVAFGWSWGPLGWTIPSEIFPLETRSAGQSITVAVNLLFTFIIAQAFLGLLCAFKFGIFLFFAGWVTVMTIFVYFLLPETKGVPIEEMTLLWSKHWFWKKVLPDATNLEDESKNVSV

SEQ ID NO: 492 - protein, 558 aa, Arabidopsis thaliana
MAFAVSVQSHFAIRALKRDHFKNPSPRTFCSCFKSRPDSSYLSLKERTCFVSKPGLVTTRYRHIFQVGAETGGEFADSGEVADSLASDAPESFSWSSVILPFIFPALGGLLFGYDIGATSGATLSLQSPALSGTTWFNFSPVQLGLVVSGSLYGALLGSISVYGVADFLGRRRELIIAAVLYLLGSLITGCAPDLNILLVGRLLYGFGIGLAMHGAPLYIAETCPSQIRGTLISLKELFIVLGILLGFSVGSFQIDVVGGWRYMYGFGTPVALLMGLGMWSLPASPRWLLLRAVQGKGQLQEYKEKAMLALSKLRGRPPGDKISEKLVDDAYLSVKTAYEDEKSGGNFLEVFQGPNLKALTIGGGLVLFQQITGQPSVLYYAGSILQTAGFSAAADATRVSVIIGVFKLLMTWVAVAKVDDLGRRPLLIGGVSGIALSLFLLSAYYKFLGGFPLVAVGALLLYVGCYQISFGPISWLMVSEIFPLRTRGRGISLAVLTNFGSNAIVTFAFSPLKEFLGAENLFLLFGGIALVSLLFVILVVPETKGLSLEEIESKILK

SEQ ID NO: 493 - protein, 131 aa, Zea mays
MARSVSYVSAAKLVSMARGNPRLAIIDVRDEERSYQAHIAGSHHFASGSFEARMPELVRAASGKDTLVFHCALSQVRGPTCARMFSDYLSETKEDSGIKNIMVLERGFNGWEVSGQPVCSCTDAHCKGTCS

SEQ ID NO: 494 - protein, 379 aa, Zea mays
MATLNPFELLGADDNDDPSLLIAAAAAAAQKAEAKKSAVAPAGKAAQPAATTKFPTKPAPPSQTVRDARGGGSSARGGFGRGERGRGRGGRGYGQNRGFSGDNGNEFQGGYGGGGYGDGAVTGGSEGERERDTRPPYRGGGRRGGYRNVEFGDDSERPPRRNYERHSGTGHGYEMKRDGAGRGNWGTATDELIAQDAEDSPKMEDAAPVAEKQGEQIDAPAADENKDNKDATANEEEEKEEDKEMTLEEFEKIREEKRKALLALKAEERKVEVDKDLRSLQPLSNKKENDEVFIKLGSDKDKKKENAERDERAKKSVSINEFLKPAEGERYYGGRGRGRGGRGDRGGFRGGYGGGYSRGPAAAAPSIEDQAQFPSLGGK

SEQ ID NO: 495 - protein, 250 aa, Arabidopsis thaliana
MIQMDGGDRLRVTLLDRMSTVESSRSCLTLEAILMADKNRTSPQILSPPPSRSQSNRSLVEVMQREHRHSRDKTAWKSLREKLRLKRNGSVWISSNSIPSLDTPIPNRDNVSHQLGFLLSNSGNVTEEASSVEGRIRLGAVLAEERALSAREEETPAEREVEPARMSLMELLEENEGQMSFVSVDGEAEEEVAAVTAAEISCCVCMVRSKGAAFIPCGHTFCRLCSRELWVQRGNCPLCNTTILEVLDLF

SEQ ID NO: 496 - protein, 249 aa, Xylella fastidiosa
MGPKIVVGNWKLHGSHAFAQALVAQVAAGLPLPGVSVIILPPLLYLSDLTQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDYMLILYGGGIKPCNAAELFSQQDVDGGLIGGASLVADDFLAIARATV

SEQ ID NO: 497 - protein, 434 aa, Zea mays
MLRAAASSCARGAVRRLSSSAVMEASPVAVGSRCQSLLDEGDWSYHREWWGKEDGPGEGVQTVFRRHSECGNGVVSVSAYPASLPASEHWPAMERWLQESNSRLYPESASSDQFKVLGYQWRVMRFNDHTRQSTAKVMTCYRTSGQRSLFLMQQPHVLAVPYVKSMVSAGLTALSCSSYDLPQAASGQNTMKILCIGHGGGSLPLFLASKFRGATIHIVEIDPVVVSASVESMGFPTSPVNKGLSPESMLPSDADDLLWGGIHDRIFLHTADAEDFIGSDGNEYDIVFIDAYDGDDVFPRKLWDVDGAFMKNLEKRVHPVHGTVVVNLHSDSDSGAEGNADFQSALPMGRHVSQVCRAYMQHFGVAFTAAVPWLCNITLVACRAGGMAGGARRGLSRRDLVLGKLLSTSDTVERALGLPFPCLPYIKNGFTMVH

SEQ ID NO: 498 - protein, 638 aa, Nostoc punctiforme PCC 73102
MVKSAPSPIASRKPSKVEGIKENSNFLREPVATEILQDTTHFTENAVQLLKFHGSYQQDNRDNRTKGQEKDYQFMLRTKNPGGLVPPQLYLALDKIADEYGNHTLRATTRQGFQLHGILKKNLKSAIATIVKNLGSTLGACGDINRNVMAPPAPFKNRPEYQYAWEYAQNIADLLTAQTGAYYEIWLDGEKAISAEENPEVKAARQRNGNGTIIHDNEEPIYGTYYMPRKFKICVTVPGDNSIDLYSQDLTLVVITNKKKQLEGFNIFAGGGLGRTHGKEETFARLADPIGYVAKDDVYDIVKAIVATQRDYGDRTDRRHARLKYLINDWGLDKFRAQVEEYFGKSVEAFKPLPEFKYYDFLGWNEQGDGKLFLGISIDNGRIKDEGSFQLKTALREIVEQFNLHIRLTANHNLIFYDIEPDSKQAIQDILSRHGIVDDPSKIEPLVRYAMACPALPTCGLAITESERAIPGILERVRALLDKVGLQNEHFVVRMTGCPNGCARPYLAELGFVGSAPESYQLWLGGSPNQTRLAQPYTEKLHHNDLEIFLEPIFVYFKKSRKSKEKFGDFCDRVGFDAIREFAASYDPNTANGANKSRHRVNLKEEVYSKLKEVAESQGKPMTQLVTEALEAYFQNLS

SEQ ID NO: 499 - protein, 928 aa, Arabidopsis thaliana
MSRRVRQRVEDNGKYKVDSPSYTVIGVEDLAPKVQQYVNWTSLPYDTVFHLFTRLNYRDRASLASTCRTWRSLGASSFLWSSLDLRAHKFDLSMAASLATRCVDLQKIRFRGVDSADAIIHLKARSLLEISGDYCRKITDATLSMIAARHEALESLQLGPDFCERITSDAIRVIAFCCPKLKKLRVSGMRDVSSEAIESLAKHCPQLSDLGFLDCLNINEEALGKVVSLRYLSVAGTSNIKWKVALENWEKLPKLIGLDVSRTTIDHIAVSRLLKSSQSLKVLCALNCPYLEEDKSYSSNRFKGKVLLAVFTDTFDELASIFADNSKKPKNIFSYWRDLIRKDKSIDEIMLWIEWIISHTLLRIAESSNSQGLNDFWLNQGATLLLSLMQSAQEDVQERAATGLATFIVVDDENASIDCGRAEAVMRDGGIRLLLELAKSWREGLQSEAAKAIANLSVNAKVAKAVAEEGGISVLADLAKSMNRLVAEEAAGGLWNLSVGEEHKNAIAQAGGVNALVDLIFRWPHGCDGVLERAAGALANLAADDKCSMEVARAGGVHALVMLARNCKYEGAQEQAARALANLAAHGDSNGNNAAVGQEAGALEALVQLTQSPHEGVKQEAAGALWNLAFDDKNRESIAAFGGVEALVALAKSSSNASTGLQERVAGALWGLSVSEANSIAIGHEGGIPPLIALVRSEAEDVHETAAGALWNLSFNPGNALRIVEEGGVVALVQLCSSSVSKMARFMAALALAYMFDGRMDEYAMIGTSLESTSKSVTLNGARTMALDQIKAFIKTFMEHQIFSTGALSSAPSMLAQVSERARIPEAGHLRCSGSEIGRFVTMLRNPCLVLRACAAFALLQFTIPESRHAMHHASLMQNAGEARGLRSAAAAASMPREAKIFMKIVLRNLEHQQAESPEGMKVSYNRI

SEQ ID NO: 500 - protein, 531 aa, Arabidopsis thaliana
MTETGVIGCGCRGVTGGNFFHPGGFSLKSCFLEQSTKRNRNFFRSVSMIPPFKRGRFITKLRSVAGNSRIFSMDAREKSRSFVLVSSRHKRVPVFVMMPIDTFGIDASGCPKIKRLKALTVSLKALKLAGVHGIAVEVWWGIVERFSPLEFKWSLYEELFRLISEAGLKLHVALCFHSNMHLFGGKGGISLPLWIREIGDVNKDIYYRDKSGFSNNDYLTLGVDQLPLFGGRTAVQCYEDFMLSFSTKFEPYLGNVIEEISIGLGPSGELRYPAHPSGDGRWKFPGIGEFQCHDKYMMEDLMAVASQEGKPQWGSRDPPNTGCYNSFPSGVPFFEEGNDSFLSDYGRFFLEWYSGKLICHADAILAKAADVLRRRQEEEKSSVMLVAKIGGIYWWYKTSSHPAELTAGYYNTSLRDGYDPVASVLSRHGAALNIPCLDMADSEIPEKYLCSPEGLRRQIHDVSKKWTIHVTGRNTSERFDEMGLRQIRENCVQPNGDTLRSFTFCRMNEKIFRVENWNNFVPFIRQMSADM

SEQ ID NO: 501 - protein, 503 aa, Arabidopsis thaliana
MSTLEDGFPADKLFAQGYSYTYDDVIFLPHFIDFSTDAVSLSTRLSRRVPLSIPCVSSPMDTVSESHMAAAMASLGGIGIVHYNCGIAAQASIIRQAKSLKHPIASDAGVKFPEYEITSLDAFGPSSFVFVEQTGTMTTPKLLGYVTKSQWKRMNYEQREMKIYDYMKSCDSSDYCVPWEIDFEKLEFVLEDKQKGFVVLERDGETVNVVTKDDIQRVKGYPKSGPGTVGPDGEWMVGAAIGTRESDKERLEHLVNVGVNAVVLDSSQGNSIYQLEMIKYVKKTYPELDVIGGNVVTMYQAQNLIQAGVDGLRVGMGSGSICTTQEVCAVGRGQATAVYKVCSIAAQSGIPVIADGGISNSGHIVKALVLGASTVMMGSFLAGSTEAPGGYEYTNGKRIKKYRGMGSLEAMTKGSDQRYLGDQTKLKIAQGVVGAVADKGSVLKLIPYTMHAVKQGFQDLGASSLQSAHGLLRSNILRLEARTGAAQVEGGVHGLVSYEKKSF

SEQ ID NO: 502 - protein, 246 aa, Zea mays
MTMATHHPRARAPLRVCAAWDMNPGAATVATPKPSKAKAKPPPATTTPARPPPLTHADLFARSSEAQGGVKKSTYMGFEKWWLPPAPVVKKPRSLYSAVSLAYLGDCIYELYARRHFFFPPLSINEYNKRVMDVVKCESQDLLLNKLLGEDFLTEEERDILRWGRNIVSSKTRTRKRAGIAVYNRASSLETLIGYLYLTNFKRLEQLMFQLGFTSGASSQHIADELRSSFQKTTPASATPPQPATQ

SEQ ID NO: 503 - protein, 635 aa, Zea mays
  misc_feature (1)..(16): Xaa can be any naturally occurring amino acid
XXXXXXXXXXXXXXXXFYSIPLFAPPPVRPAPPRPADSAAMPLHLHLLSSPATAAKLAAGLRAAPLRRCHSLAPAPRHTDRVALASSLSAVARSAGPAVAAAQTKPSVSGKKQVLISLSDKTDLAYLGNGLQGLGYSIVSTGGTASSLEAAGVSVTKVEEITHFPEMLDGRVKTLHPSIHGGILARRDQEHHLKALKDHGIGTFDVVVVNLYPFYDKVTSGNISFEDGIENIDIGGPTMIRAAAKNHKDVLIVVDHNDYPALLEYLKGKRDDQQFPRMLAWKAMQHVASYDSAVSEWLWKQSNKGEMFPPSFTVPLELKSTLRYGENPHQSAAFYADKSLSLVGAGGIATAIQHHGKEMSYNNYLDADAAWNCVSEFDSPTCVVVKHTNPCGVASRKDILEAYRLAVRGDAVSAFGGIVAFNTTIDEDLAKEIREFRSPTDGETRMFYEIVVAPGYTEKGLEVLRGKSKALRILEAKRSGKGMLSLRQVSGGWLAQESDDLTPEEITFTTKSERSPQENELADAKFAWLCAKHVKSNAIVIAKNNCMLGMGSGQPNRRESVRIAFRKAGEEAKGAALASDAFFPFAWNDAVEEACQNGIGIIAQPGGSKKDEDAVACCNKYGVSLVLTGVRHFKH

SEQ ID NO: 504 - protein, 357 aa, Arabidopsis thaliana
EKQFGTLMFYCNVLVNYMIWTLVKQIENLEMLLLQAPNQSVRMGDSRILSQMLSQKLRPAKESNPLVRWSEKIKYFILDNWQRLWIMMLWLGICGGLFTYKFIQYKNKAAYGVMGYCVCVAKGGAETLKFNMALILLPVCRNTITWLRNKTKLGTVVPFDDSLNFHKVIASGIVVGVLLHAGAHLTCDFPRLIAADEDTYEPMEKYFGDQPTSYWWFVKGVEGWTGIVMVVLMAIAFTLATPWFRRNKLNLPNFLKKLTGFNAFWYTHHLFIIVYALLIVHGIKLYLTKIWYQKTVLSSNLILSVLISYFLSFFRLITFITCLYDSCRHGCILLYPSFYMHRRGCSVLSDQASNRLR

SEQ ID NO: 505 - protein, 341 aa, Zea mays
MAPLLSPPLLADSVTKFHAASTPVSCSGSPQRYVITGLAGAGRGEHDWRRRTWGRTNLRVKAVAAESRSSEGGIAEDYYAVLGVMPDATPKQIKKAYYNCMKSCHPDLSGNDPDVTNFCMFINEVYTVLTDPIQRAVYDEIHGYAATATNPFLDGSAPRDHVFVDEFSCIGCKNCANVCSKVFEIEEDFGRARVYDQSGSTELIQEAIDSCPVDCIHWTSAAQLSLLEDEMRRVERVNVGLMLAGMGGSIDVFRMASSRWEKRQAKVLEKVRRRMSQDDSRKGGSWSDIWGAPTRYEKNEEEVKERAKRAAAAARRWREYSRKGADKPPTFKLPEAVPSKE

SEQ ID NO: 506 - protein, 483 aa, Arabidopsis thaliana
MGGQSSKIGTCCSHKTTALEAPDVENKENGEVNGVHSFREYSLEQLKIATSCFALENVVSEHGETAPNVVYQGKLENHMKIAIKRFSGTAWPDPRQFLEEARLVGQLRSKRMANLLGYCCEGGERLLVAEFMPNETLAKHLFHWDTEPMKWAMRLRVALYISEALEYCSNNGHTLYHDLNAYRVLFDEECNPRLSTFGLMKNSRDGKSYSTNLAFTPPEYLRTGRITAESVIYSFGTLLLDLLTGKHIPPSHALDLIRDRNLQTLTDSCLEGQFSDSDGTELVRLTSCCLQYEARERPNIKSLVTALISLQKDTEVLSHVLMGLPQSGTFASPPSPFAEACSGKDLTSMVEILEKIGYKDDEDLSFMWTEQMQEAINSKKKGDIAFRRKDFSEAIEFYTQFLDLGMISATVLVRRSQSYLMSNMAKEALDDAMKAQGISPVWYVALYLQSAALSVLGMEKESQIALTEGSILEARKISASTQN

SEQ ID NO: 507 - protein, 424 aa, Arabidopsis thaliana
MARKKIREYDSKRLLKEHLKRLANIDLQIRSAQVTESTDFTELTNQESWLSSTKLVVKPDMLFGKRGKSGLVALKLDLAEVADFVKARLGTEVEMEGCKAPITTFIVEPFVPHDQEYYLSIVSDRLGCTISFSECGGIEIEENWDKVKTIFLPAEKSMTLEVCAPLIATLPLEVRAKIGNFIMGAFAVFQDLDFSFMEMNPFTLVDGEPFPLDMRGELDDTAAFKNFNKWGDIEFPLPFGRVLSSTENFIHGLDEKTSASLKFTVLNPKGRIWTMVAGGGASVIYADTVGDLGYASELGNYAEYSGAPNEEEVLQYARVVIDCATTDPDGRKRALLIGGGIANFTDVAATFNGIIRALREKETRLKASRMHIYVRRGGPNYQTGLARMRALGEELGVPLEVYGPEATMTGICKRAIDCIMLPDA

SEQ ID NO: 508 - protein, 320 aa, Arabidopsis thaliana
MRPPLTGSGGGFSGGRGRGGYSGGRGDGGFSGGRGGGGRGGGRGFSDRGGRGRGRGPPRGGARGGRGPAGRGGMKGGSKVIVEPHRHAGVFIAKGKEDALVTKNLVPGEAVYNEKRISVQNEDGTKTEYRVWNPFRSKLAAAILGGVDNIWIKPGAKVLYLGAASGTTVSHVSDLVGPEGCVYAVEFSHRSGRDLVNMAKKRTNVIPIIEDARHPAKYRMLVGMVDVIFSDVAQPDQARILALNASYFLKSGGHFVISIKANCIDSTVPAEAVFQTEVKKLQQEQFKPAEQVTLEPFERDHACVVGGYRMPKKPKAATAA

SEQ ID NO: 509 - protein, 380 aa, Arabidopsis thaliana
MAIILRSSDPLLSRIHPEPQEIDHFDNLPDSILLLIFNNIGDVKALGRCSVVSKRFHSLIPQVENVFVRVDCVISDDDSSSLLSDKPRSASAASPFSAIFRLVFKPLQALGQFLKRSGSSSLPSGSSPSSLLISGGDDGEIEQGGVTHHSPTQVLKNFDEIKFLKIELPSGELGIDDGVLLKWRAEFGSTLENCVILGASSVIPPTNSDKTEASSAPVAAVEDNGSIPESFYTNGGLKLRVVWTISSLIAASARHYLLQPIIAEHKTLDSLVLTDVDGQGVLCMNRDQLEELRVKPLSASSASKRTLVPALNMRLWYAPSLELPDGTVLKGATLVAIRPSESKKEVCDVSWVSSAFDEPYGVAAKMLVKRRTYCLEMNSF

SEQ ID NO: 510 - protein, 229 aa, Zea mays
MAVLLRRAAALLVVAAVCADGASTFYSSDPNLGSARVVFQTNFGDIEFGFFPHVAPKTVEHIFKLVRLGCYITNHFFRVDKGFVAQVADVMSGRTAPMNEEQKKEAEKTIVGEFSSVKHVRGILSMGRHSDPDSAGSSFSILLGNSPHLDGQYAVFGRVTKGDDTLTKLERLPTRREGIFVMPIERINILSTYYYDIDLESCEAEKSILRRRLSESASEVERWRRKCFA

SEQ ID NO: 511 - protein, 366 aa, Zea mays
MGSRVSGPYMDSPPPPPPRPPSPPRHPPHPQGERHVGGEMLYQDTDHRLRALVGSAEGFGRHAIGGLYGAIHRVTSLQDDGPGSLREACRAEEPLWIVFEVSGTIHLHSYLRVSSYKTIDGRGQRVVLTGKGLRLKSCHHVIICNLVLEGGRGHDVDGIQVKPDSTNIWIDRCTLADYDDGLIDITRQSTDITVSRCHFMRHDKTMLIGADPTHVGDRCIRVTIHHCFFDGTRQRHPRLRFGKVHLYNNYTRSWGIYAVCAGVEAQIVSQCNIYEAGGGPPKKTTVFKYMPEKAGDREDVVAGSISSEGDAFLNGALPCLIDNPGSVFRPEEYYQQWTMEPASPALKDIIQLCAGWQPVPRPPDDR

SEQ ID NO: 512 - protein, 222 aa, Zea mays
MSAAGGDLPETVEVTLRAVGPSRPTTLRLPPLLSVAELRGCIARERRLAGTEEVRLRLILRGKTLPHQDDSHVTLRDGDTLIVAVAPKPPVNHLLDDDVEDEEEDELKFRIPQTTTLWKRKFFMFLRDKLRLPDIILMALFSLSMKAWIIIAMWFLLAPIAQKYDIGPLYIIGTGFLIILINLGRRQQGDVSAYSIFNEDFRELPGTLNADRIDADIRAGQF

SEQ ID NO: 513 - protein, 145 aa, Zea mays
MINSKMLVQLAKKWQHMAALGRRRLTMTTTIKDGNLYCTSAIANKGHCIVYTADGKRFEVPLAYLSTNVFVELLRMSEDEFGFTSEDRITVPCDAEVMEYVMCLLRRKPSEEVERAVLNSVVMPCNCMSTMTMVSKGLNQSLSIF

SEQ ID NO: 514 - protein, 175 aa, Zea mays
MGGEHEEQEGGGAKAGGYSSGLPPSEPPHLQGQPPQEYGYGTFQGPRHPPVGFPQPAPPPGFGGGGGYHNQQQPYAHAETYYAQGYQAVPGYGPVAEGRPVRMRRLPCCGLGLGWCLFIAGFFLAAIPWYIGAFVLICVRVHDHREKPGYVACTIAAVVAAVAIFLGVTKGTHVW

SEQ ID NO: 515 - protein, 158 aa, Zea mays
MAENLAPEKRHTFVHNGQKVFEWDQTLEEVNMYIELPKGVPTKLFHCTIQASHVEVGIRGNPPYLNHDLMHPVKTDSSFWTIEDAEMHITLQKREKGKTWSSPIQGQGILDPYAADQEQKRLMLQRFQEENPGFDFSQAQFSGTCPDPRTFMGGIRSE

SEQ ID NO: 516 - protein, 584 aa, Arabidopsis thaliana
MARTTRERVKSFINNRWLVFVAAMWIQSCAGIGYLFGSISPVIKSSLNYNQKQLSRLGVAKDLGDSVGFLAGTLSEILPLWAALLVGSVQNLVGYGWVWLIVTGRAPILPLWAMCILIFVGNNGETYFNTAALVSGVQNFPKSRGPVVGILKGFAGLGGAILSQVYTMIHSSDRASLIFMVAVAPSVVVVPLMFFIRPVGGHRQIRSSDATSFTVIYAVCILLAAYLMAVMLVEDFIDLSHSIIIAFTVVLFAILLVPIFIPIATSCFTASTDPCDTLEEPLLGDQQGQDPGQSTTPDHGPELIFSEVEDEKPKEVDLLPAVERHKRIAQLQAKLMQAAAEGAVRVKRRRGPHRGEDFTLTQALVKADFWLIFFSLLLGSGSGLTVIDNLGQMSQSLGYDNTHVFVSMISIWNFLGRIGGGYFSELIVRDYAYPRPVAIAVAQLVMSVGHIFFAYGWPGAMHIGTLLIGLGYGAHWAIVPATASELFGLKKFGALYNFLTLANPAGSLVFSGLIASSIYDREAERQAQGSLFNPDDVLRCRGSICYFLTSLIMSGFCLIAAALSMILVQRTKPVYTNLYGKTRN

SEQ ID NO: 517 - protein, 279 aa, Arabidopsis thaliana
MAATMADYNDQIVNETSFYNRMVLSHLLPVNLWEPLPHFLQTWLRNYLAGNILYFISGFLWCFYIYYLKLNVYVPKESIPTRKAMLLQIYVAMKAMPWYTLLPAVSEYMIEHGWTKCYSTLDHFNWFLCFLYIALYLVLVEFMIYWVHKELHDIKFLYKHLHATHHMYNKQNTLSPFAGLAFHPLDGILQAIPHVIALFIVPIHLITHLSLLFLEGIWTASIHDCIHGNIWPIMGAGYHTIHHTTYKHNYGHYTIWMDWMFGSLMVPLAEKDSFKEKEK

SEQ ID NO: 518 - protein, 530 aa, Nostoc sp. PCC 7120
MLTKKESISQVIVTAAQMREIEGRIFAAGMPVPALMEKVAGLIASRIQDFSSNFEQGRQREQVRILPPFPCVGILVGPGHNGGDALVVARELHFRGYAVWVYLPFDKLKELTSQHLQYAQSIGIPCYGEIEQLPDCDVLVDGLFGFGLERTITDPIASVINQLNEWNKPIISIDLPSGLHTDTGEVLGTAIRATYTLCLGLWKQGLLQDQALDYVGKAELIDFDIPWADVQAVLEDVPKVKRITPATALSTLPLPRPPVTHKYKEGHLLLICGSRRYAGGAILTALGARGSGVGMLSIAVPESLKQLLVSHLPEALVIGCPETESGAIAQLQLPEKTELSSFSAIACGPGLTKDATSIVEEVLASDRPLVLDADGLNILAQLGTIPTLQQRPAVTVLTPHTGEFQRLFPDVADAKHDRVKAVQEAATQSGAVVLLKGARTAIANPQGSVWINPESTPALARGGSGDVLTGLLGGLLAQVANKEIPVEDIVATAAWWHGQAGILAASERTELGVDAFTLSQYLLKVIVGRS

SEQ ID NO: 519 - protein, 618 aa, Zea mays
MGPLLRAAALSVALLALAAVGEAHSATEFLNIFKPRNEHDYFHNANQEEDVMPRASDQQNLITAPVTKSGLMKVPPRSAPTAVAQDTVVLPVDSAAGFPGAWSIISENAGVSAMHLVIMRSDKAIMFDTVTTGPSLLRLPKGNCRLDLRSKQVGAKDCAAHAVEFDYATGGVRALKVLTDVWCSSGALDAEGNLVQTGGYFEGEKVVRYLSPCGNCDWREFPGSLAEGRWYGTQQLLPDGRSIVLGGRRAFSYEFVPAEGQSNAQAIPLQILRDTTDDVENNLYPFVHLLPDGTLFIFANDRSILFDPRNGQVVREFPVLPGGGRNYPASGMSALLPLDLRRGDVLSPEVIVCGGSPKNAFTLGESNTFPPALKDCARINPLKPDARWALDQMPVARTMGDLLILPTGDLLILNGAAKGCSGWGFGRQPVLSPLLYSPRQARGSRFRALAPTTIPRMYHATSAVLPDATVLVAGSNTNSAYNFSGVDFQTEVRVERFTPPYLAPERAANRPAIDVATVPGDGMAYGAKFTFQFSTPVQAVAEPDLKVTMYAPPFTTHGYSMNQRLLVLSVTAFAANGQRYTITVDAPGKPELAPPGYYLLYVIAKGVPSKAAWVKVHK

SEQ ID NO: 520 - protein, 133 aa, Zea mays
MSYYGDRRAESSIVEAFTLSPLPYPVILVLLMVTLLLGASWFFTYDDFIEEASQQLSWALLGVPIALVLLIRWISSVDSFEGYLGFYPRESRWKGRYERGPAEGSSPWGVALLVLLLLVLASFHSTIHDMWGP

SEQ ID NO: 521 - protein, 419 aa, Zea mays
FITSLYKKAGSCRTMPPVKKSKKGKRKSKDGKLKIVRARGAPPALPPELRALDTEWWYAFLNKQVELEHAVPPDEGEAFRHFFRTSRKTFDYICSIVREDLISRPPSGLINIEGRLLSVEKQVAIAMRRLASGDSQVSVGTAFGVGQSTVSQVTWRFIESMEDRARYHLAWPSQERLEQIKAVLEDAYGLPNCCGGVDATHVIMTLPAVESSADWCDHAKNYSMFLQGIVDDQMRFIDIVTGWPGSMTFSRLMKCSGFFKLCEAGERLNGSVKVSAEGAEIREYIAGDSCYPLLPWLMTPFEGKHLPAPLQNFNARQKAARLLGTNALARLKGSWRILHKVMWRPDKNKLPSIILVCCLLHNILIDCHDELLPSVQLPEHHDTGYNRENCEQVDPNGKVMRENITAHLQHCEASKFLCN

SEQ ID NO: 522 - protein, 173 aa, Arabidopsis thaliana
MAPLQRTISDISHQISIDNTLTKEPSPTATATTLLSLSAISEVEDAKCECCGMSEECTPEYIHRVRSKFSGKLICGLCEKAVEGEMEKMNNSEVLMEKRREEAVKVHMSACSRFNRLGRSYPVLYQAEAVKEMLKKRSKKMVGATKPEKGGLARSSSCMPALAKELKDRTLVN

SEQ ID NO: 523 - protein, 284 aa, Arabidopsis thaliana
MPRYDDRYGNTRLYVGRLSSRTRTRDLERLFSRYGRVRDVDMKRDYAFVEFSDPRDADDARYYLDGRDFDGSRITVEASRGAPRGSRDNGSRGPPPGSGRCFNCGVDGHWARDCTAGDWKNKCYRCGERGHIERNCKNSPSPKKARQGGSYSRSPVKSRSPRRRRSPSRSRSYSRGRSYSRSRSPVRREKSVEDRSRSPKAMERSVSPKGRDQSLSPDRKVIDASPKRGSDYDGSPKENGNGRNSASPIVGGGESPVGLNGQDRSPIDDEAELSRPSPKGSESP

SEQ ID NO: 524 - protein, 251 aa, Arabidopsis thaliana
MATAVGSGSDVEVGFAKLQGEDFEYYMQSYSIILGRNSKKSTVDVDLSSLGGGMNISRNHARIFYDFTRRRFSLEVLGKNGCFVEGVLHLPGNPNVKLDSQDLLQIGDKEFYFLLPVWSILGGPLGPRHHVLGKATVVPYHNYHSGPGSGSGKNGVRSRELYEYDDEDDDEEEDIRGSGKKTWRDGHEGVYASGEKKREGRSKADREADDQQFLQLMHGSGWSVTDIKGVWKRMASQSSKKIPITRRLGYP

SEQ ID NO: 525 - protein, 435 aa, Arabidopsis thaliana
RISFELSIYKSVQLTYPVVIEPMETPLPPLSQLTPNPTPAAAVSSAIPAPVKSVAVQQPIDGSPRAVATDTGGIPEPLAAVPGAKLRLMCSFGGHIMPRPHDKSLTYSGGETRIVVVDRRASLSSLRSRLSSMLLNGRSFTLKYQLPSEDLDSLVTITTDEDLENMIEEYDRAASSATATATQRLRLFLFANKLETAATMGSLLDGTKSDTWFVDALNQSGLLPRGLSDSAAVNNTLVNLDEASGGETEIQNLETNVGGENNKRGDLVANGVISHQEMHMSSMPDSPMMEAAGSSIGSSSSSPSTSNLPPIRVRVSEDQRIEEQLAQMTFSNMQTQRQFDDGVSLMANRPMMIPPGAMNDAAMAYNNAPGDGTAPASNGHVSPEDDRSELGVSTGYRKPPLPMQPVTIPPRTVGGYGLTSPDSVARYFHLPLDSL

SEQ ID NO: 526 - protein, 378 aa, Arabidopsis thaliana
MATWNASSPAASPCSSRRRTKAPARRPSSESPPPRKMKSMAEIMAKSVPVVEQEEEEDEDSYSNVTCEKCGSGEGDDELLLCDKCDRGFHMKCLRPIVVRVPIGTWLCVDCSDQRPVRRLSQKKILHFFRIEKHTHQTDKLELSQETRKRRRSCSLTVKKRRRKLLPLVPSEDPDQRLAQMGTLASALTALGIKYSDGLNYVPGMAPRSANQSKLEKGGMQVLCKEDLETLEQCQSMYRRGECPPLVVVFDPLEGYTVEADGPIKDLTFIAEYTGDVDYLKNREKDDCDSIMTLLLSEDPSKTLVICPDKFGNISRFINGINNHNPVAKKKQNCKCVRYSINGECRVLLVATRDISKGERLYYDYNGYEHEYPTHHFL

SEQ ID NO: 527 - protein, 403 aa, Arabidopsis thaliana
MDAKKLDTGPRDAINWLPDEILGKILSLLATKQAVSTSVLSKKWRTLFKLVDTLEFDDSVSGMGEQEASYVFPESFKDLVDRTVALQCDYPIRKLSLKCHVGRDDEQRKACVGRWISNVVGRGVSEVVLRINDRGLHFLSPQLLTCKTLVKLTLGTRLFLGKLPSYVSLPSLKFLFIHSVFFDDFGELSNVLLAGCPVVEALYLNQNGESMPYTISSPTLKRLSVHYEYHFESVISFDLPNLEYLDYSDYALYGYPQVNLESLVEAYLNLDKAEHVESPDVTKLIMGIRNVEILSLSPDSVGVIYSCCKYGLLLPVFNNLVSLSFGTKKTRAWKLLADILKQSPKLETLIIEDLNGYPLDVSMPLNQVKELQILEYGESDDEVKRLKSFLGEESMIEVVFPEV

SEQ ID NO: 528 - protein, 442 aa, Arabidopsis thaliana
MVTLTSSSSTPNVSFDFMMNNNNNSNNLYGPFSSSSTSFSYLTSKEDALTQKNLMSGITNDVLGINKKASEDLEISVFGAEKYFNGDMDSDHSPRLVSPLPDPEVPIERIFVGPKQSSKNSSETPSLRSESSWNSQSLLLQSKYVEKKKNIKKNSSCNSYFQEKDMSSNHKVSNKKSFLATLGCRCVCSNWSSVDVVDDKRRSSGLKKIKTQLSFSGDLSSEMKIHQQQQEAMLEQRKSLEIFGSPLIEKRIIQKKFPWEYSSSAKKEEHGFSVKYEEEEDGSVSDVSTDLFEIESLTGKANPFLARQGSSDPDSPDGYAPSEVSIQWSVVTASVADFSVMSECATSPVKKNRSFQIPRIPIMAKSNREIAPQRRKSSSSGLLMGCKSHKSVRVSGDSYTSMNRTPSYVPRFPVEANPTSTETRRRISSSSVSHTQSPFLYT

SEQ ID NO: 529 - protein, 337 aa, Arabidopsis thaliana
MGVDYYKVLQVDRSASDDDLKKAYRKLAMKWHPDKNPNNKKDAEAMFKQISEAYEVLSDPQKKAVYDQYGEEGLKGNVPPPDAGGATYFSTGDGPTSFRFNPRNADDIFAEFFGFSSPFGGGRGGTRFSSSMFGDNMFASFGEGGGGGGGSMHHGGARKAAPIENKLPCSLEDLYKGTTKKMRISREIADVSGKTMQVEEILTIDVKPGWKKGTKITFPEKGNEQPGVIPADLVFIIDEKPHPVFTREGNDLIVTQKISLVEALTGYTVNLTTLDGRRLTIPVTNVVHPEYEEVVPKEGMPLQKDQTKRGNLRIKFNIKFPTRLTSEQKTGVKKLLG

SEQ ID NO: 530 - protein, 186 aa, Arabidopsis thaliana
MASYQNRPGGQATDEYGNPIQQQYDEYGNPMGGGGYGTGGGGGATGGQGYGTGGQGYGSGGQGYGTGGQGYGTGTGTEGFGTGGGARHHGQEQLHKESGGGLGGMLHRSGSGSSSSSEDDGQGGRRKKGITQKIKEKLPGHHDQSGQAQAMGGMGSGYDAGGYGGEHHEKKGMMDKIKEKLPGGGR

SEQ ID NO: 531 - protein, 332 aa, Arabidopsis thaliana
MGFDLKEIRTKKTLIGLGLGQLLSLLATSNGFTSSELARKGINVPTSQCFLNYVLLAIVYGSIMLYRRSDIKAKWYYYFLLAFVDVEANFLVVKAYQYTSLTSVMLLDCWAIPCVLVLTWFYLKTKYRLMKISGVFICIVGVFMVVFSDVHAGDRAGGSNPVKGDFLVLAGATLYAVSNTSEEFLVKNADTVELMTFLGFFGAIISAIQVSILERDELKAIHWSTGAVFPFLRFTLTMFLFYPLVPVLLKTNGATMFNLSLLTSDMWAVLIRTFGYHEKVDWLYFLAFATTATGLIIYSMKEKDQEEHRFEEVGDEAAMQRKLLGEDDEPGT

SEQ ID NO: 532 - protein, 308 aa, Arabidopsis thaliana
MALEQQHVCEKRLQAKTFSTQEFQLTLNWDDLTCPICLDFPHNGVLLQCSSYGNGCRAFVCNTDHLHSNCLDRFISACGTESPPAPDEPRSKVLEESCKPVCPLCRGEVTGWLVVEEARLRLDEKKRCCEEERCRFMGTYLELRKHAQSEHPDSRPSEIDPARKLDWENFQQSSEIIDVLSTIHSEVPRGVVLGDYVIEYGDDDTGDEFEDVPNNEGNWWTSCILYQMFDNIRNARNRRRSRMSESRRGSRRSSYENSNSDDSSVASIEFPEYRVDEIDDEFISTSGANRSSSMHQSSRRRRTRFYEN

SEQ ID NO: 533 - protein, 434 aa, Arabidopsis thaliana
MSFLIPNRGVGGTKIPLSIIVLVLCGFMFFILLYTERISLLSSSSSSSSSFFKLKSCPRKDVSSKPKEKIRKERSEILEVLDDRFEFDPEECNVAAGKWVYNSSIEPLYTDRSCPYIDRQFSCMKNGQPETDYLRWEWQPDDCTIPRFSPKLAMNKLRGKRLLFVGDSLQRSQWESFVCLVESIIPEGEKSMKRSQKYFVFKAKEYNATIEFYWAPYIVESNTDIPVISDPKKRIVKVDSVKDRAKFWEGADILVFNTYVWWMSGLRMKALWGSFGNGESGAEALDTQVAYRLGLKTWANWVDSTVDPNKTRVFFTTMSPTHTRSADWGKPNGTKCFNETKPIKDKKFWGTGSNKQMMKVVSSVIKHMTTHVTVINITQLSEYRIDAHTSVYTETGGKILTAEQRADPMHHADCIHWCLPGLPDTWNRILLAHL

SEQ ID NO: 534 - protein, 281 aa, Arabidopsis thaliana
MAVSYNALAQSLARSSCFIPKPYSFRDTKLRSRSNVVFACNDNKNIALQAKVDNLLDRIKWDDKGLAVAIAQNVDTGAVLMQGFVNREALSTTISSRKATFFSRSRSTLWTKGETSNNFINILDVYVDCDRDSIIYLGTPDGPTCHTGEETCYYTSVFDQLNNDEASGNKLALTTLYSLESIISKRKEESTVPQEGKPSWTRRLLTDDALLCSKIREEADELCRTLEDNEEVSRTPSEMADVLYHAMVLLSKRGVKMEDVLEVLRKRFSQSGIEEKQNRTK

SEQ ID NO: 535 - protein, 410 aa, Glycine max
MGACWSNRIKSVSPSNTGITSRSVSRSGHDVSSNSRSSSASISVASRSEGEILQSSNLKSFSYNELRAATRNFRPDSVLGEGGFGSVFKGWIDEHSLAATKPGIGMIVAVKRLNQDGFQGHREWLAEINYLGKLQHPNLVRLIGYCFEDEHRLLVYEFMPKGSMENHLFRRGSYFQPFSWSLRMKIALGAAKGLAFLHSTEPKVIYRDFKTSNILLDTNYSAKLSDFGLARDGPTGDKSHVSTRVMGTHGYAAPEYLATGHLTTKSDVYSFGVVLLEMISGRRAIDKNQPTGEHNLVDWAKPYLSNKRRVFRVIDPRLEGQYLQSRAQAAAALAIQCLSIEARCRPNMDEVVKALEQLQESKNMQRKGADHKQHHVRNSGPGRSNGGNGGSDVPRKASAYPRPSASLLRG

SEQ ID NO: 536 - protein, 479 aa, Glycine max
MNPDQFQKNSMFVETPEDGGKNFDDDGRVKRTGTWITASAHIITAVIGSGVLSLAWAIAQMGWVAGPAVLFAFSFITYFTSTLLADCYRSPDPVHGKRNYTYSDVVRSVLGGRKFQLCGLAQYINLVGVTIGYTITASISMVAVKRSNCFHKHGHHDKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGKERWPNSHFVNGEHALKFSLFGTFPVNFFRVVWRTTYVIITALIAMMFPFFNDFLGLIGSLSFWPLTVYFPIEMYIKQSKMQKFSFTWTWLKILSWACLIVSIISAAGSIQGLAQDLKKYQPFKAQQ

SEQ ID NO: 537 - protein, 342 aa, Saccharomyces cerevisiae
MSVFVSGANGFIAQHIVDLLLKEDYKVIGSARSQEKAENLTEAFGNNPKFSMEVVPDISKLDAFDHVFQKHGKDIKIVLHTASPFCFDITDSERDLLIPAVNGVKGILHSIKKYAADSVERVVLTSSYAAVFDMAKENDKSLTFNEESWNPATWESCQSDPVNAYCGSKKFAEKAAWEFLEENRDSVKFELTAVNPVYVFGPQMFDKDVKKHLNTSCELVNSLMHLSPEDKIPELFGGYIDVRDVAKAHLVAFQKRETIGQRLIVSEARFTMQDVLDILNEDFPVLKGNIPVGKPGSGATHNTLGATLDNKKSKKLLGFKFRNLKETIDDTASQILKFEGRI

SEQ ID NO: 538 - protein, 551 aa, Arabidopsis thaliana
  misc_feature (271)..(271): Xaa can be any naturally occurring amino acid
MVVETIERSCEGSKRRHVNGGDIAVPCSGEECSNGDINVAPGVSAKRARVSREMTFEDIYGADALLNDDDDEDDDCDWEPVQAPMEFVKWCCVNCTMSNPGDMVHCCICGEHKESGILRHGYLASPFFKDTGLIEVEEKYGGSSSATSSTAVGFDERMLLHSEFEVKAQPHPERPDRLRAIAASLATAGVFPGRCLPINAREITKQELQMVHTSEHVDAVDTTSQLLYSYFTSDTYANEYSARAARLAAGLCADLATDIFTGRVKNGFALXPPGHHAGVRHAMGFCLHNNAAVAALVAQAAGAKKVLIVDWDVHHGNGTQEIFEQNKSVLYISLHRHEGGNFYPGTGAADEVGSNGGEGYCVNVPWSCGGVGDKDYIFAFQHVVLPIASAFSPDFVIISAGFDAARGDPLGCCDVTPAGYSRMTQMLGDLCGGKMLVILEGGYNLRSISASATAVIKVLLGENPENELPIATTPSVAGLQTVLDVLNIQLEFWPSLAISYSKLLSELEARLIENKKNQMKRKVVRVPTWWKWGRKKLLYNFLSARMISRSK

SEQ ID NO: 539 - protein, 375 aa, Arabidopsis thaliana
MDFDSISRESTFLSPLLNQNAMWQMNLGSDDTMGVDGSYPERHGEPDCAYYIRTGLCRFGSTCRFNHPHDRKLVIATARIKGEYPERIGQPECEFYLKTGTCKFGVTCKFHHPRNKAGIDGSVSVNVLSYPLRPNEDDCSYFLRIGQCKFGGTCKFNHPQTQSTNLMVSVRGSPVYSALQSLTGQPSYSWSRTSFVANPPRLQDPSGFASGSQGGLFSSGFHSGNSVPLGFYALPRENVFPERPGQPECQFYMKTGDCKFGTVCKFHHPRDRQTPPPDCVLSSVGLPLRPGEPLCVFYSRYGICKFGPSCKFDHPMRVFTYNNNTASPSPSSSLHQETAITTELRNLLVSSSVEAKPTSLPETTSAKDTIVDAQH

SEQ ID NO: 540 - protein, 351 aa, Glycine max
MAEAESVQIPQVKLGTQGLVVSKLGLGCMTLSGRYNDPLPEEEGISVIKHAFSQGITFFDTSDVYGLDHANEFLLGKALKQLPRKKIQVATKFGVAVAKFPNFQIKGTPEYVRSCCEASLKRLDVEYIDLYYQHRIDQTVPIEETVGELKKLVEEGKVKYIGLSEASPDTIRRAHAVHPITALQIEWSLWTRDIEEEIIPLCRELGIGIVPYSPLGRGFFGGKGVLENMPASTVLTLHHPRFQAENINKNKRIYEQIESLAKKYQSTPPQLALAWVLHQGNDVVPIPGTTKIKNLDQNIGALSLKFTESDLREISEAVPIHDVAGSQYFFGNDKDSWKFANTPPKDPRVST

SEQ ID NO: 541 - protein, 359 aa, Arabidopsis thaliana
MGKVLQKEAFGLAAKDNSGVLSPFSFTRRETGEKDVRFKVLFCGICHSDLHMVKNEWGMSTYPLVPGHEIVGVVTEVGAKVTKFKTGEKVGVGCLVSSCGSCDSCTEGMENYCPKSIQTYGFPYYDNTITYGGYSDHMVCEEGFVIRIPDNLPLDAAAPLLCAGITVYSPMKYHGLDKPGMHIGVVGLGGLGHVGVKFAKAMGTKVTVISTSEKKRDEAINRLGADAFLVSRDPKQIKDAMGTMDGIIDTVSATHSLLPLLGLLKHKGKLVMVGAPEKPLELPVMPLIFERKMVMGSMIGGIKETQEMIDMAGKHNITADIELISADYVNTAMERLEKADVRYRFVIDVANTLKPNPNL

SEQ ID NO: 542 - protein, 512 aa, Arabidopsis thaliana
MFPLISFSPTSLDFTFFAIIISGFVFIITRWNSNSKKRLNLPPGPPGWPVVGNLFQFARSGKPFFEYAEDLKKTYGPIFTLRMGTRTMIILSDATLVHEALIQRGALFASRPAENPTRTIFSCNKFTVNAAKYGPVWRSLRRNMVQNMLSSTRLKEFGKLRQSAMDKLIERIKSEARDNDGLIWVLKNARFAAFCILLEMCFGIEMDEETIEKMDEILKTVLMTVDPRIDDYLPILAPFFSKERKRALEVRREQVDYVVGVIERRRRAIQNPGSDKTASSFSYLDTLFDLKIEGRKTTPSNEELVTLCSEFLNGGTDTTGTAIEWGIAQLIANPEIQSRLYDEIKSTVGDDRRVDEKDVDKMVFLQAFVKELLRKHPPTYFSLTHAVMETTTLAGYDIPAGVNVEVYLPGISEDPRIWNNPKKFDPDRFMLGKEDADITGISGVKMIPFGVGRRICPGLAMATIHVHLMLARMVQEFEWCAHPPGSEIDFAGKLEFTVVMKNPLRAMVKPRI

SEQ ID NO: 543 - protein, 592 aa, Arabidopsis thaliana
MSLLLMLIADMRCFRCFYTRAHSLLLLRSSNPVTVPISPVRFRLRLRRLSSSPVASVFDLHSSNQDANSNREDKDTKIGFSDDKSRKSGSNPPRWNPGEVVMNKSKKGKSKTVWVCESCGHSEGQWWGSCRACHKVGTMKRFSEGSESSASGGGGNGTGLGFTEGKGLSWLPEQATVQPHRLTDVIHGITQQQWRISLPGLFGNEVARVLGGGLAPGSLILIGGDPGIGKSTLLLQIASIIAEGSELAEPAPVLYISGEESVEQIGSRADRMRIQTEELYLFSSSDLQDILSKAHRLSPRALIIDSIQTVYLKDVTGSAGGLTQVKECTSTLLRFAKKSNIPVFLVGHVTKAGDIAGPRVLEHIVDVVLYLEGEESSTYRLLRSAKNRFGSTDELGVFEMANSGLEVVSNPSGIYLSQQNPDSDVLAGLAVAVVMDGSRSFLIEVQALCSPGSTVSRHVNGVQASRADMIIAVLMKQAGLRIQENGIFLNVANGMALSETAGDLAIAAAICSSFLEFPIPHGVAFIGEIGLGGEVRTVPRMEKRVSTVAKLGFNKCVVPKSVEESLKALSLKEIEIIGCKNLKELINAVFKG

SEQ ID NO: 544 - protein, 514 aa, Arabidopsis thaliana
MEEIRGVPTWQEELASLVDAGLRYDGAPIDLTAATKRSGFVSADGSGSEPKETLKDQVTGFMKSWGEMLLELAKGCKDIVQQTVVTDDSFLVRKLRKPAAKVSKKLSFLNEFLPEDRDPIHAWPVIFFVFLLALAALSFSPENDRPVTVITKLRLHPTGATRVQLPDGRYIAYQELGVSAERARYSLVMPHSFLSSRLAGIPGVKKSLLVEYGVRLVSYDLPGFGESDPHRGRNLSSSASDMINLAAAIGIDEKFWLLGYSTGSIHTWAGMKYFPEKIAGAAMVAPVINPYEPSMVKEEVVKTWEQWLTKRKFMYFLARRFPILLPFFYRRSFLSGNLDQLDQWMALSLGEKDKLLIKDPTFQEVYQRNVEESVRQGITKPFVEEAVLQVSNWGFTLSEFRTQKKCATNGVLSWLMSMYSEAECELIGFRKPIHIWQGMEDRVAPPSMSDYISRMIPEATVHKIRNEGHFSFFYFCDECHRQIFYALFGEPKGQLERVKETEDTVVETEAHKDT

SEQ ID NO: 545 - protein, 386 aa, Arabidopsis thaliana
MAKPVSIEVYNPNGKYRVVSTKPMPGTRWINLLVDQGCRVEICHLKKTILSVEDIIDLIGDKCDGVIGQLTEDWGETLFSALSKAGGKAFSNMAVGYNNVDVEAANKYGIAVGNTPGVLTETTAELAASLSLAAARRIVEADEFMRGGLYEGWLPHLFVGNLLKGQTVGVIGAGRIGSAYARMMVEGFKMNLIYFDLYQSTRLEKFVTAYGQFLKANGEQPVTWKRASSMEEVLREADLISLHPVLDKTTYHLVNKERLAMMKKEAILVNCSRGPVIDEAALVEHLKENPMFRVGLDVFEEEPFMKPGLADTKNAIVVPHIASASKWTREGMATLAALNVLGRVKGYPIWHDPNRVDPFLNENASPPNASPSIVNSKALGLPVSKL

SEQ ID NO: 546 - protein, 472 aa, Arabidopsis thaliana
MGHQSSWMKQTVIDSVVQSSKVGVFSMFSMDYKAPRKYSHGRNFGVARQQDFAADIVTRRPYAPYDNGMKKGPNKLSRNLVWTSKEYKSPEGNRPRQNAANGSAKPQVIGTGHRVSNQPRKNAVYGPRSSSLSDTRGCGPRLNGSPKKSVCNFWKDGNCKKGEKCQFLHSWSCFPGLAMVAALEGHKNDIKGIALPQGSDKLFSVSGDGTLLIWDCNSGQCVRSINLQAEAGSLISEGPWVFLGLPNAVKAFNVQNSKDVHLEGVVGQVHAMTAANGMLFAGTSSGSILVWKATDSESDPFKYLTSLEGHHSGEVTCFVVGGEVLYSGSVDKTIKVWDLNTLQCRMTLKQHIGTVTSLLCWDKCLISSSLDGTIKLWACSENESLKVVQTRKQELSVHTLCGMHDAEAKPIMFCSYQNGAVGIFDLPSFEERGKMFSTQTICTLTIGPGGLLFSGDKSGNLRVWSLASGTKV

SEQ ID NO: 547 - protein, 1008 aa, Arabidopsis thaliana
MLLVLDLGISSLVLVVSLVLPLIGLFVRHKWRVAAQRREEIRRLLIHASEEAARAELEASVEFSSVAVSNVFHCPVCYCLATTRCSRCKAVRYCSGKCQIIHWRQGHKDECHPASIVYDSEDESDSDLRLGEENGQNTPEETLLVGPEPVTIPIGESLLSNRARSPEDGNGDIADNKDDLIDKEEAVSVAETSGSSFSGFSSSPRNDSGDEISRCESFSSSESERSESLLDAHVSVEPEDTCFSTIEDAPSKLLSPKFVHLVESVDNLANLPKLSVHKPEDDAGQNQSQSRSLHSLVTDRHPVSADPSLKSSDFWGTALGSAERVSDSCVKSKSGRPGNSSLHFSFGSGSSRDTSAAKVSEQRSSILKEAPRGTGYISDGVNLRERNAKRFDEAEIALPISSSTDALSPLDSSNLSHVTLPKSKSASSENGSMLAPLKVGEVQLLASKASNTKKCADLMKHSPLGAKSVRVLDHQKQNGAVVQHINSLHGRSGLKASVLKVVDQWTRPKSENEMAGRHGHKGLFPYEVFAKLYTYKIEFQPCGLINVGNSCFANVVFQCLMFTPPLTTYFLQQFHSRACTKKEQCFTCGFEKLVVKAKEEKSPLSPNGLLSQLQNIGIFLGNGKEEDAHEFLRFVVDTMQSVCIKASEYDMTKSSKLEDTTLIGLTFGGYLRSKIKCMKCQVKSELREKMMDLTVEIDGDISTLDDALRRFTRTEILDGENKYRCGSCKSYERAKKKLKITEPPNVLTIALKRFQAGKFGKLNKLIRFPETLDLAPYVSGGSEKSHDYKLYGVIVHLDVMNAAFSGHYVCYIRNQNKWYKADDSTVVTSDVERILTKGAYMLFYARCTPTPPRLAVCTKTEASNKKSRVPLPKANEKSTISRSVSTSSPELSSNTPGGGRSGNIQSFYSSFQRLQKILEEDSASDSSSLFDSNSDECSCSTDSTSMDDFADFIFGDHQGRAHGQSETPSPTSSSSSSSPPFTRRSPLSRSSPETYGTSRHQLPLGGER

SEQ ID NO: 548 - protein, 314 aa, Saccharomyces cerevisiae
MSYNPYAYATSEQNGVNDRFSHTPQQQRPMQIPRNTPVNGQGNANMNANVNGSRGGFPFQDPRGSMAFQLGQSAFSNFIGQDNFNQFQETVNKATANAAGSQQISTYFQVSTRYVINKLKLILVPFLNGTKNWQRIMDSGNFLPPRDDVNSPDMYMPIMGLVTYILIWNTQQGLKGSFNPEDLYYKLSSTLAFVCLDLLILKLGLYLLIDSKIPSFSLVELLCYVGYKFVPLILAQLLTNVTMPFNLNILIKFYLFIAFGVFLLRSVKFNLLSRSGAEDDDIHVSISKSTVKKCNYFLFVYGFIWQNVLMWLMG

SEQ ID NO: 549 - protein, 888 aa, Saccharomyces cerevisiae
MSGEEEVDYTTLPLEERLTYKLWKARLEAYKELNQLFRNSVGDISRDDNIQIYWRDPTLFAQYITDSNVVAQEQAIVALNSLIDAFASSSLKNAHNITLISTWTPLLVEKGLTSSRATTKTQSMSCILSLCGLDTSITQSVELVIPFFEKKLPKLIAAAANCVYELMAAFGLTNVNVQTFLPELLKHVPQLAGHGDRNVRSQTMNLIVEIYKVTGNNSDLLEEILFKKLKPIQVKDLHKLFAKVGDEPSSSKMLFEWEKRELEKKRSQEEEARKRKSILSNDEGEYQIDKDGDTLMGMETDMPPSKQQSGVQIDTFSMLPEETILDKLPKDFQERITSSKWKDRVEALEEFWDSVLSQTKKLKSSSQNYSNLLGIYGHIIQKDANIQAVALAAQSVELICDKLKTPGFSKDYVSLVFTPLLDRTKEKKPSVIEAIRKALLTICKYYDPLASSGRNEDMLKDILEHMKHKTPQIRMECTQLFNASMKEEKDGYSTLQRYLKDEVVPIVIQIVNDTQPAIRTIGFESFAILIKIFGMNTFVKTLEHLDNLKRKKIEETVKTLPNFSIASGSTHSTIETNKQTGPMENKFLLKKSSVLPSKRVASSPLRNDNKSKVNPIGSVASASKPSMVAANNKSRILLTSKSLATPKNVVANSTDKNEKLIEEYKYRLQKLQNDEMIWTKERQSLLEKMNNTENYKIEMIKENEMLREQLKEAQSKLNEKNIQLRSKEIDVNKLSDRVLSLENELRNMEIELDRNKKRNDTNLQSMGTISSYSIPSSTVSSNYGVKSLSSALPFKEEEDVRRKEDVNYERRSSESIGDLPHRVNSLNIRPYRKNGTGVSSVSDDLDIDFNDSFASEESYKRAAAVTSTLKARIEKMKAKSRREGTTRT

SEQ ID NO: 550 - protein, 608 aa, Saccharomyces cerevisiae
MKMPLKKMFTSTSPRNSSSLDSDHDAYYSKQNPDNFPVKEQEIYNIDLEENNVSSRSSTSTSPSARDDSFAVPDGKDENTRLRKDLKARHISMIAIGGSLGTGLLIGTGTALLTGGPVAMLIAYAFVGLLVFYTMACLGEMASYIPLDGFTSYASRYVDPALGFAIGYTYLFKYFILPPNQLTAAALVIQYWISRDRVNPGVWITIFLVVIVAINVVGVKFFGEFEFWLSSFKVMVMLGLILLLFIIMLGGGPNHDRLGFRYWRDPGAFKEYSTAITGGKGKFVSFVAVFVYSLFSYTGIELTGIVCSEAENPRKSVPKAIKLTVYRIIVFYLCTVFLLGMCVAYNDPRLLSTKGKSMSAAASPFVVAIQNSGIEVLPHIFNACVLVFVFSACNSDLYVSSRNLYALAIDGKAPKIFAKTSRWGVPYNALILSVLFCGLAYMNVSSGSAKIFNYFVNVVSMFGILSWITILIVYIYFDKACRAQGIDKSKFAYVAPGQRYGAYFALFFCILIALIKNFTVFLGHKFDYKTFITGYIGLPVYIISWAGYKLIYKTKVIKSTDVDLYTFKEIYDREEEEGRMKDQEKEERLKSNGKNMEWFYEKFLGNIF

SEQ ID NO: 551 - protein, 330 aa, Saccharomyces cerevisiae
MSSPANLFPGLNDITDVLEEFPLATSRYLTLLHEIDAKCVHSMPNLNERIDKFLKKDFNKDHQTQVRLLNNINKIYEELMPSLEEKMHVSSIMLDNLDRLTSRLELAYEVAIKNTEIPRGLRLGVDNHPAMHLHHELMEKIESKSNSKSSQALKSESRREAMAANRRQGEHYSASTHQQDDSKNDANYGGSRHESQDHTGNNTNSRKRANAANTNNADPETKKRKRRVATTAVSPSTISTATAVNNGRIGTSTASRGVSSVGNSNNSRISRPKTNDYGEPLYCYCNQVAYGEMVGCDGADCELEWFHLPCIGLETLPKGKWYCDDCKKKL

SEQ ID NO: 552 - protein, 423 aa, Saccharomyces cerevisiae
MAEIPDETIQQFMALTNVSHNIAVQYLSEFGDLNEALNSYYASQTDDQKDRREEAHWNRQQEKALKQEAFSTNSSNKAINTEHVGGLCPKPGSSQGSNEYLKRKGSTSPEPTKGSSRSGSGNNSRFMSFSDMVRGQADDDDEDQPRNTFAGGETSGLEVTDPSDPNSLLKDLLEKARRGGQMGAENGFRDDEDHEMGANRFTGRGFRLGSTIDAADEVVEDNTSQSQRRPEKVTREITFWKEGFQVADGPLYRYDDPANSFYLSELNQGRAPLKLLDVQFGQEVEVNVYKKLDESYKAPTRKLGGFSGQGQRLGSPIPGESSPAEVPKNETPAAQEQPMPDNEPKQGDTSIQIRYANGKREVLHCNSTDTVKFLYEHVTSNANTDPSRNFTLNYAFPIKPISNDETTLKDADLLNSVVVQRWA

SEQ ID NO: 553 - protein, 462 aa, Arabidopsis thaliana
MAVSSFAVLPPFGSSYSSTTDRSSSSSFYSSSKLLRISQYRFQSNSRCPNVFVSCSLNQPSDDASDAALFLESNSIADYMRFKRRPDPGNGTSELQTAIVSYKKRFPWILLNPFLQVDLVSTIHIADKEYFTTLQKELEPYDSILYEMVASKETLENRRNPIASKRLKSSRSRGFSILGFIQRQMARVLTLDFQLDCLDYDTENWYHADLDFETFQLLQKEKGESFFSFARDMTIRSTKAMIQPALVTEGRDTWRSKLLWVSRVFPMPLVGLFLIGAFCADFGDQTSDYPELEALSRLDFGAAMKVFLAKRLTSELTLETSDIEEKSVIIGERNRAATEALRRAIEQGHKRIGILYGGGHMPDLGRRLREEFDLVPSEVRWVTAWSIRNPTDLETSSYPILRKMAEALRWPLNRYQTLALLIFSSVLALDLCFWELFFGSTIDWATQIGAELYQFIDNTKIV

SEQ ID NO: 554 - protein, 447 aa, Arabidopsis thaliana
MSNYRGDDAEYMEDVDDEMEDVEDDMDEEFRGDDLGASDSDVEEFDYSNNKVADTTAEQARKGKDIQGIPWDRLNISREKYRQTRLEQYKNYENVPNSGESSEKVCKVTQKGGLFYDFWRNSRSIKSTILHFQLRNLVWATSKHDVYLMSNFLVTHYSSLTSGKHEVLNVRGHVAPSEKHPGSLLEGFTQTQVSTLAVKDDFLVAGGFQGELICKHLDRPGVSFCSRMTYDDNAITNAIEIYNKPSGALHFTASNNDCGVRDFDMERYQLVKHFRFPWPVNHASLSPDGKLLAIVGDNPEGLIVDPNTGKTLETLSGHLDFSFASAWHPDGVTFSTGNQDKTCRVWDIRNLSQSVTVLKGNLGAIRSIRYTSDGKYMAMAEPADFVHVYDVSNGYETEQEIDFFGEISGISFSPDTEALFIGVWDRTYGSLLEFGRRRNYSYLDSYL

SEQ ID NO: 555 - protein, 368 aa, Cupriavidus metallidurans
MKTKAAIAWKAGAPLTIEEVDLDGPRAGEVLVEIKATGICHTDYYTLSGADPEGIFPAILGHEGAGIVTDVGPGVTSLKPGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVIFTAKVEAGANVVVFGLGGIGLNVIQGAKMVGADKIIGVDLNPAREAMARKFGMTHFVNPKDVDNVVDHIVQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFDLMKRGESIRSVVLY

SEQ ID NO: 556 - protein, 360 aa, Escherichia coli K12
MTKKGAFTSAFFIYAFSACIIRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 557 - protein, 477 aa, Arabidopsis thaliana
MADPATSSPLLDDHVGGEDERGRRSRSSTLVQKVIDVEEAKAQMIYSLPMILTNVFYYCIPITSVMFASHLGQLELAGATLANSWATVSGFAFMVGLSGSLETLCGQGFGAKRYRMLGVHLQSSCIVSLVFSILITIFWFFTESIFGLLRQDPSISKQAALYMKYQAPGLLAYGFLQNILRFCQTQSIIAPLVIFSFVPLVINIATAYVLVYVAGLGFIGAPIATSISLWIAFLSLGTYVMCSEKFKETWTGFSLESFRYIVINLTLSLPSAAMVCLEYWAFEILVFLAGVMPNPEINTSLVAICVNTEAISYMLTYGLSAAASTRVSNELGAGNVKGAKKATSVSVKLSLVLALGVVIVLLVGHDGWVGLFSDSYVIKEEFASLRFFLAASITLDSIQGVLSGVARGCGWQRLVTVINLATFYLIGMPIAAFCGFKLKFYAKGLWIGLICGIFCQSSSLLLMTIFRKWTKLNVATV

SEQ ID NO: 558 - protein, 552 aa, Arabidopsis thaliana
MELKWVSCRKQSLFLISCLALLCLASLDTISCESTQNATDFKKRSQTVSCPPDWIIGPNQTKCYAYFKNSTSWEKSEMFCRTYGGHLASLASSKELSFVQKLCNGNVSSCWIGGRSMNSSTSGFRWSWSDPKTPQWNQSMFPKVPIRTRCGNGNGSSSCRANICIAVTNGSSSIFGERCNASHAFVCAVDSDIKCRNCHKYLVILAVVSGLILFTTFAIILWLLVYKRSKKRRKSRKVSNPASSSSVVPPSWKIFTSEELRSMTKNFSEANRLAGDAKTGGTYSGGLSDGTKVAVKRLKRSSFQRKKEFYSEIRRAAKLYHPNVVAIKGCCYDHGERFIVYEFIASGPLDRWLHHVPRGGRSLDWNMRLNIATTLAQGIAFLHDKVKPQVVHRDIRASNVLLDEEFGAHLMGVGLSKFVPWEVMQERTVMAGGTYGYLAPEYVYRNELTTKSDVYSFGVLLLEIVSGRRPTQAVNSSVGWQSIFEWATPLVQANRWLEILDPVITCGLPEACVVQKVVDLVYSCTQNVPSMRPRMSHVVHQLQQLVQPLEVK

SEQ ID NO: 559 - protein, 119 aa, Arabidopsis thaliana
MHDFCFTIPYGILLIVGGFIGYLKKGSIASLAGGAGTGLLVVLAGFISLKAFEKKKTSLLATLLETVIAAALTFVMGQRFLQTQKIMPAALVAGISALMTCFYVYKIATGGNHIPPKAE

SEQ ID NO: 560 - protein, 415 aa, Arabidopsis thaliana
MGEEKSLLQFRSFPSLKTSDFALTEEPSWRLENNVSSNRRRGNKRSGGVFTNFASLSVAIRRDRRESTFNGRNGGGGGAFASVSVVIPKEEDEFAPTSAQLLKNPIALLSIVPKDAALFFAGAFAGAAAKSVTAPLDRIKLLMQTHGVRAGQQSAKKAIGFIEAITLIGKEEGIKGYWKGNLPQVIRIVPYSAVQLFAYETYKKLFRGKDGQLSVLGRLGAGACAGMTSTLITYPLDVLRLRLAVEPGYRTMSQVALNMLREEGVASFYNGLGPSLLSIAPYIAINFCVFDLVKKSLPEKYQQKTQSSLLTAVVAAAIATGTCYPLDTIRRQMQLKGTPYKSVLDAFSGIIAREGVVGLYRGFVPNALKSMPNSSIKLTTFDIVKKLIAASEKEIQRIADDNRKKASPNTIDEQT

SEQ ID NO: 561 - protein, 445 aa, Arabidopsis thaliana
MIFRRRRMRRNKSQVSQRASVLFPGCGELNYARETGDVTLEATLRKISSSLEDVVEVPDSPEESYISSSRRTGLACISAQENGSDDEITHDEQVATWSAISKETKSLIHLNGVASVASSHLSGFRAKKSSNGLKDHGRPKFSFNSHTHGETSSKISDMAEIFEPDVEDQAIEEDPIIECPNSFDERSENRQGVSVAESREVLHECTKDAVPKLQEIPLDKIRLIKRSSELDSRHEAKSRKFTHKGNSSNFQDSDTDDELPGPMDSGSSSDDEPSYQSSVPNISNQKKQFVGDRFDEAIKASSLSKEGLLFGSPKLSGGSSLYGKLQQIMKQEKETEMEIMRKLQSGIGEADSSGYVDVKVMSRHLEGKLVVCKCSVIDLSGDSLLLKNTQALAAKETETTIIFSPKVCADVDIEIGNFIRVYAPWSVLIPLFRLLSHVTKLFCDI

SEQ ID NO: 562 - protein, 246 aa, Arabidopsis thaliana
MSKKHCSELLPNKMFRNQDSKYLIPVQKEAPPVTTLPMKASTVKSPHNCEAILRDADPPISLSSVNLSEQLRSGVFLKPKKQIKYWVDERNSNCFMLFAKNLSITWSDDVNYWTWFTEKESPNENVEAVGLKNVCWLDITGKFDTRNLTPGIVYEVVFKVKLEDPAYGWDTPVNLKLVLPNGKEKPQEKKVSLRELPRYKWVDVRVGEFVPEKSAAGEITFSMYEHAAGVWKKGLSLKGVAIRPKQ

SEQ ID NO: 563 - protein, 366 aa, Arabidopsis thaliana
MRVMRSLRGNSGAGLVFRPARLNSLRSVFTGCRAVILPRFGGPEVFELRENVPVPNLNPNEVLVKAKAVSVNPLDCRIRAGYGRSVFQPHLPIIVGRDVSGEVAAIGTSVKSLKVGQEVFGALHPTALRGTYTDYGILSEDELTEKPSSISHVEASAIPFAALTAWRALKSNARITEGQRLLVFGGGGAVGFSAIQLAVASGCHVTASCVGQTKDRILAAGAEQAVDYTTEDIELAVKGKFDAVLDTIGGPETERIGINFLRKGGNYMTLQGEAASLTDKYGFVVGLPLATSLLMKKKIQYQYSHGIDYWWTYMRADPEGLAEIQRLVGAGKLKIPVEKTFPITDVVAAHEAKEKKQIPGKVVLEF

SEQ ID NO: 564 - protein, 163 aa, Arabidopsis thaliana
MASKMSLRYSLFLIFFSLISLQGFAKKTGDVSELQIGVKFKPKTCEVQAHKGDTIKVHYRGKLTDGTVFDSSFERGDPFEFKLGSGQVIKGWDQGLLGACVGEKRKLKIPAKLGYGEQGSPPTIPGGATLIFDTELIAVNEKPAGGEEYGGDEDDEGYGNDEL

SEQ ID NO: 565 - protein, 256 aa, Arabidopsis thaliana
MDSGLQQLALCLFFILCRLFQATAEDDWKIATATLSRDRDGSSSVATGGACGYGDLRQSSFAGYSAGLSGKLFNRGSSCGACLEVRCVNHIRWCLQGSPSVVVTATDFCPPNSGLSSDYGGWCNFPKEHLELSHAAFTGIAETRAEMIPIQYRRVKCGRRGGLRFSLSGSSHFFQVLISNVGLDGEVVGVKVKGHTTAWIPMARNWGQNWHSSLDLIGQSLSFEVTLKGGKTIASYDVAPPYWRFGMTYQGKQFHS

SEQ ID NO: 566 - protein, 124 aa, Arabidopsis thaliana
MESLDTNFPVRHRKVSFESKGNKTEIVICSYEDHILIIATQIGAMGTILHARKEEGMSVEPTFSVSVIFGKRDEPMLTATARRLIEHISSIVPSKPLVLSLGLKDHSSETLKEIVATVIENRLW

SEQ ID NO: 567 - protein, 185 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMNYAAIVGQGLGILLAVMTVLFIFRIILTWYPQVELTKWPWKLIALPTEPLLIPLRKLVPPIGGVDLAPILWVFICTFLREILIGQQGLITMASRLQ

SEQ ID NO: 568 - protein, 648 aa, Arabidopsis thaliana
MPQNCIAPRPEEDGGVMVQGLPDMSDTQSKSVLAFPTITSQPGLQMSMYPITLKFEEVVYKVKIEQTSQCMGSWKSKEKTILNGITGMVCPGEFLAMLGPSGSGKTTLLSALGGRLSKTFSGKVMYNGQPFSGCIKRRTGFVAQDDVLYPHLTVWETLFFTALLRLPSSLTRDEKAEHVDRVIAELGLNRCTNSMIGGPLFRGISGGEKKRVSIGQEMLINPSLLLLDEPTSGLDSTTAHRIVTTIKRLASGGRTVVTTIHQPSSRIYHMFDKVVLLSEGSPIYYGAASSAVEYFSSLGFSTSLTVNPADLLLDLANGIPPDTQKETSEQEQKTVKETLVSAYEKNISTKLKAELCNAESHSYEYTKAAAKNLKSEQWCTTWWYQFTVLLQRGVRERRFESFNKLRIFQVISVAFLGGLLWWHTPKSHIQDRTALLFFFSVFWGFYPLYNAVFTFPQEKRMLIKERSSGMYRLSSYFMARNVGDLPLELALPTAFVFIIYWMGGLKPDPTTFILSLLVVLYSVLVAQGLGLAFGALLMNIKQATTLASVTTLVFLIAGGYYVQQIPPFIVWLKYLSYSYYCYKLLLGIQYTDDDYYECSKGVWCRVGDFPAIKSMGLNNLWIDVFVMGVMLVGYRLMAYMALHRVKLR

SEQ ID NO: 569 - protein, 573 aa, Arabidopsis thaliana
MGSFNDTSCSYVDVEIKYVDECEERLRRLFDQALLVFLEEEGSIKPLPAVIGDGKNVDLFKLFVLVREREGFDTVSRKRLWEVVAEKLGFDCSLVPSLILIYLKYLNRMEKWAVEESRIVNWDNKDSEKKGCYSGMLHELGNGFKSLLDNGKCQKRNRAVAFGCNHMEESCSEFDRSRKRFRESDDDDKGVGLSSVVIREETVVCAVEEGLSDFSLEKRDDLPGMLKWLALVATSPHDPAIGVIPHSSKWKQYNGNKCWLQVARAKNSLLVQRDNAELRYRYHPFRGHQNIHHPSMYEDDRKSIGRLRYSIRPPNLSKHCSSSCCNGSSLVSLSKSRSTKCRKLTIIASERAGLTAGTSRARKRNKAEIPRRCIKVGHQHQAQVDEWTESGVDSDSKWLGTRIWPPENSEALDQTLGNDLVGKGRPDSCSCELSGFVECTRLHIAEKRMELKRELGDDFFHWRFNQMGEEVCLRWTEEEEKRFKDMIIADPQSFWTNAAKNFPKKKREELVSYYFNVFLINRRRYQNRVTPKSIDSDDEGAFGSVGGSFGRDAVTSSGSDVMICAQNRQCEDY

SEQ ID NO: 570 - protein, 158 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMGESKRRKQSLGDRYGQDQRVVEWLPLTKKQAEDFYKWTTKGAWIGIGVMAGLWVTVRFIGPTFGWWTVQ

SEQ ID NO: 571 - protein, 578 aa, Bacillus halodurans
MASSMLSSATMVASPAQATMVAPFNGLKSSAAFPATRKANNDITSITSNGGRVNCMQVWPPIGKKKFETLSYLPDLTDSGGRVNCMQAMERDHYRMVINGERVDSDETFETFNPAKGEILATVAKASREHAEKAVQAARHAFDHGKWRKYPVGKRARVLNQIAAIMRERFQELVEIEVLNSGKAISAAQAQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYMEDKSILSYYGPKPINPFGV

SEQ ID NO: 572 - protein, 289 aa, Arabidopsis thaliana
MTKDELTEEESLSGKDYLDPPPVKTFEVRELKKWSFYRAVIAEFIATLLFLYVTVLTVIGFKSQTDINAGGGACASVGLLGISWAFGGMIFILVYCTAGISGGHINPAVTFGLFLASKVSLVRAVSYMVAQCLGATCGVGLVKVFQSTYYNRYGGGANMLSDGYNVGVGVGAEIIGTFVLVYTVFSATDPKRNARDSHIPVLAPLPIGFSVFMVHLATIPITGTGINPARSFGAAVIYNNQKAWDDQWIFWVGPFVGAAIAAFYHQFVLRAGAMKAYGSVRSQLHELHA

SEQ ID NO: 573 - protein, 539 aa, Xenorhabdus nematophila
MSVKGITAQELAVYGICDVSEIVYNPSYELLFSEETQPSLQGYERGTLTHLGAVAVDTGIFTGRSPKDKYIVRDDVTCDTVWWADQGKGKNDNKPLSQETWSQLKGLVTQQLSGKRLFVVDAFCGANADTRLKVRFITEVAWQAHFVKNMFIRPSDEELVNFTPDFIVMNGAKCTNPQWKEQELNSENFVAFNLTERMQLIGGTWYGGEMKKGMFSIMNYLLPLKGIASMHCSANVGGEGDVAIFFGLSGTGKTTLSTDPKRKLIGDDEHGWDDDGVFNFEGGCYAKTINLSKEAEPDIYHAICRDALLENVTVLADGTVDFNDGSKTENTRVSYPIYHIENIVKPVSKAGHATKVIFLTADAFGVLPPVSCLTPEQTQYHFLSGFTAKLAGTERGVTEPTPTFSACFGAAFLSLHPTQYAEVLVKRMQASGAKAYLVNTGWNGTGKRISIKDTRAIIDAILNGDIEDADTIELPIFDLAVPTALPGVDTGILDPRNTYADKSEWDVKAKDLAQRFVDNFDKYTDTAAGAALVKAGPNL

SEQ ID NO: 574 - protein, 441 aa, Arabidopsis thaliana
MGNSEMSASEVAAAKQKNVDDWLPITSSRNAKWWYSAFHNVTAMVGAGVLSLPYAMSNLGWGPGVTIMVMSWIITLYTLWQMVEMHEIVPGKRLDRYHELGQHAFGEKLGLWIVVPQQLIVEVGVDIVYMVTGGASLKKVHQLVCPDCKEIRTTFWIMIFASVHFVISHLPNFNSISIISLAAAVMSLTYSTIAWAASVHKGVHPDVDYSPRASTDVGKVFNFLNALGDVAFAYAGHNVVLEIQATIPSTPEMPSKVPMWRGVIVAYIVVAICYFPVAFLGYYIFGNSVDDNILITLEKPIWLIAMANMFVVIHVIGSYQIFAMPVFDMLETVLVKKMNFNPSFKLRFITRSLYVAFTMIVAICVPFFGGLLGFFGGFAFAPTTYYLPCIMWLVLKKPKRFGLSWTANWFCIIVGVLLTILAPIGGLRTIIINAKTYKFFS

SEQ ID NO: 575 - protein, 515 aa, Bacillus halodurans
MLQPYKHEPFTDFTVEANRKAFEEALGLVEKELGKEYPLIINGERVTTEDKIQSWNPARKDQLVGSVSKANQDLAEKAIQSADEAFQTWRNVNPEERANILVKAAAIIRRRKHEFSAWLVHEAGKPWKEADADTAEAIDFLEYYARQMIELNRGKEILSRPGEQNRYFYTPMGVTVTISPWNFALAIMVGTAVAPIVTGNTVVLKPASTTPVVAAKFVEVLEDAGLPKGVINYVPGSGAEVGDYLVDHPKTSLITFTGSKDVGVRLYERAAVVRPGQNHLKRVIVEMGGKDTVVVDRDADLDLAAESILVSAFGFSGQKCSAGSRAVIHKDVYDEVLEKTVALAKNLTVGDPTNRDNYMGPVIDEKAFEKIMSYIEIGKKEGRLMTGGEGDSSTGFFIQPTIIADLDPEAVIMQEEIFGPVVAFSKANDFDHALEIANNTEYGLTGAVITRNRAHIEQAKREFHVGNLYFNRNCTGAIVGYHPFGGFKMSGTDSKAGGPDYLALHMQAKTVSEMY

SEQ ID NO: 576 - protein, 584 aa, Bacillus halodurans
MRKTKIVCTIGPASESVEKLEQLMEAGMNVARLNFSHGDFEEHGARIKNIREAAKRIGKTVAILLDTKGPEIRTQTLEGGVAELKAGQELVISMKEVVGTSERISVTYPGLVHDVVPGAKILLDDGLIGLEVVEVRDQEILTKVLNSGTLKNKKGVNVPNVSVNLPGITEKDAADIKFGIEQGVDFIAASFVRRAQDVLEIRELLEQHGAEHIKIIPKIENQEGVDNIEEILEVSDGLMVARGDLGVEIPAEEVPLVQKSLIKKCNLVAKPVITATQMLDSMQRNPRPTRAEASDVANAIFDGTDAIMLSGETAAGDYPVEAVQTMSRIAERAEQALNYQEILSKHTKEARTTITSAISQSVGHTAFNLNASAILTATESGHTARVVAKYRPKSPIVAVTSNETVVRQLALVWGVYSILGEEAETTDDMLQVTVETALKSQLVKQGDLVVITAGVPVGETGTTNIMKVHVIGEVVAKGQGIGRDTVNGKVVIAANAEEANAKVEEGSILVTFSTDKDMMPAFEKAAAVITEEGGITSHAAVVGLSLNTPVIVGVQNASALFKDGEEITVDTSRGDIYRGQASVL

SEQ ID NO: 577 - protein, 112 aa, Arabidopsis thaliana
IFSYIFRSFKKNSNILNKKTIDMAFVRSLLGAKKILSRSTGAGSAAPKGFLAVYVGESQKKRYLVPVSYLNQPSFQALLSKSEEEFGFDHPMGGLTIPCPEDTFINVTSRLQ

SEQ ID NO: 578 - protein, 200 aa, Arabidopsis thaliana
MAAAGNKSINAKLVLLGDVGAGKSSLVLRFVKDQFVEFQESTIGAAFFSQTLAVNDATVKFEIWDTAGQERYHSLAPMYYRGAAAAIIVFDVTNQASFERAKKWVQELQAQGNPNMVMALAGNKSDLLDARKVTAEDAQTYAQENGLFFMETSAKTATNVKEIFYEIARRLPRVQPTENPTGMVLPDRAMDRAVSSSCCA

SEQ ID NO: 579 - protein, 508 aa, Arabidopsis thaliana
MSWFLIAVATIAAVVSYKLIQRLRYKFPPGPSPKPIVGNLYDIKPVRFRCYYEWAQSYGPIISVWIGSILNVVVSSAELAKEVLKEHDQKLADRHRNRSTEAFSRNGQDLIWADYGPHYVKVRKVCTLELFTPKRLESLRPIREDEVTAMVESVFRDCNLPENRAKGLQLRKYLGAVAFNNITRLAFGKRFMNAEGVVDEQGLEFKAIVSNGLKLGASLSIAEHIPWLRWMFPADEKAFAEHGARRDRLTRAIMEEHTLARQKSSGAKQHFVDALLTLKDQYDLSEDTIIGLLWDMITAGMDTTAITAEWAMAEMIKNPRVQQKVQEEFDRVVGLDRILTEADFSRLPYLQCVVKESFRLHPPTPLMLPHRSNADVKIGGYDIPKGSNVHVNVWAVARDPAVWKNPFEFRPERFLEEDVDMKGHDFRLLPFGAGRRVCPGAQLGINLVTSMMSHLLHHFVWTPPQGTKPEEIDMSENPGLVTYMRTPVQAVATPRLPSDLYKRVPYDM

SEQ ID NO: 580 - protein, 593 aa, Arabidopsis thaliana
MGCVLGRPGSSGSVSGSRDEVSTRIESNRHQVNNVSVTKTETTESTSAVVVASASNGEEVRNHEDVVDQKKENGFVVTEAKERKSKGERKRSKPPDPRRSNPPKNLLGEQVAAGWPSWLSEVCGEALSGWLPRKADSFEKIDKIGSGTYSNVYKAKDSLTGNIVALKKVRCDVNERESLKFMAREILILRRLDHPNVIKLEGLVTSRMSSSLYLVFRYMDHDLAGLAASPEIKFTEQQVKCYMKQLLSGLEHCHNRGVLHRDIKGSNLLIDDGGVLRIGDFGLATFFDASKRQEMTNRVVTLWYRSPELLHGVVEYSVGVDLWSAGCILAELLAGRAIMPGRNEVEQLHRIYKLCGSPSEEYWKKIRLPSTHKHAHHKPLPQYKRRIREVYKDFSPEALSLLDTLLALDPAERQTATDVLMSDFFTTEPLACQPSDLPKYPPSKEIDAKRRDEEYRRQREARKAQGESGRRMRPRERAPRAMPAPEANAENQSNIDRMRMITHANAKSKSEKFPPPHQDGSLGFQVGSSRRLDPSEIPYSTNSFTSSYSKEPFQTWSGPLAPIGAPDSTTRRRNDINKERRMASKVKGKRIVV

SEQ ID NO: 581 - protein, 489 aa, Arabidopsis thaliana
MGHARTRTGIISVAFKFFRSLFPRHHRTNSMKIKTGTFLGVSISLILINLAAIMERADENLLPSVYKEVSEAFNAGPSDLGYLTFVRNFVQGLASPLAGVLVITYDRPIVLAIGTFCWALSTAAVGASSYFIQVALWRAVNGFGLAIVIPALQSFIADSYKDGARGAGFGMLNLIGTIGGIGGGVVATVMAGSEFWGIPGWRCAFIMMAALSAVIGLLVFLFVVDPRKNIEREELMAHKMNSNSVWNDSLAAAKSVVKVSTFQIIVAQGIIGSFPWTAMVFFTMWFELIGFDHNQTAALLGVFATGGAIGTLMGGIIADKMSRIYPNSGRVMCAQFSAFMGIPFSIILLKVIPQSTSSYSIFSITLFLMGLTITWCGSAVNAPMFAEVVPPRHRTMIYAFDRAFEGSFSSFAAPLVGILSEKLFGYDSRGIDPLKGSSVREADALSKGLLSMMAVPFGLCCLCYTPLHFVFQKDRENAKIASSKETEMI

SEQ ID NO: 582 - protein, 461 aa, Arabidopsis thaliana
MAPAPSPINSQHVAVIGAGAAGLVAARELRREGHTVVVLDREKQVGGLWVYTPETESDELGLDPTRPIVHSSVYKSLRTNLPRECMGYKDFPFVPRGDDPSRDSRRYPSHREVLAYLQDFATEFNIEEMIRFETEVLRVEPVNGKWRVQSKTGGGFSNDEIYDAVVMCCGHFAEPNIAQIPGIESWPGRQTHSHSYRVPDPFKDEVVVVIGNFASGADISRDISKVAKEVHIASRASKSNTFEKRPVPNNNLWMHSEIDTAHEDGTIVFKNGKVVHADTIVHCTGYKYYFPFLETNNYMRVDDNRVEPLYKHIFPPALAPGLSFIGLPAMGLQFYMFEVQSKWVAAVLSGRVTLPSVDEMMDDLKLSYETQEALGIPKRYTHKLGKSQCEYLDWIADLCGFPHVEHWRDQEVTRGYQRLGNQPETFRDEWDDDDLMEEAYEDFARLNLINFHPSRFLESGR

SEQ ID NO: 583 - protein, 462 aa, Arabidopsis thaliana
MAVKKKVSWRSLIVGCLGDPETLMASSKKPKRKNDVIKKQSSFQRLSILDMSNPSSNTLSEDLSISLAGSDLHVFTLAELKVITQSFSSTNFLGEGGFGPVHKGFIDDKLRPGLKAQPVAVKLLDLEGLQGHREWLTEVMFLGQLKHKNLVKLIGYCCEEEHRTLVYEFMPRGSLENQLFRRYSASLPWSTRMKIAHGAATGLQFLHEAENPVIYRDFKASNILLDSDYTAKLSDFGLAKDGPEGDDTHVSTRVMGTQGYAAPEYIMTGHLTARSDVYSFGVVLLELLTGRRSVDKKRSSREQNLVDWARPMLNDPRKLSRIMDPRLEGQYSETGARKAATLAYQCLSHRPKNRPCMSAVVSILNDLKDYNDIPMGTFTYTVPNTPDNKEDDGRVGNKPRKSSHHHHHQQQQSNHPRSSPSPTTKSPSPTAKSPRNSTENHRRTLRNGVNSPLRSEAGGERY

SEQ ID NO: 584 - protein, 315 aa, Zea mays
MVTLCHPIRIRASGSTASWRRRNAAAAAKVLCSVQQMPPPPPAATAAQSTIKVVIVGATKEIGRTAVVAVSKARGMELAGAIDSQCIGEDAGQISGMDEPLEIPVLNDLTMVLGSIAQSRATGVVVDFSEPSAVYDNVKQAAAFGLSSVVYVPKIELETVTELSAFCEKASVGCLVAPTLSIGSVLLQQAAIQASFHYSNVEIVESRPNPSDLPSQDAIQIANNISDLGQIYNREDMDSSSPARGQLLGEDGVRVHSMVLPGLVSSTSINFSGPGEMYTLRHDVANVQCLMPGLILAIRKVVRFKNLIYGLEKFL

SEQ ID NO: 585 - protein, 312 aa, Desulfitobacterium hafniense
MASSMLSSATMVASPAQATMVAPFNGLKSSAAFPATRKANNDITSITSNGGRVNCMQVWPPIGKKKFETLSYLPDLTDSGGRVNCMQAMVKIAPSILSADFAHLGDQVALVEKAGAEVLHIDVMDGHFVPNITIGPLVVKALRPYSQMRFDVHLMIEHPERFIEEFAKAGADHITVHLEATPHIHRAIQQIKGLGLTAGVSINPATPLDGIKYILDELDMVLIMSVNPGFGGQKFIPAVLPKIEVLHRHLDQMQSSCEIEVDGGINLDTAPAVVKAGANILVAGAAVFACADPARAVQELREAAQGYKGDPK

SEQ ID NO: 586 - protein, 261 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMARTQRNDNFIDKSFTVMADIILKILPTNQKAKEAFVYYRDGMSAQADGEYAEALDNYEEALRLEENPNDRSYILYNMALIHASNGDHEKALGLYQEAIELNPKMPSALNNIAVIYHFQGEKAKEAGQEDDAENLFDKAAEYWKQAIRLAPNNYIEAQNWLKITGRSEMDVFF

SEQ ID NO: 587 - protein, 355 aa, Arabidopsis thaliana
MESMVKKLKQNLRTGSWKKKEKSMKKERWFLENGSIFLKELIVDCNGKSIPIRSFTSSQIRKATKNFDLSCFVAEEGFYIWYKGVIEDRSYMIKRFSEYKVTDYRVSEVYKDIVLSARMSNHNNFLKLLGCCLEFPFPVLVFEFAEHGVLNYRGGITVNGEESLLPLSLRLKIGKEIANALAYLHMAFPKIIIYRDVKPLHVFLDNNWTAKLSDLSFSISLEEGKSQIEAEDVLGTYGYLDPLYFATRIVTEYTDVYSFGVFLMVVITGISVYFTGSDGYPVGILGYMKGLAENGKLNEIVYPMIMKEMTSAQRLQVEACVLLALRCCEERVEDRPKMIQVAKELKRIEHHVLRS

SEQ ID NO: 588 - protein, 609 aa, Arabidopsis thaliana
MATVHAALHAADASSSGSSSPVTASLYVGDLHPSVTEGILYDAFAEFKSLTSVRLCKDASSGRSLCYGYANFLSRQDANLAIEKKNNSLLNGKMIRVMWSVRAPDARRNGVGNVFVKNLPESVTNAVLQDMFKKFGNIVSCKVATLEDGKSRGYGFVQFEQEDAAHAAIQTLNSTIVADKEIYVGKFMKKTDRVKPEEKYTNLYMKNLDADVSEDLLREKFAEFGKIVSLAIAKDENRLCRGYAFVNFDNPEDARRAAETVNGTKFGSKCLYVGRAQKKAEREQLLREQFKEKHEEQKMIAKVSNIYVKNVNVAVTEEELRKHFSQCGTITSTKLMCDEKGKSKGFGFVCFSTPEEAIDAVKTFHGQMFHGKPLYVAIAQKKEDRKMQLQVQFGNRVEARKSSSSASVNPGTYAPLYYTNTHPGMVYQSYPLMWKSANMIGSSYPNSEAVTYPPMVANAPSKNRQNRIGKLDRNAVSYVPNVYQSTQMLPLSRDFSKQQHSRTYGRGKEMKKSIQQRQSETVGMEMQLLGELLHPLVEKLEPQLANKITGMLLEMDKSELLLLLKSPEDLAVRVDEAFEVLKSSKTNLTAPNTHRSDYLASGIAGVSIK

SEQ ID NO: 589 - protein, 513 aa, Arabidopsis thaliana
MAMMRTSPRDSISNLPDEILGKILSLLPTKVAASTSVLSKRWRNLLGLVDNLCFDESMVVYPNEEEETSGSLRFCDFVDKTFALLSNSHIKKFSLSRVYKYNDDVDGMVRRWIRTVMERGLLEIHLHATPMSFVAIETKLLTSNTLVKLTLSARCFVEVERVFFPALKSLSLFSILGDYTNYIRLIDGCPVLEELYMRDGDYPFLRLTCGTNVESASLKRLVIFTHNPNEMIWHELIYFEAPSLVYLDYSSYVSAKYDVVDFDLLVEARLSLRLWVSTNDYDYSDDDDDDDDDDDDDDDDDDDDDDDDDDDDDDDDDDDDDDDDDGDYYIVEPKAPIFGDVTELLAAIRNITTLHLSPDSLEVFHFCCKSMPVFNNLLNLSIESNKDKGWQVMPLLLKSCPNLHTLVIKGLVHRVTSRCGDACACIPKKQRKIVQKEEALCCLRTCQVKVLQISEYGGYFQELKQMRHFLGKLECLETVKVGVHAENNNNSEFLRANVLTLPRVSAKCNVHFI

SEQ ID NO: 590 - protein, 275 aa, Arabidopsis thaliana
MDLLKTPSSTVGLSETFARLKSQGKVALIPYITAGDPDLSTTAKALKVLDSCGSDIIELGVPYSDPLADGPAIQAAARRSLLKGTNFNSIISMLKEVIPQLSCPIALFTYYNPILRRGVENYMTVIKNAGVHGLLVPDVPLEETETLRNEARKHQIELVLLTTPTTPKERMNAIVEASEGFIYLVSSVGVTGTRESVNEKVQSLLQQIKEATSKPVAVGFGISKPEHVKQVAEWGADGVIVGSAMVKILGESESPEQGLKELEFFTKSLKSALVS

SEQ ID NO: 591 - protein, 374 aa, Arabidopsis thaliana
MALRTVLVSDVPSLPDSVYGLSEGLELSKPTSFRLPGFSVIGHRGIGMNVLQSSDRRARGVKENSILSFNSAAKYPIDFIEFDVQVTKDDCPVIFHDDFIYSEENGIVNESRVTDLSLSEFLLYGPQKETEKIGKTLMRKSKEGKVLKWDVDLDDSLCTLQEAFEQVEQTLGFNIELKFDDQTVYEREFLVHILRSVLQVVSNYAKDRPVIFSSFQPDAAKLVRELQSTYPVFFLTDAGNEIHNDERRNSLEEAIQVCLEGGLQGIVSEVKGVFRNPAAISKIKESNLSLLTYGKLNNVGEAVYMQYVMGIDGVIVDFVEEIIESTTRMMIRPPPSSSPLPSPSKDDDVAITRPEFSQKEISFLLKLLSQLIQH

SEQ ID NO: 592 - protein, 472 aa, Zea mays
GNPRRRRPPPLLIPAPPRDREGVRRGADRGHGHGNTGARLMDRIVGGKFKLGRKIGCGSFGEIYLATHVDTYEIVAVKIESSKTKHPQLFYEAKLYNTLQGGSGIANVKWCGVDGEENVLVIDLLGPSLEDLFCYCGRKFTLKTVLMLADQMITRIEFMHSKGYLHRDIKPDNFLMGLGRKANQVYIIDFGLAKRYRDSTTNRHIPYRENKSLTGTARYASCNTHLGIEQSRRDDLVSLGYVLLYFLRGSLPWQGLKAATKAQKYDKICEKKISTPIEVLCKSCPVQFSSYFHYCHSLAFDQRPDYAFVKRLFRDLFISQDYEFDYVFDWTVLKYKQGHKQKQSPGAPIARPIQAHGPKQAGVNGVINHNEAQEHVETSRPTGQAAWSQDKQATNNDRNPDVRHTVNLRQDMAAGKAQLTTSVALPSSQWKNYSDSRHKGQFDAVHHNQGIVNITSSSNSWLPTFQHNAPGK

SEQ ID NO: 593 - protein, 456 aa, Saccharomyces cerevisiae
NFKMAKRRQKKRTHAQLTPEQEQGIPKSMVIRVGQTSLANHSLNQLVKDFRQIMQPHTAIKLKERKSNKLKDFVVMCGPLGVTHLFMFTQSEKTGNVSLKIARTPQGPTVTFQVLDYSLGRDIKKFLKRPKSLNNDDVLNPPLLVLNGFSTSKRSGEDDQDVNVEKVIVSMFQNIFPPLNPARTSLNSIKRVFMINKDRETGEISMRHYFIDIREVEISRNLKRLYKAKNNLSKTVPNLHRKEDISSLILDHDLGAYTSESEIEDDAIVRVVDNQDVKAKHSQSLKSQRTPVEKKDNKEREKETEEEDVEMEEPKPSENLQPTPRKKAIKLTELGPRLTLKLVKIEEGICSGKVLHHEFVQKSSEEIKALEKRHAAKMRLKEQRKKEQEENIAKKKAVKDAKKQRKLERRKARAAEGGEGQGKDDAMSDDESSSSDSEHYGSVPEDLDSDLFSEVE

SEQ ID NO: 594 - protein, 345 aa, Zea mays
MAVERDIFGISGPTYLKSIDWNCEHNRRSVAASLVQAVYVLERDRQLNHQSFEALAPAWWEFLHFELIRKLIDDADMSIFGAIFEFNPPREEASGANAPRFVIAFRGTITEKDTISRDLSLDLHLVQNGLHRTSRFNIAMQAVQNVASVFPGSTIWLAGHSLGAGLAILTGRNMVKKGVLLESFLFNPPFVAAPVERIRDERVKHGFRIARSVITAGLTIAMKAKTEGSSQRSVADESFSILSSWTPYLFVNPGDHICSEYIGYFQHRKNMEDLGAGFIEKLATQNSIGDLFFKALGWESEPLHLLPSADLIVNVSPSSDFKYAHGISQWWQPELNLQCSKYRYS

SEQ ID NO: 595 - protein, 465 aa, Arabidopsis thaliana
MGCCYSLSSTVDPVQDHTTDASSEPRNGGGEDPPLTKFSFSALKTATNHFSPENIVSDQTSDVVFKGRLQNGGFVAIKRFNNMAWSDPKLFLEEAQRVGKLRHKRLVNLIGYCCDGDKRFLVADFMANDTLAKRLFQRKYQTMDWSIRLRVAYFVAEALDYCNTAGFASYNNLSAYKVLFDEDGDACLSCFGLMKEINNDQITTGSVNPENVIYRFGTVLVNLLSGKQIPPSHAPEMIHRKNVFKLMDPYLKGKFSIDEANVVYKLASQCLKYEGQESPNTKEIVATLETLQTRTEAPSYEVVEMTNQEKDASSSSNLSPLGEACLRMDLASIHSILVLAGYDDDKDIIELSFEEWIQEVKELQDVRRNGDRAFVEQDFKTAIACYSQFVEERSLVYPSVYARRSLSYLFCDEPEKALLDGMHAQGVFPDWPTAFYLQSVALAKLDMNTDSADTLKEAALLEVKK

SEQ ID NO: 596 - protein, 394 aa, Arabidopsis thaliana
MVDVDRRMTGLTPAHAAGLRRLSARAAAPSTPTIRNSLQSFSPFADKVINHLKNSGIKIQPGLSDTEFARVEAEFGFTFPPDLRVILSAGLSVGAGFPDWRSPGARLHLRAMIDLPVAAVSFQIAKNSLWCKSWGLKPPDPEKALRVARNALKRAPLLIPIFDHCYIPCNPSLAGNPVFFIDETRIFCCGSDLSEFFERESAFRSSEFFPRILTKQRSVSEKSAGSSSNFSRRSLDLGRANGAGKSRWVEFWSDAAVDRCRRNSASTSSSSSSSPDLPKTETPKWVNQYVNRIGSVLRRGGWSESDIDEIIHVSASGFFEGEMVIIDNQTVLDVLLLKAGRISESLRKSGWSSEEVSDALGFDFRPEKERKPVKKLSPMLVEQFEKLAEWVSQS

SEQ ID NO: 597 - protein, 610 aa, Arabidopsis thaliana
MLRSLLLRRSVGHSLGTLSPSSSTIRSSFSPHRTLCTTGQTLTPPPPPPPRPPPPPPATASEAQFRKYAGYAALAIFSGVATYFSFPFPENAKHKKAQIFRYAPLPEDLHTVSNWSGTHEVQTRNFNQPENLADLEALVKESHEKKLRIRPVGSGLSPNGIGLSRSGMVNLALMDKVLEVDKEKKRVTVQAGIRVQQLVDAIKDYGLTLQNFASIREQQIGGIIQVGAHGTGARLPPIDEQVISMKLVTPAKGTIELSREKDPELFHLARCGLGGLGVVAEVTLQCVARHELVEHTYVSNLQEIKKNHKKLLSANKHVKYLYIPYTDTVVVVTCNPVSKWSGPPKDKPKYTTDEAVQHVRDLYRESIVKYRVQDSGKKSPDSSEPDIQELSFTELRDKLLALDPLNDVHVAKVNQAEAEFWKKSEGYRVGWSDEILGFDCGGQQWVSESCFPAGTLANPSMKDLEYIEELKKLIEKEAIPAPAPIEQRWTARSKSPISPAFSTSEDDIFSWVGIIMYLPTADPRQRKDITDEFFHYRHLTQKQLWDQFSAYEHWAKIEIPKDKEELEALQARIRKRFPVDAYNKARRELDPNRILSNNMVEKLFPVSTTA

SEQ ID NO: 598 - protein, 304 aa, Arabidopsis thaliana
MNGGGSSSLRSALSYCVQQVRNYDYHHYLCLLELPTEMRKAAFALRAFNVETARAMDVASDPKIGLMRLLWWQEAIDKLYTKKPINHPAAQALSWAISEHNISKPWLKRSVDARIRDAQREVDDIPESIAELEKYAEDTVSTLLYNTLQAGGISSTTADHAASHIGKASGLVLLLKSLPYHCTRNRHQSYIPADLAEKHGLLVKQGGRLEILLDNDSREGLSNVVFEIASVANAHLLKARELAGKVPAEAKPVLLHSVPVQVLLDSLNKVQFDVFDPRIQRGVLGVPPLLFQFKLKWYSWRAMF

SEQ ID NO: 599 - protein, 671 aa, Zea mays
MSAGSTASLLAAVICLALAVLAPVVPGDGATLESVPDLVKAMYLNVESFPCVRLLNLSGEIGCSNPGSEKVIAPIVRLRKGSDQLVQPSTILLSLDQMSDFFLRVSNDPELHQKVAGVLVESNGVNNDLQELSPDRKFPQDDFAPYSNHSHDWNPAGSGIMWNKYNFPVFLLSEESTNTLQKISEKNEKTGNGYKANVAEFDLVMQTTKAQTHDSASCLKEQSCLPLGGHSVWTSLPPLNNGSTEHPKPLILAIASQDSASFFRDRSLGSDSPISGLIALLTAVDALSHIHGLSKLKKQLVFAVFNGEAWGYLGSRKFLQELDEGAASVNGISSLKIDQVLEIGSVGKAILEEYPSFYVHAEGNPSASKEILDALQSASKSLGSDNVKVKQAASSNPGVPPSSLMSFIRKNMSTSGVVLEDFDSHFSNRFYHSYLDNSVNINSSSIAAAAALVARSMYILASDDSVVDLITLNTIKVNVSLVEELIGCLLTCNPGLSCGLVKRFISPSNPCPSHYVGVFLDDPSGTQLPSYADDTSRFVWNFLADRTNSAGNKSSCTGKCGDEGEVCVGAEVEGGGRCVVSTTRYVPAYSTRVKFEDNAWHVLPANSSDPMGAADPVWTESFWNTIGLRVYAVQDPAYDWLILLAGLGITAASYCAVHFGRAYISKVAKLD

SEQ ID NO: 600 - protein, 527 aa, Zea mays
MSPLALLQALIFILCCSPLASASSSELTLAGAACGDDQLVIFDASDGLLNLSVNGVLMQDRVFACQKLGFYFGSGCLRCSNLSDAWRSAVKQYCGEGSEKSHATLHQDVPRKLLRWSTENSSRNACERSGLNENNQDIGDSSEKQEHLLAVPGVILLCCGLMLPCFHAERKEVSRHDNATIQRNALESVSSYEGSMSSEKVPPTPHRIPPSPSRFAPSPQIARVGSVNLSIQQILRATQNFSPSFKLGEGGFGMVYRAVLPDGNVVAVKRAKKDQFAGPRDEFSNEVDLLAKIDHRNLVRLLGFTDKGNERIIITEYVPNGTLREHLDGQHGRVLDFNQRLEIAIDVAHALTYLHLYAEKTIIHRDVKSSNILLTDSYRAKVSDFGFARSGPSDTEKTHISTKVKGTAGYLDPEYLRTYQLTPKSDVFSFGILLVEILSARRPVELKRTPEERITIRWTFKKFNEGNTREILDPLLEDHVDDEVLEKLLSLAFQCAAPTRDDRPTMKEVGEQLWEIRKEYGKSVRKV

SEQ ID NO: 601 - protein, 136 aa, Arabidopsis thaliana
MDITVRISGLKSSNLIRITPRFSSSSRFRCSNNEPPRKGNESNAGGGGDKASTDWDKAWKNFKKQSKKSLFSQFNVDKYVTWNPPRSEFDLSEEVDPIKRTERSNLMLWTSPRFTLVGAIVIVSFLLLYTILAPVK

SEQ ID NO: 602 - protein, 557 aa, Arabidopsis thaliana
MEPKENGSELGQKIIDGPTNPMVTPLLNDLYQFTMAYAYWKAGKHNERSVFDLYFRKNPFGGEYTVFAGLEECVKFLANFKLTDEEIDFVQECLPGSEEAFCDYLRGLDCSDVEVYAIPEGSVVFPKVPLMRVEGPVGVVQLLETPFLNLVNFASLVATNAARHRFVAGKSKSLLEFGARRAQGPDGAISASKYCYLGGFDATSNVAAGKLFGIPLRGTHSHAYVSSFMSTDEIVDKVLRSADGKTTCEDFVSHVQTWLKKIQYSPSLSGIFSETNQSELAAFTSYALAFPKTFLALVDTYDVMKSGIPNFCAVALALNDFGYKALGIRLDSGDLAYLSREARNFFCTVERELKVPGFGKMVVTASNDLNEETIDALNKQGHEVDAFGIGTYLVTCYSQAALGCVFKLVEINNQPRIKLSEDVTKVSIPCKKRSYRLYGKEGYPLVDIMTGENEPPPKVGERLLCRHPFNESKRAYVVPQRVEELLKCYWRGSADEAREVLPPLKEIRDRCIKQLENMRPDHMRRLNPTPYKVSVSAKLYDFIHFLWLNEAPVGELQ

SEQ ID NO: 603 - protein, 217 aa, Arabidopsis thaliana
MSSSLEQEIFLQWGNKKRLRCLRAKAKKISRSKNSSRFLGQDTVLLQSSRFSRGSEGAILRSGLPDRRRPSPEKEERYYTTRGVVDNIGKDCLDGNINGEDSNNKEESMWPKLFITLSNKEKEEDFMAMKGCKPSHRPKKRAKLIQRSLLKSVLKILQLSVYSFENNVLSDFKQLVSPGTWLADLCPDRYDVRVKKSSKKRRARGLKAMGNMETDSD

SEQ ID NO: 604 - protein, 473 aa, Arabidopsis thaliana
MSKEEFMKIQTCVLKVNIHCDGCKQKVKKILQKIEGVFTTKIDSEQGKVTVSGSVDPSVLIKKLAKSGKHAEIWGAPKGNNNPNQSQMANQFKGMQIDHGKAGGGGGGNNNNNKKGQKNGGGGGGGGGGGNSNAPKMGQQLNPQHLQQLQQLQKMKGFQDLKLPPQLKGSVPVNKNQNQKGVKFDVPEDDDDDDFSDEFDDEFTDDDDDEFDDEFDDLPLPSNKMKPNMTMMPNAQQMMMNAQKNANLAGGPAKNGGKGAPAAGGGGAGGGKGAGGGAKGGPGNQNQGGGKNGGGGHPQDGKNGGGGGGPNAGKKGNGGGGPMAGGVSGGFRPMGGGGPQNMSMPMGGQMGMGGPMGNMPAVQGLPATGPGGAPQGYFQGAGIDPMQMQQQQQQQQYLAAVMNQQRAMGNERFQPMMYARPPPAVNYMPPNPHQYPNPHPYPYPYPYPYPPPYGNDQYSHAFSDENTSSCDIM

SEQ ID NO: 605 - protein, 372 aa, Arabidopsis thaliana
MENGEAKQSVPLLTPYKMGRFNLSHRVVLAPLTRQRSYGNVPQPHAAIYYSQRTTPGGFLITEATGVSDTAQGYQDTPGIWTKEHVEAWKPIVDAVHAKGGIFFCQIWHVGRVSNSGFQPNGKAPISCSDKPLMPQIRSNGIDEALFTPPRRLGIEEIPGIVNDFRLAARNAMEAGFDGVEIHGANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 606 - protein, 526 aa, Arabidopsis thaliana
MGHGGEGMSLEFTPTWVVAGVCTVIVAISLAVERLLHYFGTVLKKKKQKPLYEALQKVKEELMLLGFISLLLTVFQGLISKFCVKENVLMHMLPCSLDSRREAGASEHKNVTAKEHFQTFLPIVGTTRRLLAEHAAVQVGYCSEKGKVPLLSLEALHHLHIFIFVLAISHVTFCVLTVIFGSTRIHQWKKWEDSIADEKFDPETALRKRRVTHVHNHAFIKEHFLGIGKDSVILGWTQSFLKQFYDSVTKSDYVTLRLGFIMTHCKGNPKLNFHKYMMRALEDDFKQVVGISWYLWIFVVIFLLLNVNGWHTYFWIAFIPFALLLAVGTKLEHVIAQLAHEVAEKHVAIEGDLVVKPSDEHFWFSKPQIVLYLIHFILFQNAFEIAFFFWIWVTYGFDSCIMGQVRYIVPRLVIGVFIQVLCSYSTLPLYAIVSQMGSSFKKAIFEENVQVGLVGWAQKVKQKRDLKAAASNGDEGSSQAGPGPDSGSGSAPAAGPGAGFAGIQLSRVTRNNAGDTNNEITPDHNN

SEQ ID NO: 607 - protein, 525 aa, Glycine max
MKFYISTKGIKRVTISNGEGKGSAKTTAVAAGAGRRISARTVFPVMVVLGIVLPFLFVRIAILMLESAAACSSLECAGWRFFSGVDTSLELRDELTRALIEANDGNVNEGAGSFNELVKEMTSKQDLKAFAFKTKAMLSQLERKVQLARQQESVYWHLASHGIPKSLHCLCLKLAEEYSVNAMARSRLPPPEFVSRLVDPTFHHLVLLTDNVLAASVVVTSTIESSINPEKLVFHIVTDKKTYAPMHAWFATNSIKSVVEVRGLHQYDWSEEVNAGVKEMLATNHLIWKQYYNKEKDLDYTQENSRYLEALRPSSLSLMNQLRIYLPELFPDLKKIVFLDDDVVVQHDISFLWELDLNGKVIGSVFKSWCGDGCCPGSKYINYLNFSHPLVASNFDGDQCAWLYGMNIIDLETWRRTNITETYHQWLKLNLKSGMTMWNPGVLPPALMTFEGQVHPISSSMLVTDLGYRHQSAEISKEKLEAAAVIHFSGPAKPWLEIGFPEVRSLWSRYVNISNKFIGRCRITG

SEQ ID NO: 608 - protein, 661 aa, Glycine max
MEGENASKVIELVNEIASISEYRPPVKKQYCNLARRLKLLIPMFEEIRDMNKDALPEDTSNAVLAFKEALQSARELLRFGSEGSKLYLVLERDDIMNKFYEVTAQLEQSLGGISHDKLDISDEVKEQVELVLAQFRRAKGRVDEPDVRLYEDMLSVYNSSSDAATDPSVLSQLAEKLQLMGIADLTQESLALHEMVASSGGDPGARIEKMSMLLKKIKDFVQIENLVKDDNLGGKGIFSKVYGLGTNEKSHQAPVIPDDFRCPISLELMKDPVIVSTGQTYERTCIEKWLQAGHGTCPKTQQTLTSTVLTPNYVLRSLIAQWCEANGIEPPKRPSDSQPSKSASAYSPAEQSKIESLLQKLTSVSPEDQRSAAGEIRLLAKRNADNRVAIAEAGAIPLLVGLLSVPDSRTQEHAVTALLNLSIYENNKGSIVSSGAVPGIVHVLKKGSMEARENAAATLFSLSVIDENKVTIGSLGAIPPLVTLLSEGNQRGKKDAATALFNLCIYQGNKGKAVRAGVIPTLMRLLTEPSGGMVDEALAILAILASHPEGKATIRASEAVPVLVEFIGNGSPRNKENAAAVLVHLCSGDQQYLAQAQELGVMGPLLELAQNGTDRGKRKAGQLLERMSRLVEQQQEVPIQTETQAQNEDTQPPLITNPDDS

SEQ ID NO: 609 - protein, 501 aa, Arabidopsis thaliana
MSCSATDLAVLLGPNATAAANYICGQLGDVNNKFIDTAFAIDNTYLLFSAYLVFSMQLGFAMLCAGSVRAKNTMNIMLTNVLDAAAGGLFYYLFGYAFAFGSPSNGFIGKHYFGLKDIPTASADYSNFLYQWAFAIAAAGITSGSIAERTQFVAYLIYSSFLTGFVYPVVSHWFWSVDGWASPFRTDGDLLFSTGAIDFAGSGVVHMVGGIAGLWGALIEGPRLGRFDNGGRAIALRGHSASLVVLGTFLLWFGWYGFNPGSFNKILVTYETGTYNGQWSAVGRTAVTTTLAGCTAALTTLFGKRLLSGHWNVTDVCNGLLGGFAAITGGCSVVEPWAAIICGFVAALVLLGCNKLAEKLKYDDPLEAAQLHGGCGAWGLIFTALFAQEKYLNQIYGNKPGRPHGLFMGGGGKLLGAQLIQIIVITGWVSATMGTLFFILKKMKLLRISSEDEMAGMDMTRHGGFAYMYFDDDESHKAIQLRRVEPRSPSPSGANTTPTPV

SEQ ID NO: 610 - protein, 259 aa, Arabidopsis thaliana
MAASANPSGNNQEGSSATQKVSSSSAAAANGAAVNSVDNGGNTGAAADNSQTIGALRHNPGISTDWTLEEQSLLEDLLVKYATEPSVFRYAKIAMKMKDKTVRDVALRCRWMTKKENGKRRKEDHSSRKSKDKKQEKATDSSAKSSSHLNVHPNGPSYAPPMMPIDTDDGISYKAIGGVSGDLLEQNAQMFNQLSTNFSAFQLHENVNILCKARDNILAILNDLNDMPEVMKQMPPLPVKLNEELANSILPRPSHQRKS

SEQ ID NO: 611 - protein, 218 aa, Arabidopsis thaliana
MSSINITNVTVLDNPAPFVNPFQFEISYECLTSLKDDLEWKLIYVGSAEDETYDQVLESVLVGPVNVGNYRFVLQADSPDPLKIREEDIIGVTVLLLTCSYMDQEFIRVGYYVNNDYDDEQLREEPPTKVLIDKVQRNILTDKPRVTKFPINFHPENEQTLGDGPAPTEPFADSVVNGEAPVFLEQPQKLQEIEQFDDSDVNGEAIALLDQPQNLQET

SEQ ID NO: 612 - protein, 644 aa, Arabidopsis thaliana
MNPSTPSLLYTSIFFYFTIIATQTLSLDPKFKACEPKSCGKGPQISYPFYLSGKQESFCGYPSFELTCDDEEKLPVLGISGEEYVIKNISYLTQSFQVVNSKASHDPCPRPLNNLTLHRTPFFVNPSHINFTILYNCSDHLLEDFRTYPLTCARNTSLLRSFGVFDRKKLGKEKQIASMSCQKLVDVPVLASNESDVMGMTYVEILKRGFVLNWTANSCFRCITSGGRCGTDQQEFVCLCPDGPKLHDTCTNGKNDKRRRVIVKVLIGLIAASIFWYVYHRRKTKSYRNSSALLPRNISSDPSAKSFDIEKAEELLVGVHIFSYEELEEATNNFDPSKELGDGGFGTVYYGKLKDGRSVAVKRLYDNNFKRAEQFRNEVEILTGLRHPNLVALFGCSSKQSRDLLLVYEYVANGTLADHLHGPQANPSSLPWSIRLKIAVETASALKYLHASKIIHRDVKSNNILLDQNFNVKVADFGLSRLFPMDKTHVSTAPQGTPGYVDPDYHLCYQLSNKSDVYSFAVVLMELISSLPAVDITRPRQEINLSNMAVVKIQNHELRDMVDPSLGFDTDTRVRQTVIAVAELAFQCLQSDKDLRPCMSHVQDTLTRIQNNGFGSEMDVVDVNKSGPLVAQSPDSVIVKWDSK

SEQ ID NO: 613 - protein, 335 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMRSYSQLDLDISLCTKYRLLCNAGDSLISLLPHPMTATVTAQEAFRAAYENRYTWDENFPGYRAHLTVTQGDERYEGEVEVKADYTVTVTGFSDETVQESVYNQMRDIVTHRKQGNFEKSHGKNEFSFGETDASGAIAIDVKGDAMGSNYKIRGTEICQVSRVMGPVAFTINTEESLDTGSGYIAIKYNAIFKDPKTDTLKGKRDFTETYGELGGYYLPTQQTVEAIAAGGEKIFTDFSFTNLELLA

SEQ ID NO: 614 - protein, 692 aa, Arabidopsis thaliana [sequence omitted]

SEQ ID NO: 615 - protein, 358 aa, Arabidopsis thaliana
  misc_feature (334)..(334): Xaa can be any naturally occurring amino acid
MLSLSCSSSSSSLLPPSLHYHGSSSVQSIVVPRRSLISFRRKVSCCCIAPPQNLDNDATKFDSLTKSGGGMCKERGLENDSDVLIECRDVYKSFGEKHILKGVSFKIRHGEAVGVIGPSGTGKSTILKIMAGLLAPDKGEVYIRGKKRAGLISDEEISGLRIGLVFQSAALFDSLSVRENVGFLLYERSKMSENQISELVTQTLAAVGLKGVENRLPSELSGGMKKRVALARSLIFDTTKEVIEPEVLLYDEPTAGLDPIASTVVEDLIRSVHMTDEDAVGKPGKIASYLVVTHQHSTIQRAVDRLLFLYEGKIVWQGMTHEFTTSTNPIVQQXLQAASMDQSDTRGGKPSLKRDTNR

SEQ ID NO: 616 - protein, 217 aa, Arabidopsis thaliana
MGAYRADDDYDYLFKLVLIGDSGVGKSNLLSRFTRNEFSIESKSTIGVEFATRSVHVDEKIIKAQLWDTAGQERYRAITSAYYRGAVGALLVYDITRHITFENVERWLKELRDHTDANVVIMLVGNKADLRHLRAVPTEEARSFSERENMFFMETSALDATNVEQAFTHVLTQIYRVMSRKALDGTGDPMSLPKGQTIDIGNKDDVTAVKSSGCCSG

SEQ ID NO: 617 - protein, 568 aa, Arabidopsis thaliana
MFGRSAIRGGGFRAENLGQNALTLIGNIGFSLFVFGVLIFTIIAATYEPEDPLFHPSDKITTFLTSTSNATLRSDDSVVKTGEDFMLANQTAFAEFININDVEASTNETTTEEEGNKLECDVNTPIDCKDQQVFHLMMRATIDKFKDIHFYKFGKPVTGEEGVNSCDMAWRYRPRDGKSAAFYKDYRRFVVAKSENCSVSVVGIGEYHSGLNARKRKKNQKAGFEKTGGKKDDFSLPVVGELVNDSLPMVESDSVFKTGKYLVYVGGGDRCKSMNHFLWSFLCALGEAQYLNRTLVMDLTLCLSSIYTSSGQNEEGKDFRFYFDFEHLKEAASVLDEAQFWAQWGKLRKKRRNRLNLHLVEDFRVTPMKLAAVKDTLIMRKFGSVEPDNYWYRVCEGDAESVVKRPWHLLWKSRRLMEIVSAIASRLNWDYDAVHIERGEKARNKEVWPNLEADTSPSALLSTLQDKVEEGRHLYIATNEGELSFFNPLKDKYATHFLYDYKDLWDESSEWYSETTKLNGGNPVEFDGYMRASVDTEVFLRGKKQIETFNDLTNDCKDGVGTCNAATS

SEQ ID NO: 618 - protein, 410 aa, Arabidopsis thaliana
MNCLFLFKSKKPRKQQKDNNKNKRKGKELLQNSAPELTNRSETSSFNLQTPRSLPSPRSIKDLYTEREQNLRVFSYEELSKATYVFSRKLVIGEGGFGIVYKGKILSNGDSSDPPLVVAIKKLNRQGLQGHKQWLAEVQFLGVVNHPNVVKLIGYCSEDGETGIERLLVYEYMSNRSLEDHLFPRRSHTLPWKKRLEIMLGAAEGLTYLHDLKVIYRDFKSSNVLLDDQFCPKLSDFGLAREGPDGDNTHVTTARVGTHGYAAPEYVQTGHLRLKSDVYSFGVVLYEIITGRRTIERNKPVAERRLLDWVKEYPADSQRFSMIVDPRLRNNYPAAGARSLAKLADLCLKKNDKERPTMEIVVERLKKIIEESDSEDYPMATTTTKESSQVRRRQVAKPEKQSLRGVSVRG

SEQ ID NO: 619 - protein, 680 aa, Zea mays
MCGIFAYLNYNVSRERRYILEVLFNGLRRLEYRGYDSAGIALDADRQVPSPAPASSSDARPYAGAPPLVFRQEGKIENLVRSVYSEVDEKDVNLDAAFSVHAGIAHTRWATHGVPAPRNSHPQSSGAGDEFLVVHNGIITNYEVLKETLTRHGFTFESDTDTEVIPKLAKFVFDKSHDEQGDVTFSQVVMEVMRQLEGAYALIFKSPHYPNELIACKRGSQLILGVNELSGQQNGKSFHDVKTLTTNGKPKELFFSSDLCAIVEHTKNYLALEDNEIVHIKDGSVSILKFDPHKEKPASVQRALSVLEMEVEQIKKGSYDHFMQKEIHEQPHSLKTTMRGRLKDGGVVLGGLKEYLKTIRRCRRVVFIGCGTSYNAALAARPFVEELTGIPVTMEVASDLLDRQGPIYREDTAVFVSQSGETADTLLALDYALENGALCVGITNTVGSTLSRKTHCGVHINAGCEIGVASTKAYTSQIVAMAMMALAIGSDQISTQARRDSIISGLNNLSSNVSEVLKLDAGMKELASSLIDSESLLVFGRGYNYATALEGALKVKEVALMHSEGMLAGEMKHGPLALVDENLPIIVIATRDACFSKQQSVIQQLLSRRGRLIVMCSRGDASAVCPSGGSCRVIEVPQVADCLQPVINIIPLQLLAYHLTVLRGFDVDQPRNLAKSVTTQ

SEQ ID NO: 620 - protein, 745 aa, Arabidopsis thaliana
MRFGKEFVSQMIPEWQEAYIDYAYLKTILQDIQASRNRSDSNNQSSTPSFARNLTRRYNRDALVSENHDIVVNTVTRLEEGLETAAYETTFLKAGEAGGDFEVTFFRTLDREFNKVNNFYRLKVETARTEALALNKQMDALIAFRHKVMDQNQKNPSVFDSVSEDINGSASEVGSSSKCTEHNVALADLMRNEDTSNESILERIRMNKTREITPLSAIKTILKVHKQDELKFTRDNLKEVEKRLQVAFIEFYQKLRHLKNYSFLNASAVSKIMKKYDKIAKRNAAKLYMEMVDKSFLSSSEEVHKLLLKVESIFIEHFSNSNRREGMSHLRPKINKERHLITFSTGFFFGCGISLIVALGLIIHARNIMGTPGQRTYMETMFPLYRFFGFVVLHMDVYAANIYFWRRYRVNYSFIFGFKQGTELGYRHVLLLSFGLGTLSLCAVLLNLDMEMDAQTKDYRLVTELIPLFLLVLVIIIVLCPFNILYRSSRFFFLSVLFRCIAAPFYAVHLPDFFLGDQLTSQVQALRSLEFYICYYGFGDFRYRRRNTCTSNIGFRTFYFIVAVIPYWLRFLQCIRRMVEDRDLSHGYNGIKYLLTIVAASLRTAYTLNRGSNWNITAWVFSGVATFYGTYWDIVLDWGLLQRGCKNSFLRDKLLVPHKTVYYAAMVLNVLLRLVWLQTVLDLKFSFLHRETMVALMACLEIIRRGIWNFFRLENEHLNNVGRYRAFKTVPLPFNYEEDGDHHNN

SEQ ID NO: 621 - protein, 324 aa, Zea mays
MAVDRVDGEEAFEEVDPTGRFGRYADVLGLGSVKKVYRGFDQEEGIEVAWNRVRLRSLADRDPGMVERLHAEVRLLRSLSHDHIIGFHKVWLDRDAGVLNFITEVCTSGSLREYRHRHRHVSVKALKKWARQILEGLNHLHTHDPCIIHRDLNCSNVFINGNNGQVKIGDLGLAAIVDKTHVAHTILGTPEFMAPELYTETYTESVDIYSYGMCVLEMVTREVPYAECGSVVQIFHNVTRGVPPAALKRLKDAELRGFIERCIGQPRNRPSAADLLQDPFFNGVRGGDDDDDATALADASSVVAATPVPRPRSYVDDLAGLRLD

SEQ ID NO: 622 - protein, 336 aa, Arabidopsis thaliana
MGGTKLTHVTTTNPNNSNIHGPVVDEVEGLIKVYKDGHVERSQLLPCVDPSLPLELGVTCSDVVIDKLTNVWARLYVPMTTTKSSVSKLPLIVYFHGGGFCVGSASWLCYHEFLARLSARSRCLVMSVNYRLAPENPLPAAYEDGVNAILWLNKARNDNLWAKQCDFGRIFLAGDSAGGNIAQQVAARLASPEDLALKIEGTILIQPFYSGEERTESERRVGNDKTAVLTLASSDAWWRMSLPRGANREHPYCKPVKMIIKSSTVTRTLVCVAEMDLLMDSNMEMCDGNEDVIKRVLHKGVGHAFHILGKSQLAHTTTLEMLCQIDAFIHHYDPLN

SEQ ID NO: 623 - protein, 145 aa, Arabidopsis thaliana
MASKALVLLGLFAVLLVVSEVAAASSATVNSESKETVKPDQRGYGDNGGNYNNGGGYQGGGGNYQGGGGNYQGGGGNYQGGGGRYQGGGGRYQGGGGRYQGGGGRQGGGGSGGSYCRHGCCYRGYNGCSRCCSYAGEAVQTQPGH

SEQ ID NO: 624 - protein, 178 aa, Arabidopsis thaliana
MQYYENREKDYYEVAQGQRNGYGQSQSHNHEGYGQSQSRGGYGQIHNREGYNQNREGYSQSQSRPVYGLSPTLNHRSHGGFLDGLFKGQNGQKGQSGLGTFLGQHKSQEAKKSQGHGKLLGQHDQKKTHETNSGLNGLGMFINNGEKKHRRKSEHKKKNKDGHGSGNESGSSSGSDSD

SEQ ID NO: 625 - protein, 158 aa, Glycine max
MAEEHRCQAPRFCANNCGFFGSPATQNMCSKCYRDFQLKEQQSSNAKMVLNQSLVPSPPPAVISQPSSSSSAAVDPSSAVVDDAPRESEEVKAPQQNRCMTCRRRVGLTGFKCRCGMMLCGTHRYPEQHACEFDFKGMGREQIAKANPVVKGEKLDKI

SEQ ID NO: 626 - protein, 482 aa, Escherichia coli K12
MKLNDSNLFRQQALINGEWLDANNGEAIDVTNPANGDKLGSVPKMGADETRAAIDAANRALPAWRALTAKERATILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 627 - protein, 503 aa, Arabidopsis thaliana
MAIVIGLLEIFTAFVFFIFFQCLLLHKKTPKPLLTNWPALGMLPGLLLQVPRIYDWITEVLEATDMTFCFKGPCLSGMDILLTVDPVNIHYILSSNFANYPKGMEFKKIFEVVGDSIFNVDSGLWEDMRNSSHAIFSNQDFQMFWVSTSVRKLRQGLVPILENAADKNILVDLQDLFQRFLFDTSLILMTGYDPKCLSVEMPKVEFGDAVDGVSDGVFYRHVKPVFLWRLQYLIGVGVEKRLKRGLAVFDQLLEKIITAKREEINSHGTHHPSRGEAIDVLTYYMTMDTTKYKYLEPSDDRFIKDTILGFLIAARDTTSSALTWFFWLMSKNPEAINKIRQEVNKKMPRFDPADLEKLVYLHGAVCETLRLYPPVPFNHKSPAKPDVLPSGHRVDEKWKIVISMYALGRMKSVWGDDAEDFRPERWISDSGRLKHEPSYKFLAFNAGPRACLGKKLTFLQMKTVAAEIIRNYDIKVVEGHKTEPVPSVLFRMQHGLKVNITRI

SEQ ID NO: 628 - protein, 490 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMTPELNPNFPEETTSDAWLTPADAGQDGDAQEPAEDGGEEGVVSEELALPEDLPPMDAMVAAVEEMTPVVVPETVPETETPALEDLVAQKTALEKDIAALQREKAQWYGQQFQQLQREMARLVEEGTRELGQRKAALEKEIEKLERRQERIQQEMRTTFAGASQELAIRVQGFKDYLVGSLQDLVSAADQLELGVGDSWESSSTHGDAIIENADPTPVVSFAEQGFSSQKRQIQALLEQYRTRPDYYGPPWQLRRTFEPVHAERIENWFFTLGGRGAILSLDSRLQNILVGSAAIAILNQLYGDRCRALILAATPERLGEWRRGLQDCLGISRSDFGPDRGIVLFESANALIQRAERLVGDRQMPLVLVDETEEQIDLALLQFPLLLAFAPSYQVGGSNYFS

SEQ ID NO: 629 - protein, 332 aa, Arabidopsis thaliana
LKIGKNFDMEEDRCSIKDDATQLIGNTPMVYLNNIVDGCVARIAAKLEMMEPCSSVKERIAYGMIKDAEDKGLITPGKSTLIEATSGNTGIGLAFIGAAKGYKVVLTMPSSMSLERKIILLALGAEVHLTDPSKGVQGIIDKAEEICSKNPDSIMLEQFKNPSNPQTHYRTTGPEIWRDSAGEVDILVAGVGTGGTLSGSGRFLKEKNKDFKVYGVEPTESAVISGGKPGTHLIQGIGAGLIPDNLDFNVLDEVIQVTSVEAIETAKLLALKEGLLVGISSGAAAAAAIKVAKRPENAGKLIVVIFPSGGERYLSTSLFESVRHEAENLPIQ

SEQ ID NO: 630 - protein, 223 aa, Arabidopsis thaliana
MDSDSWSDRLASATRRYQLAFPSRSDTFLGFEEIDGEEEFREEFACPFCSDYFDIVSLCCHIDEDHPMEAKNGVCPVCAVRVGVDMVAHITLQHANIFKMHRKRKPRRGGSYSTLSILRREFPDGNFQSLFGGSSCIVSSSSSSNVAADPLLSSFISPIADGFFTTESCISAETGPVKKTTIQCLPEQNAKKTSLSAEDHKQKLKRSEFVRELLSSTILDDSL

SEQ ID NO: 631 - protein, 252 aa, Arabidopsis thaliana
MKKTKTMVASISTLIRRTYPSTNQCNSLATIQSQTQLPRESLQHHSSAEGRLRFSGRVFCSESGAGCWNCGEKAAFLFCNSCRSIQPVDDSVDYFQIFGLEKKYEIDPGSLEGKYKDWQKKLHPDLVHNKSKKERDYAAEQSAKVTEACRTLTKRLSRAMYIMKLNGVNVNEEETITDPTLLMEIMELREAISEADDSTSLNQIRSQVQEKLKQWSDSFVEAFESQKFDDAVKCIQRMTYYERACEEILKKL

SEQ ID NO: 632 - protein, 390 aa, Arabidopsis thaliana
MYMIESKGGAIACMLLALLFLGTWPAIMTLTERRGRLPQHTYLDYTLTNLLAAVIIALTLGEIGPSRPNFFTQLSQDNWQSVMFAMAGGIVLSLGNLATQYAWAYVGLSVTEVITASITVVIGTTLNYFLDDRINRAEVLFPGVACFLIAVCFGSAVHKSNAADNKTKLQNFKSLETTSSFEMETISASNGLTKGKAKEGTAAFLIELEKQRAIKVFGKSTIIGLVITFFAGICFSLFSPAFNLATNDQWHTLKHGVPKLNVYTAFFYFSISAFVVALILNIRFLYWPILGLPRSSFKAYLNDWNGRGWSFLAGFLCGFGNGLQFMGGQAAGYAAADAVQALPLVSTFWGILLFGEYRRSSRKTYTLLISMLLMFIVAVAVLMASSGHRK

SEQ ID NO: 633 - protein, 369 aa, Synechocystis sp. PCC 6803
MKSRAAVAFEVGKPLQIVEIDVAPPQQGEVLVKITHTGVCHTDAFTLSGDDPEGLFPVVLGHEGAGIVVEVGEGVTSVQLGDHVIPLYTAECGKCLFCRSGKTNLCVAVRATQGKGVMPDGTSRFSYNGQSLYHYMGCSTFSEYTVVAEVSLAKINPEANHEHVCLLGCGVTTGIGAVHNTAKVQPGDSVAVFGLGGIGLAVVQGARQAKAGRIIAIDTNPAKFELAKQMGATDCINPKDHDQPIQQVIVEMTGWGVDHSFECIGNVEVMRSALECAHRGWGQSVIIGVAGAGQEISTRPFQLVTGRKWMGTAFGGVKGRSQLPGMVEQSMRGEIQLAPFVTHTMELKDINQAFDLMHDGKSIRSVIHY

SEQ ID NO: 634 - protein, 481 aa, Arabidopsis thaliana
MARPRRRNTEIGDGFTEIFNREIGFSHPITISRRISASEGRVKKLDLYGKLNGHEGCVNAVEFNSTGDVLVSGSDDRQIMLWNWLSGSRKLSYPSGHCENVFQTKFIPFTDDRTIITSGADGQVRLGQILENGKVETKRLGRHHGRVYKLAVLPGDPNVFYSCGEDGFVQHFDIRSNSATMVLYSSPFTQGCRRHHSSSRIRLNSIAIDPRNSYYLAVGGSDEYARVYDTRRVQLAPVCRHVLPDAPVNTFCPRHLRETNSVHITGLAYSKAGELLVSYNDELIYLFEKNMGYGSSPVSVSPEKLQEMEEPQVYIGHRNAQTVKGVNFFGPNDEYVTSGSDCGHIFIWKKKGGKLVRAMVGDRRVVNQLESHPHIPLLASCGIEKSVKLWTPMSNDVLSLPEKIDKVMELNRVGREDQSRVTLTPDVIMHVLRLQRRQTSAFTERRYVSTDIGSDEGNDARFIASLVANDDESSDRECTVS

SEQ ID NO: 635 - protein, 627 aa, Arabidopsis thaliana
MITFKSIALTIIFLSYFVSCVSSQRETKFLNHGFLGANLLNFGSSKVYPSGLLELTNTSMRQIGQAFHGFPIPLSNPNSTNSVSFSTSFIFAITQGTGAPGHGLAFVISPSMDFSGAFPSNYLGLFNTSNNGNSLNRILAIEFDTVQAVELNDIDDNHVGIDLNGVISIASAPAAYFDDREAKNISLRLASGKPVRVWIEYNATETMLNVTLAPLDRPKPSIPLLSRKMNLSGIFSQEHHVGFSASTGTVASSHFVLGWSFNIEGKESDFDITKLPSLPDPPPTLSPSPSPPVSTEKKSNNTMLIIIVAASATVALMILIFSGFWFLRRDKIFFIGGARKFSYQTISNATGGFDNSKLLGERNSGSFYKGQLAPTEIIAVKKITCTTRQQKTTLIAEIDAISKIKQRNLVNLHGYCSKGKDIYLVYEYVPNGSLDRFLFNNDRPVLTWSDRFCIIKGIAAALQHLHGEGQKPLIHGNVKASNVLLDEELNARLGDYGQGSRHSTTGHVAPELVNTGKVTRDTDVFAFGVLMMEIVCGRKAIEPTKAPEEISLVNWVLQGFKKGDLLMSCDTRINRENLVAREVLLVLKTGLLCANRSPESRPMMKNVFRYLEGTEALPHDDYLFYGV

SEQ ID NO: 636 - protein, 277 aa, Arabidopsis thaliana
MAASYHVRSSSLPARLHPHGLNQIQQLLNKLRADDNNSLSLLSNLYDSVSHLFNDSPSSLLVPHHSFFTHLLDLSLLHLDLCSKLRDITCRIKDCLRDLRSAFRRRRHSGDSTIRCHVKAFIRSRKAVHKDIAKLLLLLKQTGLSSSESSHPLITLLQQVCSQTCQTFRTVLLSLSTAVPKPRPSKWALVTKLVIKNVTSTSGQVRTGHRNEFQMMDEELRRFSMAEEIKKDRIKSMITNLDKVDVAVEDLEESLERLYRRMIQARVSLLNILSLHI

SEQ ID NO: 637 - protein, 250 aa, Arabidopsis thaliana
RAMFGSGGYEVGSKRQRMMQSNPYLAVGTGPTSFPPFGYAGGFPVVRLRGLPFNCADIDIFEFFAGLNIVDVLLVSKNGKFSGEAFVVFAGPMQVEIALQRDRHNMGRRYVEVFRCSKQDYYNAVAAEEGAYEYEVRASPPPTGPSRAKRFSEKEKLEYTEVLKMRGLPYSVNKPQIIEFFSGYKVIQGRVQVVCRPDGKATGEAFVEFETGEEARRAMAKDKMSIGSRYVELFPTTREEARRAEARSRQ

SEQ ID NO: 638 - protein, 467 aa, Arabidopsis thaliana
MILDLGFPCFVPPRTSSREDNKAWLLAETEPKLIDSEQHSLQSSFRFSLCSQLELEKIKKEKPSLSYRNFPVSEGSETVLLVNLENETGELTGEMNWSRGLSLEKSISPVADSLIRFSYRELLTATRNFSKRRVLGRGACSYVFKGRIGIWRKAVAIKRLDKKDKESPKSFCRELMIASSLNSPNVVPLLGFCIDPDQGLFLVYKYVSGGSLERFLHDKKKKKSRKTPLNLPWSTRYKVALGIADAIAYLHNGTEQCVVHRDIKPSNILLSSNKIPKLCDFGLATWTAAPSVPFLCKTVKGTFGYLAPEYFQHGKISDKTDVYAFGVVLLELITGRKPIEARRPSGEENLVVWAKPLLHRGIEATEELLDPRLKCTRKNSASMERMIRAAAACVINEESRRPGMKEILSILKGGEGIELRTLSSRKKSNLPGIMDCYPQLQRTKSEMKSHLTLAMLGVTEFEADDLL

SEQ ID NO: 639 - protein, 228 aa, Zea mays
MGNGPSLSPCLNPHLPESSATVRLVYWGGRARQLALTGGGDDAIVTAGDVAAELPPPATGYAVCPADAFFIGLPIPAMSPGEELLPGRTYFVLPAARLPCLKALTPATLAALSQSHGRKKQQPIFAVAGCPFEHVKGAHGGAPLIRVLPEFIEKLITACDAGANASANKDTAAKQAAELCSTPELKRHYAQLVGAGRSRPWSPRLETIAERGRSRWMRLAARTMLSSR

SEQ ID NO: 640 - protein, 305 aa, Chlorobaculum tepidum
MKIGFVGLGKMGSNMVEHLLELGHEVVAFDLSAEAVKAIAAKGATAASSLQHLVGELAAPRVVWMMVPAGRPVDAVIDGLTPFLRAGDIVIDGGNSRYTDSVARAEKLRKQGIRMLDIGTSGGLDGARHGACMMAGGDREAYEHVEPVLRDLCVENGYGYMGASGSGHFVKMVHNGIEYGMMQAIGEGFELLRASGYDLDNQNVARVWSNGSVIRGWLMDLAGKAFAQGNDLGWLGGKVADSGEGRWTVEAAIELGVAVPIISGSLFRRFQSQNEEHFSDKVVAALRHEFGGHAYEKPGEGEGKA

SEQ ID NO: 641 - protein, 135 aa, Zea mays
MASTACFVIVSKNDIPIYEAEVGSAPKKEDLSYHHQFILHAALDVVQDLAWTTNAMFLKSVDRFNDLVVSVYVTAGHTRFMLLHDSRSEDGIKSFFQEVHELYIKIFLNPLYLPGSRITSSHFDTKVRALARRYL

SEQ ID NO: 642 - protein, 559 aa, Arabidopsis thaliana
MNSHFIQEASEACFNGCCSSPFSSHSMSEKPEELEFSVTTTGTSFLTRNTKFTSQESLPRLRTSFYDLITAFPDYLQTNQADHLRSTEYQNLSSSSHVFGQQQPLFSYSQFREISESESDLNHSLLTLSCKQVSSGKELLSFEEESRFQSRIRKRITSFMNLEESEYHMILTQDRSSAFKIVAELYSFKTNPNLLTVYNYEDEAVEEMIRISEKKGIKPQSAEFSWPSTEILSEKLKRRITRSKRRGKRGLFVFPLQSLVTGASYSYSWMSLARESEWHVLLDTSALGSKDMETLGLSLFQPDFLICSFTEVLGQDDPSGFGCLFVKKSSSTALSEEPTNPENLTAVKAEPSWKWKTEYQAGYNEITPVDHEDHKAASTSSSEIVEIESSVKQDKAMIEFQGLDHADSLGLILISRRSKSLTLWLLRALRTLQHPGYHQTEMPLVKLYGPKTKPSRGPSISFNIFDWQGEKVDPLMVERLAEREKIGLRCAYLHKFRIGNKRRSDEAVSLRLSVVTVRLGGFMTNFEDVFKVWEFVSRFLDADFVEKEKWRMKALDKNK

SEQ ID NO: 643 - protein, 167 aa, Arabidopsis thaliana
MMNTYNMVKQEFIKKWINTLHMLDSSIEHPLNVTERKNAIRLSSDLAMAAARNGSTVWSRALISRSGNKTANKPMARRILKKARNRMKNRCNILRRNGNFTAKTWVRKRTDLLKSLVPGGELIDDKDYLIRETLDYIVYLRAQVDVMRTVAAVDLFTRNLTNDRRNK

SEQ ID NO: 644 - protein, 532 aa, Zea mays
PGRPTTPLTLRGRPRDLSTTSPPAPARRPRGGPAMKGSSHSQAGAQAVRRRRWGCLLPLLVGAAFLAEIAFLGRLDMAKNAEAVESWTTSFYRRSADLGDAVGGGAASRAGGDSEDEEIRLCEQRLEREDAVPYDRDFDSDPVLVGGAAKDWNKCYVGCEFGFSASKTPDATFGIAPDPSVDGILRSMESSQYYSENNIDVARGRGYKIVMTTSLSSDVPVGYFSWAEYDIMAPVPPKTEEALAAAFISNCGARNFRLQALEMLENLDVKIDSYGSCHRNRDGKVDKVDTLKRYRFSLAFENSNEEDYVTEKFFQSLVAGSIPVVVGAPNIQEFSPGEGAILHIKELDDVASVAKTMKNIASNPDAFNQSLRWKYDGPSDSFKALIDMAAVHSSCRLCIHIATKIHLKEERTPKFTNRPCSCSTKKGTIYHLFIRERGRFKSESIYMRSGQLTLGALESAVLGKFRSLNHVPVWKDERPPSIRGGDDLKLYRIYPVGLTQRQALYGFRFRDDSELEQYIKDHPCAKLEVIFV

SEQ ID NO: 645 - protein, 246 aa, Arabidopsis thaliana
  misc_feature (128)..(128): Xaa can be any naturally occurring amino acid
MIPYATIEEASIALSRNLTWLETLWFDYSATKSDYYLYCHNILFLFLIFSLVPLPLVFIESSQSTSDLFNRYKIQPKVKNSFSSMFKCYKDVMKMFILVVGPLQLVSYPSIQVNFWNLASNFGIDAIXVDFVFRVLKQMIEIRSGLPLPSCMEIVAQLVVYFLVEDYTNYWVHRFFHCKWGYEKFHHIHHEYTAPIGYAAPYAHWAEVLLLGIPTFLGPAIAPGHMITFWLWIALRQIEAIETHSG

SEQ ID NO: 646 - protein, 266 aa, Zea mays
MAASIGIMDGAYFVGRGEILHWINATLQLSLAKVEEAASGAVQCQLMDMVHPGVVPMHKVNFDAKTEYDMIQNYKVLQDVFNKLRIGKNIEVNKLVKGRPLDNLEFLQWLKRYCDSVNGGIMNENYNPVERRSKGCKERVSKGSNKPSKSLQANRLSGADPTDGGHGVGKVCNTFSEEHYIEQIQKLSEKIADLKVSVDSTEKERDFYFSKLRDIEILCQRPELEHLPMTKAVRKILYAADAKDSPLPEANDIITKSPSLFSNETE

SEQ ID NO: 647 - protein, 525 aa, Bacillus halodurans
MKSKVMSAYDAIQMIPDGATIATGGFVGNGHPEALTAAVEERFIKERHPRDVTVVYAAGQGDGKMRGLNHLGHEGLVSRVIGGHWGLAPKLQQLAIANKIKAYNFPQGVISHLFRDIAAGKPGTISRVGLKTFVDPRIQGGKLNAATTEDLVEVMTIKGVEYLFYHTFPIHVALIRGTFADELGNVTLEKEAGTLEILSIAQAAKNSGGIVIVQVERIVETGSLDPRLVKVPGILVDAIVVATPEQHMQTFSEQYNPAYSGEIRAVVKELGVLPMDERKIIARRSAMELKPYAVTNLGIGMPEGVSMIANEEGIGAKIHLTVESGPIGGIPAGGLSFGAATNPEAIIDQPYQFDFYDGGGLDVAFLGLAQLDRFGNVNVSKFGTKIAGAGGFINITQNAKRVVFCGTFTAGGLEVDITDGTLSIKQEGRVQKFVRDVEQITFSGPFASESKQTVLYITERAVFELTENGIALIEIAPGIDVQKDILDQMGFEPIIASPLKPMDQRIFRLGAMGLTFASGGALVTQ

SEQ ID NO: 648 - protein, 579 aa, Arabidopsis thaliana
MEQQQQQQLPSTTTRPKPKLLNRLNTYVGSSRVGKRFKLAERNSTFTTELRAGTATFLTMAYILAVNASILSDSGGTCSVSDCIPLCSNPAIEPSQCTGPGLRLIQPDVSCKFNPVNPGYAACVEEIRKDLIVATVAASLIGCVIMGLMANLPLALAPGMGTNAYFAYTVVGFHGSGSISYRTALAAVFIEGLIFLFISAIGFRAKLAKLVPKPVRISSSAGIGLFLAFIGLQNNQGIGLVGYSPSTLVTLAACPASSRISLAPVITSANGTVSLLAGGSVSGDIMCIHGRMESPTFWLGIVGFVIIAYCLVKNVKGAMIYGIVFVTAVSWFRNTEVTAFPNTSAGDAAHDYFKKIVDVHVIKHTAGALSFSGINKGHFWEALVTFLYVDILDTTGTLYSMARFAGFVDEKGDFAGQYFAFMSDASAIVIGSLLGTSPVTVFIESSTGIREGGRTGLTAITVAVYFLLAMFFTPLLASIPAWAVGPPLILVGVMMMKSVTEIDWEDMREAIPAFVTMILMPLTYSVAYGLIGGIGSYVVLHLWDWGEEGLVKLGFLKRKVKEEDNNNGVVKASEIDTTV

SEQ ID NO: 649 - protein, 156 aa, Arabidopsis thaliana
MGACASRESLRSDSAKLILLDGTLQEFSSPVKVWQILQKNPTSFVCNSDEMDFDDAVSAVAGNEELRSGQLYFVLPLTWLNHPLRAEEMAALAVKASSALTKSGGVGWVSGDDDVTTSEKTYQKKNIAGVKTNGGGGRGCGKGKRRFTANLSTIAE

SEQ ID NO: 650 - protein, 246 aa, Arabidopsis thaliana
MATGGAAADLEDVQTVDLMSELLRRLKCSQKPDKRLIFIGPPGSGKGTQSPVVKDEYCLCHLSTGDMLRAAVASKTPLGVKAKEAMEKGELVSDDLVVGIIDEAMNKPKCQKGFILDGFPRTVTQAEKLDEMLKRRGTEIDKVLNFAIDDAILEERITGRWIHPSSGRSYHTKFAPPKTPGVDDITGEPLIQRKDDNADVLKSRLAAFHSQTQPVIDYYAKKAVLTNIQAEKAPQEVTSEVKKALS

SEQ ID NO: 651 - protein, 463 aa, Arabidopsis thaliana
MDFSGLFLTLSAAALFLCLLRFIAGVRRSSSTKLPLPPGTMGYPYVGETFQLYSQDPNVFFAAKQRRYGSVFKTHVLGCPCVMISSPEAAKFVLVTKSHLFKPTFPASKERMLGKQAIFFHQGDYHSKLRKLVLRAFMPDAIRNMVPHIESIAQESLNSWDGTQLNTYQEMKTYTFNVALISILGKDEVYYREDLKRCYYILEKGYNSMPINLPGTLFHKAMKARKELAQILANILSKRRQNPSSHTDLLGSFMEDKAGLTDEQIADNIIGVIFAARDTTASVLTWILKYLADNPTVLEAVTEEQMAIRKDKKEGESLTWEDTKKMPLTYRVIQETLRAATILSFTFREAVEDVEYEGYLIPKGWKVLPLFRNIHHNADIFSDPGKFDPSRFEVAPKPNTFMPFGSGIHSCPGNELAKLEISVLIHHLTTKYRWSIVGPSDGIQYGPFALPQNGLPIALERKP

SEQ ID NO: 652 - protein, 363 aa, Arabidopsis thaliana
  misc_feature (91)..(91): Xaa can be any naturally occurring amino acid
MSSDAARTPLLPTEKIDTMAQDFNLNSRTSSSRKRRLRRSRSAPRGDCMYNDDVKIDEPPPHPSKIPMFSDLNPNLRRVIMFLALYLTIGXLCFYLVRDQISGHKTSGVVDALYFCIVTMTTVGYGDLVPNSSASRLLACAFVFSGMVLVGHLLSRAADYLVEKQEALLVRAFHLRQSFGPTDILKELHTNKLRYKCYATCLVLVVLFIVGTIFLVMVEKMPVISAFYCVCSTVTTLGYGDKSFNSEAGRLFAVFWILTSSICLAQFFLYVAELNTENKQRALVKWVLTRRITNNDLEAADLDEDGVVGAAEFIVYKLKEMGKIDEKDISGIMDEFEQLDYDESGTLTTSDIVLAQTTSQIQR

SEQ ID NO: 653 - protein, 219 aa, Arabidopsis thaliana
MALPLSGTRHLTRALLSNVTLMAPPRIPSSVHYGGSRLGCSTRFFSIRCGANRSGSTYSPLNSGSNFSDRPPTEMAPLFPGCDYEHWLIVMDKPGGEGATKQQMIDCYIQTLAKVVGSEEEAKKRIYNVSCERYLGFGCEIDEETSTKLEGLPGVLFVLPDSYVDPENKDYGAELFVNGEIVQRSPERQRRVEPQPQRAQDRPRYNDRTRYSRRRENTR

SEQ ID NO: 654 - protein, 495 aa, Arabidopsis thaliana
MFKKIMKGANRKASKAEANDSSMYGFDPPGRSGPGSNMIVNHASRGSLVPSSPNSMAAATTQPPPMYSVEPLPLFRDVSVSERQSLFLRKLQICCFQFDFTDTLKNAREKEIKRQTLLELVDFIQSGAGKLTEVCQEEMVKMISVNIFRCLPPASHENTGQEPADLEEEEPYLEPSWPHLQLIYELLLRYIVPSDTDTKVAKRYIDHSFVLRLLELFETEDPREREYLKTILHRIYGKFMVHRPFIRKAMNHIFYRFIYETERHSGIGELLEILGSIINGFALPMKEEHKLFLIRALIPLHKPKPIAMYHQQLSYCIVQFVEKDYKLADTVIRGLLKFWPVTNCTKEVLFLGELEEVLEATQTVEFQRCMVPLFQQIARCLSSSNFQVAERALFLWNNEHVVGLIAQNRGVILPIIFASLEKNIESHWNQAVHGLSANIKRMFMEMDPELFEECQQQYEEKQAKSKQVEEQRQNRWRRLDEAVEEREREDPMITS

SEQ ID NO: 655 - protein, 371 aa, Arabidopsis thaliana
VFAMMRGAAPTGVVSVMVLMILVLLKQIESASANGSSLGLPPRKFCNIYQGSWVYDKSYPLYDSKNCPFIERQFNCKSNGRPDSEYLKYRWQPSGCNLPRFNGLDFLGRIMKGKKLMFVGDSLSLNQWQSLTCLLHNAAPKANSTSTRSPSGLSVFSFPAYNSSIMFSRNAFLVDIVGAPPKRVMKLDSISSGSLWKTADVLVFNSWHWWLHTDRKQPWDAIMSGNVTVKDMDRLVAYEKAMMTWAKWIDQNIDPSKTKVFFQGISPDHGRAREWSKQGGKGSCIGETKPIMGSSYLAGPHAAEMVVAKVIKTMKNQARLMDVTLMSQLRKDGHPSVYGFGGHRMADCSHWCLSGVPDSWNQLLYSELFHS

SEQ ID NO: 656 - protein, 74 aa, Arabidopsis thaliana
MMKTRFLDWYLKIAIGSAIIGGGMEFFMIKTGFYDKVTVIEAERRALENSPEAQAIREALNPWRNKDAETSKTP

SEQ ID NO: 657 - protein, 531 aa, Arabidopsis thaliana
MLVTRRWESHPANSPDLILQFFGNEFHGYGDDMPETLRRLTELLGYEKEEDGAGMNAAKKIAAELNRRKDDIPAFRRLRCLELDQLNEFLFSTKLNPPIGDQVHHDMHAPLSHYFIHTSLNSYFTGNVFGKYSILPIIEALEQGVRVVELDLWPDGRGSICVRPSWNFEKPLKLQECLDSIKEHAFTKCTYPLIITFKDGLKPELQSKATQMIQQTFNHMVYHHDPHSLEVFPSPQQLRNKILISRRPPKELLYANDDDGKVGVRNGVEIRQHPADPNYQSLVSFHVVEPRGMLQNVLTGKANKIQRPGWYETDIISFTQKRFLRTRPQRKLLIYAPYKPQRAWMHGAQLIALSRKEEKEKLWLMQGMFRANGGCGYVKKPDFLLNAGPSGVFYPTVNPVVVKILKVKIYMGDGWIVDFKKRIGRLSKPDLYVRISIAGVPHDENIMKTTVKNNEWTPTWGEEFTFPLTYPDLALISFEVYDYEVSTADAFCGQTCLPVSELIEGIRAVPLYDERGKACSSTMLLTRFKWS

SEQ ID NO: 658 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 659 - protein, 268 aa, Arabidopsis thaliana
MAAAANTSAVFASPSQPLSSKRSFLYSSRIGPILRRFPRKKLDLQVKAVATTLAPLEEIKEYKLPSWAMFEMGTAPVYWKTMNGLPPTSGEKLKLFYNPAASKLTLNEDYGVAFNGGFNQPIMCGGEPRAMLKKDRGKADSPIYTMQICIPKHAVNLIFSFTNGVDWDGPYRLQFQVPKRWQNKPIEFFNEGLANELSQDGACERAIFPDSNVVPTRCTMIANLTVEGGDRCNLDLVPGCMDTNSEHFNPYANVDDGSCPLELSDSDE

SEQ ID NO: 660 - protein, 393 aa, Arabidopsis thaliana
MSSSSSVRISLSFIFLALLISPAVSQTCKSQTFSGDKTYPHCLDLPQLKAFLHYSYDASNTTLAVVFSAPPAKPGGWIAWAINPKATGMVGSQTLVAYKDPGNGVAVVKTLNISSYSSLIPSKLAFDVWDMKAEEAARDGGSLRIFARVKVPADLVAKGKVNQVWQVGPELGPGGMIGRHAFDSANLASMSSLDLKGDNSGGTISGGDEVNAKIKNRNIHGILNAVSWGILFPIGAIIARYMRVFDSADPAWFYLHVSCQFSAYVIGVAGWATGLKLGNESEGIRFSAHRNIGIALFTLATIQMFAMLLRPKKDHKYRFYWNIYHHGVGYAILTLGIINVFKGLNILKPQDTYKTAYIAVIAVLGGIALLLEAITWVVVLKRKSNNSMKPLRT

SEQ ID NO: 661 - protein, 504 aa, Arabidopsis thaliana
MASWTSSQFLYEETKPWGIQFLEKFKRSGRLSFKQYQALVFILTFVAYIAFHAARKPNSIVKGTLSASTIEGGWAPFDGPDGTALLGQIDLAFLSVYAVGMFVAGHLGDRLDLRTFLTIGMIGTGLFTALFGVAFWANFHSFYYFLAVQVMAGLFQSIGWPCIVAVLGNWFDKKRRGMIMGVWSAHTSLGNIAGSLIASGLLRYGWGWSFLGPAFLMTFLGIVVYLFLPVNPPTVEAERDGTEIDSTMRLGDTITESLLESRMSTGFDRKAVGFMAAWKIPGVAPFAFCLFFTKLVSYTFLYWLPFYVSHNMIGGEYLSEETSGNLSTIFDVGGVVGGVLAGYISDQLNGRAITAAGFMYLAIPALFLYRVFGHISLTINVILMFTSGVFIIGPFALITTAVSADLGTHKSLKGNARALATVSAIIDGTGSVGAAIGPVLTGYISAISWDAVFYMLMTAALISGLLLTKLIIAEVKALLFGSEDEVAASSSSPPASRPPIDVLV

SEQ ID NO: 662 - protein, 162 aa, Arabidopsis thaliana
MRKIIGFRIGRRVSRWIFRKTRIQRSGYNRIHSTQQACMLMRPLAKLKSWGQRLKQSFRRRSTRRSAYIPVDHKKADPVPRGHLAIYVGQKDGDCHRVLVPIVYFNHPLFGELLREAEKEYGFCHEGGITIPCLYSDFERVKTRIASGSSSRVFPWGRHCRN

SEQ ID NO: 663 - protein, 368 aa, Arabidopsis thaliana
MDLNSNHKSSVLKDPSPSVNQSRLGVSSRFMMSQWKKPAKLDDVRSNGWLDAMISSSPPRKKLVKDFNVEVAPEDDFAQRAWMVKYPSAISSFAHIAAQAKKKKIAVFLDYDGTLSPIVDDPDRAIMSDAMRSAVKDVASYFPTAIISGRSRDKVYQLVGLTELYYAGSHGMDIMTSSDGPNCFKSTDQQGKEVNLFQPAREFIPVIDEVFRTLVEKMKDIKGAKVENHKFCASVHYRNVDEKDWPIIAQRVHDHLKQYPRLRLTHGRKVLEVRPVIDWNKGRAVEFLLESLGLSNKDDLLPIYIGDDTTDEDAFKVLRDGNRGFGILVSSIPKESNAFYSLRDPSEVKKFLKTLVKWAKLEKNSTGF

SEQ ID NO: 664 - protein, 405 aa, Sinorhizobium meliloti
MEEFHKVRRLPPYVFEQVNRLKASARAAGADIIDLGMGNPDLPTPQSIVDKLCEVVQDPRTHRYSSSKGIPGLRRAQAAYYARRFGVKLNPETQVVATLGSKEGFANMAQAITAPGDVVLCPNPTYPIHAFGFLMAGGVIRSISVEPDESFFPPLERAVRHSIPKPLALILNYPSNPTAQVATLDFYKDVIAFAKKHDIIVLSDLAYSEIYFDDAPPPSVLEVPGATDVTVEFTSMSKTFSMPGWRMGFAVGNERLIAALTRVKSYLDYGAFTPIQVAATQALNGDGSDIAEVRAIYKRRRDVMVESFGKAGFEVPPPPATMFAWAKIPEKFRHLGSLEFSKLLVEKADVAVAPGIGFGEQGDDYVRLALVENEHRIRQAARNIKRFLSSADETMHNVISLNAHR

SEQ ID NO: 665 - protein, 369 aa, Acidithiobacillus ferrooxidans
MDVRAAVAFEAGKPLVIETVQLDGPKEGEVLVELKATGICHTDHFTLSGADPEGLFPCILGHEGAGIVVDVGPGVKSVKKGDHVIPLYTPECRECEYCLSRKTNLCQKIRTTQGKGLMPDGTTRFSFKGKPLFHYMGCSTFANYTVMPEIALAKIREDAPFDTTCYIGCGVTTGIGAVVFTAKVEPGANVVVFGLGGIGLNVIQGAKLVGANMIIGVDINPAREAIARKFGMTHFVNPKEVEGDLVSHLVELTHGGADYSFECIGNVKVMRQALECCHKGWGVSCIIGVAGAGQEISTRPFQLVTGRRWIGSAFGGARGRTDVPKIVDWYMEKKINIDDLITHRLKLEDINEGFHLLETGQSIRSVVVY

SEQ ID NO: 666 - protein, 245 aa, Arabidopsis thaliana
MASSGNGTTAGTGSPCGACKFLRRKCASDCIFAPYFSSEQGAARFAAIHKVFGASNVSKLLLNVPIHDRCEAVVTIAYEAQARLHDPVYGCVSHIFALQQQVAFLQSQVMQMKAQIAGHQTSAAGDLRHSSESTNQFMTWQQTSVSPIGSAYSTPYNHHQPYYGHVNPNNPVSPQSSLEESFSNTSSDVTTTANVRETHHQTGGGVYGHDGIGFHEGYPNKKRSVSYCSSDLGELQALALRMMKN

SEQ ID NO: 667 - protein, 585 aa, Pseudomonas fluorescens PfO-1
MASSMLSSATMVASPAQATMVAPFNGLKSSAAFPATRKANNDITSITSNGGRVNCMQVWPPIGKKKFETLSYLPDLTDSGGRVNCMQAMATLTRADWEQRARDLKIEGRAYLNGEYTDAVSGETFECISPVDGRLLGKIASCDADDAQRAVENARATFNSGVWSRLAPTKRKATMIRFAGLLKQHAEELALLETLDMGKPISDSLYIDVPGAAQALSWSGEAIDKIYDEVAATPHDQLGLVTREPVGVVGAIVPWNFPLMMACWKLGPALSTGNSVILKPSEKSPLTAIRIAELAVEAGIPKGVLNVLPGYGHTVGKALALHNDVDTLVFTGSTKIAKQLMIYSGESNMKRVWLEAGGKSPNIVFADAPDLQAAAESAASAIAFNQGEVCTAGSRLLVERSIKDKFLPMVIEALKAWKPGNPLDPATNVGALVDTQQMNTVLSYIESGHSDGAKLVAGGKRILQETGGTYVEPTIFDGVSNAMKIAQEEIFGPVLSVIAFDTAEEAINIANDTPYGLAAAVWTQDISKAHLTAKALRAGSVWVNQYDGGDMTAPFGGFKQSGNGRDKSLHAFDKYTELKATWIKL

SEQ ID NO: 668 - protein, 382 aa, Arabidopsis thaliana
MRCFSCLNTQTNDMRINIDTLSDLTDYASVATKIDPRGTGSKSGILVNGKVNSPKPGGGARSFTFKELAAATKNFREGNIIGKGGFGSVYKGRLDSGQQVVAIKQLNPDGHQGNQEFIVEVCMLSVFHHPNLVTLIGYCTSGAQRLLVYEYMPMGSLEDHLFDLEPDQTPLSWYTRMKIAVGAARGIEYLHCKISPSVIYRDLKSANILLDKEFSVKLSDFGLAKVGPVGNRTHVSTRVMGTYGYCAPEYAMSGRLTIKSDIYSFGVVLLELISGRKAIDLSKPNGEQYLVAWARPYLKDPKKFGLLVDPLLRGKFSKRCLNYAISITEMCLNDEANHRPKIGDVVVAFEYIASQSKSYEDRRTARKSTDSNRLRRETKQSY

SEQ ID NO: 669 - protein, 451 aa, Arabidopsis thaliana
MTKKRKLESESNETSEPTEKQQQQCEKEDPEIRNVDNQRDDDEQVVEQDTLKEMHEEEAKGEDNIEAETSSGSGNQGNEDDDEEEPIEDLLEPFSKDQLLILLKEAAERHRDVANRIRIVADEDLVHRKIFVHGLGWDTKADSLIDAFKQYGEIEDCKCVVDKVSGQSKGYGFILFKSRSGARNALKQPQKKIGTRMTACQLASIGPVQGNPVVAPAQHFNPENVQRKIYVSNVSADIDPQKLLEFFSRFGEIEEGPLGLDKATGRPKGFALFVYRSLESAKKALEEPHKTFEGHVLHCHKANDGPKQVKQHQHNHNSHNQNSRYQRNDNNGYGAPGGHGHFIAGNNQAVQAFNPAIGQALTALLASQGAGLGLNQAFGQALLGTLGTASPGAVGGMPSGYGTQANISPGVYPGYGAQAGYQGGYQTQQPGQGGAGRGQHGAGYGGPYMGR

SEQ ID NO: 670 - protein, 683 aa, Oryza sativa
MEPVNDFQEGISTEHAFEAEPVPSLSETITPRSMVVSFILSVTLSIVAMKVTLSSGFIPSFSIPAGLLGFCVSRASIRILDYFAVAQLPFTRQENTIIQTCVVACTSITFTGGFGTYILAMGKKAAVGDVNAQNNVEEPSFARMITFLFLISFAGMFIIMPFRKVMIIRHRLTFPSGTATAHLINSFHTPQGVKQARKQVTLLFKSFGGTIAWSLFQWFFASGPGCGFKFFPTFGLEAYKHGFFFDFTMANVGIGMMCPYMIVFSVFIGTIISCGVIWPYIESKEGIWYPSNLGPNSLNGIRGYKVFIGLSMIMADCLFVFLCIMVRTTCAMIKRRRQAMQGGGGNAQPFQGIDIADQPVKSFDDRRRAQVFLRDEIPDSVTIGCYVLLSIISIAAIPHLYPQMRYSHVALIYLAAPVFAFCNAYGFGVTDMNLASTYCKIAMFAFGSWVGIKSGGVVAALVAGGITMSILGNAADVAQDLKTGYLTLTSPRAVFISEAIGTALGCVVNPTVFWVFYRVYKMGSGDMGDMPYAKLYRGFAMLSVGDGEQGLPRHSMLLFKVFFVLALALSVFREVASRKEWRIRRYIPSTIGMAITFFMPPRVPVGMCIGSLVAYLWEKMDAGRGRMLSPALASGLICGDGVGSILLSMLTLMGARAPICIKFLSRGDNVKLDAFLATLHDMR

SEQ ID NO: 671 - protein, 156 aa, Zea mays
  misc_feature (67)..(67): Xaa can be any naturally occurring amino acid
MADWGPVIVATVLFVVLTPGLLCTLPGRGRVAEFGSMHTSGLAILVHAVLYFALITIFLIAIGIHVXRGLARDPAFLYKKKAGSCRTMADWGPVIVATVLFVVLTPGLLCTLPGRGRVAEFGSMHTSGLAILVHAVLYFALITIFLIAIGIHVYAG

SEQ ID NO: 672 - protein, 387 aa, Zea mays
MSNPGSLPASAHHEHEHTPLCRSCGAPTTSPTPAPWSGTTDSPPPAYRPIRLPAINAPTNTAAIVLSPVPQPLPVPPAAPPHAFLVPAKRITSPDDIARFHASVHGLHFLGFVAALSASVHGRKLSDPLPSPPSPAIAALLDLVSALAALVASTPPLPHSSRYGNPAFRLWHEKLTDSASELISRITATASSPADLAGADVELAPYLLDSFGNATRIDYGTGHETNFAAFLYCLARLGLITEPDYPAVVLRVFTAYLDLMRTLQDTYQLEPAGSHGVWGLDDYHFLPFVFGSAQLIDHKYMKPKSIHNPDILENFSKEYMYLACVAYVKKVKKGPFMEHSPMLDDISGVANWKKVNSGLLKMYKAEVLEKVPIMQHFLFGSLIKWED

SEQ ID NO: 673 - protein, 168 aa, Arabidopsis thaliana
MSGAGKKIADVAFKASRTIDWDGMAKVLVTDEARREFSNLRRAFDEVNTQLQTKFSQEPEPIDWDYYRKGIGAGIVDKYKEAYDSIEIPKYVDKVTPEYKPKFDALLVELKEAEQKSLKESERLEKEIADVQEISKKLSTMTADEYFEKHPELKKKFDDEIRNDNWGY

SEQ ID NO: 674 - protein, 346 aa, Arabidopsis thaliana
MESKTINDVVVSESNHELASSSPSEFEKNQKHYQEIIATLPHKDGWRPKDPFVEYGGHWWLQPLLEGLLHAQKFFKARPNDFFVCSYPKTGTTWLKALTFAIANRSKFDVSTNPLLKRNPHEFVPYIEIDFPFFPSVDVLKDEGNTLFSTHIPYDLLPESVVKSGCKIVYIWRDPKDTFVSMWTFAHKERSQQGPVVSIEEAFDKYCQGLSAYGPYLDHVLGYWKAYQANPDQILFLKYETMRADPLPYVKRLAEFMGYGFTKEEEEGNVVEKVVKLCSFETLKNLEANKGEKDREDRPAVYANSAYFRKGKVGDWQNYLTPEMVARIDGLMEEKFKGTGFLSSKS

SEQ ID NO: 675 - protein, 645 aa, Arabidopsis thaliana
MSSLISFIFLFLFSSITASAQNTFYLYHNCSVTTTFSSNSTYSTNLKTLLSSLSSLNASSYSTGFQTATAGQAPDRVTGLFLCRVDVSSEVCRSCVTFAVNETLTRCPKDKEGVFYYEQCLLRYSNRNIVATLNTDGGMFMQSARNPLSVKQDQFRDLVLTPMNLAAVEAARSFKKWAVRKIDLNASQSLYGMVRCTPDLREQDCLDCLKIGINQVTYDKIGGRILLPSCASRYDNYAFYNESNVGTPQDSSPRPGKGGNSSVIIIAVVVPITVLFLLLVAVFSVRAKNKRTLNEKEPVAEDGNDITTAGSLQFDFKAIEAATNCFLPINKLGQGGFGEVYKGTLSSGLQVAVKRLSKTSGQGEKEFENEVVVVAKLQHRNLVKLLGYCLEGEEKILVYEFVPNKSLDHFLFDSTMKMKLDWTRRYKIIGGIARGILYLHQDSRLTIIHRDLKAGNILLDDDMNPKIADFGMARIFGMDQTEAMTRRVVGTYGYMSPEYAMYGQFSMKSDVYSFGVLVLEIISGMKNSSLYQMDESVGNLVTYTWRLWSNGSPSELVDPSFGDNYQTSEITRCIHIALLCVQEDAEDRPTMSSIVQMLTTSLIALAEPRPPGFFFRSKQEQAGPSIDSSTHCSVDEASITRVTPR

SEQ ID NO: 676 - protein, 355 aa, Arabidopsis thaliana
MSSSESVENECMCWAARDPSGLLSPHTITRRSVTTDDVSLTITHCGVCYADVIWSRNQHGDSKYPLVPGHEIAGIVTKVGPNVQRFKVGDHVGVGTYVNSCRECEYCNEGQEVNCAKGVFTFNGIDHDGSVTKGGYSSHIVVHERYCYKIPVDYPLESAAPLLCAGITVYAPMMRHNMNQPGKSLGVIGLGGLGHMAVKFGKAFGLSVTVFSTSISKKEEALNLLGAENFVISSDHDQMKALEKSLDFLVDTASGDHAFDPYMSLLKIAGTYVLVGFPSEIKISPANLNLGMRMLAGSVTGGTKITQQMLDFCAAHKIYPNIEVIPIQKINEALERVVKKDIKYRFVIDIKNSLK

SEQ ID NO: 677 - protein, 422 aa, Arabidopsis thaliana
MSSLPLRSGEKMESPSISDAVPLHAPEDATADFSQPQSPLHEVDSFPVTESSDDVVVNVSEIPNLSPSDDDFDHERNSGEDRDQDHGENPVETDGVVVPIDELNQKIIRQVEYYFSDENLPTDKFLLNAMKRNKKGFVPISTIATFHKMKKLTRDHALIVSALKESSFLVVSADEKKVKRLSPLPEIRDPKIFTVLVENLPEDHSNENIREIFGKAGSIKSVSICDPNAVEESEKGGKKENFIRTRLHAFVEYETVEAAEKAAATLNNEQDWRNGLRVKLLEQAAGKFAQRRPARREVDKEKDTTGRVHDQTGGEKNKKTREHQNHRLHHSDNPADDDGGNHQKDKNGNKGRVVGQGRRQNHQGGNGIGHGTASSSSHPNYHPVEVSKRPPGPRMPDGTRGFTMGRGKAIPPPTSTQTSHEV

SEQ ID NO: 678 - protein, 356 aa, Arabidopsis thaliana
MSSDDTIEESLLVDPKLLFIGSKIGEGAHGKVYQGRYGRQIVAIKVVNRGSKPDQQSSLESRFVREVNMMSRVQHHNLVKVSLLLSSLSLLSILLLEYTISIWQFIGACKDPLMVIVTELLPGMSLRKYLTSIRPQLLHLPLALSFALDIARALHCLHANGIIHRDLKPDNLLLTENHKSVKLADFGLAREESVTEMMTAETGTYRWMAPELYSTVTLRQGEKKHYNNKVDVYSFGIVLWELLTNRMPFEGMSNLQAAYAAAFKERPVMPEGISPSLAFIVQSCWVEDPNMRPSFSQIIRLLNEFLLTLTPPPPQPLPETATNRTNGRAITEFSIRPKGKFAFIRQLFAAKRNINS

SEQ ID NO: 679 - protein, 570 aa, Arabidopsis thaliana
MASLFSSRLGSQSLSLLINIFFIFLIFLHFASQTPPPSGSIQTLNSFAGGDSDSCSGGLASLDDHRSKCSYIRSQSKCGPQGYIDYLKIFFCIFGQSPVLGHLVLSAWLFVLFYLLGDTAASYFCPSLDSLSKVLKLSPTMAGVTLLSLGNGAPDLFSSVVSFTRSNNGDFGLNSILGGAFFVSSFVVGTICVLIGSRDVAIDRNSFIRDVVFLLVALCCLGLIIFIGKVTIWVALCYLSIYLLYVGFLSVSHFFDRKKRMSDQILRSREDLAEMGVSLLGYIAEEKLALPEKTTQEFKIVFEDSPKRHRSCFSVLVSIIGLPLYLPRRLTIPVVCEEKWSKPCAVVSTAIAPVLLTELYCSHYSGSQRNLILYIISGSIGLIVGILAYLTTEKSHPPKKFSLVWLLGGFTMSVTWTYMIAQELVSLLISLGNIFGISPSVLGLTVLAWGNSLGDLIANVTVAFHGGNDGAQIALSGCYAGPLFNTVIGLGVPLVISSLAEYPGVYIIPSDNSLLETLGFLMVGLLWALVIMPKKKMRLDKLVGGGLLAIYLCFLSLRLARVFGVLDTDR

SEQ ID NO: 680 - protein, 302 aa, Arabidopsis thaliana
KIENLCLNLFVSAGLAVTSVMLVTTCLMTLVMTIVWKQRIITVLAFVVFFGSIELLYFSSCVYKVPEGGWIPILLSLTFMAVMYIWNYGTTKKHEFDVENKVSMDRIVSLGPSIGMVRVPGIGLVYSNLVTGVPAVFGHFVTNLPAFHKILVFVCVKSVQVPYVGEEERFVISRVGPKEYGMFRSVVRYGYRDVPREMYDFESRLVSAIVEFVETEPGLEEEEMSSVRRKKEECMEIMEAKEAGVAYILGHSYAKAKQSSSVLKKLAVNVVFAFMSTNCRGTDVVLNVPHTSLLEVGMVYYV

SEQ ID NO: 681 - protein, 694 aa, Arabidopsis thaliana
MGCVCGKPSAIEDSKDSPRERFSSKSSSEFRVSRPVASSRREEPLRIKERSDVVSVRPVLSNKQSNVSLHLRGENLSRREKRIENVAATSPLAMSITIAKATEGEYVAAGWPPWLASVAGEAIRGWVPRRADSFEKLDKIGQGTYSNVYRARDLDQKKIVALKKVRFDNLEPESVRFMAREIQILRRLDHPNIIKLEGLVTSRMSCSLYLVFEYMEHDLAGLASHPAIKFSESQVKCYLQQLLHGLDHCHSRGVLHRDIKGSNLLIDNSGVLKIADFGLASFFDPRQTQPLTSRVVTLWYRPPELLLGATRYGAAVDLWSAGCILAELYAGKPIMPGRTEVEQLHKIFKLCGSPTEDYWVKSRLPHATIFKPTQPYKRLVGETFKEFPQPALALLETLLSVNPDDRGTATAALKSEFFSTRPLPCDPSSLPKYPPSKELDARMRDEESRRQVGGNRDQRHQERRGTKESRAIPAPDANAELVASMQKRQSQSTNRSRSEKFNPHPEEVASGFPIDPPRPSSQAFEPNRESQGNIIPHKRASHSGPLSRRSASAKGRRNYQDSQKVSSIADYSAMPGFAATRTGAPQQETCRGMTRLPGSFKETSEEANQEENGRSNKKDPILLGYGSKGHKIHYSGPLVVPSGNMDQVLKDHDRHIQEAVRRARIDKARVKKLQADEASSQQVATNHPSSVSSR

SEQ ID NO: 682 - protein, 440 aa, Arabidopsis thaliana
MEGESKGLIVGISLGLVIGVVLAISALFCFRYHRKKSQIVNSGSRRSATIPIRENGADSCNIMSDSTIGPDSPVKSSKNGRSVWLEGFSKRSNVISASGILEYSYRDLQKATCNFTTLIGQGAFGPVYKAQMSTGEIVAVKVLATDSKQGEKEFQTEVMLLGRLHHRNLVNLIGYCAEKGQHMLIYVYMSKGSLASHLYSEKHEPLSWDLRVYIALDVARGLEYLHDGAVPPVIHRDIKSSNILLDQSMRARVADFGLSREEMVDKHAANIRGTFGYLDPEYISTRTFTKKSDVYGFGVLLFELIAGRNPQQGLMELVELAAMNAEEKVGWEEIVDSRLDGRYDLQEVNEVAAFAYKCISRAPRKRPNMRDIVQVLTRVIKVRHCRKRQKNSPSPSPRLPPPPPIVEESEGELTANGSLRSEIHRRDNSLDSSIAEDVIL

SEQ ID NO: 683 - protein, 502 aa, Arabidopsis thaliana
MKAAVFRNEDGDEEEEEEEEEEVCNVFDGGEVESKRNNETKNLKGFFTSLLLMEEHEKQDQEARNAASRREMSDFQSNYRKRARTMSDYYSDLNDYYADAEESGDINLKKSRVSRAVASVAVAAASEIEAESSEITGSGSVRGTGSGQQRRLWVKDRSRAWWEECSRLDYPEEDFKKAFRMSKSTFELICDELNSAVAKEDTALRNAIPVRQRVAVCIWRLATGEPLRLVSKKFGLGISTCHKLVLEVCKAIKDVLMPKYLQWPDDESLRNIRERFESVSGIPNVVGSMYTTHIPIIAPKISVASYFNKRHTERNQKTSYSITIQAVVNPKGVFTDLCIGWPGSMPDDKVLEKSLLYQRANNGGLLKGMWVAGGPGHPLLDWVLVPYTQQNLTWTQHAFNEKMSEVQGVAKEAFGRLKGRWACLQKRTEVKLQDLPTVLGACCVLHNICEMREEKMEPELMVEVIDDEVLPENVLRSVNAMKARDTISHNLLHHGLAGTSFL

SEQ ID NO: 684 - protein, 431 aa, Arabidopsis thaliana
MLLKIKRVPTVVSNYQKDETVEEGGCGRNCLSKCCINGARLPLYTCKNLDKSVGENTESPVTFLESLVIGEWEDRFQRGLFRYDVTACETKVIPGKYGFIAQLNEGRHLKKRPTEFRVDKVLQPFDGNKFNFTKVGQEELLFQFKASTNDDDSEIQFLASMPLDADNSPSVVAINVSPIEYGHVLLIPRVLDCLPQRIDHKSLLLALQMAAEADNPYFRLGYNSLGAFATINHLHFQAYYLAMQFPIEKASSLKITTTNNGVKISKLLNYPVRGLLVEGGNTIKDLADTVSDASVCLQNNNIPFNILISDSGKRIFLLPQCYAEKQALGEVSSTLLDTQVNPAVWEMSGHMVLKRKEDYEGASEEKAWRLLAEVSLSEERFREVNTMIFDAIGFSSHEEEEEEELEEQNSMNGGSFTIVHCPSVKEEAVSN

SEQ ID NO: 685 - protein, 146 aa, Arabidopsis thaliana
MASNIIMFEDIFVVDKLDPDGKKFDKVTRVEARSHNLEMFMHLDVNTEVYPLAVGDKFTLAMAPTLNLDGTPDTGYFTPGAKKTLADKYEYIMHGKLYKISERDGKTPKAELYVSFGGLLMLLQGDPAHISHFELDQRLFLLMRKL

SEQ ID NO: 686 - protein, 386 aa, Arabidopsis thaliana
MANEGSDPLLQYMISPRLKKPPQLLFPLPEDNEVAIPMPMTPSEFKERLIFGPFSCSPRDSSHFIDSMKQPSPSSSSTAVNNPFSDSSTLDPLLPPPPPQPEPWLSDQTSSHCQGHALHRSKTAPAMAVINDLHHPIRQKDPTETSRSVVRQAFALLVVYLSLGVLIYWLNRDHYVVNQTHPVVDGLYFCIVTMCTIGYGDITPNSVVTKLFSIMFVLVGFGFIDILLSGMVSYVLDLQESYMLDSAKRRDEPEKRRSYIIDVKKGRMRIRLKVALALGVVVLCIAVGVGIMHFIEEIGWLDSFYLSVMSVTTVGYGDRAFKTLPGRLFAAIWLLVSTLAVARAFLYLAEARVDKRNRERAKKVLCETMSVSQFFAADIDNNGCVR

SEQ ID NO: 687 - protein, 326 aa, Arabidopsis thaliana
  misc_feature (58)..(58): Xaa can be any naturally occurring amino acid
  misc_feature (110)..(110): Xaa can be any naturally occurring amino acid
  misc_feature (208)..(208): Xaa can be any naturally occurring amino acid
MTKIELRALGNTGLKVSAVGFGASPLGSVFGPVAEDDAVATVREAFRLGINFFDTSPXALLLLLYFLKITDSSILIADSLNVETNLIVKVKIFIGRFHIYFFIWHLLCVXRYYGGTLSEKMLGKGLKALQVPRSDYIVATKCGRYKEGFDFSAERVRKSIDESLERLQLDYVDILHCHDIEFGSLDQVYHFISLGFITFVVCVSNLYXVFIHCCQIVSETIPALQKLKQEGKTRFIGITGLPLDIFTYVLDRVPPGTVDVILSYCHYGVNDSTLLDLLPYLKSKGVGVISASPLAMGLLTEQGPPEWHPASPELKVWHFTKECDSC

SEQ ID NO: 688 - protein, 186 aa, Arabidopsis thaliana
MSDNKDRDSDSDAPEELTQEQAKLEEEALWKIQRENKNRVSREKKERRKLMAEQVTLRKSRKIEIIEDVVEEEEPEENSEALANKGFLSKDIIDFLAEREKQKAESDSEEEEIIDELPRKKKQKSSGIETVIYKEIPPPECLKTGLDFLKMRRAQVPRSSSVIKNSGQALRLATGAALAKKQRQRK

SEQ ID NO: 689 - protein, 422 aa, Zea mays
MATKYAAAAADLVTGRPRKRARLGWDVASAAEAQIGTFCGQEVGDVASLLLSANPSDHTCSSLLPKGVARNASPPWREDDKDGHYVFAVGENLASRYKIYRKMGEGTFGQVLECWDRESKEMVAIKIVRSVKKYSDAAMIEIDVLQKLAKNDAAGKHCVQIRNWFDYRSHICIVCEKLGPSLYDFLQKTGFHPFPIDLIRRIGQQLLESVAFMHRLQLIHTDLKPENILLVSSDYVKLPDPKDGSFSRKLPKSSAIKLIDFGSAAYHHQDRSYIVSTRHYRAPEVILGHGWSYPCDIWSVGCILVELCSGETLFQTHDNLEHLAMMDRVLGPLPRHMLERADQHAEKYVRKGGLNWPQAITTVESVRAVLKLPRLQNLVMQHVDHSAGDFIDLLKRLLAYEPSGRLTAQEALGHVFFTRYRQ

SEQ ID NO: 690 - protein, 219 aa, Zea mays
MSAGELRLELDELRRLESLAKHPRVQILLANEIRNVEAKLAKATEPSPEPLAAASAPAPAPAARPVLSYVTLGSFSWEQDNEKIRIYVSLEGVEQEKVETTFKPTSVDIKFHDVKGKNYRCAIPKLNKEIVPEKCKVVVKPTRVVVTLFKGSKGNWLDLHFKEDKFKPNMDKEKDPMSGIMDLMKNMYEEGDEDMKRTIAKAWSDARSGKTTDSMSGLR

SEQ ID NO: 691 - protein, 292 aa, Arabidopsis thaliana
MAQSCLKIVRINNLRNRVNRRILILRRFTRLLWSRIVACTPGKSRRYLLLSRALPSPTVSRPSPSPIPAVDVVVGGGGGGGEFVRRSSVVYDNDNSHRRSDSDLVSLKISLLGDPEIGKTSFLAKYVGEEKEVEMRELEKGINCTDKTLYMGGARISYSIWELEGAERSRDQIPVACKDSVAILFMFDLTSRCTLNSVISWYQQARKSNQTAIPVMVGTKFDEFIQLPIDLQWTIASQARTYAKALNATLFFSSASYNINVNKIFKFVTAKLFDLPWTVERNLTIGEPIIDF

SEQ ID NO: 692 - protein, 201 aa, Arabidopsis thaliana
MARNFELSLILFVLYLSTAAIVMARNLEEESSGDTEFIKASCETTSYPDRCFQSLSSYASEIKKQPRKLAETALAVSIARAKSAKTYVSEMTDYKGITKRQHEAVADCLEEMGDTVDRLSNSLKELKHLEEGDSGEDFWFCLSNVRTWTSAALTDETACMDGFGGKAMAGELKSLIRTHIVSVAEETSNALALINDFASKH

SEQ ID NO: 693 - protein, 110 aa, Arabidopsis thaliana
MSSSPLSSSLFHPLSTLSTHCHGRRQNLCFNRKQQPFVVRAAKLPEGVIVPKAQPKSQPAFLGFTQTAEIWNSRACMIGLIGTFIVELILNKGILELIGVEIGKGLDLPL

SEQ ID NO: 694 - protein, 393 aa, Arabidopsis thaliana
MANQSTETNQPSNMQTYGVPIYAADWIPEVDVRSKIIMDPEKSEDDDESSSSSSSSRSCIVLSGGGGEGRSGISNVILICRVDLNTNSLSEQPLGRLVVGSDLPYRMAVHPREGGLICALPNSCKLFHWEDIMSREDNQAGESEEVIKELRDVGQQLALAFNPEGSVLAAGAEDGTLRVFKWPSMNTLLNESQAHSSVKCLTFSESGQFLVSLGGPVCRVWDVNASAAVASLSKEKDEMFASCRFSVDSAGNEVLYIAANTERGGSIITCDTKLWKRKWSKPIKKNSISAFNVSADGKLLAIGTLEGDVLILESTRMQTIQVVKKAHLGLVTALTFSPDSRGLVSVSFDSRARLTMIEQKGDKPGVRWWLLVLLIVLLYVVAYYYMKAKGIIP

SEQ ID NO: 695 - protein, 73 aa, Arabidopsis thaliana
MIEVVLNDRLGKKVRVKCNDDDTIGDLKKLVAAQTGTRAEKIRIQKWYNIYKDHITLKDYEIHDGMGLELYYN

SEQ ID NO: 696 - protein, 181 aa, Arabidopsis thaliana
MPPTNNYRISGEPPSTTPSHPPPKPKTRILSLFLVGVIMFSIFFLFLVLIGIASVLILPLLLSSLHRHHRRRRRNRRQESSDGLSSRFVKKLPQFKFSEPSTYTRYESDCVVCFDGFRQGQWCRNLPGCGHVFHRKCVDTWLLKASTCPICRARVRLWEEDPQEGELWRCFGHRRSSLLDL

SEQ ID NO: 697 - protein, 508 aa, Arabidopsis thaliana
MGTRFQSFLLVFLLSCLILISTASCERNGDGTIRIGLKKRKLDRSNRLASQLFLKNRGSHWSPKHYFRLNDENADMVPLKNYLDAQYYGDITIGTPPQKFTVIFDTGSSNLWIPSTKCYLSVACYFHSKYKASQSSSYRKNGKPASIRYGTGAISGYFSNDDVKVGDIVVKEQEFIEATSEPGITFLLAKFDGILGLGFKEISVGNSTPVWYNMVEKGLVKEPIFSFWLNRNPKDPEGGEIVFGGVDPKHFKGEHTFVPVTHKGYWQFDMGDLQIAGKPTGYCAKGCSAIADSGTSLLTGPSTVITMINHAIGAQGIVSRECKAVVDQYGKTMLNSLLAQEDPKKVCSQIGVCAYDGTQSVSMGIQSVVDDGTSGLLNQAMCSACEMAAVWMESELTQNQTQERILAYAAELCDHIPTQNQQSAVDCGRVSSMPIVTFSIGGRSFDLTPQDYIFKIGEGVESQCTSGFTAMDIAPPRGPLWILGDIFMGPYHTVFDYGKGRVGFAKAA

SEQ ID NO: 698 - protein, 315 aa, Arabidopsis thaliana
MSLLDLPDLTLDCILEKLSPSELCAMTSVCSELRDKCVSDHLWEKHMETKWGRLMGDAAIQEWKSHVATIMRCLTSSSSSSRKSKPNWSSRFVANLKPFAWLSSNHGCENRGSSSYLAPIDSVMYWYSNLENGKFWFPAQVYNRENGHVGFMMSCYDAKIRYDFKTDTFQARYSAHGRRAAEEKVTWQRLRPSQDDTKSRDLHVSDCLHGLRPGDHFEIQWRRTKEFPYGWWFGIVGHLQNCDGVQNCRCDSDENVVMEFRQFRPESPWRRTVIKRKDHRETGNEENGFYGGVKKLGTEEEISTWKQLWPSQALE

SEQ ID NO: 699 - protein, 608 aa, Glycine max
MEQLVNFIIRPPRAEYDPKSDLLDQEFMLKGKWYQRKDVEIKNSRGDVLQCSHYLPIVSPEGKPLPCVIYCHGNSGCRADASEAAIILLPSNITVFTLDFSGSGISGGEHVTLGWNEKDDLKAVVNYLRDDGNVSLIGLWGRSMGAVTSLMYGAEDPSIAGMVLDSPFSDLVDLMMELVDTYKVRLPKFTVKFAIQYMRRAIQKKAKFDITDLNTIKVAKSCFVPALLGHAIDDDFIQPHHSDRIFEAYMGDKNIIKFDGDHNSPRPQFYFDSINIFFHNVLQPPEDEVGESFFDPMNDYFGKDVWRSVHELGYSNESSSKNKDAEPSTSSTINAIEQVRSRRPMSRMEVPSDISSKDEHREHEEKCGNISPSSSSMISFELSNGDPFGSHVPATLEDDQYVEYQLDDLAGFPSTAEEEERMFMEAVMESLKDLEVRNPNAEQPTSSVSSVYVDAVEPSDKDASSGEISRPVETESSSLKHTTESKFKTTSSTSEEFEPLNGESNSISVKHSQNVVSEPSPVPSVSLEGPAHLQLQPPPSAPTDTSSVTESSNTSGSASSDSSASLQSSSETDVSHNTKATVTVVRNPAGHVMDGLMRRWDFNFFKNK

SEQ ID NO: 700 - protein, 280 aa, Arabidopsis thaliana
MSKEVSEEGKTHHGKDYVDPPPAPLLDMGELKSWSFYRALIAEFIATLLFLYVTVATVIGHKKQTGPCDGVGLLGIAWAFGGMIFVLVYCTAGISGGHINPAVTFGLFLARKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKALGSFRSNATN

SEQ ID NO: 701 - protein, 568 aa, Arabidopsis thaliana
LSQEKKKMKESFKVCFCCVRNFKVKSSEPPEEIKNLFHDYSQDDRMSADEMLRFVIQVQGETHADINYVKDIFHRLKHHGVFHPRGIHLEGFYRYLLSDFNSPLPLTREVWQDMNQPLSHYFLYTGHNSYLTGNQLNSNSSIEPIVKALRNGVRVIELDLWPNSSGKEAEVRHGGTLTSREDLQKCLNVVKENAFQVSAYPVVLTLEDHLTPILQKKVAKMVSKTFGGSLFQCTDETTECFPSPESLKNKILISTKPPKEYLQTQISKGSTTDESTRAKKISDAEEQVQEEDEESVAIEYRDLISIHAGNRKGGLKNCLNGDPNRVIRLSMSEQWLETLAKTRGPDLVKFTQRNLLRIFPKTTRFDSSNYDPLVGWIHGAQMVAFNMQSHGRYLWMMQGMFKANGGCGYVKKPDVLLSNGPEGEIFDPCSQNLPIKTTLKVKIYTGEGWNMDFPLDHFDRYSPPDFYAKVGIAGVPLDTASYRTEIDKDEWFPIWDKEFEFPLRVPELSLLCITVKDYDSNTQNDFAGQTCFPLSEVRPGIRAVRLHDRAGEVYKHVRLLMRFVLEPR

SEQ ID NO: 702 - protein, 783 aa, Arabidopsis thaliana
MATLTEIATLEEKYIELCKMHGILPNTAILSAFFEAEVKKSRNQRCIMNLYVDRVKYDDYLPLLELCNEINTSEVQGIDLFVRSACSLEDHYALPLIRSVNQKLRVVHLHDSFGKNFWQDVFFQGLSCKVLNVRSMHIHKLNIVGEFTQLHTLILDKNRIVGFGEDCFSCMPKLTYLSMCDTLVSDLWTSAAALLKLPSLKELRFQIWISCSDSSPLNSESSPSSSTKDDINTFIESDPPVEADMWDVAEQMDPSLPVEETLHSMDFSYKIPEQDDLDSHVSVSAGLNGEVLMREKVRRGKMPYQPKDVSPVDTFTRQFGNVGLKYISSKASPICSEKHYRMYMINSLPKLQVLDNLAIRKSDRDKAIETYSANFEDLPYKRKKESVVRVLENREKRSSKGKSQNSYKRSLCAAKMGSPASPLLHSLPFLSSRIQQEDDNSRLCPRQFEYHPLDPSLMVFGTLDGEVVVLNHESGKIFRYIPSNGSQSTILGLCWLKIYPSMVIAGSANGSLKLYDIQKASSTVTTSSHSTSGSVTFDEFDQLTSVHANSTDQLFLASGYSKDVALYDIGRGTRLQVFANMHQEHINVVKFSNHSPFLFATSSFDKDVKLWDLRQEPSRPCYTASSTKGNVMVCFSPDDRYLLASAVDNEVRQLLTVDGRLHLNFEIVPRVSSMNYTRSYYMNGNDYIISGSCDENVIRVCCAQTGRRLRDVTLEGNGSDFSMMYVQSLRGDPFRDFNMSVLAAYARSSSLSEIVKVNLLASRDSTAEESHGLRSYPSSSMGG

SEQ ID NO: 703 - protein, 477 aa, Arabidopsis thaliana
  misc_feature (259)..(259): Xaa can be any naturally occurring amino acid
  misc_feature (269)..(269): Xaa can be any naturally occurring amino acid
MKKTLSPEPVTIYGNRQETFVGDMEYYTYFDESCIQDMNYFVKTITGIKSKGIRPDLIGSIIAHYASKWLPDLSGNVSAIISSTSLESKNNHNDTQPESVTASVMKKRFFVETLIGILPPEKDSVPCNFLLRLLRTAKMVGANPNYLTELETRVSWQLDQASLKELMIPSFSYTSGTLLDIELVTRLVNKFSGLDSEGVKTAAALVKVAKLVDSYLAEAAVDGGLALPEFISLITALPSHARTTEDGLYRAIDTYLKVXIKLETLKLRXKIKTEFKIWILLQAHPQVLKQERKELCRLIDSRKLSPEAALHAAQNDRLPVRAIIGVLFTEQTKLSRHIDCNSSSISSTTRSPTNASGSHYLEGGSAARCLSKREMNVQQAEIRRLREDVVRLQSQCGAMHFQLERLMEKKSSGGSKGFFRWKRLGLVPSIRGSVSVEKGEEESGDNGEGFEPRTPGNMKTRLVKGRTTPSRWRKSMS

SEQ ID NO: 704 - protein, 1051 aa, Arabidopsis thaliana
MLFFLFFFYLLLSSSSDLVFADRRVLHEPFFPIDSPPPSPPSPPPLPKLPFSSTTPPSSSDPNASPFFPLYPSSPPPPSPASFASFPANISSLIVPHATKSPPNSKKLLIVAISAVSSAALVALLIALLYWRRSKRNQDLNFSDDSKTYTTDSSRRVYPPPPATAPPTRRNAEARSKQRTTTSSTNNNSSEFLYLGTMVNQRGIDEQSLSNNGSSSRKLESPDLQPLPPLMKRSFRLNPDVGSIGEEDEEDEFYSPRGSQSGREPLNRVGLPGQNPRSVNNDTISCSSSSSGSPGRSTFISISPSMSPKRSEPKPPVISTPEPAELTDYRFVRSPSLSLASLSSGLKNSDEVGLNQIFRSPTVTSLTTSPENNKKENSPLSSTSTSPERRPNDTPEAYLRSPSHSSASTSPYRCFQKSPEVLPAFMSNLRQGLQSQLLSSPSNSHGGQGFLKQLDALRSRSPSSSSSSVCSSPEKASHKSPVTSPKLSSRNSQSLSSSPDRDFSHSLDVSPRISNISPQILQSRVPPPPPPPPPLPLWGRRSQVTTKADTISRPPSLTPPSHPFVIPSENLPVTSSPMETPETVCASEAAEETPKPKLKALHWDKVRASSDREMVWDHLRSSSFKLDEEMIETLFVAKSLNNKPNQSQTTPRCVLPSPNQENRVLDPKKAQNIAILLRALNVTIEEVCEALLEGNADTLGTELLESLLKMAPTKEEERKLKAYNDDSPVKLGHAEKFLKAMLDIPFAFKRVDAMLYVANFESEVEYLKKSFETLEAACEELRNSRMFLKLLEAVLKTGNRMNVGTNRGDAHAFKLDTLLKLVDVKGADGKTTLLHFVVQEIIRAEGTRLSGNNTQTDDIKCRKLGLQVVSSLCSELSNVKKAAAMDSEVLSSYVSKLSQGIAKINEAIQVQSTITEESNSQRFSESMKTFLKRAEEEIIRVQAQESVALSLVKEITEYFHGNSAKEEAHPFRIFLVVRDFLGVVDRVCKEVGMINERTMVSSAHKFPVPVNPMMPQPLPGLVGRRQSSSSSSSSSTSSSDEDEHNSISLVS

SEQ ID NO: 705 - protein, 317 aa, Saccharomyces cerevisiae
MLFSWPYPEAPIEGYWGKPTSLIDWCEENYVVSPYIAEWSNTITNSIFLMTAFYSTYSAWRNKLETRYILIGMGFSLVGIGSWLFHMTLQYRYQLLDELPMLYATIIPSWSIFAETQEILIKDEKKRKESSFRIQMVISFIMCGIVTILTWIYVVVQKPAIFQVLYGILTLLVVVLSGWLTYYHVHDSFAKKNLFITMVMGMIPFVIGFICWQLDIHLCSFWIYIRRTYLALPLGVLLELHAWWHLLTGTGVYIFVVYLQYLRILTHGNPNDFLFIWRWGFFPELVRKGLPIGTSYSLEYLGPIVNTQVDDETKKNN

SEQ ID NO: 706 - protein, 399 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMFLSGGQSELEATLNLNAMNQAPNPWHVSFSYARALQNTCLKTWGGKEENVKAAQDILLARAKANSLAQLGKYTGEGESEEAKEGMFVKGYTY

SEQ ID NO: 707 - protein, 658 aa, Saccharomyces cerevisiae
MASSMLSSATMVASPAQATMVAPFNGLKSSAAFPATRKANNDITSITSNGGRVNCMQVWPPIGKKKFETLSYLPDLTDSGGRVNCMQAMALLIDSVPTVAYKDQKPGTSGLRKKTKVFMDEPHYTENFIQATMQSIPNGSEGTTLVVGGDGRFYNDVIMNKIAAVGAANGVRKLVIGQGGLLSTPAASHIIRTYEEKCTGGGIILTASHNPGGPENDLGIKYNLPNGGPAPESVTNAIWEASKKLTHYKIIKNFPKLNLNKLGKNQKYGPLLVDIIDPAKAYVQFLKEIFDFDLIKSFLAKQRKDKGWKLLFDSLNGITGPYGKAIFVDEFGLPAEEVLQNWHPLPDFGGLHPDPNLTYARTLVDRVDREKIAFGAASDGDGDRNMIYGYGPAFVSPGDSVAIIAEYAPEIPYFAKQGIYGLARSFPTSSAIDRVAAKKGLRCYEVPTGWKFFCALFDAKKLSICGEESFGTGSNHIREKDGLWAIIAWLNILAIYHRRNPEKEASIKTIQDEFWNEYGRTFFTRYDYEHIECEQAEKVVALLSEFVSRPNVCGSHFPADESLTVIDCGDFSYRDLDGSISENQGLFVKFSNGTKFVLRLSGTGSSGATIRLYVEKYTDKKENYGQTADVFLKPVINSIVKFLRFKEILGTDEPTVRT

SEQ ID NO: 708 - protein, 412 aa, Bacillus halodurans
MASSMLSSATMVASPAQATMVAPFNGLKSSAAFPATRKANNDITSITSNGGRVNCMQVWPPIGKKKFETLSYLPDLTDSGGRVNCMQAMIQQKQSLLEHKPVLSKELEKLVNHYRTLSLNGQCAQYIPALREANQTYLGLYVVHSNGIEIKSGDWQVPFTLQSISKIINFIAACLDRGITYVLDRVDVEPTGDPFNSMVRLEMRKTGKPFNPMINAGAITVASLLSGKSPTEKLESVYSLVEKMLGRRASANEAVFHSEWQTAHRNRSLAYYLKDTGYLESEVDDALHVYFTLCAIEVATKDIAKIGLILANNGYDPLSHQQIFPKEVAKLTKALMLTCGMYNASGTFAAHIGIPAKSGVSGGIMAAVPARGRSDEAMGIGIYGPAIDDFGNSVAGVALLKHLSHMWDLSIF

SEQ ID NO: 709 - protein, 475 aa, Arabidopsis thaliana
MVEFHELLTVMVSLFLVKIFHWVYQWRNPKTNGKLPPGSMGFPFIGETFEFFKPHDALQFSTFIKDRVLRHGPVFRTSLFGDKAIISMDMELNLEMAKANSVPGVTKSVIRLFGENNLFLQSKESHKHVRNLTFQLLGPQGLKSRMIEDVDLLARTYMEEGARNGYLDVKETSSKILIGCLAKKVMGEMEPEAAKELALCWRYFQSGWFRFFLNLPGTGVYKMMKARKRMMKLLRKTVLTKRASGEELGEFFNIIFGEMEGEGETMSVENAVEYIYTFFLVANETTPRILAATVKFISDHPKVKQELQREHEEIVRGKAEKEGGLTWEDYKSMHFTQMVINESLRIISTAPTVLRVLEHDFQVGDYTIPAGWTFMGYPHIHFNSEKYEDPYAFNPWRWEGKDLGAIVSKTFIPFGAGRRLCVGAEFAKMQMAVFIHHLFRYRWSMKSGTTIIRSFMLMFPGGCDVQISEDTEVDK

SEQ ID NO: 710 - protein, 856 aa, Saccharomyces cerevisiae
MMGDEKLSRHTSLKRARSLSESIKGLFKPSGISGSNNAAAPSSRPGQDQAHSHQTARIITSNVSSPSISPVHSPVLQAAPKHHKLGVPNIAKLSLSPSREPSLNSENEMFSQESFISEKDEDEANLLEREDLQNKKEEKARAKHVRSKEAYVPHHRYTVGSDEVERQPRERLKNFPQNAGSSNPANSNANHVLDQENNFSIDAMLDYDEESKLRRRNSLGVRNHSNRTRSRKNSLSTPRSPPMKNGNGGMNSNATNNVGNGTGNRIYMRGRNHSDSISASSLPKFQEIECKCILDLGHFKVFENGYHEHSLRVLPIITNNKNVDSGDEKDADASVNSGDDGDNDSEANMHKQKSVFSLSGLFKSHKDGNQQQQQQQQQEENGEQINLEKAFSIIPSQRFIKSQTLKKSRTSNLKNGNNDELMKNDGKNIPQIVNPNAAVGVEELKLINALSEKIRKGLKSENTKGNNGEGRSNSNKQEDSDDTEGKAGTTNDDTSHKPCSQKYGKSIGVVGAGAYGVVKICARCKTAKDVLPYSTYSNGKKLFFAVKELKPKPGDQIDKFCTRLTSEFIIGHSLSHPHFEANAMIAGNVSRTTPPKHVFNAPNILKILDLMEYSNSFVEVMEFCASGDLYSLLTRNNISNESNNGSSRLIQTVKEGSGSPLHPLEADCFMKQLLNGVQYMHDHGIAHCDLKPENILFQPNGLLKICDFGTSSVFQTAWEKHVHFQSGAMGSEPYVAPEEFIRDAEYDPRLVDCWSCGIVYCTMVMGQYLWKIAIPEKDSLFKSFLSEIKDDGQFYLFEELRHVSSELNRLRKIALYRTFQVDPTKRITIEQLLQSSWMRKTKCCVVYRHLHTKVSK

SEQ ID NO: 711 - protein, 431 aa, Arabidopsis thaliana
MGLSLRVRRRGGSVSKKEIIPVTSCSEEVEITIPSQFQCPISYELMKDPVIIASGITYDRENIEKWFESGYQTCPVTNTVLTSLEQIPNHTIRRMIQGWCGSSLGGGIERIPTPRVPVTSHQVSEICERLSAATRRGDYAACMEMVTKMTRLGKESERNRKCVKENGAGLVLCVCFDAFSENANASLLLEETVSVLTWMLPIGLEGQSKLTTTSSFNRLVELLRNGDQNAAFLIKELLELNVTHVHALTKINGVQEAFMKSINRDSTCVNSLISIHHMILTNQETVSRFLELDLVNITVEMLVDSENSVCEKALTVLNVICETKEGREKVRRNKLVIPILVKKILKISEKKDLVSVMWKVCKSGDGSEVEEALRLGAFKKLVVMLQVGCGEGTKEKVTELLKMMNKVMKMNGFVDRSYSSSIEFKHVKKPF

SEQ ID NO: 712 - protein, 573 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMGFETLNKSFINGKWTGGESGRTEDILNPYDQSVITTASLATGKQLEDAFDIAQKAQKEWAKSTTEDRKAVLQKARGYLHENRDDIIMMIARETGGTIIKSTIELEQTIAILDEAMTYTGELGGVKEVPSDIEGKTNKIYRLPLGVISSISPFNFPMNLSMRSIAPAIALGNSVVHKPDIQTAISGGTIIAKAFEHAGLPAGVLNVMLTDVKEIGDGMLTNPIPRLISFTGSTAVGRHIGEIAGRAFKRMALELGGNNPFAVLSDADVDRAVDAAIFGKFIHQGQICMIINRIIVHQDVYDEFVEKFTARVKQLPYGDQTDPKTVVGPLINERQIEKALEIIEQAKTDGIELAVEGKRVGNVLTPYVFVGADNNSKIAQTELFAPIATIIKAGSDQEAIDMANDTEYGLSSAVFTSDLEKGEKFALQIDSGMTHVNDQSVNDSPNIAFGGNKASGVGRFGNPWVVEEFTVTKWISIQKQYRKYPF

SEQ ID NO: 713 - protein, 515 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMNQSEMLYSQAKQVIPGGVNSPVRAFNGVGGTPVFIQRADGAYLYDVDGNAYIDYVGSWGPMVLGHNHPAIRNAVIEAAERGLSFGAPTAAEVEMAKRVTELVPSMDMVRMVNSGTEATMSAIRLARGYTGRDKIIKFEGCYHGHADCLLVKAGSGALTIGQPNSPGVPADFAKHTLTCVYNDLNSVREAFEKYPEEIACIIVEPVAGNMNCIPPRPEFLPGLRKLCDEFGALLIIDEVMTGFRVALGGAQEYYNVKPDLTSLGKIIGGGMPVGAFGGRQDIMEKLAPTGPVYQAGTLSGNPIAMAAGLACLNEVAQPGVHPRLSELTDKLASGLKNAASAAGVPLVVNHVGGMFGIFFTDAESVTCYQDVMACDVERFKQFFHLMLDEGVYLAPSAFEAGFMSIAHSDEDIQRTVDAAARCFARLN

SEQ ID NO: 714 - protein, 561 aa, Bacillus subtilis subsp. subtilis str. 168
MKTEQTPWWKKAVVYQIYPKSFNDTTGNGVGDLNGIIEKLDYLKTLQVDVLWLTPIYDSPQHDNGYDIRDYYSIYPEYGTMEDFERLVSEAHKRDLKVVMDLVVNHTSTEHKWFREAISSIDSPYRDFYIWKKPQENGSVPTNWESKFGGSAWELDEASGQYYLHLFDVTQADLNWENEEVRKHVYDMMHFWFEKGIDGFRLDVINLISKDQRFPNAEEGDGRSFYTDGPRVHEFLHEMNEKVFSHYDSMTVGEMSSTTVDHCIRYTNPDNKELDMTFSFHHLKVDYPNGEKWALAPFDFLKLKEILSDWQTGMHAGGGWNALFWCNHDQPRVVSRYGDDGAYRVKSAKMLATAIHMMQGTPYIYQGEELGMTNPKFTDISSYRDVESLNMYHAFKEKGMADQDITAILQAKSRDNSRTPVQWDATENGGFTTGTPWIPVAGNYREINAEAALRDQNSVFYHYQKLIQIRKMYDIVTEGTYEIIAKDDPNIFAYLRHGSNEKLLVINNFYGTEAAFTLPDSLAPDEWKAEVLLTNDEAREGLQNMTLRPYESIVYRLTKPC

SEQ ID NO: 715 - protein, 151 aa, Arabidopsis thaliana
MASLLDKAKDFVADKLTAIPKPEGSVTDVDLKDVNRDSVEYLAKVSVTNPYSHSIPICEISFTFHSAGREIGKGKIPDPGSLKAKDMTALDIPVVVPYSILFNLARDVGVDWDIDYELQIGLTIDLPVVGEFTIPISSKGEIKLPTFKDFF

SEQ ID NO: 716 - protein, 202 aa, Arabidopsis thaliana
MNPEYDYLFKLLLIGDSGVGKSCLLLRFADDSYLDSYISTIGVDFKIRTVEQDGKTIKLQIWDTAGQERFRTITSSYYRGAHGIIVTYDVTDLESFNNVKQWLNEIDRYASENVNKLLVGNKCDLTSQKVVSTETAKAFADELGIPFLETSAKNATNVEEAFMAMTAAIKTRMASQPAGGSKPPTVQIRGQPVNQQSGCCSS

SEQ ID NO: 717 - protein, 86 aa, Arabidopsis thaliana
MGNETKTNGGPASMAGGGGFRAKMEHYVYSGEKKHVLVGIGIVTIIFGVPWYLMTQGSKHQSHQDYMDKADKARKARLSSSSSANK

SEQ ID NO: 718 - protein, 277 aa, Zea mays
MPYAKGMQIEVSKLEDNSVVAWSPAVVAKIIWKNNLLVDYTLSKCYGTTLSEEIVDVKHVRPRPPQASEISFCINDEVEAFQGDCWWLGVITNVLPEFKYTFKSTHLGTEVEVNQKFLRLRYDWVGDQWEQESKNVPKAKFTQGVKVEVCSDDEGFRGAWFEATVVKAVGSKFLVEYATLKADDGTKPLKESVEARHIRPCPPDIPATDGFKLLDEVDAFCNDAWWVGVVSKVLGEKRCTVYFRPWKEEMEFEHAQLRLHCDWMGGRWMRASPALEM

SEQ ID NO: 719 - protein, 477 aa, Glycine max
MWSSTSSTAAIPSDEEPSESSSSSSFSTSLFNFSSGNPRIEETRGLMHLFPDDTPSTLPVGRKPLVCVVGVPNHMTYADFCQFCGSFIQHMLEMRIVRMDGMEDQYSVLVRFDDQDSTDSFYKHYNGRRFSSLEVEVCRVLFTLDVQYTGSIEHAQPSNATSTELPTCPVCLERLDQDTGGILTTICNHSFHCSCISKWADSSCPVCRYCQQQAEKSICFVCQTTENLWICVICGYVGCGRYKGGHAIIHWKETQHCYSLEVETKRVWDYVGDNYVHRLIQSKTDGKLIELNTQCAHADNGCGSCSCEDNAMNEAILNSKVEAIVNEYNELLATQLENQKLYFESLLQEVKEESERKISKAVQKAISLKQQKIQSKIDRCKKEKKFLDDLNENLVKNEDIWKTKILAIEEREKKTTRLMGDRVADLEMQLGDLMVCLEGGRTVEQLAASDEIKEGIILDKSIESSTTSGSDLVGRDA

SEQ ID NO: 720 - protein, 323 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMVDFQDTWALLHPAIAVVVVFPLLGIVLNRALLTRERRLAMKVGEKSKIPPIVGTEHVAIGRYLSMAVVGVTFLGLAYPIFSKFINKNLISEEPFRVLFIIALFILSITSFIFLFQAKTRIWRGIFATLTGMGLVLLGCQPEIYRRDHEWLVSHFYYGILAALLMIFSVATIQDIYQDRRNRWRNAHIIINSFALLLFIGQGITGARDLLEIPLHWQKPYIYQCDSVGKTCPQFK

SEQ ID NO: 721 - protein, 325 aa, Nostoc sp. PCC 7120
MSNPRVLCLGEVLFDCLADQLGLKLEQVKSWTAYPGGAPANVACALVKLGTPAGFIGAVGEDEPGNVLVKLLQEVGVDTTGVQRHSTAPTRQVYVVRDLAGDRTFAGFGQYDTSEFADTHLQAKQLPESVFQEADFLILGTLELAYPDSEKAIHRALELAEQYDLKIVLDVNWRPVFWHDENIARQKIQEIFKRVDFLKLAKEEAEWLFDTSDPGAITYRLGSIEGVLVTDGENGCGYCLGENEGKIPAFAVSVVDTTGAGDSFLAGFIHQLSEHGIHNLNDAETAKRIITYASAVGALTTTKAGAIASQPTAMEVETFLASNKI

SEQ ID NO: 722 - protein, 441 aa, Arabidopsis thaliana
MERDEEASGPMMEMCTNGGEETSNRRPIISGEPLDIEAYAALYKGRTKIMRLLFIANHCGGNHALQFDALRMAYDEIKKGENTQLFREVVNKIGNRLGEKYGMDLAWCEAVDRRAEQKKVKLENELSSYRTNLIKESIRMGYNDFGDFYYACGMLGDAFKNYIRTRDYCTTTKHIIHMCMNAILVSIEMGQFTHVTSYVNKAEQNPETLEPMVNAKLRCASGLAHLELKKYKLAARKFLDVNPELGNSYNEVIAPQDIATYGGLCALASFDRSELKQKVIDNINFRNFLELVPDVRELINDFYSSRYASCLEYLASLKSNLLLDIHLHDHVDTLYDQIRKKALIQYTLPFVSVDLSRMADAFKTSVSGLEKELEALITDNQIQARIDSHNKILYARHADQRNATFQKVLQMGNEFDRDVRAMLLRANLLKHEYHARSARKL

SEQ ID NO: 723 - protein, 476 aa, Arabidopsis thaliana
MDLLFLFFSLLLSYLFFKIWKLIDSKQDKDCYILDYQCHKPTDDRMVSTQFSGEIIYRNQNLGLTEYKFLLKAIVSSGIGEQTYAPRLVFEGREERPSLQDGISEMEEFYVDSIGKLLERNQISPKDIDILVVNVSMLSSTPSLASRIINHYKMRDDVKVFNLTGMGCSASLISVDIVKNIFKSYANKLALVATSESLSPNWYSGNNRSMILANCLFRSGGCAILLTNKRSLRKKAMFKLKCMVRTHHGAREESYNCCIQAEDEQGRVGFYLGKNLPKAATRAFVENLKVITPKILPVTELIRFMLKLLIKKIKIRQNPSKGSTNLPPGTPLKAGINFKTGIEHFCIHTGGKAVIDGIGHSLDLNEYDIEPARMTLHRFGNTSASSLWYVLAYMEAKKRLKRGDRVFMISFGAGFKCNSCVWEVVRDLTGGESKGNVWNHCIDDYPPKSILNPYLEKFGWIQDEDPDTFKVPDAFM

SEQ ID NO: 724 - protein, 575 aa, Arabidopsis thaliana
MALNLSHQLGVLAGTPIKSGEMTDSSLLSISPPSARMMTPKAMNRNYKAHGTDPSPPMSPILGATRADLSVACKAFAVENGIGTIEEQRTYREGGIGGKKEGGGGVPVFVMMPLDSVTMGNTVNRRKAMKASLQALKSAGVEGIMIDVWWGLVEKESPGTYNWGGYNELLELAKKLGLKVQAVMSFHQCGGNVGDSVTIPLPQWVVEEVDKDPDLAYTDQWGRRNHEYISLGADTLPVLKGRTPVQCYADFMRAFRDNFKHLLGETIVEIQVGMGPAGELRYPSYPEQEGTWKFPGIGAFQCYDKYSLSSLKAAAETYGKPEWGSTGPTDAGHYNNWPEDTQFFKKEGGGWNSEYGDFFLSWYSQMLLDHGERILSSAKSIFENMGVKISVKIAGIHWHYGTRSHAPELTAGYYNTRFRDGYLPIAQMLARHNAIFNFTCIEMRDHEQPQDALCAPEKLVNQVALATLAAEVPLAGENALPRYDDYAHEQILKASALNLDQNNEGEPREMCAFTYLRMNPELFQADNWGKFVAFVKKMGEGRDSHRCREEVEREAEHFVHVTQPLVQEAAVALTH

SEQ ID NO: 725 - protein, 139 aa, Arabidopsis thaliana
MKIVKANAGALTNFEVLDFLNSRGASKDTTRVIAPIARSEYKVYDYLVETAASTQTRESINKFADKCKDFKLAKAEILNIINLRPSSIVELLPIIENLDDREIDTDGILELVKDLLPPLPTTASPKDDDEEETENGEQS

SEQ ID NO: 726 - protein, 312 aa, Arabidopsis thaliana
MGNCLKHFKQQLPSIAPKPLIIPPIFSARKRESESLQIRGLKKATKKFRQDRVVECEDYSVRKFYKGYIDETTFAPSRAGTGIAVSVMECDSSRSLQDWMAVVRSLGQLSHQNLVNFLGYCCEDNKPFFLVFEYSHKGSLDSHIFGKEEEALPWEIRVKIAIGTAQGLAFLHSIKNSPLNRELRMHNIMLDEVQYNAKTVLSRTNQTKLGILDMTTDVYIFGMILLELLMGSKDRKKIKEEQGLVDYWTSSFLPDNYKIEEIIDPRLGSDYSANAATQMGTLINRCTAHNTKKRPLMQQVLDGLNHIAEIKD

SEQ ID NO: 727 - protein, 345 aa, Arabidopsis thaliana
MSNSESYPPEFRPLMSEKSTETGLDRSKDIDIPVIDMEHLDMEKLREACKDWGIFHLENTGIPLTFMSQVKEITESVLSLPFEEKRTLFGVNSPLSYYWGTHTVSPSGKAVTRAPQESSGHLFEGINIPLASLSRLLALSCTDPKLESFRSQYYQLSLCDELRRVVMEEYGKHVTRIIVTLFEAIIETLSLELSGDQKMGYLSESTGVIRVQRYPQCTESPGLEAHTDSSVISIINQDDVGGLEFMKDGEWFNVKPLASSFVVGLGDMMQVISDEEYKSVLHKVGKRMRKKERYSIVNFVFPDKDCMFNSTRYKPFKFSEFEAQVKLDVETHGSKVGLSRFLSNP

SEQ ID NO: 728 - protein, 295 aa, Zea mays
MDVSRKKKWVAWAVAAAIFVVLMLVTPAIPQDEAYHDFADQRTLFLGIPNTLNVISNIPFFFVGVTGLILCHFNNYFRLSSQGELWSWTLFFAGVTAVGFGSSYYHLNPNDATLVWDRLPMTIAFTSVMAIFIIERVDDRAGAKSLAPLVIAGALSIMYWRHFDDLRPYAVVQFVPCIALPVMAIVIPPMYTHSSYWLWAAGFYLLAKVEEAADKTIYNWTHQIVSGHTLKHLCAAMVPVFLALMLAKRTTEPERISLLQKWKTSWVAVRERRFKDSSTVDVDCGYAVVSSISEQ

SEQ ID NO: 729 - protein, 386 aa, Zea mays
MAKETEYYDVLGVCPAASDEEIRKAYYIKARQVHPDKNPNDPHAAENFQALGEAYQVLSDPLQRKAYDGYGKNSVSRENILDGTVVFTLLFGSELFEDYIGHLAMATMASSELTSDNDTPEKLQDRLKNVQREREEKLARFLKEFLSQYVRGDKEGFANRAEAEAKKLSCTSSGLDILRTIGYVYSRQAAKELGKKAMYLGVPFVAEWVRNKGHLWKSQITAAKGALQLLQLQEEACRQSSKDGNATEQDVDLQMRMNKDLMMSSLWKLNVVDIEMTLLHVCEMVLSENNVKKDDLKARATALKFLGKIFMREKEALPGPAPAPGPSGPSKRTVLDDDSSSDDSSDDDLTRTAPYRTPAFTQGIGRLFRCLCNPAYDVDDDFEPHK

SEQ ID NO: 730 - protein, 392 aa, Arabidopsis thaliana
MKYIRSNSLKRLFSFKRRSFDSDSSENSSPLAASSTKCVEGFQETDQFQRPKWKCFSFQEIYDATNGFSSENLVGRGGFAEVYKGILGKNGEEIAVKRITRGGRDDERREKEFLMEIGTIGHVSHPNVLSLLGCCIDNGLYLVFIFSSRGSLASLLHDLNQAPLEWETRYKIAIGTAKGLHYLHKGCQRRIIHRDIKSSNVLLNQDFEPQISDFGLAKWLPSQWSHHSIAPIEGTFGHLAPEYYTHGIVDEKTDVFAFGVFLLELISGKKPVDASHQSLHSWAKLIIKDGEIEKLVDPRIGEEFDLQQLHRIAFAASLCIRSSSLCRPSMIEVLEVLQGEDIEKEKWKMEEEEEVKEEFWGYEDLEDCECDSSISLSPPDSISNRSSSHRSR

SEQ ID NO: 731 - protein, 168 aa, Arabidopsis thaliana
MELLSRALFFFLLLSVLSSFSSSSFISDGVFESQSLVLGRNLLQTKKTCPVNFEFMNYTIITSKCKGPKYPPKECCGAFKDFACPYTDQLNDLSSDCATTMFSYINLYGKYPPGLFANQCKEGKEGLECPAGSQLPPETSAEVNAATTSSSRLWLTVSAALLVFVKLF

SEQ ID NO: 732 - protein, 305 aa, Arabidopsis thaliana
MDHEEIPSTPSTPATTPGTPGAPLFGGFEGKRNGHNGRYTPKSLLKSCKCFSVDNEWALEDGRLPPVTCSLPPPNVSLYRKLGAEFVGTLILIFAGTATAIVNQKTDGAETLIGCAASAGLAVMIVILSTGHISGAHLNPAVTIAFAALKHFPWKHVPVYIGAQVMASVSAAFALKAVFEPTMSGGVTVPTVGLSQAFALEFIISFNLMFVVTAVATDTRAVGELAGIAVGATVMLNILIAGPATSASMNPVRTLGPAIAANNYRAIWVYLTAPILGALIGAGTYTIVKLPEEDEAPKERRSFRR

SEQ ID NO: 733 - protein, 381 aa, Arabidopsis thaliana
MEAKIVKVSDSSYKDGLGKKRKHPGNYTPYDSGRSYAKLQWVLSPNSSTQKLEKRRNLDGENKVIVSENHVEKSLVRYFSYYKKTGVPKRVMFHENGEWIDLPDHILCDIRNDLEAKRATIEFNWCGRHFLLDFLHMYRLDLETGVKTQLAWIDIAGKCFFPETFDTLERDGCHHIRGEDPEQHDQREIKLHIEIDVNSGELPRLNLNVVTDESGDNMDDFQAVQRSSNGPNDEASEDSCSRELDDAVEKWDKTETDRFSGVKPAEEELDKDAVKQMFALGAATLGHVESLDVYQFSSEIAKARLSLFQKQADITKKHRGDANIRYAWVPAKKEVLSAVMMHGLGVGGAFIKKSMYGVGVHAANCPYFRFLFALYASSSLI

SEQ ID NO: 734 - protein, 467 aa, Xanthomonas campestris
MSDVLPIILSGGSGTRLWPLSRESYPKQFLPLVGEHSMLQATWLRSAPVAAHAPIVVANEEHRFMAAEQLQQLGVKPSAILLEPKGRNTAPAIAVAALEATRNGGDPLLLVLPSDHVIRDEAAFQAAVTVAAAAAEQGKLVTFGIKPTAPETGYGYIKAGVGTGATAVERFVEKPDLATAQGYLASGEYYWNSGMFLFRASRYLEELRKFQPAIADACQKAWEGGKRDADFTRLDKDAFASSPSDSIDYAVMEKTADAVVVPLDAGWNDVGSWSSLLDVSEQDGQGNAHHGDVIQLDCKNTYAYGSRLIAMVGLENVVVVETDDAVLVGHRDRIQEVKEVVSQIKSAGRSEATWHRKVYRPWGAYDSIDMGQRFQVKRITVKPGATLSLQMHHHRAEHWIVVSGTAEVTRGEEVLLLTENQSTYIPLGVTHRLKNPGKLPLELIEVQSGSYLGEDDIVRFEDTYGRT

SEQ ID NO: 735 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 736 - protein, 124 aa, Arabidopsis thaliana
MEEEEARQVVIDNDLKKKIKETVKKILKRSSLLEITEIKAREEASSELNLDLSRDPYKIIVREAVDSFIEKAIMTIDTEMGKLHTQIVEDVDGEVTENATKTTTKKKKKKKAKKKVEEEESSPA

SEQ ID NO: 737 - protein, 166 aa, Arabidopsis thaliana
MAFVTTAEVCDANQELIRSGQLRALQPIFQIYGRRQIFSGPVVTVKVFEDNGLIRQFIEEKGNGRVLVVDGGGSQRCAILGGNPVVQAQNNGWAGIVVNGCIRDVDEINGCDIGVRALASHPIKASKKGLGEQRVPVNIAGTRICDGEWLYADTDGILVSQIELSV

SEQ ID NO: 738 - protein, 522 aa, Arabidopsis thaliana
MPAGGFVVGDGQKAYPGKLTPFVLFTCVVAAMGGLIFGYDIGISGGVTSMPSFLKRFFPSVYRKQQEDASTNQYCQYDSPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVAATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFVYIFLPETKGIPIEEMGQVWRSHWYWSRFVEDGEYGNALEMGKNSNQAGTKHV

SEQ ID NO: 739 - protein, 204 aa, Arabidopsis thaliana
MEKSNDHDKASHGGSGGGATEKWEETSLGIRTAETMLRLAPVGLCVAALVVMLKDSETNEFGSISYSNLTAFRYLVHANGICAGYSLLSAAIAAMPRSSSTMPRVWTFFCLDQLLTYLVLAAGAVSAEVLYLAYNGDSAITWSDACSSYGGFCHRATASVIITFFVVCFYIVLSLISSYKLFTRFDPPSIVDSAKNLEVAVFGS

SEQ ID NO: 740 - protein, 273 aa, Arabidopsis thaliana
MSSPDIVGILENTKELDRLRKDQEEVLVEINKMHKKLQASPEIVEKPGDISLAKLKNLYIQAKELSENEVTVSNILLTQLDLLLPYGPTGQQRRKLGVVAEGNDQKRKRMKVDSDVIRLSPSMRNQIEAYASLKGEQVAARVTAESADKDEWFVVKVIHFDRETKEVEVLDEEPGDDEEGSGQRTYKLPMLCILPFPKRNDPSNTQEFPPGKHVLAVYPGTTALYKATVVSTPRKRKSDEYLLEFDDDEEDGALPQRTVPFHKVVALPEGHRQ

SEQ ID NO: 741 - protein, 340 aa, Arabidopsis thaliana
MSSTQEASVTDLPVKRPREAEEDNNGGAMETENGGGEIKEPSCMSSIIPGWFSEISPMWPGEAHSLKVEKILFQGKSDYQDVIVFQSATYGKVLVLDGVIQLTERDECAYQEMITHLPLCSISNPKKVLVIGGGDGGVLREVARHSSVEQIDICEIDKMVVDVAKQYFPNVAVGYEDPRVNLIIGDGVAFLKNAAEGTYDAVIVDSSDPIGPAKELFEKPFFESVNRALRPGGVVCTQAESLWLHMDIIEDIVSNCRDIFKGSVNYAWTSVPTYPSGVIGFMLCSSEGPQVDFKKPVSLIDTDESSIKSHCPLKYYNAEIHSAAFCLPSFAKKVIDSKAN

SEQ ID NO: 742 - protein, 514 aa, Arabidopsis thaliana
MKMMMMIILLLCSIILITILFFKKQSRGKKSNAPPSPPRLPLIRNLHQLGRHPHRSLCSLSHRYGPLMLLHFGSVPVLVVSSADAAKDVLKTHDRVFASRPRSKIFDKIFYNGRDVALAPYGEYWRQMKSVCVLHLFSNKMVRSFRDVRQEEISLMIEKIRISSSLRINLSEILVNLTNNVICRVALGRKYGGKTDFKDLMKRLTRLLGEFSVGSYVSWLAWIDWIRGLDGQLIKISNDLDEFLERVVQDHVDGDGHKNDFVDFLLTIEREKSVGFEIDRLSIKAIILVKGRYENKFKFTDELVYNHSSCFGFQDVFVGDMDTTYTLLEWAMTELLCHHECLDRLQEEVRMVCKDKSGVSEDDLQDMKYLKAVIKETLRLHPPLPLMVPHESTHDVKLRDYHIPAGTHVMINAWAIGREAATWGPDAEEFRPERHLNSYVDYRGQDTELVPFGAGRRICPAISFAVVLDEVVLANLVHQFDWTLPEESTEYQTDVAESTGMAVHRMFPLFAMTT

SEQ ID NO: 743 - protein, 1026 aa, Arabidopsis thaliana
MPSMLVLVGTMPSLASLVSLGGACASVSGTSSSDASYALVKRVSLSRRSVKGTKKWLCRYSVSSSTTTTTADFIADQNNNSVSIDSNSFRGSKDGDDSEVVLKQTPKPVLKPPVARVERGLGVNTAPWSKDLSNGGKFDGEEERNKVIESLGEVLDKAEKLEIPKPGNKEGGEAVKPSQPSANSSNSRNGSYANASDGGTRKTKTMKSVWRKGDAVAAVQKVVKESPKIFNRGVQTEPRTREEGEVNAKAGTPLAPPQPPFRPQPPVRPQPMLQGKPMVAPPVKKSPILKDLGMAAKPLVSEEVDSSVKSKERKPILVDKFASKKKGVDPAASQAVLAPTKPGKGPPSNKFRVEHRNKKNASASPRRRIVAEDDGDDDASISRSGRKGRKWSKASRKAVRLQAAKDAAPVKAEILEVEEEGMSIEDLAYNLAIGEGDILGYLYSKGIRPDGVHTLDREMVKMICRDYDVEVLDADSVKVEEMAKKRQTFDEEDLDKLEDRPPVITIMGHVDHGKTTLLDYIRKSKVAASEAGGITQGIGAYKVSVPVDGKLQSCVFLDTPGHEAFGAMRARGARVTDIAIIVVAADDGIRPQTNEAIAHAKAAAVPIVIAINKIDKEGASPDRVMQELSSIGLMPEDWGGDVPMVQISALKGENVDDLLETVMLVAELQELKANPHRNAKGIVIEAGLDKAKGPFATFIVQKGTLKRGDVVVCGEAFGKVRALFDHSGERVDEAGPSIPVQVIGLNNVPIAGDEFEIVSSLDVAREMAEARAVSLRDERISAKAGDGKVTLSSLASAVSAKKMSGLDLHQLNIILKVDVQGSIEAVRQALQVLPQENVTLKFLLQATGDVSNSDVDLASASEAIVFGFNVKASGSVKKAAENKGVEIRLYRVIYELIDDVRNAMEGLLESVEEQIPIGSAEVRATFSSGSGRVAGCMVNEGKFVKDCGIRVVRKGKTVHVGVLDSLKRVKENVKEVSAGLECGIGMDDYDDWIEGDIIEAFNAVQKRRTLEEASASMSAAIEEAGV

SEQ ID NO: 744 - protein, 283 aa, Arabidopsis thaliana
MYKDRSGGGIMGGGGSSRSEILGGAIDRKRINDALDKHLKKSSPSTSRVFTSKDKDSVPSTSTAKSQLHSRSPDVESDTDSEGSDVSGSEGDDTSWISWFCNLRGNEFFCEVDEDYIQDDFNLCGLSGQVPYYDYALDLILDVESSNGDMFTEEQHEMVESAAEMLYGLIHVRYILTTKGMAAMMEKYKNYDFGRCPRVFCCGQSCLPVGQSDIPRSSTVKIYCPKCEDIYYPRSKYQGNIDGAYFGTTFPHLFLMAYGNMKPQKPAQNYVPKIFGFKVHNKQ

SEQ ID NO: 745 - protein, 491 aa, Arabidopsis thaliana
METQTHVLFLFLLITLLLNTTNKTQARQHKNPSSSSSSFLVLTLTKSSVSLPTPKSQTQERIKKPLSSVDVVMEPLREVRDGYLITLNIGTPPQAVQVYLDTGSDLTWVPCGNLSFDCIECYDLKNNDLKSPSVFSPLHSSTSFRDSCASSFCVEIHSSDNPFDPCAVAGCSVSMLLKSTCVRPCPSFAYTYGEGGLISGILTRDILKARTRDVPRFSFGCVTSTYREPIGIAGFGRGLLSLPSQLGFLEKGFSHCFLPFKFVNNPNISSPLILGASALSINLTDSLQFTPMLNTPMYPNSYYIGLESITIGTNITPTQVPLTLRQFDSQGNGGMLVDSGTTYTHLPEPFYSQLLTTLQSTITYPRATETESRTGFDLCYKVPCPNNNLTSLENDVMMIFPSITFHFLNNATLLLPQGNSFYAMSAPSDGSVVQCLLFQNMEDGDYGPAGVFGSFQQQNVKVVYDLEKERIGFQAMDCVLEAASHGLNQGS

SEQ ID NO: 746 - protein, 392 aa, Arabidopsis thaliana
MEETRGISDPENGSSSYGGKPPNPLSFSSSSAAAAVYRQTFDGERSLAPCNKRSLVRHSSLVKTMVSDISVENEFTIEKNKSEFVPATRSGAWSDIGSRSSMEDAYLCVDNFMDSFGLLNSEAGPSAFYGVFDGHGGKHAAEFACHHIPRYIVEDQEFPSEINKVLSSAFLQTDTAFLEACSLDGSLASGTTALAAILFGRSLVVANAGDCRAVLSRQGKAIEMSRDHKPMSSKERRRIEASGGHVFDGYLNGQLNVARALGDFHMEGMKKKKDGSDCGPLIAEPELMTTKLTEEDEFLIIGCDGVWDVFMSQNAVDFARRRLQEHNDPVMCSKELVEEALKRKSADNVTAVVVCLQPQPPPNLVAPRLRVHRSFSAEGLKDLQSYLDGLGN

SEQ ID NO: 747 - protein, 508 aa, Arabidopsis thaliana
MASVSLLDVAIAIICLFFFYYMYFKKPHGQVFRNWPVIGMLPGFLMVLHRIYNFGVEALEMSHLTFLFKGPWFAEMDMLFTVDPANIHYILSSNFSNYTKGADFKEVFDVFGEMIFSSDSELWKNQRKAAQFMLNHQGFQKLSLSATRSKLYDGLVPLFNQCCEEEKVVDLQQVFQRFTFDTTFFIVTGFDPKSLSIEMPEVEYAKALDDLGEGIFYRHIKPKFFWKLQNRFGLGQEKRMTEADATFDRVSAKYILAKREEIRSQGIDHHANGESEDLLTSHIKLDTTKYELLNPSDDKFLRDTILAFNLAGRDTTSSALSWFFWLLSENPQVVTKIRKEIIDKNISKDGRNGQENLDKLVYLHAALYESMRLYPPVAFQRKSPIKPDVLPSGHKVEANSVIIIFLFALGRMRAVWGEDATEFKPERWVSESGGLRHAPSFKFLSFNAGPRTCPGKQLAMTLMKTVVVEILQNYDIDVIKGQKIEPEPGLMLHMKHGLRVTITKRCSA

SEQ ID NO: 748 - protein, 250 aa, Arabidopsis thaliana
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITVITGVFYWIAQLLGSTAACFLLKYVTGGLAVPTHSVAAGLGSIEGVVMEIIITFALVYTVYATAADPKKGSLGTIAPLAIGLIVGANILAAGPFSGGSMNPARSFGPAVAAGDFSGHWVYWVGPLIGGGLAGLIYGNVFMGSSEHVPLASADF

SEQ ID NO: 749 - protein, 516 aa, Pseudomonas fluorescens PfO-1
KKAGSCRTMTTTPKPLVLMILDGFGHSDSPESNAVYAAKKPVLDRLWATVPNGLISGSGMDVGLPDGQMGNSEVGHMNLGAGRVVYQDFTRVTKAIRDGEFFENPTICAAVDKAVAAGKAVHFMGLLSDGGVHSHQDHLIAMAELAFKRGAEKIYLHAFLDGRDTPPKSAASSIELLDATFQALGKGRIASLIGRYYAMDRDNRWDRVAQAYNLIVDGKGEINAATAQEGLEAAYARGESDEFVKATSIGEPVKVEDGDAVVFMNFRADRARELSRVFVEDGFKEFERARQPKVQYVGLTQYAESIPAPAAFAPGSLENVLGDYLAKNGKTQLRIAETEKYAHVTFFFSGGREEPFPGEERILIPSPKVATYDLQPEMSAPEVTDRIVEAIENQRYDVIVVNYANGDMVGHSGVFEAAVKAVECLDTCVGRIVEALEKVGGEALITADHGNVEQMADESTGQAHTAHTTEPVPFIYVGKRDLKVREGGVLADVAPTMLKLLGLEKPAEMTGTSILV

SEQ ID NO: 750 - protein, 1035 aa, Sinorhizobium meliloti
  misc_feature (206)..(206): Xaa can be any naturally occurring amino acid
MMEAVPMNVDLSRRSFLKLAGAGAAATSLGAMGFGEAEAAVVAHVRPHKLTTTTETRNTCPYCSVACGVIIYSKGDLRKGEAADIIHIEGDADHPTNRGTLCPKGAALKDFVKSPTRLQYPMHRKPGSDKFERISWEDAFDRIARLMKDDRDANFIAANAAGVPVNRWTTVGMLAASATTNETAWATFKFAKALGIVGFDNQARVXHGPTVSSLGPTFGRGAMTNSWTDIKNTDLVVVMGGNAAEAHPCGFKWVTEAKATRGAKLIVVDPRYTRTASVSDYYAPIRQGTDIAFLNGVMKYCIDNDKVQWDYMKAFTNASYLVKDGFGYQDGLFTGYDAEKRDYDKSTWDYVLGDDGFVVTDPALQHPRCVWNLLKAHLAPYTPEMVERICGTPKDKFLKVAEMISECSSPTKTMTSMYALGWTQHSSGSQNIRAMAMLQLILGNIGVRGGGMNALRGHSNIQGLTDLGLMSHLLTGYLTMPTEKDVDFTTYMSTRQFKPLRPGQTSYWQNYRKFMVSFQKAMWGDAARIDNDWAFNYLSKLDVPAYDVLRVFELMYAGKVNGYICQGFNPLLAFPNRDKNTKALSNLKWLVTMDPLDTETARFWENHGDFNPVDTASIQTEVFQLPTTCFAEEEGSLTNSGRWLQWHWAGGTPPGEAKHDTYIVAQIFLRMKEMYRNEGGAFPDPILNLSWDYADPNEPTPEELAKEINGRALTDLMDPANPMKVQVAAGKQILNFSQLRDDGSTMCGCWIYSGNFNEQGNNMARRDNHDPDDTGAYLGWSFAWPLNRRTLYNRASADLQGKPWDPSRKLLEWDGTKWAGYDVPDIAPTAKPDEIGPFIMNQEGTARLFSRGLMRDGPFPAHMEPFESPVANVFNPKMRGNPVSRVFQTDVAQMGLSDEFPYAATSYRLTEHFHYWTKHNRVNSALQPEFFVEISEELAEEKNIENGGWVRVWSKRGSVKAKAVVTKRIRPLMCDGKPVHVVGIPLHWGFTGSAKKGLGPNSLAPFVGDANIETPEYKAFLVNIEPSTAPEEATV

SEQ ID NO: 751 - protein, 114 aa, Arabidopsis thaliana
EFFFFYKYYSRRRYIVITKASQRAYTIGSSQEKPSWASDPDTGYFRPETAAKELDPYIAKTSQVQGKMMRGEELWWMPDPQTGYYRPDNFARELDAVELRSLHFNKNQKTYVVS

SEQ ID NO: 752 - protein, 709 aa, Nostoc punctiforme PCC 73102
MYVAVWPGNVYPLGANWDGKGTNFALFSENATGVELCLFDADNHEIRLPLTEKNNFVWHAYLPGVGPGQRYGFRVHGPWAPELGHRFNPNKLLIDPYAKAIDGEISDTAAIFGYSLDAPEQDLAFSDLDNAEIMPKCIVVDQSFDWGDDKLLSIPWHETIIYETHVRGFTKLHPEIPEELRGTYAGLAHPVAIQYLQQLGITSVELMPVHHFLSSPGFLVNKGLKNYWGYDSINYFTPYSGYSANGSVGQQVTEFKQMVKDLHSAGIEVILDVVYNHTGEGNHLGPTLSLRGIDNAVYYRLVKDNSRYYMDFTGCGNSLNVRHAQVLKLIMDSLRYWVTEMHIDGFRFDLASALARELYEVDSLAAFFDIIHQDPVLADVKLIAEPWDLGEGGYQVGNFPLRWSEWNGRYRDTVRDFWRGEDDSLGQFAYCFTGSPDLYQANGRNPSASINFITAHDGFTLNDLVSYNEKHNQDNGEDSRDGESHNRSWNCGVEGETNDPDVIRLRQRQRRNFLATLMLSQGIPMLLGGDEIGCTQKGNNNVYCQDNEIAWRDWSLQKSNSELLDFARELIYFRHQHPVFRRRKWFQGRPIHGFGISDIGWFNDDGSEMTEKQWLVSYAKAMEIFLNGEGIVTPGRRGERIIDESFLLFFNAHYETIEFALPNVFQDREWEIVIDTNEPRFLSPGKLVMGEQTVPVTDRSLIVLRRLAS

SEQ ID NO: 753 - protein, 447 aa, Arabidopsis thaliana
MAGSEAVEDKEIKSAVSSCEAYFEKVQSRKNLPKSLQETLNSAFAGIPVSSFPQVPGGRVIEIQAETPVSEAVKILSDSKILSAPVINTDHESSLDWRERYLGIIDYSSIILWVLESAELAAIALSATSATAAGVGAGAVGALGVAALGMTGPVAAAGLAAAAVGAAVAGGVAAERGIGKDAPTAADKLGKDFYEVILQEEPFKSTTVRTILKSFRWAPFLPVSTESSMLSVMLLLSKYRLRNVPVIKTGEPDIKNYVTQSAVVHGLEGCKGRDWFDHISALPISDLGLPFMSPNEVISIESEELILEAFKRMRDNNIGGLPVVEGLNKKIVGNISMRDIRYLLLQPEVFSNFRQLTVKSFATKIATAGEEYGLAIPAITCRPDSTLGSVINSLASRSVHRVYVAAGDENELYGVITLRDVISCFVSEPPNYFENCLGFSVKEMLNR

SEQ ID NO: 754 - protein, 378 aa, Arabidopsis thaliana
METRNETKASPENNLRNRGADGNNSKKDMIFRADKIDLKNLDIQLEKHLSRVWSRSIEKHPKPKEEWEIELAKLEMRNVIARGAYGIVYKGIYDGQDVAVKVLDWGEDGYATTAETSALRASFRQEVAVWHKLDHPNVTRFVGASMGTANLKIPSSAETENSLPQRACCVVVEYIPGGTLKQYLFRNRRKKLAFKVVVQLALDLSRGLSYLHSERIVHRDVKTENMLLDYQRNLKIADFGVARVEAQNPKDMTGETGTLGYMAPEVLDGKPYNRRCDVYSFGICLWEIYCCDMPYPDLSFADVSSAVVRQNLRPDIPRCCPTALATIMKRCWEANPEKRPEMEEVVSLLEAVDTTKGGGMIPEDQRPGCFCFVSGRGP

SEQ ID NO: 755 - protein, 396 aa, Arabidopsis thaliana
MFCDSFAFAQVMSCFGCFGGSERSRHSPNPYDDDTYSHDSGETSNPGGDDEEGEEEEEVEELSRSKRSEEILKCKLQNGLVCRQFPVKETNKLTRGEDEDGNKTINEFVRERKIGSGSYGKVVLYRSTVDDKHYAIKAFHKSHLSRLRVAPSETAMGDVLREVMIMKTLEHPNIVNLIEVIDDPEFDDFYMVLEYVDGKWAYDDSGPPGALGEITARKYLRDVVAGLMYLHAHNVIHGDIKPDNLLVTSTGRVKIGDFSVSQVFKDDDDQLRRSPGTPVFTAPECCLGITYSGRSADTWAVGVTLYCMILGQYPFLGDTLQDTYDKIVHNPLIIPEGLNPRLRDLIEGLLCKDPNQRMTLKAVAEHPWITGEDGAISEYCCWCKRKAEEEEDQNHS

SEQ ID NO: 756 - protein, 243 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMVYFILCRLLKKTSPRNQASFNGKNNPMPNASTALTGKALLNKVKELSHLPRRETAKACGYYSTSKEGQVRVNLTDFYDAVLAAKGVPLDPSGTKDGRGREPTFRVSVHKNGQIVIGSTYTQEMGLKSGDEFEIKLGYKHIHLKQITDSDDEEEV

SEQ ID NO: 757 - protein, 541 aa, Arabidopsis thaliana
SFFLQFPLMSKSKKLHQLITEQEQSKVYSHIKLGNFPGGSEIFEMVIKISYGFKVDISVSTAVPLRCAAEYLEMTEEYSPENLISKTEKFLSEFVFTNVQESIKALKACESVSSLAESLCITEQCIDSIVFQASSTDPSSFYGWPINNGGIFTVDRKKQSKDSKTELWFEDLTELSFPIFRRVILSMKSSVLSPEIVERSLLTYAKKHIPGISRSSSASSSSSSSSTTIASENQQRELLETITSDLPLTATTTRSLFGLLRAAIILNASENCRKFLEKKIGSNLEKATLDDLLIPSYSYLNETLYDIDLVERLLRRFLENVAVSSSSLTVVGRLIDGVLGEIASDANLKPEQFYNLAVLLPVQARVYDDGLYRAVDIYFKTHSWILEEEKEKICSVMDCRKLTVEGCTHAAQNERLPLRAVVQVLFLEQLQLRQVITGTLLTEEDGDKTVVDLGRWKEAVKENQVLRLDMDTMRTRVNQLEKECLYLKKVIAKIDKESLLKAKHGAGKWSIGKKFGCKFSAQVCDSQEATMVDRRSRRFLS

SEQ ID NO: 758 - protein, 478 aa, Arabidopsis thaliana
MPVLYEQDKHVSSAILTGQERGVLRCQERTSLLHHWKLTKEQIALVEKAGFGWFRLVGSISLNNSLISALVERWRRETNTFHFPCGEMTITLDEVSLILGLAVDGKPVVGVKEKDEDPSQVCLRLLGKLPKGELSGNRVTAKWLKESFAECPKGATMKEIEYHTRAYLIYIVGSTIFATTDPSKISVDYLILFEDFEKAGEYAWGAAALAFLYRQIGNASQRSQSIIGGCLTLLQCWSYFHLNIDRPKRTTRQFPLALLWKGRQQSRSKNDLFKYRKALDDLDPSNVSWCPFEGDLDIVPQSFKDNLLLGRSRTKLIGPKVVEWHFPDRCMKQFGLCQVIPGEVPPRKNEKNHDEDLLEDMNTADEEWMRRRENIVENGGGNGDESEYMQWFNSITVPKLHRDTSLEADIMNVQAAILQFDEVASTLSLEDLHPEEREAIEEAVMSMSNALRVGDWYEASTTNKRKRREEQQQTDWSE

SEQ ID NO: 759 - protein, 649 aa, Cupriavidus metallidurans
MASSMLSSATMVASPAQATMVAPFNGLKSSAAFPATRKANNDITSITSNGGRVNCMQVWPPIGKKKFETLSYLPDLTDSGGRVNCMQAMAHLKITGMTCDSCAAHVKEALEKVPGVQSALVSYPKGTAQLAIVPGTSPDALTAAVAGLGYKATLADAPLADNRVGLLDKVRGWMAAAEKHSGNEPPVQVAVIGSGGAAMAAALKAVEQGAQVTLIERGTIGGTCVNVGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVATGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIAIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 760 - protein, 400 aa, Chloroflexus aurantiacus
MTGERAAELIQADHQYLLQSYVRADFVIERGEGVYLYDSEGRRYLDFVAGIAVNALGYGDRDVLKAINDQAERLIHVSNLYHTQPAIELAKLLVQSSPAFAKAFFCNSGAEAIEGAIKFSRRYARAHVGEGKTTIVAFDGSFHGRTMGAVAITAREKYREPFMPVMPGVRFARYNDLDSLAAVMGDDVCAVVVEPVQGEGGLRAAEPAFMQGVRELCQRYGALLVFDEIQCGVGRTGTLWAHEQLGVQPDMMTVAKPLAGGLPIGAVLMGQHVADTIHPGDHGTTFGGNPLATAVGTVVFRKISDPAFLAHVQQVSNYLDEALQDFANEHADQVIELRGRGLMRGVRIAGSASAVREAAHRHGLLVATAGEDVIRLLPPLIIEPQHVDEALSGLRAALRA

SEQ ID NO: 761 - protein, 563 aa, Arabidopsis thaliana
MAVSSFQCPTIFSSSSISGFQCRSDPDLVGSPVGGSSRRRVHASAGISSSFTGDAGLSSRILRFPPNFVRQLSIKARRNCSNIGVAQIVAAKWSNNPSSALPSAAAAAATSSASAVSSAASAAAASSAAAAPVAAAPPVVLKSVDEEVVVAEEGIREKIGSVQLTDSKHSFLSSDGSLTVHAGERLGRGIVTDAITTPVVNTSAYFFKKTAELIDFKEKRSVSFEYGRYGNPTTVVLEDKISALEGAESTLVMASGMCASTVMLLALVPAGGHIVTTTDCYRKTRIFMENFLPKLGITVTVIDPADIAGLEAAVNEFKVSLFFTESPTNPFLRCVDIELVSKICHKRGTLVCIDGTFATPLNQKALALGADLVVHSATKYIGGHNDVLAGCICGSLKLVSEIRNLHHVLGGTLNPNAAYLIIRGMKTLHLRVQQQNSTAFRMAEILEAHPKVSHVYYPGLPSHPEHELAKRQMTGFGGVVSFEIDGDIETTIKFVDSLKIPYIAPSFGGCESIVDQPAIMSYWDLPQEERLKYGIKDNLVRFSFGVEDFEDVKADILQALEAI

SEQ ID NO: 762 - protein, 432 aa, Arabidopsis thaliana
MDPQAFIRLSVGSLALRIPKVLINSTSKSNEKKNFSSQCSCEIKLRGFPVQTTSIPLMPSLDAAPDHHSISTSFYLEESDLRALLTPGCFYSPHAHLEISVFTGKKSLNCGVGGKRQQIGMFKLEVGPEWGEGKPMILFNGWISIGKTKRDGAAELHLKVKLDPDPRYVFQFEDVTTLSPQIVQLRGSVKQPIFSCKFSRDRVSQVDPLNGYWSSSGDGTELESERRERKGWKVKIHDLSGSAVAAAFITTPFVPSTGCDWVAKSNPGAWLVVRPDPSRPNSWQPWGKLEAWRERGIRDSVCCRFHLLSNGLEVGDVLMSEILISAEKGGEFLIDTDKQMLTVAATPIPSPQSSGDFSGLGQCVSGGGFVMSSRVQGEGKSSKPVVQLAMRHVTCVEDAAIFMALAAAVDLSILACKPFRRTSRRRFRHYSW

SEQ ID NO: 763 - protein, 493 aa, Arabidopsis thaliana
MEPSQRNTKPPSFSDSTIPVDSDGRATVFRPFSLSSPHSRAFHLAWLSLFSCFFSTFSIPPLVPVISSDLNLSASTVSAAGIASFAGSIFSRLAMGPLCDLIGPRTSSAILSFLTAPVILSASLVSSPTSFILVRFFVGFSLANFVANQYWMSSMFSGNVIGLANGVSAGWANVGAGISQLLMPLIYSTIAEFLPRAVAWRVSFVFPAIFQVTTAVLVLLYGQDTPHGNRKNSNQNKLTIPEEEEVLVVEEDERSSFVEILIGGLGNYRAWILALLYGYSYGVELTTDNVIAGYFYERFGVNLEAAGTIAASFGISNIASRPAGGMISDALGKRFGMRGRLWGLWIVQSVAGLLCVLLGRVNSLWGSILVMWVFSVFVQAASGLVFGVVPFVSTRSLGVVAGITGSGGTVGAVVTQFLLFSGDDVRKQRSISLMGLMTFVFALSVTSIYFPQWGGMCCGPSSSSEEEDISRGLLVEDEDEEGKVVSGSLRPVC

SEQ ID NO: 764 - protein, 236 aa, Arabidopsis thaliana
MGSHEQSPENNGSSTVSKKVADIWQRMNEGVPNKRVNFVSTALPAKNSANSNWKSYLGVNVKKKDTCVSDVQKSVLNHSCSEEAKSIAAAALAAVRNATVTAAAASSRGKIEITEVKDFAGQEIEVKRLVEADSKEALERGNKGSSSSSAAPSAVDAVLEQIKKKQKLSVLDKTKKDWGEYKEEHKGVEDELDKYKKSSDQYLDKVGFLERADYRQFEKERDARLALQSKRRHDDV

SEQ ID NO: 765 - protein, 122 aa, Zea mays
MNSRRDFRSHRAALFDGIEEGGVRAPAYSSREIHEHENDQALDSLHDRVSVLKRLTGDIHEEVENHNRMLDRMGNDMDASRGFLSGTVDKFKMVFETKSSRRMATMVASFIAVFLLIYYLTK

SEQ ID NO: 766 - protein, 386 aa, Arabidopsis thaliana
METDEAYQKKERAALVAIVVLACLALSSLFVAFSYYCYIRNKEKGDCQKVQDVTENGLQIFTFKQLHSATGGFSKSNVVGNGGFGLVYRGVLNDGRKVAIKLMDHAGKQGEEEFKMEVELLSRLRSPYLLALLGYCSDNSHKLLVYEFMANGGLQEHLYLPNRSGSVPPRLDWETRMRIAVEAAKGLEYLHEQVSPPVIHRDFKSSNILLDRNFNAKVSDFGLAKVGSDKAGGHVSTRVLGTQGYVAPEYALTGHLTTKSDVYSYGVVLLELLTGRVPVDMKRATGEGVLVSWALPQLADRDKVVDIMDPTLEGQYSTKEVVQVAAIAAMCVQAEADYRPLMADVVQSLVPLVRNRRSASKLSGCSSSFSLARSPNSPGKASIGSQ

SEQ ID NO: 767 - protein, 433 aa, Zea mays
MGSLGGSAGAGDGGKVGLPALDVTLAFPQATPASLFPPAVSDYYQFDDLLTDEEKALRKKVRGIMEKEIAPIMTEYWEKAEFPFHAIPSLASLGLAGGTIKGYGCPGLSLTASAISIAEVARVDASCSTFILVHSSLAMSTIALCGSEAQKQKYLPSLTQFKTIGCWALTEPDYGSDASSLRTAATKVPGGWHLDGQKRWIGNSTFADVLIILARNADTNQLNGFIVKKGAPGLKATKIENKIGLRMVQNGDIILNKVFVPEEDRLTGINSFQDINKVLAMSRIMVAWQPIGISMGVYDICHRYLKERKQFGAPLAAFQLNQEKLVRMLGNIQAMLLVGWRLCKLYESGKMTPGRSSLGKAWTSKKAREVVSLGRELLGGNGILVDFLVAKAFCDVEPIFSYEGTYDINSLVAGREITGIASFKPAVSAKSRL

SEQ ID NO: 768 - protein, 425 aa, Zea mays
MGCGPSIPDKYTIGGKGRKRRSVIQEVAVFVPTIRIPVASDIAHPLRGIVSKDLVDRLSTLRAHVASLAEEIYHADVSAVQELQHALEEYLPVVLGLTTKESRLESSVQFRWKTLDDDQECCLASAWYEVLSVVHMMAMLALFEANLLLIPKNSQGGGERKVAEDAKKDVVDSLLRASGCLDYSVHRILVQIPAQVKKGFPSYLQEGMLEAISIQALAQCVEIQLGLASECEKATLSVKRRLACEQVSYFSQAHYCLSGCDTSDSYGKKLLLFLKWKWMEAKAVAYYYHGLVLDKGGEPANHTSAVCCLSAADDLLSDSKRACLSFCLANPVTRVPPPWGVMKNMHKKIPDVANKKFQAHGHLFEQNKNSALQSVPDLPEFALSLRPDGYELPITDSIWENVDGQPQIQSLKEHMIDDEDEVGTK

SEQ ID NO: 769 - protein, 182 aa, Zea mays
MEAGGEEFAIGVVISAKTTLGEEFEGQIVAFDRPSNLLVIQEGVGRAERGERRNVRVLKANYIREFSVVSKGDDPLDPASCMLDLNSIYAREDAALRQAEIEAERIGVGVTPEAQSIFDALSKTLPVQWDKTDIVVMKEVRVRSPYLPENVNGGTAAANERVKKVIDFERKRLHSRVPGQFS

SEQ ID NO: 770 - protein, 37 aa, Zea mays
MFDDQDLGFFANFLGIFIFVLVIAYHFVMADPKYEGN

SEQ ID NO: 771 - protein, 332 aa, Zea mays
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHRESQQPPQQQQPQVQVQQAQPQKQAAPVMRRASSIAARQAAMAQQSQETKPISSSPKIKRQTSARSGSVASTKPPVAASALKPGGSPKKGEVKPAADPVQTPTTGADSPKPEPSAPSLPGAEGVDKMAIDEASGDALEGAEELDPALEEETPMEETIRVTRAKLRRRTATEDPAGN

SEQ ID NO: 772 - protein, 342 aa, Arabidopsis thaliana
MGCFSSKHRKTQNDGGEKSIPINPVQTHVVPEHRKPQTPTPKPMTQPIHQQISTPSSNPVSVRDPDTILGKPFEDIRKFYSLGKELGRGQFGITYMCKEIGTGNTYACKSILKRKLISKQDKEDVKREIQIMQYLSGQPNIVEIKGAYEDRQSIHLVMELCAGGELFDRIIAQGHYSERAAAGIIRSIVNVVQICHFMGVVHRDLKPENFLLSSKEENAMLKATDFGLSVFIEEGKVYRDIVGSAYYVAPEVLRRSYGKEIDIWSAGVILYILLSGVPPFWAENEKGIFDEVIKGEIDFVSEPWPSISESAKDLVRKMLTKDPKRRITAAQVLEHPWIKGGE

SEQ ID NO: 773 - protein, 104 aa, Arabidopsis thaliana
MEVNGEEERRSRREDEEKEDYYYSLLNSPCSVCNKFVQAILKCLGLESSSIPPSSSSSSPSLVEEEDSGTETVEETGFMARITAVLRRRPRPPPYSSGRPGQNN

SEQ ID NO: 774 - protein, 338 aa, Arabidopsis thaliana
MESKTTQNGSEVVELTEFEKTQKKYQDFIATLPKSKGWRPDEILTQYGGHWWQECLLEGLFHAKDHFEARPTDFLVCSYPKTGTTWLKALTYAIVNRSRYDDAANPLLKRNPHEFVPYVEIDFAFYPTVDVLQDRKNPLFSTHIPNGLLPDSIVNSGCKMVYIWRDPKDTFISMWTFLHKEKSQEGQLASLEDSFDMFCKGLSVYGPYLDHVLGYWKAYQENPDRILFLRYETMRANPLPFVKRLAEFMGYGFTDEEEENGVAEKVVKLCSFETLKNLEANKGDKEREDRPAVYANSAYFRKGKVGDWANYLTPEMAARIDGLVEEKFKDTGLLQHDN

SEQ ID NO: 775 - protein, 165 aa, Arabidopsis thaliana
MEKETKEKIEKTVIEILSESDMKEITEFKVRKLASEKLAIDLSEKSHKAFVRSVVEKFLDEERAREYENSQVNKEEEDGDKDCGKGNKEFDDDGDLIICRLSDKRRVTIQEFKGKSLVSIREYYKKDGKELPTSKGISLTDEQWSTFKKNMPAIENAVKKMESRV

SEQ ID NO: 776 - protein, 175 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 777 - protein, 161 aa, Arabidopsis thaliana
MAEEHRCETPEGHRLCVNNCGFFGSSATMNLCSNCYGDLCLKQQQQASMKSTVESSLSPVIAPVLENYAAELEIPTTKKTEEKKPIQIPTEQPSPPQRPNRCTVCRKRVGLTGFMCRCGTTFCGSHRYPEVHGCTFDFKSAGREEIAKANPLVIAAKLQKI

SEQ ID NO: 778 - protein, 183 aa, Arabidopsis thaliana
FCSKISTLELGDLSIMGSEQNDSTSFSPSEPKLCVKGCGFFGSPSNMNLCSKCYRDIRATEEQTASAKAAVEKSLNPNKPKTQPQQSQEITQGVLGSGSSSSSTRGGDSAAAPLDPPKSTATRCLSCNKKVGVTGFKCRCGSTFCGTHRYPESHECQFDFKGVAREAIAKANPVVKADKVDRI

SEQ ID NO: 779 - protein, 153 aa, Arabidopsis thaliana
MAPFPLSLIFGKKKRRRDDEIRRQKPTLKGVMTAFFATEAAICLLLLAGISLTGTAVALFASMPLFLVFSPVLVPAGIATTILASGLMAGGTSGVSGLTILMWLYKKYTGRDFPIKIPGAAAAGGAAPAAPAAPAPAAPAAKPAAKPAAKPGA

SEQ ID NO: 780 - protein, 445 aa, Arabidopsis thaliana
MVGSHKASGVLLVLLVVMATTIANGTPVVDTAKNAATAVEDTAKNAATAVGGAAASVGAKVTGAKPGGASLDVKASGAKGDGKTDDSAAFAAAWKEACAAGSTITVPKGEYLVESLEFKGPCKGPVTLELNGNFKAPATVKTTKPHAGWIDFENLADFTLNGNKAIFDGQGSLAWKANDCAKTGKCNSLPINIRFTGLTNSKINSITSTNSKLFHMNILNCKNITLTDIGIDAPPESLNTDGIHIGRSNGVNLIGAKIKTGDDCVSIGDGTENLIVENVECGPGHGISIGSLGRYPNEQPVKGVTVRKCLIKNTDNGVRIKTWPGSPPGIASNILFEDITMDNVSLPVLIDQEYCPYGHCKAGVPSKVKLSDVTIKNIKGTSATKVAVKLMCSKGVPCTNIALSDINLVHNGKEGPAVSACSNIKPILSGKLVPAACTEVAKPGP

SEQ ID NO: 781 - protein, 728 aa, Arabidopsis thaliana
MAMRDLVNGGAACAVPGSSSSSNPLGALTNALLGSSSKTQERLKEIPNANRSGPRPQFYSEDQQIRSLPGSELDQPLLQPGAQGSEFFRGFRSVDQNGLGAAWDEVQQGGPMPPMGPMFEPVQPTFEGPPQRVLSNFLHSFVESSRGGIPFRPAPVPVLGLSQSDKQCIRDRSSIMARHFFADRGEEFINSQVNALLSSLDIDDGIQARGHVPGRFRELDDYWNESQAVVKPNLHPADNWAAEFNQHGMDHGGPDSWVQSFEQQHGVNGWATEFEQGQSQLMSSQMRSMDMQNIAAMEQTRKLAHTLSQDGNPKFQNSRFLQFVSKMSRGELIIDENQVKQASAPGEWATEYEQQYLGPPSWADQFANEKLSHGPEQWADEFASGRGQQETAEDQWVNEFSKLNVDDWIDEFAEGPVGDSSADAWANAYDEFLNEKNAGKQTSGVYVFSDMNPYVGHPEPMKEGQELFRKGLLSEAALALEAEVMKNPENAEGWRLLGVTHAENDDDQQAIAAMMRAQEADPTNLEVLLALGVSHTNELEQATALKYLYGWLRNHPKYGAIAPPELADSLYHADIARLFNEASQLNPEDADVHIVLGVLYNLSREFDRAITSFQTALQLKPNDYSLWNKLGATQANSVQSADAISAYQQALDLKPNYVRAWANMGISYANQGMYKESIPYYVRALAMNPKADNAWQYLRLSLSCASRQDMIEACESRNLDLLQKEFPL

SEQ ID NO: 782 - protein, 107 aa, Arabidopsis thaliana
MAKAEGLFLLGLVVISSLVMLTESRLARKDLGIDLGGIGIGLGVGLGIGLGGGSGSGAGAGSGSGSGSRSSSSSSSSSSSSSSGSGGSAGSSAGSFAGSRAGSGSGN

SEQ ID NO: 783 - protein, 218 aa, Arabidopsis thaliana
MASRNYRWELFAASLTLTLALIHLVEANSEGDALYALRRSLTDPDHVLQSWDPTLVNPCTWFHVTCNQDNRVTRVDLGNSNLSGHLAPELGKLEHLQYLELYKNNIQGTIPSELGNLKNLISLDLYNNNLTGIVPTSLGKLKSLVFLRLNDNRLTGPIPRALTAIPSLKVVDVSSNDLCGTIPTNGPFAHIPLQNFENNPRLEGPELLGLASYDTNCT

SEQ ID NO: 784 - protein, 142 aa, Arabidopsis thaliana
MYPKQFSLYNYSLETMSKDENVESKETIRVDKRVREDEEEEEEKKIDTFFKLIKHYQEARKRRREELAENSGVVRRKSNGGERSGIVVPAFQPEDFSQCRTGLKPPLMFVSDHKEENTKVEQEEDQTEERNEDKALDLNLAL

SEQ ID NO: 785 - protein, 165 aa, Arabidopsis thaliana
MENLVGLLRIRVKRGINLVSRDSNTSDPFVVVTMGSQKLKTRGVENSCNPEWDDELTLGINDPNQHVTLEVYDKDTFTSHDPMGDAEIDIKPFFEVQGTDIQELTNGTEIRRVKPSGDNCLAEESRIIFSNGKILQDMILQLRNVESGEVEIQIEWINVTGSSDF

SEQ ID NO: 786 - protein, 270 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMVRDMKHTVEVMIPEAEIKARIAELGRQITERYKDSGSDMVLVGLLRGSFMFMADLCREVQVSHEVDFMTASSYGSGMSTTRDVKILKDLDEDIRGKDVLIVEDIIDSGNTLSKVREILSLREPKSLAICTLLDKPSRREVNVPVEFIGFSIPDEFVVGYGIDYAQRYRHLPYIGKVILLDE

SEQ ID NO: 787 - protein, 307 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMTIAKLPRQILPNLYRFAPNRDTLGGTAYLLITGEGNVLIDCPAWHEDNEAWLGEQGPVRWLCLTHRDGHGPKVKTIQEKLSCQVVVQEQEAYLLPGARICRFREQLAMAPFLTAIWTPGYSPGASCYYWGENGGILFTGRHLLPDGEGNLRAIKQAKTFHWPRQQASVEKIHRYLDEKNLPLRAVCPGGNVGYLRGEDWCLNPRESLESMLREFQAKV

SEQ ID NO: 788 - protein, 420 aa, Arabidopsis thaliana
MVCSSFIRSFIVQAGCRIGVLAQGRHQFIHIKKTLSVGFGFRTSVIGFRTTSGIGFRTSAKMMVDTSAGEKRISLVDMPPEKVDDGGYIGGGWKNDDGSLSCGYCSFRGKRSTMEDFYDIKASTIEGQAVCMFGIFDGHGGSRAAEYLKEHLFNNLMKHPQFLTDTKLALNETYKQTDVAFLESEKDTYRDDGSTASAAVLVGNHLYVANVGDSRTIVSKAGKAIALSDDHKPNRSDERKRIESAGGVIMWAGTWRVGGVLAMSRAFGNRMLKQFVVAEPEIQDLEIDHEAELLVLASDGLWDVVPNEDAVALAQSEEEPEAAARKLTDTAFSRGSADNITCIVVKFRHDKTESPKIETNAMAESEPELNPTTELEPESNPSTALETESIPKAELESEPDAIPDPKPETEPETKGEKAGE

SEQ ID NO: 789 - protein, 381 aa, Arabidopsis thaliana
MAMHTVRLSPATQLHGGISSNLSPPNRKPNNSIVRYGCGSSKRFRIVTVLASLRENDANGRDNSVRAMEVKKIFEDSPLLPKPLSSNQLTESVSNGSRVRVAYQGVRGAYSESAAEKAYPNCEAVPCEEFDTAFEAVERWLVDRAVLPIENSLGGSIHRNYDLLLRHNLHIVGEVKLAVRHCLLANHGVNIEDLRRVLSHPQALAQCENTLTKLGLVREAVDDTAGAAKQIAFENLNDAAAVASEKAAKIYGLNIVAKDIQDDCDNVTRFLMLAREPIIPGTNRLFKTSIVFSLEEGPGVLFKALAVFALRQINLTKIESRPLRKHPLRASGGLKYFDYLFYVDFEASMADEVAQNALRHLEEFATFLRVLGSYPVDTTML

SEQ ID NO: 790 - protein, 229 aa, Arabidopsis thaliana
MAKTLARSTASRITKRLISTSGATTPSPSYILSRRSTPVFSHAVGFISSLNRFTTIRTRMDRSGGSYSPLKSGSNFSDRAPTEMAPLFPGCDYEHWLIVMDKPGGENATKQQMIDCYVQTLAKIIGSEEEAKKKIYNVSCERYFGFGCEIDEETSNKLEGLPGVLFILPDSYVDQENKDYGAELFVNGEIVQRPPERQRKIIELTTQRTNDKPKYHDKTRYVRRRENMR

SEQ ID NO: 791 - protein, 133 aa, Arabidopsis thaliana
  misc_feature (102)..(102): Xaa can be any naturally occurring amino acid
MGSSEKRSKDIMSDIPTFSAENLQNNLKVIQNSRTFLSIIAGVLAGIIGFNGLIGFVFYFVVMLITSVGLMAKAGFSADLYFDSWNRVLFDGFLGGLMSFVXSGHLRMTWCTYSEGTSAPDEDGETAHKIEFG

SEQ ID NO: 792 - protein, 163 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMDVGDRVRVTSSVVVYHHPEHKKTAFDLQGMEGEVAAVLTEWQGRPISANLPVLVKFEQRFKAHFRPDEVTLIED

SEQ ID NO: 793 - protein, 391 aa, Glycine max
MEFNKFRIRSYEGQSDRAQVEDLERRCEVGPSESVFLFTDTMGDPICRIRNSPMYMMLVAELDNELVGVIQGSIKVVTVHGHPPKDLAKVGYVLGLRVSPQHRRKGIGSSLVRTLEEWFTSKDVDYAYMATEKDNHASVSLFMDKFGYTKFRTPAILVNPVNHHCFQISPNIEIARLKIDQAEYLYRRFMGSTEFFPNDIGNILRNKLSLGTWVAYFKGDIAWGDFGSDGQVPNSWAMLSVWNSGEIFKLRLGKAPFSCLVCTKSWWLIHKIFPCLKLPTIPDFFNPFGFYFMYGVHHEGPFSGKLVRALCQFVHNMGAESKDESNCRIIVTEVGGRDELNHHIPHWKLLSCPEDLWCIKALKNEGTNNKFHELTTKTPPTRALFVDPREV

SEQ ID NO: 794 - protein, 544 aa, Synechocystis sp. PCC 6803
MASSMLSSATMVASPAQATMVAPFNGLKSSAAFPATRKANNDITSITSNGGRVNCMQVWPPIGKKKFETLSYLPDLTDSGGRVNCMQAMNTAKTVVAEQRDFFRQGKTKSVQDRLTALAKLKTQIQAQEEEIIKALKQDFGKPTFESYVNEILGVIREINYYQKHLQQWSKPQRVGTNLMVFPASAQLRPEPLGVVLIISPWNYPFYLCLMPLIGAIAAGNCVVVKPSEYTPAISGVITRLIQNVFSPAWATVVEGDETISQQLLQEKFDHIFFTGSPRVGRLIMAAAAEQLTPVTLELGGKSPCVVDREINLQETAKRIMWGKLVNAGQTCVAPDYLLVEQSCLEQLLPALQQAIQMLFGENPAHSPDYTRIVNQQQWSRLVSLLSHGKVITRGDHNEGDRYIAPTLIIDPDLNSPLMQEEIFGPILPILTYQSLSEAIDFINIKPKPLALYFFSNNRQKQEEILQSTSSGSVCLNDILLHLTVTDLPFGGVGESGMGRYHGKATFDTLSNYKSILRRPFWGETNLRYSPYGKKMNLIKKLFS

SEQ ID NO: 795 - protein, 64 aa, Arabidopsis thaliana
MAGHKVAHATLKGPSVVKELIIGLTLGLAAGGLWKMHHWNEQRKTRTFYDLLERGEIGVVASEE

SEQ ID NO: 796 - protein, 240 aa, Arabidopsis thaliana
MAMSHLFLSSSPQSSLALRLHSTTQFTLSYSKNNKDCSFQSANEAKVSKRSLLCRAIHMESGHSGEQPKKLNFDNLLRRTKHVWDNSPQPVKEFPWNRAFGNFIQLVLDLAISVVKFLFVPILAVSSISEMSYCAHERKLALVPFPLVIGMVVAGVLQETALKISPRLKEAEVPWHLIAMMMFFTLIKLPGPYYPYWGRLLVPHFANGVLLRALWSMFFWYKKTRNTSGNPLQNHSLETE

SEQ ID NO: 797 - protein, 168 aa, Arabidopsis thaliana
MLVYQDLLTGDELLSDSFPYKEIENGILWEVEGKWVTVGAVDVNIGANPSAEEGGEDEGVDDSTQKVVDIVDTFRLQEQPTYDKKGFIAYIKKYIKLLTPKLSEEDQAVFKKGIEGATKFLLPRLSDFQFFVGEGMHDDSTLVFAYYKEGSTNPTFLYFAHGLKEVKC

SEQ ID NO: 798 - protein, 441 aa, Arabidopsis thaliana [sequence omitted]

SEQ ID NO: 799 - protein, 481 aa, Zea mays
MTDHRDVMLPLSLQYIATRALLLLVIASAVSCSSLPPEDGIRVVSAEKRIDLTGPIVKVFLTLKVENAPTASEASRVLLAFTPTEFQHLSIVKATRAEGKRKKKAFVPLSVQASELATTAPDAPRLYSVLLSTPLKPGDATTLEVLYMLTHSLEPFPAEISQSESQLVYYRDSAVLLSPYHVLEQVTYIKMPSNRIESFTRVDPTTRAGSEVKYGTYSNQMPNSYLPVLVHYENNRPFAVVEELVRKVEISHWGNIQITEQYKLKHGGARHKGVFSRLEYQSRPSISGASSFKNLLARLPPRVHSVYYRDEIGNISSSHLRTDSHKSDLEIEPRYPLFGGWHCTFTIGYGLPLQDFVFESVDGRRYINLTFGCPLLDTVVDDLTVKVVLPEGSKNPEHVVPFVTEKHLETSYSYLDVVGRTTVVLKKKNVVGEHNVPFQVYYEFNPIFMLAEPLMLISAVLLFFVAFIAYLHMDLSIRKSS

SEQ ID NO: 800 - protein, 550 aa, Arabidopsis thaliana
MKALRRSYTSTSSGNSSSSSSLPSSSSSSLPSSSSSSPPSSNSNSYSNSNSSSSSSSWIHLRSVLFVANLSSPSSVTSSDRRRKSPWSRRKRKWALTPHQWRSLFTPEGKLRDGGVGFLKKVRSRGVDPSIRAEVWLFLLGVYDLNSTSEEREAVKTQKRKEYEKLQRRCQMLLKCGNGSTDNLEELPSDEANSQCVRFVDDYKITGPMTSQDVVSALNTDSSDTDSCEDNEDVLLLSSFAHSDEKKPEEDNSNNNSEENSSLLVAAASEVQVEVAVHEDFSTWQRIIRLDALRADSEWANYSPYSTAITESKARRLAESVGLKDYDHLESCRLYHAARLVAILEAYAMYDPEIGYCQGMSDLLSPILAVISEDHEAFWCFVGFMKKARHNFRLDEAGIQRQLSIVSKIIKNKDSQLYKHLENLQAEDCSFVYRMVLVMFRRELSFEQTLCLWEVMWADQAAIRAGVGKSPWSRIRQQAPPTDDLLLYAIAALVLRRKLIIQKYSSMDEIVEECNSMAGQLNVWKLLDDAHHLVVTLHDKIETLSQSQSI

SEQ ID NO: 801 - protein, 135 aa, Arabidopsis thaliana
LKQPFISDIFDVIIDQIESNTFKTNNINGIISLYEASYLSTKSDTKLHKVIRPFATEQIRKFVDDEDTKNIEVREKAYHALEMPYHWRMRRLDTRWYIDAYEKKHDMNLVLIEFAKIDFNIVQAAHQEDLKYVSR

SEQ ID NO: 802 - protein, 173 aa, Arabidopsis thaliana
MAETSDVSPLKRYREQETLVEEETNKRQKPTSSSSSASYNQILCLLNDSDEQNQHNNDLTSFINALQQEISSDDQYAVVSETSNVEDSFSSCVSSKEEEVEDDSKEKVMQHLLEASDDELGIPNTDFGESNYEKANDGYVYGDSLLDGFGDAFWELEDEAANYYTLLQSELFM

SEQ ID NO: 803 - protein, 1077 aa, Arabidopsis thaliana
VSPQTQKMNLQTPRKSSLSGSRKDLWFAIREGSLVDVDSALSILKKTGGNINLRNAYGLTPLHIAVWRNHIPIVRRLLAAGADPDARDGESGWSSLHRALHFGHLAVASVLIDSGASFTLEDIKLRTPVDLVSGPVAQVIGEQQSSVATEVFSWGNGANYQLGTGNQHVQKVPGRVDSLHGCFIKLVSAAKFHSVAISTHGEVYTWGFGRGGRLGHPEFDIHSGQAAVITPRQVISGLGSRRVKAVAAAKHHTVIATEGGDVYTWGSNREGQLGYTSVDTQATPRKVTSLKAKIVAVSAANKHTAVVSDCGEVFTWGCNKEGQLGYGTSNSASNYSPRLVDYLKGKVFTAIASSKYHTLVLRNDGEVYTWGHRLVTPRRVIISRNLKKAGNTLLNFHRRRPLRLTAIAAGMVHSLALAEDGAFFYWVSSDSNLRCQQLHSLHGKTVVSISAGKYWASAVTSTGEVYMWDGKNGKDIAPSLSRLHNLKRATTVAVGETHLLVVGSLYHPAYAPIVLKKSQTLQADKCREEENEELDEGFMFDDVESVNVLQSVQYDNPKERIVPSLKSLCEKVAAECIVEPRNAIQLLEIADSLGAEDLKKYCEDIVIRNLDFILTFSPQSIANTSPDVLANLEKLLDDRSSETWSSRPLPTPTATFPVVIDSEEEESESDILRTRDSHVKHFSSIGGTRMDSFLQPEDELTQHNSKEVRALRKKLQQIEILEAKQSRGQLLDGQQIAKLQKKLDIESSLVELGIPVEEFPEAKATTALPLEGKANKKGKKKKKGNQRFVQVETFPEFGEVKVEIDTMQDKEIEEICEAIKPKGGKTMLDTTMISGFPKESDFVSLSQKKDNPPDSPRSKKLATAANKKKNRKGGLSMFLTGALDDVPKPVVAPPPRPKIEGPVWGGAKISKGLSSLRDIQDEQSKTRSHEPVRTTKNQSGDDSPGKSEGKILLSSFLTSKPIPMEPAKSLQQSDVEKGTPPWASSETPRKLSRPSLRDIQMQEVKKQQSLSHSPKTKTSGFTVATGQGSPSDSPGTNRWFKPEIDAPSAIRSIQIEEKAMKDLRRFYSSVKVVRNQP

SEQ ID NO: 804 - protein, 209 aa, Arabidopsis thaliana
MAAVRRRERDVVEENGVTTTTVKRRKMEEEVDLVESRIILSPCVQATNRGGIVARNSAGASETSVVIVRRRDSPPVEEQCQIEEEDSSVSCCSTSEEKSKRRIEFVDLEENNGDDRETETSWIYDDLNKSEESMNMDSSSVAVEDVESRRRLRKSLHETVKEAELEDFFQVAEKDLRNKLLECSMKYNFDFEKDEPLGGGRYEWVKLNP

SEQ ID NO: 805 - protein, 519 aa, Arabidopsis thaliana
MKQKNQHKKKKKRSCAAKPSGDGTTSDGNKKDVEEERKDGEGKREIENVGKNFIESLMEAFCSVSMEEAMAAYKEAGGDLNKAAEILSDLVESGDDPSTSSVASGSSGQETASTSEYGAGSSSSCSEDLTRDRWFKGSKQSRVIAATGMVSSVIAKDYLKPNPVRKEFPMMERSKELCGNGKKAADREKAEQFLSSMLGDDCELSMAVVRDVLCQCGYDVDMALNVLLDMSSSSTDDSLSGKCFGIGVSDSLAESSFDTDTSDCELFWGGDYSQRDYAKALMSSQDPFATTQGIDELGLPQKVLESLFNIRQNPKHESKTTSWRNVAKKMQSLGIDASSSSGEEPHPNTFVKDDSYHELRKGANDQWNVTKSYYQKAAEAYSKGGRAHAAYLSDKGRVASKQAQRADERASQDIFVARNKGIENVVTIDLHGQHVKPAMKLLKLHLLFGSYVPSIQTLRVITGCGASGFGKSKVKQSVVKLLEREGVRYCEENRGTLLIKLDGGSREFSFLDTESDSDE

SEQ ID NO: 806 - protein, 492 aa, Glycine max
LIKKMASDKVVETVIAGNYVEMETEGKPKDVKTKLSSLLWHGGSVYDAWFSCASNQVAQVLLTLPYSFSQLGMLSGILFQIFYGLLGSWTAYLISILYVEYRTRKEREKVNFRNHVIQWFEVLDGLLGKHWRNVGLAFNCTFLLFGSVIQLIACASNIYYINDNLDKRTWTYIFGACCATTVFIPSFHNYRIWSFLGLLMTTYTAWYLTVASLLHGQMEGVKHSGPTKLVLYFTGATNILYTFGGHAVTVEIMHAMWKPQKFKALYLLATLYVLTLTLPSAAAVYWAFGDMLLNHSNAFALLPKSPFRDMAVILMLIHQFITFGFACTPLYFVWEKAIGMHECKSLCKRALVRLPVVIPIWFLAIIFPFFGPINSTVGSLLVSFTVYIIPALAHIFTFRSPSSRQNAVEQPPKFVGRWVGTFIINTFVVVWVLVVGFGFGGWASMVNFIRQIDTFGLFTKCYQCPPPLLPPMPPHQLNATAPSPLHHPHHAH

SEQ ID NO: 807 - protein, 514 aa, Arabidopsis thaliana
MYTDTLSGLLENVAKKFPDRRALSVSGKFNLTHARLHDLIERAASRLVSDAGIKPGDVVALTFPNTVEFVIMFLAVIRARATAAPLNAAYTAEEFEFYLSDSDSKLLLTSKEGNAPAQEAASKLKISHVTATLLDAGSDLVLSVADSDSVVDSATELVNHPDDGALFLHTSGTTSRPKGVPLTQLNLASSVKNIKAVYKLTESDSTVIVLPLFHVHGLLAGLLSSLGAGAAVTLPAAGRFSATTFWPDMKKYSATCYTAVPTIHQIILDRHASHPETEYPKLRFIRSCSASLAPVILSRLEEAFGAPVLEAYAMTEATHLMSSNPLPEEGPHKPGSVGKPVGQEMAILNEKGEIQEPNNKGEVCIRGPNVTKGYKNNPEANKAGFEFGWFHTGDIGYFDTDGYLHLVGRIKELINRGGEKISPIEVDAVLLTHPDVSQGVAFGVPDEKYGEEINCAVIPREGTTVTEEDIKAFCKKNLAAFKVPKRVFITDNLPKTASGKIQRRIVAQHFLEKP

SEQ ID NO: 808 - protein, 697 aa, Arabidopsis thaliana
MAVMNGGRATKRARRSNRISADLYDFSTFPTAEINGESTTLPPFRDGVRTFLATHARVTFPPSTLFSSLMTWQIMLRPGDSTDGSDLSSKLVSLDVVEEDVTRSSRSVYCEHCCVVGWSSHPVCRKRYRFIIRSGGDTKACTRCGNTQNLSEGSNCKWCSMALDIENWVYSQLEDNTHLLHGVIHSNGYAHLLCLNGREGGSGFLTGRAIMDFWDRLCSSLAVRKASVMDVSRKYGMDYRLLHGITRGCSWYSEWGYEFKSGSYALTKEAYQSAVDTLSAIPLSEFLFQGRKPRTQLHSIISFYQSLSCSELVTVKDLFSFLLQMIRENSSKPASKSSVLCAWSKSDVERVQQTMVKILKASGRPQANWVTRWALKRSICKSASPQLIDYCLKHFGGVLVDDGSRVVSSRCNPGSNDFEYRLESVNNVHRLSNQDVNNASVEHVKQDLRYLYETLLHPQTMAEFRSRATREKMIDAATKILDCKHFIKDYLSSTVNPVAINLWCCVELSDELKESPAPPPERLVLPLNATVSDLKIEAAKAFQEVYAMFKRFEVEELLGYGSIDDSITLKFLVGTNGVIRIKGRCSKHGLLRYRMERGVDNWKVDCKCGTKDDDGERMLACDGCGVWHHTRCIGINNADALPSKFLCFRCIELYSKKPKQSKKERGSSQVPKAGFVCRGESAAMGSGSNLSVTLRVG

SEQ ID NO: 809 - protein, 365 aa, Arabidopsis thaliana
MGGVTSSMAAKLAFFPPNPPSYKLVRDETTELFLMSPFPHRENVDILRLPTRRGTEIVAMYIRYPMAVTTLLYSHGNAADIGQMYELFIELSIHLRVNLMGYDYSGYGQSSGKPTEQNTYADIEAAYKCLEENYGAKQENIILYGQSVGSGPTVDLAARLPRLRASILHSPILSGLRVMYPVKRTYWFDIYKNIDKITLVRCPVLVIHGTADDVVDFSHGKQLWELCQEKYEPLWLKGGNHCDLELFPEYIGHLKKFVSAVEKSASKRNSSFSRRSMEGCEQPPRHSVDAPRKSKDGREKPRKSIDRLRFQGYKLSHIEKPEKLKVPFEEMERSRRSVDIYRDKSQPMERARKSVDWLDRSRATE

SEQ ID NO: 810 - protein, 627 aa, Arabidopsis thaliana
MKYKRKLSLSVVFLFVFYLAAVTSDLESDRRALLAVRNSVRGRPLLWNMSASSPCNWHGVHCDAGRVTALRLPGSGLFGSLPIGGIGNLTQLKTLSLRFNSLSGPIPSDFSNLVLLRYLYLQGNAFSGEIPSLLFTLPSIIRINLGENKFSGRIPDNVNSATRLVTLYLERNQLSGPIPEITLPLQQFNVSSNQLNGSIPSSLSSWPRTAFEGNTLCGKPLDTCEAESPNGGDAGGPNTPPEKKDSDKLSAGAIVGIVIGCVVGLLLLLLILFCLCRKRKKEENVPSRNVEAPVAAATSSAAIPKETVVVVPPAKATGSESGAVNKDLTFFVKSFGEFDLDGLLKASAEVLGKGTVGSSYKASFEHGLVVAVKRLRDVVVPEKEFRERLHVLGSMSHANLVTLIAYYFSRDEKLLVFEYMSKGSLSAILHGNKGNGRTPLNWETRAGIALGAARAISYLHSRDGTTSHGNIKSSNILLSDSYEAKVSDYGLAPIISSTSAPNRIDGYRAPEITDARKISQKADVYSFGVLILELLTGKSPTHQQLNEEGVDLPRWVQSVTEQQTPSDVLDPELTRYQPEGNENIIRLLKIGMSCTAQFPDSRPSMAEVTRLIEEVSHSSGSPNPVSD

SEQ ID NO: 811 - protein, 241 aa, Arabidopsis thaliana
MAEASFYIGVIGNVISVLVFLSPVETFWKIVKRRSTEEYKSLPYICTLLGSSLWTYYGIVTPGEYLVSTVNGFGALVETIYVSLFLFYAPRHLKLKTVVVVAMLNVFFPIAAIVATRSAFEDEKMRSQSIGFISAGLNIIMYGSPLSAMKTVVTTKSVKYMPFWLSFFLFLNGAIWAVYALLQHDVFLLVPNGVGFVFGTMQLILYGIYRNAKPVGLSNGLSEIAQDEEEGLTSRVEPLLS

SEQ ID NO: 812 - protein, 511 aa, Arabidopsis thaliana
  misc_feature (344)..(344): Xaa can be any naturally occurring amino acid
MITVDHKSDTVLLPIYGRMVPFNVTTIRTVLGNQNTIRVIFNVPGTPLNPNDSLKNKDAIYLKEVSFRTKDSRHSSDVVQQVKSLRRKVMARESERAERTSLVNQEKLQIVRNNSKPLSLSNLWIRPPFSGRKKNRGTLEAHVNGFRYSTTNERVDVLFANIKHAFFQPAEKEMTTLLHFHLHNHIMVGTKKTKDVQFYVEVMDVVQSLGGRRRSSAYDADEIVEEQRERDRKNKINMDFNHFANQVNDMWQLPQFASLSLEFDQPLREFGFNGVPHKTSTFIIPTSSCLVELTESPFLVVCLSEIEIVNLERVGFGQKSFDMAIIFKDLKKDVLRVDSVPTSXLEGIKEWLDTTDIKYYESKLNLNWRQILKTITDDPQSFTDAGGWEFLNQDGSDSESGGSEDSDKGYEPSDVEVESESEDETSESESDDEEEEEDSEQESEEEKGKTWAELEREATNADREHGVESDSEEERKRRKMKAFGKSRPGSSGAGGSSSMKNMPPSKRSRHR

SEQ ID NO: 813 - protein, 727 aa, Arabidopsis thaliana
MNANEEGEGSRYPITDRKTGETKFDRVESRTEKHSEEEKTNGITMDVRNGSSGGLQIPLSQQTAATVCWERFLHVRTIRVLLVENDDCTRYIVTALLRNCSYEVVEASNGIQAWKVLEDLNNHIDIVLTEVIMPYLSGIGLLCKILNHKSRRNIPVIMMSSHDSMGLVFKCLSKGAVDFLVKPIRKNELKILWQHVWRRCQSSSGSGSESGTHQTQKSVKSKSIKKSDQDSGSSDENENGSIGLNASDGSSDGSGAQSSWTKKAVDVDDSPRAVSLWDRVDSTCAQVVHSNPEFPSNQLVAPPAEKETQEHDDKFEDVTMGRDLEISIRRNCDLALEPKDEPLSKTTGIMRQDNSFEKSSSKWKMKVGKGPLDLSSESPSSKQMHEDGGSSFKAMSSHLQDNREPEAPNTHLKTLDTNEASVKISEELMHVEHSSKRHRGTKDDGTLVRDDRNVLRRSEGSAFSRYNPASNANKISGGNLGSTSLQDNNSQDLIKKTEAAYDCHSNMNESLPHNHRSHVGSNNFDMSSTTENNAFTKPGAPKVSSAGSSSVKHSSFQPLPCDHHNNHASYNLVHVAERKKLPPQCGSSNVYNETIEGNNNTVNYSVNGSVSGSGHGSNGPYGSSNGMNAGGMNMGSDNGAGKNGNGDGSGSGSGSGSGNLADENKISQREAALTKFRQKRKERCFRKKVRYQSRKKLAEQRPRVRGQFVRKTAAATDDNDIKNIEDS

SEQ ID NO: 814 - protein, 558 aa, Synechocystis sp. PCC 6803
MASSMLSSATMVASPAQATMVAPFNGLKSSAAFPATRKANNDITSITSNGGRVNCMQVWPPIGKKKFETLSYLPDLTDSGGRVNCMQAMIQAKAGFKAGVQDYRLTYYTPDYTPKDTDLLACFRMTPQPGVPAEEAAAAVAAESSTGTWTTVWTDNLTDLDRYKGRCYDLEAVPNEDNQYFAFIAYPLDLFEEGSVTNVLTSLVGNVFGFKALRALRLEDIRFPVALIKTFQGPPHGITVERDKLNKYGRPLLGCTIKPKLGLSAKNYGRAVYECLRGGLDFTKDDENINSQPFMRWRDRFLFVQEAIEKAQAETNEMKGHYLNVTAGTCEEMMKRAEFAKEIGTPIIMHDFFTGGFTANTTLARWCRDNGILLHIHRAMHAVVDRQKNHGIHFRVLAKCLRLSGGDHLHSGTVVGKLEGERGITMGFVDLMREDYVEEDRSRGIFFTQDYASMPGTMPVASGGIHVWHMPALVEIFGDDSCLQFGGGTLGHPWGNAPGATANRVALEACVQARNEGRNLAREGNDVIREACRWSPELAAACELWKEIKFEFEAMDTL

SEQ ID NO: 815 - protein, 606 aa, Synechocystis sp. PCC 6803
MASSMLSSATMVASPAQATMVAPFNGLKSSAAFPATRKANNDITSITSNGGRVNCMQVWPPIGKKKFETLSYLPDLTDSGGRVNCMQAMDNSTVSSIDITPQDRYNQQLLAHVHPPDWINPSPKDQYDLVVIGAGTAGLVVAAGAAGLGIGLKVALIEKHLMGGDCLNFGCIPSKALISSARVVGVMNNANSLGIKKPDSIEIDFPAVMARMRQIRTGISHHDSAQRFRDLGIDVFLGEGHFVRNNQIEVGGAILNYKKAIIATGAKAVKPNIPGIEEVGFLTNETVFSLTACPDRLGVIGGGPIGCELAQAFQRLGAQVTLFHRGSHLLNKEDPEAAAIVQESLIKDGIELILNAKLERAELTDRGKVLHYRANGDSGTIVVDEILVGAGRAPNVEELNLEAVGVKFDRRGVKVNDYLQTTSPQIYAAGDICMDWKFTHAADAAARIVIKNTLFSPFGLGRSKLSSLTMPWVTYTDPEIAHVGLNETMAEALDIGYKIIKIPFSQVDRAIAADETEGFLKIIHVANSDEILGATIVASHAGEMISEITTAIVNKIGLSKLAGVIHPYPTQAEAIKKAADTYRRTLLTNNTKNLLKLLTKFPSKLF

SEQ ID NO: 816 - protein, 550 aa, Arabidopsis thaliana
MGRSNEQDLLSTEIVNRGIEPSGPNAGSPTFSVRVRRRLPDFLQSVNLKYVKLGYHYLINHAVYLATIPVLVLVFSAEVGSLSREEIWKKLWDYDLATVIGFFGVFVLTACVYFMSRPRSVYLIDFACYKPSDEHKVTKEEFIELARKSGKFDEETLGFKKRILQASGIGDETYVPRSISSSENITTMKEGREEASTVIFGALDELFEKTRVKPKDVGVLVVNCSIFNPTPSLSAMVINHYKMRGNILSYNLGGMGCSAGIIAIDLARDMLQSNPNSYAVVVSTEMVGYNWYVGSDKSMVIPNCFFRMGCSAVMLSNRRRDFRHAKYRLEHIVRTHKAADDRSFRSVYQEEDEQGFKGLKISRDLMEVGGEALKTNITTLGPLVLPFSEQLLFFAALLRRTFSPAAKTSTTTSFSTSATAKTNGIKSSSSDLSKPYIPDYKLAFEHFCFHAASKVVLEELQKNLGLSEENMEASRMTLHRFGNTSSSGIWYELAYMEAKESVRRGDRVWQIAFGSGFKCNSVVWKAMRKVKKPTRNNPWVDCINRYPVPL

SEQ ID NO: 817 - protein, 410 aa, Arabidopsis thaliana
MKEKAESGGGVGYVRADQIDLKSLDEQLQRHLSKAWTMEKRKSLSDGEDNVNNTRHNQNNFGHRQLVFQRPLLGGGYSNNNSSKNDIIRSTEVEKSRREWEIDPSKLIIKSVIARGTFGTVHRGIYDGQDVAVKLLDWGEEGHRSDAEIASLRAAFTQEVAVWHKLDHPNVTKFIGAAMGTSEMSIQTENGQMGMPSNVCCVVVEYCPGGALKSFLIKTRRRKLAFKVVIQLSLDLARGLSYLHSQKIVHRDVKTENMLLDKSRTLKIADFGVARLEASNPNDMTGETGTLGYMAPEVLNGSPYNRKCDVYSFGICLWEIYCCDMPYPDLSFSEVTSAVVRQNLRPEIPRCCPSSLANVMKRCWDANPEKRPEMEEVVAMLEAIDTSKGGGMIPPDQQQGCFCFRRHRGP

SEQ ID NO: 818 - protein, 325 aa, Arabidopsis thaliana
MKAIVISEPGKPEVLQLRDVADPEVKDDEVLIRVLATALNRADTLQRLGLYNPPPGSSPYLGLECSGTIESVGKGVSRWKVGDQVCALLSGGGYAEKVSVPAGQIFPIPAGISLKDAAAFPEVACTVWSTVFMMGRLSVGESFLIHGGSSGIGTFAIQIAKHLGVRVFVTAGSDEKLAACKELGADVCINYKTEDFVAKVKAETDGKGVDVILDCIGAPYLQKNLDSLNFDGRLCIIGLMGGANAEIKLSSLLPKRLTVLGAALRPRSPENKAVVVREVEKNVWPAIEAGKVKPVIYKYLPLSQAAEGHSLMESSNHIGKILLET

SEQ ID NO: 819 - protein, 528 aa, Nostoc punctiforme PCC 73102
MDARALWQRYQNWLYFHEGLGLYLDISRMRFDDAFVESLQPKFDKAFADMAELEKGAIANPDENRMVGHYWLRNPDLAPTPELTQEIVQTLEQIEAFAEKVQTGAIHPPRASRFTDIISIGIGGSALGPQFVAEALAPDFPPLKIHFIDNNDPAGIDRVLNHLRNSLASTLVLVISKSGGTPEPRNGMIEVKKAYAGHNLEFAQYAVAITSVDSNLDKLAKDEGWLARFPMYDWVGGRTSEMSAVGLVPAALQGIDVRAMLDGAKEMDDATRVPDVKNNPAALLALSWYFAGNGKGEKDMVVLPYKDSLFLFSRYLQQLVMESLGKEKDLDGNVVHQGIAVYGNKGSTDQHAYVQQLREGVANFFATFVEVLEDRQGPSTEIDPGVTSGDYLSGFLQGTRQALYENHRDSITVTIPQVNPRTVGALIALYERAVGLYASLVNVNAYHQPGVEAGKKAAASILDLQTRVVAVLQKEKTPISLDELAKKAGASDQIEAIYKILRHIHANQRGVVLQGDLHKPGSLTVSAS

SEQ ID NO: 820 - protein, 561 aa, Bacillus subtilis subsp. subtilis str. 168
MKTDWWKDAVVYQIYPRSFQDSNGDGIGDLRGIISRLDYIKELGADVIWICPIYPSPNVDYGYDVTNHKAIMDSYGTMDDFHELLDQVHQRGLKLVMDFVLNHTSVEHPWFKEAELDKNSKYRSYYYWRPGTKNGPPTDWLSNYGCPVWQYEEHTGEYYLHMNAVKQADLNWENPEVRQAVYDMMKFWLDKGVDGLRIDQLHLISKKEYLPSYEDYINQQAEPKPFQPNGERIHDYLKEITDEVFSHYDVMSVGEVGSVTPEEGLKYTGTDKHELNMIFHFQHMELDQQPGKEHWDLKPLELSDLKSVLTKWQKKLEHQGWNTLFWCNHDQPRIVSRFGDDGEYRKASAKMLAAVIYFMKGTPYIYQGEEIGMTNAPFTRIEDYKDIQTINMYHKRVFEKGYDPNDVMRSILAKSRDHARTPMQWNSGKNAGFTDGTPWLKVNPNFTAINVEEAQGDPDSVLNYYKKLISLRKQYADLMKGSFDLLLPDDPQLFVYMRENSKQQLLSVNNFSKEQAVFQWPKNCGKAQASLLLSNYNNDDLDDEMVFRPYESRVYLLDKTN

SEQ ID NO: 821 - protein, 209 aa, Arabidopsis thaliana
MSASKFIKCVTVGDGAVGKTCMLICYTSNKFPTDYIPTVFDNFSANVAVDGQIVNLGLWDTAGQEDYSRLRPLSYRGADIFVLAFSLISKASYENVLKKWMPELRRFAPNVPIVLVGTKLDLRDDKGYLADHTNVITSTQGEELRKQIGAAAYIECSSKTQQNVKAVFDTAIKVVLQPPRRKEVPRRRKNHRRSGCSIASIVCGGCTAA

SEQ ID NO: 822 - protein, 248 aa, Arabidopsis thaliana
LILLEIALIGVLLEQLEEDDEDMATSKKMITREEWEKKLNVVKLRKEDMNTLVMNFLVTEGYVEAAEKFQRESGTKPEIDLATITDRMAVKKAVQNGNVEDAIEKVNDLNPEILDTNPELFFHLQQQRLIELIRQGKTEEALEFAQEELAPRGEENQAFLEELEKTVALLVFDDASTCPVKELLDLSHRLKTASEVNAAILTSQSHEKDPKLPSLLKMLIWAQTQLDEKAVYPHINDLSTGKLEDPSE

SEQ ID NO: 823 - protein, 350 aa, Arabidopsis thaliana
MFQTLMVLIRRLMLLLNSLIVKVYRHDSNLFFVQGHKEWINEVNFLGVVNHPNLVKLVGYCADDDERGMQRLLVYELMCNKSLEDHLVGRVVSVSLPWMMRLKIAQDAAQGLAYLHEEMDFQLIFRDFKSSNILLDERFGAKLSDFGLARQGPPEGLGHVSTSVVGTVGYAAPEYVQTGKLTAKSDVWSFGVVLYELITGRRAVDRNRPRGEQKLLEWVKPYVSDSKKFHLIVDPRLEGQYYCMKSVQRVAALANKCLMKQPKSRPKMSEVVSLLGRIIDEEAENVPPPVADETEEIIKAELNGESEPELKKQGSSYRKKVLDLRDKMNLNKSLSKLDWRNWTPGLVRTW

SEQ ID NO: 824 - protein, 234 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMVLTALRSFLLFLAVTCLSLAIAMPAWALTEVPLTEIDYKPCPADLAEGNVGSGSSSPANCFLVTGIANNRTGKTVYDADVFGRIYDANHEPAMQNRTRLGNIAEIPPGKSDFEVRISVPAQQPLPLQLEQFKASGFSAKIRGQAL

SEQ ID NO: 825 - protein, 316 aa, Arabidopsis thaliana
MWFFGSKGASGFSSRSTAEEVTHGVDGTGLTAIVTGASSGIGVETARVLALRGVHVVMAVRNTGAGAKVKEDIVKQVPGAKVDVMELELSSMESVRKFASEYKSAGLPLNLLINNAGIMACPFMLSKDNIELQFATNHLGHFLLTKLLLDTMKNTSRESKREGRIVNVSSEAHRYSYPEGVRFDKINDESSYSSIRAYGQSKLCNVLHANELAKQLKEDGVNITANSLHPGAIMTNLWGYFNSYLAGAVGAVAKYMVKSVPQGAATTCYVALNPQVAGVTGEYFSDSNIAKPIELVKDTELAKKLWDFSTKLTDSQ

SEQ ID NO: 826 - protein, 195 aa, Arabidopsis thaliana
MASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKLDLRDDKQFFIDHPGAVPITTNQGEELKKLIGSAVYIECSSKTQQNVKAVFDAAIKVVLQPPKQKKKKKNKNRCAFL

SEQ ID NO: 827 - protein, 509 aa, Arabidopsis thaliana
MTLTIPNAPGSSGYLDMFPERRMSYFGNSYILGLTVTAGIGGLLFGYDTGVISGALLYIKDDFEVVKQSSFLQETIVSMALVGAMIGAAAGGWINDYYGRKKATLFADVVFAAGAIVMAAAPDPYVLISGRLLVGLGVGVASVTAPVYIAEASPSEVRGGLVSTNVLMITGGQFLSYLVNSAFTQVPGTWRWMLGVSGVPAVIQFILMLFMPESPRWLFMKNRKAEAIQVLARTYDISRLEDEIDHLSAAEEEEKQRKRTVGYLDVFRSKELRLAFLAGAGLQAFQQFTGINTVMYYSPTIVQMAGFHSNQLALFLSLIVAAMNAAGTVVGIYFIDHCGRKKLALSSLFGVIISLLILSVSFFKQSETSSDGGLYGWLAVLGLALYIVFFAPGMGPVPWTVNSEIYPQQYRGICGGMSATVNWISNLIVAQTFLTIAEAAGTGMTFLILAGIAVLAVIFVIVFVPETQGLTFSEVEQIWKERAYGNISGWGSSSDSNNMEGLLEQGSQS

SEQ ID NO: 828 - protein, 350 aa, Glycine max
MSFLRSFARNKDISKVGRRGIHCMQKLCAEKISPDSLEKAQNRVIDAALTLVRENTRLKKELVHSLGGAVATSTLLGVPLGHNSSFLEGPAFAPPFIREGIWCGSANSTTEEGKDLKDLRIMVDVGDIPIQEMRDCGIGDERLMKVVSDSVKLVMEEDPLRPLILGGDHSISYPVVRAISEKLGGPVDVLHFDAHPDLYDEFEGNYYSHASSFARIMEGGYARRLLQVGIRSINKEGREQAKKFGVEQFEMRHFSKDRPFLENLNLGEGAKGVYISIDVDCLDPGYAVGVSHYESGGLSFRDVMNMLQNLKGDIVGGDVVEYNPQRDTPDRMTAMVAAKFVRELAAKMSK

SEQ ID NO: 829 - protein, 562 aa, Zea mays
MSEVNNTQLDLEKGFSQVSHDNDSSSPVTVHKMKVETEGGSEIESPTPEKRESRSKGVVVSSLARNLLAERYKDRLANQLVEDESETDDEDYNESVSPSGSRSLFLESIELLEKHKDLLNLFNRMESSIRLLHLRKKMATFNNIATQVEILTKRKLLYSHLAQMKHLFPEAIQIKRILVHDEKSICMYADMEITLVMDVVECTSPDHSLSMTICEAFYSKLLRFLDAHHKGADIPEAILPEPFNSRPREKLYLEAVHNGHAAEPPLHGAVEEGFSNASHFPQSFQKFMSKKIIADGTEKTQLLSDPAELSSVSAYGTKGSNRNPKKQDEHAPVPVNSEISATPSRHLISCCQESTPKQQTSESPLLSGTPAMQTPKRPLLAPLEKPKATCGHISEPRSASSARRSLNTSLTYEGGSPSYYDGMEHTATAKKCMISEDLSSFNKSFEEDSHVFFTDKDKINEVESVDSQERIASLRTTFDIVYDISHSTKNPLITKQELFHNILANNLEIEEIGEIEEQLHILEDLAPDLISKKVINGGEILYSIEPITDKNSVRARLVVEPV

SEQ ID NO: 830 - protein, 442 aa, Zea mays
MNILLELKHLKPFSIPARLVICKGLLIVIALILLRAIVSPFLAIDSSEKKEFYESTAPDLLPRIRRDKFLEVPQIIWGLNNQKIAFARACLTARFLNRSLLMPSLSASLFYKEVDLLQPINFDKVFDFNKFNARCHGFVRLAQYSEVSNRTEPFKLQKGTGRRWTADRDLDQLQQSIGSNADDSEVIEIVGKNPFLWPDHWPVKDYAKIFDCLVLVPEIETEVVNVISKIREAGQRARHEAGSSHSKQRRDSSTNPPVPYVAVHMRIEKDWMIHCKKWEQRSKSHEICSSKEEIIHKVSQITDLHRPVVVYLAVADSLLEDDSITSGWRVGMVAYEKKKLGVTDVYDRQPYLIKSAIDFEVCSRADVFVGNSFSTFSNLVVLSRTERLYNLGKASSCGENIGLSSYAYNVMGGDGGPQRWMTDMSDGSLQRLSYGTNNVSCH

SEQ ID NO: 831 - protein, 326 aa, Arabidopsis thaliana
MSAVLTAGGGLTAGDRSIITAINTGASSLSFVGSAFIVLCYCLFKELRKFSFKLVFYLALSDMLCSFFLIVGDPSKGFICYAQGYTTHFFCVASFLWTTTIAFTLHRTVVKHKTDVEDLEAMFHLYVWGTSLVVTVIRSFGNNHSHLGPWCWTQTGLKGKAVHFLTFYAPLWGAILYNGFTYFQVIRMLRNARRMAVGMSDRVDQFDNRAELKVLNRWGYYPLILIGSWAFGTINRIHDFIEPGHKIFWLSVLDVGTAALMGLFNSIAYGFNSSVRRAIHERLELFLPERLYRWLPSNFRPKNHLILHQQQQQRSEMVSLKTEDQQ

SEQ ID NO: 832 - protein, 148 aa, Arabidopsis thaliana
MSEQEGKNEKKVTEGQWTTGLYDCLSEDISTCCFTWVCPCVAFGRIAEILDKGETSRGLAGLMVVAMSSIGCGWYYASKYRAKLRHQYALPEAPCADGAIHCFCCPCALTQEHRELKHRGLDPSLGWNIENGGLNSNTPPFVASGMDR

SEQ ID NO: 833 - protein, 62 aa, Arabidopsis thaliana
MESDLGKLFIGGISWDTDEERLRDYFSNYGDVVEAVIMRDRATGRARGFGFIVFADPCVSER

SEQ ID NO: 834 - protein, 148 aa, Arabidopsis thaliana
MPSSTFSGTVSTPKLSVAVDMGNPFLNLTVDAFLKIGAVGVTKSLAEDTYKAIDKGSLSKSTLEHALKKLCKEGVYWGAAGGVYIGTEYGIERIRGSRDWKNAMLAGAATGAVLSAVGKKGKDTIVIDAILGGALATASQFVNNHYFY

SEQ ID NO: 835 - protein, 202 aa, Arabidopsis thaliana
MEGTVFTPCLEGMKHVKSDQGEMLTKPFLELCKTILPVIDKFGAAMTLVKSDIGGNITRLEKNYLSDPDKFKYLYTFVQVEIESKIAKGSSSCTNGLLWLTRAMDFLVELFRNLVAHQDWSMPQACADSYQKTLKKWHGWLASSTFSMALKLAPDRKKFMDVISGSGNIQADMERFCAEFGPFLHDNHKFLASVGMDDMKAS

SEQ ID NO: 836 - protein, 234 aa, Arabidopsis thaliana
MATASESSSSKRWLPLESNPDVMNQYLWGLGLAPDEAECNDVYGLDDELLEMVPKPVLAVLFLYPITKKSEEERIEQDKEIKEKVHSDKVYFMKQTVGNACGTIGLLHAIGNITSEIKLSDGSFLDRFFKSTANMTPMERAKFLENDSQIEDAHSVAVIAGDTPASEDADTHFICLACVEGELYELDGRKAGPISHGASSPATLLKDATKVIKKMIEKNPGSLNFNLIAISKRT

SEQ ID NO: 837 - protein, 185 aa, Arabidopsis thaliana
NFQKLRGQQSIAIDDSNTSGHENRDFKSMGWEEWRDSRKDGYGLDVTNPTSDTALMDAIHKEDTEMVKKILKEQKIERAKVERSSSETAGRSYANDSSKKDPYCSSSNQIIKPCKREEKRVTIHMMSESKNGKLILLPSSIEELLRLASEKFGGCNFTKITNADNAEIDDLDVIWDGDHLYFSSN

SEQ ID NO: 838 - protein, 257 aa, Arabidopsis thaliana
MTKDFPIPPVVFPTSGSSPATANVQQRRVPTAPYQPPRQSSASSSIPFIPFEIGSAAVSMPAGPFDGTIASSASFGRGVSASFEDEEPLLDELGIHPDQIWKKTRSILNPFRINQTVHKDSDLSGPIFLYLALCLFQLLAGKIQFGVILGWVVVSSIFLYIVFNMLAGRNGNLNLHTCTSLVGYSLLPVVILSAVSLFVPQGAGPVRFVLGAAFVLWATRACSNLVVSLADGGEEHRGLISYACFLIYTLFSLLVIF

SEQ ID NO: 839 - protein, 344 aa, Arabidopsis thaliana
MEWIRGETIGYGTFSTVSLATRSNNDSGEFPPLMAVKSADSYGAASLANEKSVLDNLGDDCNEIVRCFGEDRTVENGEEMHNLFLEYASRGSLESYLKKLAGEGVPESTVRRHTGSVLRGLRHIHANGFAHCDLKLGNILLFGDGAVKIADFGLAKRIGDLTALNYGVQIRGTPLYMAPESVNDNEYGSEGDVWALGCVVVEMFSGKTAWSLKEGSNFMSLLLRIGVGDEVPMIPEELSEQGRDFLSKCFVKDPKKRWTAEMLLNHPFVTVDVDHDVLVKEEDFVVNMKTEDVSTSPRCPFEFPDWVSVSSGSQTIDSPDERVASLVTDMIPDWSVTNSWVTVR

SEQ ID NO: 840 - protein, 63 aa, Arabidopsis thaliana
MASLKFPLEILAVFVIISVILLPIAQSHSSSPAPAPTSDGTSIDQGIAYVLMMVALALTYFIH

SEQ ID NO: 841 - protein, 414 aa, Arabidopsis thaliana
MDLLRLREKGIFLSQRRRKWLIFMAISGVSGYGAYKVYHLPSVARKRKRLFKLFGAIVSVAELISDSAETLSMVSRDVKDFLNSDSDEIPNSLKQIAKITTSNEFTDSLSRVSQAVTIGAFRGYKSESSIGDSGIEKSSDSSVVDRVIDKVFSEAGTGFVSVVVGSFAKNLVLGFYSGKVESGVKCEGSDSSETPRWVTLLGDDKCRELLADCIERFTSTAIGVYLDKTMDINTYDQIFEGLTNPKHQDSVKDVLVSVCNGALETIVRTSHDVFTSSRSKNVIEEIEDDDFKSNGSARSKMVSESGDGVKSNGWTEAIATTLAVPSNRRFMFDVTGRVTLETTRSIIAFIMVKTFQGFRKSINVVHEEVTDRGRQAVEYVGAKSSVIITVCLALYLHIISGCVRNSPIGVSQHF

SEQ ID NO: 842 - protein, 430 aa, Zea mays
MSVAAGVSDAAIAVRDKLRGKIGQTKVKRYWPGKAPEWADDVDEDVDLRTARVSLDKAFPRDEDGDVPAKDDRRLRRLAETRAENKEELRADHRRIRQAEIVSTAEEENERQEADADEEDEEAQEERRRRIRARQLLREQEELLPQEEEEPVEAEESEEESEYETDSEDEQMGMAMVKPVFIPKSQRDTIAERERLEEEERQLEELVKKRLEARKIETRQIVVEEIRKEEHIEKALNEEANIEDVDTDDELNEAEEYESWKNREIARIKRDREERDARLKEKEEIEKVRNMTEEERREWERKNPKPLRQTKQKWKFMQKYYHKGAFFQEGADDVIQSAGKEDIYTRDFSEPTGEDKMDKSILPKVMQVKHFGRSGRTKWTHLVNEDTTDWNAPWSTNGPLRAKYNAKMAGMNAPIAKPKGSKKLKDWDAK

SEQ ID NO: 843 - protein, 198 aa, Zea mays
MEGQFQVGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRYCLEGSGYLDVRDQDDQWIRVAVKKGGMIVLPAGMYHRFTLDSDNYIKAMRLFVGEPVWTPYNRPHDHLPARKEYVEKIINRGGNQAVEAR

SEQ ID NO: 844 - protein, 170 aa, Zea mays
MQGGGGVDQPPMQMVLRVRHPSSLGGSGADEDDGEGSSRSALSVFKAKEEQIERRKMEVREKVFAHLGRVEEESKRLAFIRQELEGMADPTRKEVESIRKRIDTVNRQLKPLSKSCVKKEKEYKEVLEAYNEKSKEKALLVNRLIELVSESERMRMKKLEELNKTVDSLY

SEQ ID NO: 845 - protein, 500 aa, Arabidopsis thaliana
MADGNTRFTVDEALVAMGFGKFQIYVLAYAGMGWVAEAMEMMLLSFVGPAVQSLWNLSARQESLITSVVFAGMLIGAYSWGIVSDKHGRRKGFIITAVVTFVAGFLSAFSPNYMWLIILRCLVGLGLGGGPVLASWYLEFIPAPSRGTWMVVFSAFWTVGTIFEASLAWLVMPRLGWRWLLAFSSVPSSLLLLFYRWTSESPRYLILQGRKAEALAILEKIARMNKTQLPPGVLSSELETELEENKNIPTENTHLLKAGESGEAVAVSKIVLKADKEPGFSLLALLSPTLMKRTLLLWVVFFGNAFAYYGVVLLTTELNNSHNRCYPTEKQLRNSNDVNYRDVFIASFAEFPGLLISAAMVDRLGRKASMASMLFTCCIFLLPLLSHQSPFITTVLLFGGRICISAAFTVVYIYAPEIYPTAVRTTGVGVGSSVGRIGGILCPLVAVGLVHGCHQTIAVLLFEVVILVSGICVCLFPFETSGRDLTDSISASKEPPSASV

SEQ ID NO: 846 - protein, 537 aa, Corynebacterium glutamicum
MTAAQTKPDLTTTAGKLSDLRSRLAEAQAPMGEATVEKVHAAGRKTARERIEYLLDEGSFVEIDALARHRSKNFGLDAKRPVTDGVVTGYGTIDGRKVCVFSQDGAVFGGALGEVYGEKIVKVMDLAIKTGVPLIGINEGAGARIQEGVVSLGLYSQIFYRNTQASGVIPQISLIMGACAGGHVYSPALTDFIVMVDQTSKMFITGPDVIKTVTGEDVTQEELGGAHTHMATSGTSHYSASDDSDALDWVRELTSYLPSNNRAETPRQEADIMIGSIQENINDVDLELDTIIPDSPNQPYDMKEVISRIVDDAEFFEIQEDYAENILCGFARVEGRSVGIVANQPTQFAGCLDIKASEKAARFIRTCDAFNIPILEFVDVPGFLPGTNQEFDGIIRRGAKLLYAYAEATVGKITVITRKSYGGAYCVMGSKDMGADLVFAWPTAQIAVMGASGAVGFIYRKELKQAATEGKDVAEVMKGYEQEYEETLVNPYVAAERGLVDAVIPPSETRGQIIEGLRLLDRKVVNVPAKKHGNIPL

SEQ ID NO: 847 - protein, 498 aa, Zea mays
MTIARRLLRSNASAQAISLLKHVTGTASLQGHAHSPLDASVRHFSSAPSAQSDTTEENGFKGHGMLAPFTAGWQSNDLHPLIIERSEGSYVYDINGNKYLDSLAGLWCTALGGSEPRLVKAATEQLNNLPFYHSFWNRTTKPSLDLAQEILSMFTAREMGKVFFTNSGSEANDSQVKLVWYYNNALGRPDKKKFIARSKAYHGSTLISASLTGLPALHQKFDLPAPFVLHTDCPHYWRYHLPGETEEEFATRLATNLENLILKEGPETIAAFIAEPVMGAGGVIPPPKTYFDKVITAFGRLGTMFGCDYYNIKPDLVSLAKALSNAYVPIGATLVSPEISEVIHSQSNKLGSFAHGFTYSGHPVACAVAIEALKLYRERDIPGHVKQIAPKFQDGIRALADSPIIGEIRGLGMIMGTEFTNNKSPADLFPAEWGVGAIFGEECQKRGMLVRVAGDAIMMSPTLIMTPGEVDELVSIYGEALRATEERVSDLKMKSEKN

SEQ ID NO: 848 - protein, 364 aa, Zea mays
MASEPVARAVAEEVGRWGSMKQTGVTLRYMMEFGSRPTQRNLLLSAQFLHKELPIRFARRALELDSLPFGLSNKPAILKVRDWYLDSFRDIRYFPEVRSRNDELAFTQMINMVKVRHNNVVPTMALGVQQLKKELGRSRKVPFEFDEIDEFLDRFYMSRIGIRMLIGQHVALHDPKPEPGVIGLINTRLSPIQVAQAACEDARSVCLREYGSAPDINIYGDPNFTFPYVTLHLHLMLFELVKNSLRAVQERYMNSDKDVPPVRIIVADGEEDVTIKVSDEGGGIPRSGLPRIFTYLYSTAKNPPELDRPNTEGVTMAGYGFGLPISRLYARYFGGDLQIISMEGYGTDAYLHLSRLGDSEEPLP

SEQ ID NO: 849 - protein, 385 aa, Bacillus halodurans
MFGRKVLSFLMIIILLGTMLQVNQAYALESVTLFTPHTGTSAAPGDTIRYNVDVMNNGSSIQSMSFAMEGLPKGWNYNIKSDEADVRELSVKGNSEASITAEISVPLDADKGEYQFALVATDGNSQSTLDLAVSVTEQGSFETELTTKQGNLEGHADSTFSYTVTLSNKTAEAQNYALSNSADDGWGVRFLSEGNSVTSLSLDPNTSTDLTVEVTPPENVEADTYEIPITASTTDSNSELVLEAVVTGSYGIEVTTPTGVLNTDMTAGDDQTIELVITNTGTAPLTDINLSVDAPSEWEVEFDENTIADLEPGDSKTVKATVTAPKDAIAGDYVATFTASTDETSSDATFRISVGTSTVWGIVSIAIILGVVGGLYSIIRKFGRR

SEQ ID NO: 850 - protein, 694 aa, Arabidopsis thaliana
MLCACSGEQFRFEDQPGSPESLATRDFSASGLSSRNGGGDWDSKLEDIQVDEAESTLKEALSLNYEEARALLGRLEYQRGNFDAALQVFKGIDIKVLTPRIIKAIVEKTLPCKPRSKAVIVPPTTMSMHSVSLLLEAILLKARSLEELGSYKEAAEECKIILDVVENALPSGMPDGISGFAKLQDIFQKALELLPLLWKKAGNHHETIASYRRALSRPWNLDPQRLAVTQKSLALVLLYGSVEACPKDNIEEAIVLLMLLVKKMVVGDIQWDPELMDHLTYALSMTGQFEVLANYLEQTLPGVYTRGERWYLLSLCYSAAGIDKAAINLLKMALGPSESRQIPHIPLLLFGAKLCSKDPKHSRDGINFAHRLLDLGNSQSEHLLSQAHKFLGVCYGNAARSSKLDSERVFLQKKSLFSLNEAAKRGKADPELDVIFNLSVENAVQRNVQAALDGAVEYSSMVGGVSTKGWKHLAIVLSAEKRLKDAESILDFTMEEAGDIEKIELLRLKAVLQMAQEQPKKAMKTCSSLLGLIRAQEKSEQSESLLQKFETEAWQDLASVYGKLGSWSDAETCLEKARSMCYYSPRGWNETGLCLEAKSLHEEALISFFLSLSIEPDHVPSIVSIAEVMMKSGDESLPTAKSFLMNALRLDPRNHDAWMKLGHVAKKQGLSQQAAEFYQAAYELELSAPVQSFI

SEQ ID NO: 851 - protein, 135 aa, Brassica napus
MADQQRSGHNTSDSRRKSAAGRRTSQHTTTSSLSSGGGAMAAAATTGTGTVSPCGACKFLRRKCVSGCIFAPHFGSDQGAARFAAVHKVFGASNVSKLLHHIPVNRRHDAVVTISYEAQARLSDPVYGCVSTILA

SEQ ID NO: 852 - protein, 146 aa, Brassica napus
QKGLTLKETRQMEFLSQVVDETLRVITFSLTAFREAKTDVEMNGYLIPKGWKVLTWFRDVHMDPEVFPDPRKFDPSRWDKGFIPKTGAFLPFGAGSHLCPGNDLAKLEISIFLHHFLLKYRVKRSNTECPVMYLPHTRPTDNCLAR

SEQ ID NO: 853 - protein, 326 aa, Brassica napus
  misc_feature (177)..(177): Xaa can be any naturally occurring amino acid
  misc_feature (188)..(188): Xaa can be any naturally occurring amino acid
  misc_feature (269)..(269): Xaa can be any naturally occurring amino acid
MWFFGKKGASGFSARSTAEEVTHGVDGTGLTAIVTGASSGIGVETARVLALRGVHVVMAVRNTGSGAKVKEDIVNRVPGAKLDVMELDLSSMDSVRKFASDYKSSGRPLNLLINNAGIMACPFMLSKDNIELQFATNHLGHFLLTKLLLDTMKNTSRESKRGGRIVNLSSEAHRYSXPEGVRFDKITXTKSSYSSIRAYGQSKLCNILHANELAKQLKEDGVNITANSLHPGAIMTNLGRYFNSYLAGAVGAVAKYVLKTVPQGAATTXCYVALSPQVTGVTGEYFLDSNIAKPISLAKDSELAKKVWDFSTKLTESQSGESSTSN

SEQ ID NO: 854 - protein, 138 aa, Brassica napus
  misc_feature (59)..(59): Xaa can be any naturally occurring amino acid
  misc_feature (132)..(132): Xaa can be any naturally occurring amino acid
VRYNVAPDVLLKRYGPEADVWTAGVILHRLLSGVPPFWAHAQQGIFDAVLTGHIHFESXPWPVISDSAKDLIRRMLCSKPAERLTAHEVLRHPWICENGVAPDRALDPAVLSRLKQFSAMNKLKKMALKVIXESLSEE

SEQ ID NO: 855 - protein, 73 aa, Brassica napus
MDLKMDNVIGGKFKLGRKIGGGSFGELFLGVSVQTGEEVAVKLEPAKTKHPQLHYESKIYMLLQGGTGIPSLK

SEQ ID NO: 856 - protein, 480 aa, Brassica napus
MASVAASPAFSLRKSTTGATYSAATRARASLLPVPSKSISTRPLGFSAVLDSRFTVHVASKVQSFRGKGTRGVVSMAKKSVGDLTSADLKGKKVFVRADLNVPLDDNQTITDDTRIRAAIPTIKYLIENGAKVILSTHLGRPKGVTPKFSLAPLVPRLSELLGIEVKKADDCIGPEVESLVASLPEGGVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKAKGVSLLLPTDVVVADKFAPDANSKVVPASGIEDGWMGLDIGPDSIKTFNEALDTTQTVIWNGPMGVFEMEKFAAGTEAVANKLAELSEKGVTTIIGGGDSVAAVEKAGVAGVMSHISTGGGASLELLEGKVLPGVIALDEAITVTV

SEQ ID NO: 857 - protein, 239 aa, Brassica napus
KPSVAGFLLQKELDYLVGAVSSPKRPFAAIVGGSKVSSKIGVIESLLEKCDILLLGGGMIFTFYKAQGLSVGSSLVEEDKLELATSLLAKAKAKGVSLLLPTDVVVADKFAPDANSKVVSASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIAVTV

SEQ ID NO: 858 - protein, 64 aa, Brassica napus
MAGHRVAHATLKGPSVVKELVIGLALGLAAGGLWKMHHWNEQRKTRAFYDLLERGEISVVHPEE

SEQ ID NO: 859 - protein, 135 aa, Brassica napus
ATLWGSTDLLTGDELFFDFFLYRGMENGFFGEVEGKGTTKGWVGVNMGANQFVEEGGEDKGVANFVEKVVDIVNTLRFKEQPTYNRKGLMAYIKKSIKLLTPKLTRDQLEGFKKGLEGATKYFFPKLKDFQFFVG

SEQ ID NO: 860 - protein, 184 aa, Brassica napus
MVIMIRYPPQLAMALDDDQYLEYHLEDIPSNAEEEERMLMKAVMESLKDLEVQSLEKKESPEKRVLGSNSFQTAQEPLLSRKESTSTQANQSETTDSASSPATVGGDVAPSSSESKAPNGTSDSLTAPVDASVPGCTSQNASENGDMSADTKATVTVERTSSAPGKVFDGLIRKWDLNFFKNNK

SEQ ID NO: 861 - protein, 236 aa, Brassica napus
RFVQASALVSQPALYSKDLLREHTIGPAMVHPSETVKGSLWHDLQDPGVKRALFVRVGLQILQQFSGINGVLYYTPQILEQAGVGILLSNLGISSSSSSLLISALTTFVMLPAIAVAMRLMDLSGRRTLLLTTIPILIASLIVLVISNLVHMNSIVHAVLSTVSVVLYFCFFVMGFGPTPNILCSEIFPTRVRGICIAICALTFWICDIIVTYSLPVLLKSIGLAGVFGMYAVVCC

SEQ ID NO: 862 - protein, 143 aa, Brassica napus
  misc_feature (34)..(34): Xaa can be any naturally occurring amino acid
  misc_feature (93)..(93): Xaa can be any naturally occurring amino acid
  misc_feature (120)..(120): Xaa can be any naturally occurring amino acid
PAQDQLAAPLTGSKRSAGFPDTRKSNTDSYFHVXASRDARSSCMNEWAPHGKKKIETLSYVPDLTDHQSTKQDDYLLHLTGGTPCVEYEMQHXFVGPERGNTPGYYDARYWTMGKLSLIXCTDSAQMLKEVLECKTEYPNAFI

SEQ ID NO: 863 - protein, 314 aa, Brassica napus
  misc_feature (265)..(265): Xaa can be any naturally occurring amino acid
  misc_feature (274)..(274): Xaa can be any naturally occurring amino acid
  misc_feature (291)..(291): Xaa can be any naturally occurring amino acid
MASSLTAAGTQPSAPSFSGLRRTCLKLDAAVSFSHRVNSSVRLVSSSQRSPRGVVAMAGSGKFFVGGNWKCNGTKDSITKPVSDLNTATLEPDVDVVVSPPFVYIDQVKSSLTDRIEISGQNSWVGKGGAFTGEISVEQLKDIGCKWVILGHSERRHVIGEKDEFIGKKAAYALSEGLGVIACIGEKLEEREAGKTFDVCFDQLKAFADAVPSWDKVVVAYEPVWAIGTGKVASPQQAQEVHVAVRDWLKKNVSEEVASKTRIIXGGSVNGAHXADLPKEEAIDGFLVAGXSLKGPEFAPHCELSSPQRKFLLD

SEQ ID NO: 864 - protein, 274 aa, Brassica napus
VDPRVRAAAANTAAIFASPLKPLSSKSSLLYSSTISPLQRRYPTRKLDLQVIKAVATTLAPPEEIKEYRLPSWAMFEMGKAPVYWKTMNGLPPTAGEKLKLFYNPAATELTPNEDYGVAFNGGFNQPIMCGGEPRAMLKKERGKADSPIYTMQICIPKHAVNLIFSFTNGVDWHGPYRLQFQVPKRWQNKPIGFFNEGLANELSQDGACERAIFPDSNIVATRCTMIANLTVEGGDRCNLDLVPGCMDTNSEHFNPLANVDDGSCPLELSDSDE

SEQ ID NO: 865 - protein, 236 aa, Brassica napus
  misc_feature (215)..(215): Xaa can be any naturally occurring amino acid
  misc_feature (224)..(224): Xaa can be any naturally occurring amino acid
MDFNAGVPMSSLSPLMTQEAMWQMNLSHDETMEAGSYPERPGEPNCSYYIRTGLCRFGSTCRFNHPPDRELVIATARMRGEYPERIGQPECEYYLKTGTCKFGVTCKFHHPRNKAGIAGRVSLNMLGYPLRSNEVDCAYFLRTGHCKFGATCKFNHPQPQPTTSLMVPTSGQQQSYPWSSASFIPSPRWQDPSGYTPLLMPQGSVPVQGWNPYTXQLGSVSPSXTGNDHTTTETCS

SEQ ID NO: 866 - protein, 170 aa, Brassica napus
RPRVRALGDGEDNTMGVESRLTLEARLRALEGKALGRLSGSAKGKPKIEVYAKDKKSGSGGLITPAKTYNTAADSLLGQTSTAENGVKEKKDKKKKKKKAADAEEEEAKTEEPSKKKSKKKKAEVEAEAEEPKAEDPSKKKKKRKPEEEEPEMPAKKKEKKDKKKKKSEV

SEQ ID NO: 867 - protein, 162 aa, Brassica napus
VDPRVRLLQPEFVDPLNQTAMACPAFPLCPLAITEAERGIPSILKRVRAMFEKVGLEYDESVVVRVTGCPNGCARPYMAEVGLVGDGPNSYQVWLGGTPNQTQIARAFMDKVKIQDLEKVFEPLFYNWKLGRQAKESFGEFTTRMGFEKLKELISAYEGSPQ

SEQ ID NO: 868 - protein, 72 aa, Brassica napus
MHDFCFTIPYGMLLMVGGSMGYFKKGSIASLAGGAGTGLLVLLAGFITLKAFEKKKKSPVFAVVLQTGLFLS

SEQ ID NO: 869 - protein, 137 aa, Brassica napus
EIFPKLSKVLFLDDDIVVQKDLSGLWSVDLKGNVNGAVETCGESFHRFDRYLNFSNPLISKNFDPRACGWAYGMNVFDLDEWKRQNITEVYHRWQNLNQDRDLWKLGTLPPGLITFWKRTYPLDRKWHVLGLGYNPS

SEQ ID NO: 870 - protein, 121 aa, Brassica napus
MFGRSALHRAGGFRPENLGQNALNLIGNIGFSLFVVGVLVFTIIAATYEPEDPLFHPSDKITTFLTSTSNATLRSDESVVETGEDFMPGNQTAFAAFINITDVDPTASEENELDCDASVPP

SEQ ID NO: 871 - protein, 181 aa, Brassica napus
MASSMLSSATVVSSPAQAAMVAPFTGLKSSAAFPVTRKTNTDITSIASNGGRVNCMKVWPPVGKKKFETLSYLPDLTDVELAKEVDYLLRNKWIPCVEFELEHGFVYREHGNTPGYNDGRYWTMWKLPLFGCTDSAQVLKEVQECKTEYPNAFIRIIGFDNNRQVQCISFIAYKPPSFTGA

SEQ ID NO: 872 - protein, 181 aa, Brassica napus
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 873 - protein, 166 aa, Brassica napus
VKRPWHLLWKSRRLMEIVGAIASRLNWDYDAVHIERGEKARNTELWPNLEKDTSPSALLSTLQDKVEEGRNLYIATNEAELSFFNPLKDKYATHFLDEYKDLWDESSEWYSETTKLNGGNPVEFDGYMRASVDTEVFLRGKKQIETFNELTNDCKDGVGTCNVAAT

SEQ ID NO: 874 - protein, 151 aa, Brassica napus
SKKYETAKKFGVNEFVNPKDHQKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNMTLGEINKAFDLLHEGTCLRCVLSTSD

SEQ ID NO: 875 - protein, 266 aa, Brassica napus
  misc_feature (30)..(31): Xaa can be any naturally occurring amino acid
  misc_feature (83)..(84): Xaa can be any naturally occurring amino acid
  misc_feature (239)..(239): Xaa can be any naturally occurring amino acid
MMQMDGGDRLRVTLLDCMETGRSSLPGLTXXAILMADRNGTPPQPLPSRNQSNRTLLDVMQREHRHDYSSHRDKTAWKSLREXXRLKRNATVWISSNPIPSLNTPVLNRDNDSHQLGSLLSNSRNEGGQSQPESASSGGVTADGRLQLGAVLAEERGLSAREEETPPVTADMQPARMSLMELLDENEGQMSLVGVGGDGEEEERGVVEETAAAAEISCCVCMVRSKGAAFIPCGHTFCXLCSRELWVQRGNCPLCNTSISEILDLF

SEQ ID NO: 876 - protein, 136 aa, Brassica napus
  misc_feature (98)..(98): Xaa can be any naturally occurring amino acid
  misc_feature (122)..(122): Xaa can be any naturally occurring amino acid
GRVGGRVGVNHQRCVAAWLGQGIYIVERDRQLQREGSQALASPWWDSFHFKLIRRLIDDADFSIFGAIYEFKPPQQDTTSITTADSKAPRYAIAFRGXTLTKPDSISRDLEFDIHIIPIGLXRTSRFHIVIQAARS

SEQ ID NO: 877 - protein, 77 aa, Brassica napus
STHASARIFGGLKWGDTGSAHATLKGPSVEKELVIGLALGLSAGGLCKMHHWNDQRKTRAFYDLLDRAEIIISHPEE

SEQ ID NO: 878 - protein, 258 aa, Brassica napus
  misc_feature (123)..(123): Xaa can be any naturally occurring amino acid
MTKDFAIPPVVFPSGGSTSNPNVQQRRFPAAPFQPPRPSSSAIPFMSFDIGSAAASSAAPAGPFTGTLNSSASFGGGGGSSSFEDEEPLLDELGIHPDQIWKKTRSILNPFRINQTVHHDSDXLSGPIFLYLALCLFQLLAGKIQFGVILGWIVVSSIFLYAVFNMLAGRNGNLNLHTCTSLVGYCLLPVVILSAVSLFVPQGAGAVRFAVAGVFVLWSTRACSALVVSLADGGEEHRGLISYACFLIYTLFSLLVIF

SEQ ID NO: 879 - protein, 148 aa, Brassica napus
VALAVAQVVMAIGTSFFAFGWPGAMYIGTLLIGLGYGAHWAIVPATASELFGLKNFGALYNFLTLANPAGSLVFSGMIASTICDMEAEKQAHGSVFNPDDVLKCDGYICYFLTSLIMSGFCIIACILSLFLVRRTKPVYTQLYGKTRT

SEQ ID NO: 880 - protein, 51 aa, Brassica napus
  misc_feature (15)..(15): Xaa can be any naturally occurring amino acid
TRRLDILFYIFQFIXVLLFTVIILIGTGWSFLKPFLQEKEKNVLIIVIPLS

SEQ ID NO: 881 - protein, 133 aa, Brassica napus
VREKEEEEEEEEGEEEEDLLSRVDPETARGIAKQMFSIGTIVEVSSDEEGFKGSWFAAKVIEHVDEDKYLVEYRDLREENGIEPLKEEADFLHIRATPTTDEDVDFAVGEKIDAFYNDALWVRDVIDSMKDGI

SEQ ID NO: 882 - protein, 152 aa, Brassica napus
  misc_feature (134)..(134): Xaa can be any naturally occurring amino acid
MSSKDKKPAKPSSSRAGGIRTLSDLNRRSNPDSDSDSDGPQEYYTGGEKSGMMVQDPSKKDDVDEIFNQARQLGAVEGPLETPSSSSRSFTGTGRLLSGESVATAPPQQPDPVAHNIVFWSNGFTIDDGPLRKXLDDPENASFLESIRESEC

SEQ ID NO: 883 - protein, 109 aa, Brassica napus
APPTRFIVADGIEDVTIKVSDEGGGIPRSGLPKIFTYLYSTARNPLEEDVDLGTADVPVTMAGYGYGLPISRLYARYFGGDLQIISMEGYGTDAYLHLSRLGDSQEPLP

SEQ ID NO: 884 - protein, 146 aa, Brassica napus
MASSIIMFEDIFVVDKLDPDGKKFDKVTRIEATSHNLDMFMHLDVNTEVYPMAVGDKFTLAMAPTLNLDGTPDTGYFTPGAKKTLADKYEYVMHGKLYKITERDGQTPKAEMYVSFGGLLMLLRGDPAHISHFELDQRLFLLMRKL

SEQ ID NO: 885 - protein, 66 aa, Brassica napus
VERAGHRVAHPPLKGPSVVKELVIGLALGLTDGGLGKMHPWNEQRKPRAFYVLLKRGKISVVPPEE

SEQ ID NO: 886 - protein, 160 aa, Brassica napus
VLMIVIPLQVLANIASIVIGETGPFIKDWVTWNQVFLLVDIICCCAIIFPIVWSIRALRETSKTDGKAARNLSKLTLFRQFYIVVIGYLYFTRIVVFALKTIAAYKYQWVSFAAEEIVSLVFYVIMFYMFRPEEKNEYFAVDDDEEEAAAIALRDDEFEL

SEQ ID NO: 887 - protein, 218 aa, Brassica napus
MGSSGDVNWKLEDHPKLPKGKTIGLIVLDGWGESEPDQYNCIHKAPTPAMDSLKNGRPDTWRLIKAHGTAVGLPSEDDMGNSEVGHNALGAGRIYAQGAKLVDLALESGKIYEDEGFKYISESFEKGTVHLIGLLSDGGVHSRLDQVQLLVKGFAERGAKRIRVHILTDGRDVLDGSSVGFVETLESELAELRSKGVDAQVASGGGRMYVTMDRYEND

SEQ ID NO: 888 - protein, 123 aa, Brassica napus
EAIKVCLEGKLQGIVSEVKGVFRNPSAIAKIKESNLSLLTYGKLNNVGEAVYMQYVMGIEGVIVDFVEEISESVTLMMIRPPSPSSPLPSSQSKDDVAAITRPEFSQKEIDFLLKPLSQLIQH

SEQ ID NO: 889 - protein, 127 aa, Brassica napus
MAPGGNHPTASRHVAVIGAGAAGLVAARELRREGHSVVVLERGSQIGGVWAYTSQMEPDPLSLDPARPVVHSSLYKSLRTNIPRECMGFTDFPFATRPHDGSRDPRRHPGHSEVLAYLRDFAKEFDI

SEQ ID NO: 890 - protein, 141 aa, Brassica napus
PRVRIKEGPDTIGAFIAEPVMGAGGVIPPPATYFEKIQAVVKKYDILFIADEVICAFGRLGTMFGCDKYNIKPDLVSLAKALSSAYMPIGAILMSQEVADVIYSQSNKLGAFSHGFTYSGHPISCAVAIEALKIYKERNIP

SEQ ID NO: 891 - protein, 249 aa, Brassica napus
  misc_feature (215)..(215): Xaa can be any naturally occurring amino acid
  misc_feature (219)..(219): Xaa can be any naturally occurring amino acid
MVILSASSTVRAALDTQPRLPYNPNAPRKVKKTPNGNSFLPLPLPPPPSPRISISVDDLLKRPESKELTLSEEVVDSYMGYETWSPSPPKLEKPRSVFNAASLAFIGDSIYELYARRHFLFPPLSIEDYNDRVRAVVRCEAQYALLKKLVDDDFLTKEERDVLRWGKNLGSARTRTRRRAGVAVYNKASSLETLIGYLYLTNGKRLEKIMEKLGXSSDXSTEIMIEMAKPKPSEPNLPSFILNEQVSVV

SEQ ID NO: 892 - protein, 133 aa, Brassica napus
MAMVSAASSSLVRAALDTTKPKLRYNPNSPRNVKRNPNSTTSFVPPSSPSSSPAATVLTTTSVSVSDLLKRPASKDIGGDEDSCVGYEKWFPSPPKVGKPRSVFNAASLAYIGDSIYEIYARRHFLFPPLSIE

SEQ ID NO: 893 - protein, 122 aa, Brassica napus
KLVDSYLAEAAIDGGLTLPELISLAEALPSHARTTEDGLYRAIDTYLKAHPQVMKQERKELCRLIDSRKLSPEAALHAAQNDRLPVRSIIRVLFTEQTKLSRHTDWSPSGSHYSEPGSGPQC

SEQ ID NO: 894 - protein, 88 aa, Brassica napus
APLWGSTDLLTGDELFFAFFLSRGMEMGFFGEVEGKGPPKGCVGVNMGANPFVEKGGEDKGVANFVEKVVAIVNTLRFKEQPIYDRRG

SEQ ID NO: 895 - protein, 858 aa, Brassica napus
MKGVRKTYDSSYTLSFLLVFFVMFLFHPALSIHINTLSSTESLTISNNRTLVSPGNVFELGFFRTTSSSRWYLGIWYKNLPYKTYVWVANRDNPLSDSIGTLKISNMNLVLLDHSNKSVWSTNLTRGNERSPVVAELLENGNFVIRYSNNNNASGFLWQSFDFPTDTLLPEMKLGYDRKKGLNRFLTAWRNSDDPSSGEISYQLDTQRGMPEFYLLKNGVRGYRSGPWNGVRFNGIPEDQKLSYMVYNFTDNSEEAAYTFRMTDKSIYSRLIISNDEYLARLTFTPTSWEWNLFWTSPEEPECDVYKTCGSYAYCDVNTSPVCNCIQGFKPFNMQQWELRVWAGGCIRRTRLSCNGDGFTRMKNMKLPETTMAIVDRSIGRKECKKRCLSDCNCTAFANADIRNGGSGCVIWTGELEDIRNYFDDGQDLYVRLAAADLVKKRNANGKTIALIVGVCVLLLMIMFCLWKRKQKRAKTTATSIVNRQRNQDLLMNGMILSSKRQLPIENKTEELELPLIELEAVVKATENFSNCNKLGQGGFGIVYKGRLLDGQEIAVKRLSKTSVQGTGEFMNEVRLIARLQHINLVRILGCCIEADEKMLVYEYLENLSLDSYLFGNKRSSTLNWKDRFNITNGVARGLLYLHQDSRFRIIHRDMKVSNILLDKNMTPKISDFGMARIFARDETEANTRKVVGTYGYMSPEYAMDGVFSEKSDVFSFGVIVLEIVSGKRNRGFYNLNHENNLLSYVWSHWTEGRALEIVDPVIVDSLSSLPATFQPKEVLKCIQIGLLCVQERAEHRPTMSSVVWMLGSEATEIPQPTPPGYSLGRSPYENNPSSSRHCDDDESWTVNQYTCSDIDAR

SEQ ID NO: 896 - protein, 135 aa, Brassica napus
TSLRDESWYVGKLRHNRLANLIGYCCDGDERLLVAEFMPNDTLAKHLFHWENQTIEWAMRLRVGYYIAEALDYCSTEGLPLYHDLNAYRVLFDEDGDPRLSCFGLMKNSRDGKSYSTNLAYTPPEYLRNGRVTPE

SEQ ID NO: 897 - protein, 269 aa, Brassica napus
  misc_feature (77)..(77): Xaa can be any naturally occurring amino acid
MAAAANTAVFVSPSQPLSSKRNFLYSPTVSPIQRRFPRRKLELQVKAVATTLAPLEEIKEYKLPSWAMFEMGTAPVXWKTMNGLPPTAGEKLKLFYNPAATKLTPNEDYGVAFNGGFNQPIMCGGEPRAMLKKDRGKADSPIYTMQICIPKHAHAVNLIFSFTNGVDWHGPYRLQFQVPKRWQNKPIGFFNEGLANELSQDGACERAIFPDSNIVATRCTMIANLTVEGGDRCNLDLVPGCMDTNSEHFNPLANVDDGSCPLELSDSDE

SEQ ID NO: 898 - protein, 229 aa, Brassica napus
  misc_feature (136)..(136): Xaa can be any naturally occurring amino acid
MSWFLIAAAIVAAVVSYNLIQRLRFKLPPGPRPKPIVGNLYDIKPVRFRCYYEWAQTYGPIISVWIGSILNVVVSSAELAKEVLKEHDQKLADRHRNRSTEAFSRNGQDLIWADYGPHYVKVRKVCTLELFTPKRXLESLRPIREDEVTAMVESVFRDCNLPENRVKGLQLRKYLGAVAFNNITRLAFGKRFMNAEGVMDEQGLEFKAIVSNGLKLGASLSIAEHIPWL

SEQ ID NO: 899 - protein, 76 aa, Brassica napus
  misc_feature (40)..(40): Xaa can be any naturally occurring amino acid
STHASATRPVLTRRITNSDLEAADLDEDGVVGAAEFILYXLKEMGKIDEKDISGIVEEFEQLDYDESGTLTTYASF

SEQ ID NO: 900 - protein, 304 aa, Brassica napus
RPTRPDPGPPAPYKSLTCSAPQCASLRASACRSDKCLYQVRYGDHASGSFTVGDYATDTVTFGTSGKVDDVALGCGRDNEGLFTGAAGLLGLGGGALSMTSQIKATSFSYCLVDRDSGKSSSLDFNSVQAGAGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKSIDLPAKNYLIPVDDAGTFCFAFAPTSSSLSIIGNVQQQGTRITYDLANNLIGLSANQC

SEQ ID NO: 901 - protein, 113 aa, Brassica napus
LAAHGDSNNNNAAVGQEAGALEALVQLTKSPHEGVQQEAAGALWNLSFDDKNRESIAAFGGVEALVALAKSCSDASTGLQERAAGALWGLSVSEANRFNHFKFFINAKVITYI

SEQ ID NO: 902 - protein, 179 aa, Brassica napus
RVSEDTRYEKRGAGRSFFPTHSSSSSLPLLSVSMETPSISTVKPQAVEDAIGSTADISQPQPQPPSHEVDSSPVAVSSDGVVVVSEIPSDDDLDHERNVGEDRDHDHGDHPVETEVAVVSNDELKQKIIRQVEYYFSDENLPTDKFLLNAMKKNKKGFVPISSIATFHKMKKLTRDLDL

SEQ ID NO: 903 - protein, 130 aa, Brassica napus
  misc_feature (123)..(123): Xaa can be any naturally occurring amino acid
IYHDLNAYRILFDDEGDPRLSTFGLMKNSSNGKSYSTNLAYTPPEFLRTGRVIPESVVYSYGTILIDLLSGKHIPPNHALDMIRGRNALLLMDSSLEGQFDNEDATKLVDLASKCLQNEAKDXPDTKFLQ

SEQ ID NO: 904 - protein, 256 aa, Brassica napus
  misc_feature (165)..(165): Xaa can be any naturally occurring amino acid
VDPRVRDVMMPKYLHWPASDPEIQSTKRKFESIHKVPNVVGSIYTTHVPIIAPKVHVAAYFNKRHTERNQKTSYSITVQGVVNAEGIFTDVCIGNPGSLTDDQILDKSSLSQQRAARGMLRDGWIVGNGGFPLTDWLLVPYARQNLTWTQHAFNESVGGIQKVAXSAFGRLKGRWACLQKRTEVKLQDLPYVLGACCVLHNICEMRKEEMAEGVEFEVFDDVTVPEDNIRSVAASSARDQISHNLLHRGLAGTRAL

SEQ ID NO: 905 - protein, 181 aa, Brassica napus
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREHGSTPGYYDARYWTMWKLPLFGCTDSAQVLKEVQECKTEYPNAFIRIIGFDNNRQVQCISFIAYKPPSFTGA

SEQ ID NO: 906 - protein, 181 aa, Brassica napus
MASSMLSSAAVVTSPAQATMVAPFTGLKSSSAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 907 - protein, 181 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 908 - protein, 182 aa, Brassica napus
  misc_feature (112)..(112): Xaa can be any naturally occurring amino acid
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGXSTPGYYDGRYWTMWKLPLFGCTDSAQVLKEVQECKTEYPNAFIRIIGFDNNRQVQCISFIAYKPPSFTGA

SEQ ID NO: 909 - protein, 339 aa, Brassica napus
  misc_feature (265)..(265): Xaa can be any naturally occurring amino acid
MEPTTTQNGSELELELSEFEKTQKKYQDFIASLPKSKGWRPKEILIQHGGHWWQECLLEGLLHAKDHFQARPTDFLVCSYPKTGTTWLKALTYAIVNRSRFDDATNPLLKRNPHEFVPYVEIDFAFYPTVDVLQDQKNPLFSTHIPNGSLPDSIVNSGCEMVYIWGDPKDTFISMWTFLHKEKSQEGQLASLEESFDMFCKGLSVYGPYLDHVLGYWKAYQENPERILFLRYETMRANPFPFVKRLAEFMGYGFSAEEKEKGVSXNVVKLCSFETFKNFEANKGYKEREARPAVYANSAFFRKGKVGDWANFLTPEMAARIDGLVEKKFKNTGLLEHDQ

SEQ ID NO: 910 - protein, 87 aa, Brassica napus
SSDSSSLFDSTSDECSCSTDSTSMDDFADFIFGDNQGRAHGQSEAPSPTSSSSSSSPPFTRHSRLGDLSRSSQETCRNSRHRVSLGR

SEQ ID NO: 911 - protein, 226 aa, Brassica napus
AVRDLCTKHNVLMIADEVQSGLARSGKMLACDWEEIRPSMVTSGKALGGGVVPVSAVLADKNVMLHIKPGQHGSTFGGNPLASAVAMASLDVIEEEKLVERSASRGDELRIQLNEIKEKFPDYIKEVRGRGLFNAVEFNSESLSPVSAYDICLSLKERGVLAKPTHNTIVRLTPPLSISSDELREGSKALRDVLEVDLPNLQKINAGKTPVSHLTECDRCGRSLYA

SEQ ID NO: 912 - protein, 117 aa, Brassica napus
  misc_feature (116)..(116): Xaa can be any naturally occurring amino acid
MGKTAGNRDWTQIYAIYGIQQWQTLVFLLFHAFFFSILSLLFLVYFDQICFFLDSFFLSGASRLTAGFTGAVTALSAVCLLFAAANFVYSDVPLQYEMAQRMVSSVSDWSCVKTAXD

SEQ ID NO: 913 - protein, 139 aa, Brassica napus
  misc_feature (136)..(136): Xaa can be any naturally occurring amino acid
DAWAVYDPEIGYCQGMSDLLSPILAVIEDDAFAFWCFVGFMSKARHNFRLDEVGIRRQLSMVSKIIKFKDIRLYRHLENLEAEDCFFVYRMVVVMFRRELTFEQTLCLWEVMWADQAAIRTGIAKATWGRIRLRAXPTE

SEQ ID NO: 914 - protein, 150 aa, Brassica napus
  misc_feature (65)..(65): Xaa can be any naturally occurring amino acid
DLSLIPGAASKSAKKQNRDNTNTELWFEDLAQLSLPIFRTVILSMRSEDLSSDVIESCLISYAKXHIPGILRSNRKPSSSSSTAASENEQREILETITSNLPLDKSSISATTRFLFGLLRTAIILNASETCRDLLERKIGSQLERASLDD

SEQ ID NO: 915 - protein, 89 aa, Brassica napus
  misc_feature (20)..(20): Xaa can be any naturally occurring amino acid
MDQHFQSTPLERNLPVILGXWRVWKESFLGYPARAILPYSQALEKFVPLIHQVSLESNGKGGSIDGLPFPFETVEIDFGEPGPNGHHSF

SEQ ID NO: 916 - protein, 141 aa, Brassica napus
  misc_feature (128)..(128): Xaa can be any naturally occurring amino acid
MAARNWIFAVAVAVFLSLSTFSSAQDLQIVNAERRIDLSSHIVKAVLTLKVENIGKDPAADMLLAFPPTQIKNLAMVQALAVMGKKKKKTYLPLVVRPTEQPDAPNDAGYFLVSFATPLGPGETVTLXVLYILTQSLEPFP

SEQ ID NO: 917 - protein, 166 aa, Brassica napus
MTSPTALICETQAWKDLKGHVEDINKTHLRDLMSDAHRCESMMLEFEGLLLDYSRQRATVETMDKLLNLAKAAQLSEKISRMFNGEHINSTENRSVLHVALRAPKDAFIKADGKNVVPEVWNVLDKIKDFSDKIRSGSWVGATGKPLKDVIAIGIGGSFLGSLFVH

SEQ ID NO: 918 - protein, 507 aa, Brassica napus
MGTRFQSLLAFLLSCLILISAASSSEQKGDGTLRIGLKKRKLDRANRLASQLFLKNRGSWSPKDYFCLNDANSDIVPLKNYLDAQYYGEITIGTPPQKFTAIFDTGSSNLWVPSSNCYFSIACYFHSKYKARDSSTYKRNGKPASIRYGTGAISSYFSNDDVKVGGLVIKDQEFIEATSEPGITFLLAKFDGILGLGFKEIAVGNSTPVWYNMVEKGLVKEPIFSFWLNRNPEDPEGGQIVFGGVDPKHFKGEHTYVPVTRKGYWQFDMGDLNIAGKPTGYCANGCSAIADSGTSLLTGPSTVITMINHAIGAVGIASQECKTVIGQYGQTMLDSLVSQVDPRKVCSQIGLCGFDGTHSVSMGIKSVVEDGVSGLLNEAMCSACEMASVWMQSELSQNQTQERILAYAAELCDHIPNPNQQSAVDCERVSSMPIVTFTIGGKPFDLSPQDYIFKIGDGVQAQCTSGFTAMDIPPPRGPLWILGDIFMGPYHTVFDYGKTRVGFAKAT

SEQ ID NO: 919 - protein, 120 aa, Brassica napus
  misc_feature (30)..(30): Xaa can be any naturally occurring amino acid
LLVPYARQNLTWTQHGFNENIGGIQKIAVXAFERLKGRWACLQKRTEVKLQDLPYVLGACCVLHNICEMRNEEMAPELKFDVFDDVTVPETNIRSATASNKRDQISHNLLHRGLAGTRTL

SEQ ID NO: 920 - protein, 88 aa, Brassica napus
  misc_feature (17)..(17): Xaa can be any naturally occurring amino acid
APLWGSTDFLTGVGLFXDFFLSRGMEMGFFGEVEGRGPPKGCVGVTIVATPFVEKGGGAKVVTNFVERVVAIVDPLRFKEQPIYTRRG

SEQ ID NO: 921 - protein, 137 aa, Brassica napus
VQIEVLTGILNLCALVGSLLAGRTSDVIGRRYTIVLASVLFMLGSILMGWGPSYPVLLTGRCTAGLGVGFALMVAPVYSAEIATASHRGLLASLPHLCISIGILLGYLVNYFFSKLPLHIGWRLMLGIAAIPSLVLA

SEQ ID NO: 922 - protein, 147 aa, Brassica napus
MGQAEEEDKSKGFAEEAVNQHHHHHHQYGTFQGVSNYPQPSPPPGVYDSSAPHYVHGYHAVPVYGIAEGRPVTVRQRRLSCCGIGLGWFLFIVGFFLGGIPWYVGMGIMIVGRRVDHREKPGYIACTIAAILATIAVILGVSKGAED

SEQ ID NO: 923 - protein, 80 aa, Brassica napus
MQCANHSILLLTPYKMGRFNLSHRVVLAPLTRQRSYGNVSHPHAVLYYSQRTCPSGFLTTEASGVLDTAQGFQDTSGDLV

SEQ ID NO: 924 - protein, 223 aa, Brassica napus
  misc_feature (210)..(210): Xaa can be any naturally occurring amino acid
RPTRPQTSSFNSLIMVFEASIAIFCFIPLCFFLFMNPRDNLLRNWPVLGMLPGLLVEFHRIYEFSVEILRSSNLTFTFKGPWYSGMDMLFTVDQANIHHIVSSNLSNYTKGPDFKEVFDVLGDGILTADSELWKNLRKASKVMFSHQGFRRLLMSTTRRKINDGLIPLFNHLAEEGAVVDLQDVFVRVTFDTTLVMVTGSADPRSLCVEXPEADEFAKAPNDV

SEQ ID NO: 925 - protein, 93 aa, Brassica napus
  misc_feature (7)..(7): Xaa can be any naturally occurring amino acid
SVEDRSXSPKPMERSVSPRGKDQSLSPDRRVVDASPKLEKQDGSDYEGSPKENGNGKSSVSPIAGGEESPQDRSPVDDEPELNRSSPKGSESP

SEQ ID NO: 926 - protein, 137 aa, Brassica napus
  misc_feature (96)..(96): Xaa can be any naturally occurring amino acid
  misc_feature (117)..(117): Xaa can be any naturally occurring amino acid
ILQDGHNSTKIYDSLLLKQTDYPKENSLYPFVWLNTDGDLCILANSRCILLSHKTNQVIKELPQLPSGSRNYPGSSSLALLPMHLYMKNPKAIPGXVLVCGGTRHDAYYRANKNVFXPGLQDCARIRIYRAYPRWKI

SEQ ID NO: 927 - protein, 121 aa, Brassica napus
KLALSETYKQTDVAFLEWEKDTYRDDGSTASAAVLVGNHLYVANVGDSRTIVSKAGKAIALSDDHKPNRSDERKRIESAGGVIMWAGTWRVGGVLAMSRAFVNRMLKQFVIAEPEIQDLEI

SEQ ID NO: 928 - protein, 97 aa, Brassica napus
MASEPVDDGGREKQSIRVYTRKGKGQRKQSPFFAFAADEIRKANNRRVNPPETLARESSDPIAVEKTALETKSRDDAGASVAKVIDKPLVEAFSEDD

SEQ ID NO: 929 - protein, 376 aa, Brassica napus
  misc_feature (352)..(352): Xaa can be any naturally occurring amino acid
MGFYFISLLFLPLLSVFILSGSKQAFASDNTLLVNTDHRNSTAHGGLSSLRGKKQRSGCNLFQGRWVFDASYPFYDTSSCPFIDGEFNCGKRPDKQFLKYSWQPASCSIPRFDGAAFLRRWRGKRVMFVGDSLSLNMWESLGCMIHASVPNAKYTFLKRTPLSTITFQEYGVTLYLYRTPYIVDIAKEKVGRVLNLGAIEGGANAWKNMDVLVFNSWHWWTHKGNSQGWDYIRDGSSLVRDMNRLDAFYKGLSTWGRWVDQNVETTKTKVFFQGISPTHYEGREWNEPRKSCTGQMQPLGGSNYPSGQPASAGVVSKVVGAMKTRVSLLDITTLSQLRKDAHPSTYGGDGGXDCSHWCLPGLPDTWNQLLYAALSM

SEQ ID NO: 930 - protein, 272 aa, Brassica napus
STHASAQLLRLRVAPSETAMSDVLREVMIMKILEHPNIVNLIEVIDDAETDHFYMVLEYIDGKWVYDGSGPPGALGEKTARKYLRDIVAGLMYLHAHNVIHGDIKPDNLMVTSSGTVKIGDFSVSQVFKDDDDQLRRSPGTPVFTAPECCLVSGITYSGRAADTWAVGVTLYYMILGQYPFLADTLQDTYDKIVNNPLILPDGLDPLLRDLMECLLCKNPSERMTLKKVSEHPWFLGEDGHVPEYFWCCKRKSALKIEQEEEANGMSEDSDF

SEQ ID NO: 931 - protein, 127 aa, Brassica napus
RTRGLGFEIKGIALSGALSNFNLVVFLFSYIAFFEEELSKDEKVSEESYEQSVREWKKLLGLAVPSCVAVCLEWWCYEIMIVLCGLLINPRVSVSSMGIIIQINSLVYIFAHSLGSAVSTRVRYELG

SEQ ID NO: 932 - protein, 254 aa, Brassica napus
MARKFFVGGNWKCNGTAEEVKKIVNTLNEAQVPSQDVVEVVVSPPYVFLPLVKSTLRSDFHVAAQNCWVKKGGAFTGEVSAEMLVNLDIPWVILGHSERRALLNETNEFVGDKVAYALAQGLSVIACVGETLEQREAGSTMDVVAAQTKAIADRVSNWSKVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 933 - protein, 254 aa, Brassica napus
MARKFFVGGNWKCNGTAEEVKKIVNTLNEAQVPSQDVVEVVVSPPYVFLPLVKSILRPDFHVAAQNCWVKKGGAFTGEVSAEMLVNLDIPWVILGHSERRALLNETNEFVGDKVAYALAQGLKVIACVGETLEQRESGSTMDVVAAQTKAIADRVSNWSDVVIAYEPVWAIGTGKVASPAQAQEVHDELRKWLAKNVSADVAATTRIIYGGSVNGGNCKELGGQADVDGFLVGGASLKPEFIDIIKAPAAEKSA

SEQ ID NO: 934 - protein, 254 aa, Brassica napus
MARKFFVGGNWKCNGTAEEVKKIVNTLNEAQVPSQDVVEVVVSPPYVFLPLVKSILRPDFHVAAQNCWVKKGGAFTGEVSAEMLVNLDIPWVILGHSERRALLNETNEFVGDKVAYALAQGLKVIACVGETLEQREAGSTMDVVAAQTKAIADRVSNWSDVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 935 - protein, 122 aa, Brassica napus
  misc_feature (104)..(104): Xaa can be any naturally occurring amino acid
EGIYMVEGDRKFKREGFKALAFPWGDSFHLKLIRGLLNNPDFFIFGAFYNLKPPHQDTTTITTVDFKAPRFAIAFKGTLTKPDSIFRDLKLDIHIFRTGLNRPXRFDIVLQAVKSMVTFLGA

SEQ ID NO: 936 - protein, 134 aa, Brassica napus
NQFDLGAEKIFRIGSLPDEGLSHILSFLTTKEAALTSILSKRWRNLFTLVPNLDIDDSVFLIPEEGKRERDGILRSFMDFVDRVLALQGDTPINKFSLKCKTGIDTDRVNLWIFNVLQRGVTSLELVLDFSRNR

SEQ ID NO: 937 - protein, 171 aa, Brassica napus
MLAKSKMCLLRYYSLFLIVFSLISLQGFAKKTGDVSELQIGVKFKPKTCEFKAHKGDRIKVHYRGKLTDGTVFDSSFERGDPFEFELGSGQVIKGWDQGLLGACVGEKRKLKIPAKLGYGEQGSPPTIPGGATLIFDTELLAVNEKPAGGEEHQEEDDGEDVDDTYGADEL

SEQ ID NO: 938 - protein, 164 aa, Brassica napus
SFQDTSKPLAVSRVMVAWQPIGISMGVYDMYHRYLMERKQFGAPLAAFQLNQQKLVKMLGNVQAMFMMGWRLCKLYESGQMTPGQASLGKAWISSKARETASLGRELLGGNGVVGDFLVAKAFGDLEPIFTYEGTYDINTLVTAREVTGIASFKPAASRSRSRL

SEQ ID NO: 939 - protein, 94 aa, Brassica napus
RLCKLYESGQMTPGQASLGKAWISSGARETASLGRELLGGNGVVGDFLVAKAFGDLEPIFTYEGTYDINTLVTGREVTGIASFKPPASRGRSRL

SEQ ID NO: 940 - protein, 227 aa, Brassica napus
MASLGQITLPRAPSLEMSLLRRRFDRPIRTRIGFNGRIVSEQAQVSVKASVSQKAIEEEARVLVGTYARAPVVLSSGKGCKLIDAEGKEYLDCASGIAVNALGHGDPDWLQAVTDQAAVLAHVSNVYYTIPQIELAKRLVASSFADRVFFCNSGTEANEAAIKFSRKFQRYTHPQDKEVATGFIAFTNSFHGRTLGALALTSKEQYRASFEPIMPGVTFLEYGNVQA

SEQ ID NO: 941 - protein, 136 aa, Brassica napus
MSVLSSADRDNAEKKVRSSYFDGPAMEISVAFPQATPASKFPPCTSDYYHFDDLLTPEEQAVRKRVREFMEKEVAPIMTEYWEKAEFPFHIIPKFGALGVAGGSIKGYGCPGLSITANAFATAGISRGDASRGTFK

SEQ ID NO: 942 - protein, 106 aa, Brassica napus
MTVLSSADRDNAEKKGKSSYFDLPAMEISVAFPQATPASKFPPCTSHYYHFDDLLTPEEQAVRKRVREFMEKEVAPIMTDFWEKAEFPFHIIPKFGALGVAGGSIK

SEQ ID NO: 943 - protein, 116 aa, Brassica napus
MATSLLTSTPLSSSFLPVPRNLSVHGHCPSQRTLWFGLKQSSLCVRAAKLPQGVIVPKVEPKFVPAFLGFTFTAEIWNSRACMIGLIGTFIVELILNKGILQIIGVDVGKGLDLPL

SEQ ID NO: 944 - protein, 313 aa, Brassica napus
  misc_feature (82)..(82): Xaa can be any naturally occurring amino acid
GVLPYTTKNVEDDYFLGQILGQGQFGTTFLCTHKKTAQKLACKSIPKRKLLCQEDYDDVLREIQIMHHLSEFPNVVRIRTRXEDTSSVHIVMELCEGGELFDRIVKRGHYSEREAAKLIKTIVGVVEACHSLGVMHRDLKPENFLFASCDEDASLKSTDFGLSVFCKPGATFSELVGSAYYVAPEVLHKHYSRECDVWSAGVILYILLCGFPPFWDESEFGIFRKILQGKIDFETRPWPSISESAKDLIVKMLEKDPKKRLTAHQVLCHPWIGDDKGAPDKPLDCAVLSRLKNFSAMDKLKKMAFRVIAERLS

SEQ ID NO: 945 - protein, 321 aa, Brassica napus
  misc_feature (165)..(165): Xaa can be any naturally occurring amino acid
  misc_feature (180)..(180): Xaa can be any naturally occurring amino acid
STHASATIRAIAFKSGVCFLHSPKPQVGIRHSSPDSSLSFKRLAPIAALSTSSPTLGLADTFKELKKQGKVAFIPYITAGDPDLSTTAEALKVLDACGSDIIELGVPYSDPLADGPVIQAAATRSLEKGTNLDSIPDMLDKVLPELSCPVSLFTYYNPILKRGLXGKFMSSIRDVGVQGXLLFPDVPLEETEFLRKEALNTTIELVLLTTPTTPTERMKRIVDASEGFISLVSSIGVTGARASVSGKVQSLLKDIKEAPAKPVAVGFGISKPEHVKQIAGWGADGVIVGSAMVRLLGDVKSPTEGLKELESLPKSLKSAFF

SEQ ID NO: 946 - protein, 287 aa, Brassica napus
  misc_feature (118)..(118): Xaa can be any naturally occurring amino acid
MVKFERVPLLLGLVLVLTLVVAKASEPVCRQAEKFSRASFPEGFLWGTATAAFQVEGAVDEGCRGPSMWDTFTKKYPHRCQNHNADVAVDFYHRYKEDIKLMIDLNTDAFRLSIAWPXIFPHGRMSKGISKQGVQFYHDLIDELLKNKITPLVTVFHWDTPQDLEDEYAGFLSGNIVKDFTEYANFTFHEYGHKVKNWITFNEPWVFSRAGYDVGKKAPGRCSPYIQEWGKHCEDGRSGFEAYQVSHNLLLAHAYSVEAFRACKQCAGGKIGIAHSPAWFEPADLES

SEQ ID NO: 947 - protein, 300 aa, Brassica napus
  misc_feature (126)..(126): Xaa can be any naturally occurring amino acid
  misc_feature (191)..(191): Xaa can be any naturally occurring amino acid
  misc_feature (229)..(229): Xaa can be any naturally occurring amino acid
MIPYATIEEASLALGRNLTTLETLWFDYSATKSDYYLYCHNILFLFLIFSLVPLPLVFVELARSASGWFDRYKIQPKVKNSFSDMFRCYRDVMKMFILVVGPLQLVSYPSIQMIEIRSGLPLPSFXEIAAQLEVYFLVEDYTNYWVHRFFHSKWGYEKIHHIHHEYTAPIGYAAPYAHWAEVLLLGVPTFXLGPAIAPGHMITFWLWIALRQIEAIETHSGYDFPMDTXRKFIPFYGGAEYHDYHHYVGGQSQSNFASVFTYCDYIYGTDKGYRFQKKLLQQINQESKKSNMQNGGDKLD

SEQ ID NO: 948 - protein, 137 aa, Brassica napus
LVIGGRFKLGRKIGSGSFGELYLGVNVQTGEEVAVKLESVKTKHPQLHYESKLYMLLQGGTGIPNLKWFGVEGDYSVMVIDLLGPSLEDLFNYCNRKFTLKTVLMLADQLLNRVEYMHSRGFLHRDIKPDNFLMGLG

SEQ ID NO: 949 - protein, 121 aa, Brassica napus
MTIGGGHGDSEVLTVMEPPSQRNTETPSFQNATVPVDSSGRATVFRPFSLSCPHSRAFHLAWLSLFSCFFSTFSIPPLIPVISSDLGLYASAVSDAGTAFFAGSIFSRLAMGPLCDLIGPR

SEQ ID NO: 950 - protein, 85 aa, Brassica napus
MAMRDLVNGGAACAVPGSSSSSNPLGALTNALLGSSSKTQERLKEIPNATSSGPGPQFYSQDQHLSSLPGSELDQPVLQPGAQGT

SEQ ID NO: 951 - protein, 127 aa, Brassica napus
RVQSIANPDEGRMVGHYWLRNSSLAPRPALKTLIENTLESICSFADDIVSGKIKPPSSPAGRFTQILSVGIGGSALGPQFVAEALAPDNPPLKIRFIDNTDPAGIDHQIAQLGPELASTLVIVISKS

SEQ ID NO: 952 - protein, 174 aa, Brassica napus
  misc_feature (24)..(24): Xaa can be any naturally occurring amino acid
CICGPLKVVSEIRNLHHVLGGTLXNPNAAYLMIRGMKTMHLRVQQQNSTASRMAEILEAHPKVSHVYYPGLASHPEHHIAKRQMTGFGGVVSFEIDGDIERTIKFVDSLKIPYIAPSFGGCESIVDQPAIMSYWDLTQEERLKYGIKDNLVRFSFGIEDFEDVKADVLQALEAI

SEQ ID NO: 953 - protein, 245 aa, Brassica napus
  misc_feature (221)..(221): Xaa can be any naturally occurring amino acid
  misc_feature (228)..(228): Xaa can be any naturally occurring amino acid
RPTRPIDSLTNLEEIILASDGAMVARGDLGAQIPLEQVPAAQQRIVKVCRELNKPVIVASQLLESMIEYPTPTRAEVADVSEAVRQRSDALMLSGESAMGQFPDKALTVLRSVSLRIERWWREEKRYEATPLQAISSASSDKISEEICNSASKMANNLGVDAVFVYTKNGHMASLVSRCRPDCPIFAFTNTTSLRRRLNLQWGLIPFRLSFSEDMESNLNXTFSLLKXRGMIKSGDLVIAVSDML

SEQ ID NO: 954 - protein, 207 aa, Brassica napus
VSILEAYALYDPEIGYCQGMSDLLSPILAVISEDHEAFWSFVGFMKKARHNFRLDEAGIQRQLRIVSKIIKSKDSQLYKHLENLQAEDCSFVYRMVLVMFRRESTHASGEVMWADQAAIRAGVGKSPWSRIRQQAPPTDDLLLYAIAALVLRRKLIIQRYSSMDEIVEECNSMAGQLDVWKLLDDAHHLVVTLHDKIETLSSRSLSV

SEQ ID NO: 955 - protein, 217 aa, Brassica napus
ASGDCDLKFREGGEGLTPDETLLLHTEQATTVQVREAILSDPVSSPEDGGGESADNKDELMDKEEAVSVAETSGSSFSGFSSSPRNDSGDDDISFCDSSSSSDSEISEPPRDAHVSVESEETCFSNIDDVKSKPLSPKFVQLVESANDLAKLPKLSLNKPGGDAGQKPSQSSSLVSSVGTDGHPRSADPSLMKSSDFWGTALGSVERVTENWDGSKP

SEQ ID NO: 956 - protein, 435 aa, Brassica napus
  misc_feature (267)..(267): Xaa can be any naturally occurring amino acid
MAEKSFKYIILGGGVSAGYAAKEFASQGVKPGELAVISKEAVAPYERPALSKGYLFPEGAARLPGFHCCVGSGGEKLLPESYKQKGIELILSTEIVKADLAAKSLVSAAGDVFKYETLIIATGSTVLRLTDFGVKGADSKNILYLREIDDADKVVEAIQAKKGGKAVVVGGGYIGLELSAALRINNFDVTMVFPEPWCMPRLFTADIAAFYETYYTNKGVKIIKGTVASGFTAHPNGEVNEVQLKDGRSLEADIVIVGVGAKPLTAXLFKGQVQEDKGGIKTDAFFKTSVPDVYAVGDVATFPLKMFGDMRRVEHVDHSRKSAEQAVKAIKAAEGGGAVEEYDYLPFFYSRSFDLSWQFYGDNVGDSVLFGDSNPSNPKPRLGAYWVQDGKVVGAFMEGGSGDENKALAKVAKARPAAESLDDLTKQGISFAAKI

SEQ ID NO: 957 - protein, 195 aa, Brassica napus
  misc_feature (13)..(13): Xaa can be any naturally occurring amino acid
  misc_feature (18)..(18): Xaa can be any naturally occurring amino acid
  misc_feature (26)..(26): Xaa can be any naturally occurring amino acid
  misc_feature (42)..(42): Xaa can be any naturally occurring amino acid
  misc_feature (65)..(65): Xaa can be any naturally occurring amino acid
CVSAVEGINGICXYTSSXFEQAGFPXRLGMIIYAVLQVVITXALNAPNRLTKLEESPLLLVSATXGLVIGCLITAVSFYLKAHDMAHKAVPVLAVVGIMVYIASFSAGMGAMPWVVMSEIFPINIKGVAGGMATLVNWFGAWAVSYTFNFLMSWSSYGTFIIYAVINALAIVFVIAVVPETKGKTLEQIQAVVNP

SEQ ID NO: 958 - protein, 214 aa, Brassica napus
MRLRSLISLLFLLFLTSSAYARLVAVRPSSTDLIISDGINGASGSVIKTLVSAEEKEEACEQTYGFMPCTKTALGNVFLILVYGFLMFTAATYLSAGSELLLEILGPGIVGGLFLPMLGALPDAMLIMVSGLSGDAATAQTQVSVGMGLLAGSTVMLLTVIWGTCTVVGKCDLRDNIAGNNQDTKGLHLKDSGVTGGVGTRCAGRIWVWGGWRG

SEQ ID NO: 959 - protein, 118 aa, Brassica napus
AARDWKKWNRSHKRKVPVRKVKTHKVSPLQLSKDKSTIIWRQFDAPEPENYWYRVCEGQASKYVERPWQTLWKSKRLMNIVSEISGKMDWDFDAVHVVRGEKAKDKKLWPHLDEDTWQ

SEQ ID NO: 960 - protein, 221 aa, Brassica napus
  misc_feature (163)..(163): Xaa can be any naturally occurring amino acid
  misc_feature (173)..(173): Xaa can be any naturally occurring amino acid
  misc_feature (201)..(201): Xaa can be any naturally occurring amino acid
MAEEVVLDLEELRQLQNIAKRPRVLNLISSEICNLEKLRESASVSNAKPEVEPAVPVPVSSSVKPVSPAANYATLGTFSWDQDNEKVKVYISLEGVDEDKVEAEFKPMSLDVKIHDLQGKNYRCAIPKLHKEIVPEKCKVLVKPKRIVVTMFKSSRGNWMDIXYKEDKIKPSXEKEKDPMAGIMDMMKNMYEGGDEEMKKXIAKAWTDARSGKAGDSLKGL

SEQ ID NO: 961 - protein, 189 aa, Brassica napus
NVTKIRQEVNINLLKICGQERPSNDYSIECLNKLGDLRGALYESMRLYPPVPFERMTPVRPDVLPSGHKVDASMKILIFIYALGRMEAVWGEDALEFKPGRWVSETGGFREEPSYKFFAFFGGPRSCLGKLLAMTLMKTVVVEILQNYDFQLVKGQTIEPATGPILRMKHGLRVKLTKRCSSYETNENT

SEQ ID NO: 962 - protein, 190 aa, Brassica napus
RARACNQRGNPDLLQQAVETCPVDCIYQTFAAQLSLLEDEMRRVERVNVALMLSGMGSGVVDVFRMARSRWEKRQAKVLNQARSRMMKRKSTDEEPSYWDNLWGKDNQYQKSEEEVQERAQRAAAAARRWREYSRRGVDKRPTFKLPDSSSLQRRQLKPPPPDMIVKYICNNFTVLEDLYSFLPTSICGR

SEQ ID NO: 963 - protein, 328 aa, Brassica napus
  misc_feature (194)..(194): Xaa can be any naturally occurring amino acid
  misc_feature (210)..(210): Xaa can be any naturally occurring amino acid
  misc_feature (236)..(236): Xaa can be any naturally occurring amino acid
MKAIVISEPGAPEVLQLREVEDPQVKDDEVLIRVHATALNRADTLQRLGSYSPPPGSSPYPGLECSGTIESVSNSVSRWKVGDQVCALLSGGGYAEKVAVPVGQVLPVPAGISLKDAAAFPEVACTVWSTVFMMGRLSPAESFLVHGGSSGIGTFAIQMAKHQGVRVFVTAGNEEKLAACKELGADVCINYKTXEDFVAGVKAETDGKGXVDVILDCIGAPYLQKNLDSLNFDGRXLCIIGLMGGANAEIKLSSLLPKRLTVLGAALRPRSKENKAVVVAEVEKIVWPAIEAGKVKPVIYKYLPLSQAAEAHSLMESSSHIGKILLVT

SEQ ID NO: 964 - protein, 134 aa, Brassica napus
  misc_feature (28)..(28): Xaa can be any naturally occurring amino acid
GSQQPQLILAHTLFLRTQPDVQDIEKVXLNSDVLDSISSDGMAPMYESLTTSSVPELDQSLLDSMRATNDEELITRDEKIAHAEDELGESEVREADLAKALYIVTITDKEKALEQLKLTARKIVAVGQQMDHVF

SEQ ID NO: 965 - protein, 207 aa, Brassica napus
  misc_feature (58)..(58): Xaa can be any naturally occurring amino acid
VDPRVRICTCHRLVLEVCRAIYDVMMPKCLAAGHRRIPRYTPTKRKFESHDKIPNAVXSIYTTHIPIIDPKDHVAAYSITRPTERNQNTSNSITVQGVVNSKGILTDVCIGNPGSLTDDQILDTSYLSNQRAGRGMLRDGRIDRNGGIPLTDWLLVPYARHNLTRTQHGDHESAGWIHKVATDAYWRLKGRWSCLQNRTDVKLHDLA

SEQ ID NO: 966 - protein, 241 aa, Brassica napus
GDPRVRDIEDVRREVEIMKHMPKHPNIVSLKDAFEDDDAVHIVMELCEGGELFDRIVARGHYTERAAAAVMKTILEVVQVCHKNGVMHRDLKPENFLFANKKETSPLKAIDFGLSVFFRPGEGFNEIVGSPYYMAPEVLRRNYGPEVDIWSAGVILYILLCGVPPFWAETEQGVAQAIIRSVIDFKRDPWPRVSDTAKDLVRKMLEPDPKKRLSAAEVLEHPWIQNAKKAPNVSLRETVKA

SEQ ID NO: 967 - protein, 149 aa, Brassica napus
  misc_feature (114)..(114): Xaa can be any naturally occurring amino acid
MSAVLTAGGGLTAGDRSILTAINTGASSLSFVGSTFIVLCYCLFKELRKFSFKLVFYLALSDMLCSFFLIVGDPSKGFICDAQGYTTHFFCVASFLWTTTIAFTLHRTVVKHKXTDVEDLEAMSHLYVWGTSLVVTVIRSFGNNHSHLG

SEQ ID NO: 968 - protein, 136 aa, Brassica napus
  misc_feature (101)..(101): Xaa can be any naturally occurring amino acid
LLQNIDKISLVRCPVLVIHGTADDVVDFSHGKQLWELCQEKYEPLWLKGGNHCDLELFPEYIGHLKKFVSAVEKSASKRNSSFSRRSMEGGCEHPSRHSVXAPKKSKDGREKPRKSVDRLKFQGYKLSHIERPEKL

SEQ ID NO: 969 - protein, 189 aa, Brassica napus
MAFAISTQSHFAIRPLQLNQFKNSCPRAFLGSCFKPRPDSSYLRSKELPKLGLVPRHRQKFQVGVGTGGELADSGEVADSVASDAPESFSWSSVILPFIFPALGGLLFGYDIGATSGATLSLQSATLSGTTWFNLSPVQLGLVVSGSLYGALLGSTLVYGIADFLGRRRELIIASGLYLLGSLITGCAP

SEQ ID NO: 970 - protein, 128 aa, Brassica napus
  misc_feature (43)..(43): Xaa can be any naturally occurring amino acid
LQAEDCSFVYRMVLVMFRRELSFEQTLCLWEVMWADQAAIRAXVGKSPWSRIRQQAPPTDDLLLYAIAALVLRRKLIIQKSSSMDEIVEECNSMAGQLDVWKLLDDAHHLVVTLHDKIETLSSQSLSI

SEQ ID NO: 971 - protein, 110 aa, Brassica napus
  misc_feature (20)..(20): Xaa can be any naturally occurring amino acid
  misc_feature (81)..(81): Xaa can be any naturally occurring amino acid
PTHPPRLIRKTLTQSLPKSXARFVCSTDDNKSMNAFSAAVALSSILLSSPMPAVADISGLTPCKESIQFSTSEKNDIKTLXSSLNLYAPDSAPVLALNAQIEKTKHMFHN

SEQ ID NO: 972 - protein, 269 aa, Brassica napus
RPTRPHFPSTILFLVIFLLLAAFKRPKRLQHRPIPSPPTWPIIGNLHQLGELQHQSLWNLSKKYGPGMLLKLGKVPTVILSSSETARQALRDNDLNCCSRPPLAGARELSYNNKDMSFSPYNDYWKELRKLCARELFSAKQIHSFQPIKDEEIKRVIAQISESASLKNPVNLTKTFLALTVSVVCKAAFGVSFEGTVLSNDRFNKLVRDAFETLGSFSATDFIPHVGWIIDQFTGLQKMREKSVRDLDAFYEQLFDLHKEGDRKGVKIL

SEQ ID NO: 973 - protein, 118 aa, Brassica napus
IASKLPRLRGVVLHSGILSGLRVLCHVKFKFCCDIYSNINKIKKVKCPVLVIHGTEDDVVNWLHGNRLWKMAKEPYEPLWIKGGGHCNLEIYPEYIRHLYRFIQDMENTTTKSRLKKD

SEQ ID NO: 974 - protein, 142 aa, Brassica napus
MARKKIREYDSKRLVKEHFKRLSGNELPIRSVQINQTTDLNELVEKEPWLSSEKLVVKPDMLFGKRGKSGLVALKLDFAEVATFVKERLGKEVEMSGCIGPITTFIVEPFVPHNEEFYLNVVSDRLGCSISFSECGGIEIEE

SEQ ID NO: 975 - protein, 223 aa, Brassica napus
  misc_feature (194)..(194): Xaa can be any naturally occurring amino acid
MESEPLTVTTVPNQDKTETESSEFEKNQERYQTLISTFTHEKGWRPKEPFIEYGGHWWVQPLLEGCLHAQEFFQARPDDIFVCSYPKTGTTWLKALTFAIVNRSRFDDTSNPLLKRNPHEFVPYIEIDFPFFPQVDVLKDKGNTLFSTHIPYESLPDSVVKSRCKLVYIWRDPKDTFISLWTFLHKERSELGPXNNLEESFDMFCRGLSGYGPYLDHVLGYWK

SEQ ID NO: 976 - protein, 107 aa, Brassica napus
  misc_feature (45)..(45): Xaa can be any naturally occurring amino acid
  misc_feature (92)..(92): Xaa can be any naturally occurring amino acid
MAPNNIIEYDSNRLGKEHFKRVGGKKLPIKSFHINQETDLNELVXKEPLLSFKKLVVKPDMLFVKRFKSGLDSLKLYFAEFSTFVKNRFYKXVEMCGFKCPITSFIS

SEQ ID NO: 977 - protein, 262 aa, Brassica napus
  misc_feature (106)..(106): Xaa can be any naturally occurring amino acid
RPTRPELTRTIVGVVEACHSLGVMHRDLKPENFLFVSKHEDSLLKTIDFGLSMFFKPDDVFTDVVGSPYYVAPEVLRKQHGPEADVWSAGVIVYILLSGVPPFWAXVLHGDLDFSSDPWPSISESAKDLVRKMLVRDPKKRLTAHQVLCHPWVQVDGVAPDKPLDSAVLSRMKQFSAMNKFKKMALRVIAESLSEEEIAGLKEMFNMIDADQSGQITFEELKAGLKRVGANLKESEILDLMQAADVDNSGTIDYQEFIARTL

SEQ ID NO: 978 - protein, 94 aa, Brassica napus
LFKSLNLLQLFFCVCCYQSLGFDSRLIEQHLSFLIFFHVPTSLPLSFSFFLDFFFLNGQSQLMSNQMRSMNMQNLAAMEQTRKLAHTLSQDGNP

SEQ ID NO: 979 - protein, 316 aa, Brassica napus
  misc_feature (16)..(16): Xaa can be any naturally occurring amino acid
  misc_feature (20)..(21): Xaa can be any naturally occurring amino acid
  misc_feature (23)..(23): Xaa can be any naturally occurring amino acid
  misc_feature (31)..(31): Xaa can be any naturally occurring amino acid
  misc_feature (53)..(53): Xaa can be any naturally occurring amino acid
  misc_feature (57)..(57): Xaa can be any naturally occurring amino acid
IGEGGFGQVFKGWLDXKTLXXSXPVVGIPVXVKKSNPDSAQGLHEWQCEVKFXGKFXHPNLVKLLGYCWEENQFLLVYEYLPKGSLENHLFSKGEALTWDTRLKIAIEAAQGLNFLHNSEKSVIYRDFKASNILLDSNFNAKLSDFGLAKLGPINGFSHVTTRVMGTQGYAAPEYMATGHLYVRSDVYGFGVVLLEILTGLRALDPNRPPLQLNLVEWAKPGLTQKKKIQKMMDPRLEHKYPISAVIRTAALILRCVEEDPKNRPPMDEVLRELEIVRTMRDEPKEEKRKRSGGGPDNNRINRYGSPHVRGTGRTR

SEQ ID NO: 980 - protein, 330 aa, Brassica napus
MANSGEGKVVCVTGASGYIASWLVKSLLSRGYTVKASVRDPSDPKKTQHLLSLDGAKERLHLFKADLLEQGSFDSAIDGCEGVFHTASPFYHDVKDPQAELIDPAVKGTLNVLNSCTKASSVKRVVVTSSMAAVAYNGKPLTPDVTVDETWFSDPEVCKTSKMWYVLSKTLAEDAAWKFAKEKGLDIVTINPAMVIGPLLQPTLNTSAAAILNFINGAKTFSNSTFGWVNVKDVANAHIQAYEVPSANGRYCMVERVLHHSEIVNILRQLYPNLQLPESCADENPFVPTYEVSKEKIKSLGIDYIPFEVSIKETVESLKEKGFINVRASI

SEQ ID NO: 981 - protein, 172 aa, Brassica napus
LASASEAIIFGFNVTASGSVKKAAENKGVEIRLYRVIYELIDDVRNAMEGLLESVEEQIPIGSAEVRATFSSGSGRVAGCMVNEGKFVKDCGIKVIRKGKTVHVGVLDSLKRVKENVKEVSAGLECGIGMDDYDDWIEGDTIEAFNAVQKRRTLEEASASMSAAIEEAGVEL

SEQ ID NO: 982 - protein, 274 aa, Brassica napus
  misc_feature (230)..(230): Xaa can be any naturally occurring amino acid
  misc_feature (264)..(264): Xaa can be any naturally occurring amino acid
MDIFDNSDLEYLVDDFHGFSDSEDDEPFGEFDHKSEADSDFEDDLDPTQESDTSALEARNGKDIQGIPWERLNYSRDQYRYKRLQQYKNFEILFRSRQDLDKECLQVEKGKHFYDFQFNTRLVKSTIAHFQLRNLLWATTKHDVYFMKNYSLMHWSSLLQRSKEVLNVAKPIVPTMKQPGLLSQSISRVQISTMAVKDDLIVAGGFQGELICKRINEPGVAFCTVLHRFXNDITNSVDIYNAPSGSLRVITANNDCTVRVLDAXNFAFLNSFTL

SEQ ID NO: 983 - protein, 317 aa, Brassica napus
MSSSSSSSFRSPAGAAATLFSSDQKIRLGRLDVLRSSHSAFLGRRNPRGVVSVHPSSSPSPIQAVSSPSKPEAATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIRNMGSTLGACGDLNRNVLAPAAPYVKKDYLFAQETADNIAALLSPQSGFYYDMWVDGEQFMTAEPPEVVKARNDNSHGTNFVDSPEPIYGTQFLPRKFKVAVTVPTDNFVDLLTNDIGGGGVSDEN

SEQ ID NO: 984 - protein, 178 aa, Brassica napus
MSASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKLDLRDDKQFFIDHPGAVPITTNQGEELKKLIILHRSSWCCTHHYKPRTCCNLVTQLVLP

SEQ ID NO: 985 - protein, 146 aa, Brassica napus
RHERLAQRGESLILELLPEELRGSTIEIVPYFFDSFGNASRIDYGTGHETNFAAWLYCLARMGVIKEEDYHGVVARVFVKYLELMRKLQMVYCLEPAGSHGVWGLDDYHFLPFIFGSSQLVDHKYMKPKSIHNDDILENFSGEFMY

SEQ ID NO: 986 - protein, 385 aa, Brassica napus
  misc_feature (150)..(150): Xaa can be any naturally occurring amino acid
MVAHKETVCVTGASGFIGSWLVMRLLERGYFVRATVRDPGNLKKVQHLLDLPNAKTQLTLWKADLSDEGSYDDAINGCDGVFHIATPMDFESKDPENEVIKPTVNGVLGIMKACDKAKTVRRIVFTSSAGTVNVEEHQKNVYDENDWSDXDFIMSKKMTGWMYFMSKTLAEKAAWDYAKEKGIDFISIIPTLVIGPFITTSMPPSLITALSPITRNEAHYSIIRQGQYVHLDDLCNAHIFLYEQAAAKGRYVCSSHDATILTISEFLRQKYPEYNVPSTFEGVDENLKSIMFSSKKLIDMGFNFKYSLEDMLVESIETCRQKGFLPVTLPEHLKSEDKVPGSDDNKEIKNGSAGLTDGMVACKKTEPGMAGEKADSHMSAQQICA

SEQ ID NO: 987 - protein, 241 aa, Brassica napus
  misc_feature (11)..(11): Xaa can be any naturally occurring amino acid
  misc_feature (35)..(35): Xaa can be any naturally occurring amino acid
  misc_feature (93)..(93): Xaa can be any naturally occurring amino acid
MSITESYPPAXFRRVINDGAPSGTAEIEPVCVQDXDIDIPVIDFECLDQDILTEACRDWGIFRLKNHGVPLPLMSQLQEISESLLSLPFENKXEIIVEGFNVPLSKLPASTSCDDDAQHSELESFRVLIEEYGRHITRIAVSLFEAIAQTLNLELSSHQRSGYLLESTGLIRVYRYPPSDKTAGEALGMEVHTDSSVISILTEDETGRLEIMKDEKWFLVKPVADTLIVNLGNMMHAISDN

SEQ ID NO: 988 - protein, 355 aa, Brassica napus
MAAQGNSTDTLFSPYKMGRFDLSHRVVLAPMTRCRALNGVPNAALAEYYAQRTTPGGFLISEGTMISPGSAGFPHVPGIYSEEQVEAWKHVVEAVHSKGGLIFCQLWHVGRASHPLYQPNGGSPISSTDKPISERWRVLLPDGSHAKYPKPRPLHASEIPRVVEDYCNSAVNAIRAGFDGIEIHGAHGYLIDQFMKNGINDRTDQYGGSIENRCRFLLQVVKGVVSAIGASKVGVRISPAIDHLDATDSDPLSLGLAVVDLLNKLQDDTGSKLAYLHVTQPRYHAYGQTESGRQGSDEEEAKLMKSLRTAYNGTFMSSGGFNKELGMQAIRQGDADLVSFGRLFIANPDLVSRFK

SEQ ID NO: 989 - protein, 303 aa, Brassica napus
  misc_feature (176)..(176): Xaa can be any naturally occurring amino acid
  misc_feature (190)..(190): Xaa can be any naturally occurring amino acid
  misc_feature (197)..(197): Xaa can be any naturally occurring amino acid
  misc_feature (216)..(216): Xaa can be any naturally occurring amino acid
  misc_feature (293)..(293): Xaa can be any naturally occurring amino acid
MGEVLKKEAYGLAVKDESGVISPFHFSRRETGENDVRFKVLFCGICHTDLSMAINEWGFTSYPLVPGHEIVGVVTEVGAKVTKFNAGDKVGVGYMVSSCGSCETCTDDQENYCPKMILTSGGKYYDDTITYGGYSDHMVCEEDYIIRIPENLPLDATAPLLCAGTTVYSPMKYHGXLDKPGMHIGVVGLXGGLGHVXVKFAKAMGIKVTVISTSDXKRDEALTRLGADLFLVSRDPEQMKDAMGTMDGIIDTVSATHPVLPILDLLKYKGKLIMVGAPDKPLELPVLPLIFGXKMVVGSMVGG

SEQ ID NO: 990 - protein, 272 aa, Brassica napus
  misc_feature (88)..(88): Xaa can be any naturally occurring amino acid
VDPRVRNWLGIGLERKMKSSLVTVNRMFAKIISTRREEISRGEGEQLMDALTYYIKAAPASDRLLKPSNDTFIRDVAFSLLLAGRDTXTSSVLTWFFWLLSKHPHVLTKIRQEINTKFDPTYLEKLVYLHAALYETMRLYPPVPFNHKSPLKSDVLPSGHKVKAESKIVICIYALGRMRSVWGEDALDFKPERWISESGELKHEPSYKFMAFNAGPRACLGKHLALQQMKIVAVELIQNYDFKFTEGHKIEAVPSIVLRIKHGLSVTVTKKM

SEQ ID NO: 991 - protein, 163 aa, Brassica napus
MAQLLSPVCTDLLKFQSSVLSSRSSTSRFSAKTSGAAASSWCLRKRRSSGSIGRLRVATEDASSLSTGDVADDYYAVLGLLPDATPEEIKKAYYNCMKSCHPDLSGNDPETTNFCMFINDVYEILSDPVQRMVYDEIHGYAVTATNPFLDDSSPKDHVFCGEF

SEQ ID NO: 992 - protein, 47 aa, Brassica napus
WGRPMGAVTSLMYGAEDPSIAGMVLNSPFSDLVDLMMELVDTYKFPL

SEQ ID NO: 993 - protein, 176 aa, Brassica napus
  misc_feature (26)..(26): Xaa can be any naturally occurring amino acid
  misc_feature (37)..(37): Xaa can be any naturally occurring amino acid
AAVSSCSFHQFITFGFACTPLYFVWXKVIGMHDTKSXCLRALARCPVGRGGWFLAIIFPFFGPINSAVGALLVSFTVYIIPSLAHMLTYRSASARQNAAEKPPFFLPSWTAMYVLNAFVVIWVLIVGFGFGGWASVTNFVRQVDTFGLFAKCYQCKPPVPAAAAAHAPVAALHHRL

SEQ ID NO: 994 - protein, 519 aa, Brassica napus
MSGAITCSAADLATLLGPNATAAADYICGQLGTVNNKFTDAAFAIDNTYLLFSAYLVFAMQLGFAMLCAGSVRAKNTMNIMLTNVLDAAAGGFFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMTSLVLIGCNKLAELVQYGDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSALPLAFNFQLFGNLLPFKYCLGFGFEI

SEQ ID NO: 995 - protein, 143 aa, Brassica napus
PEFRGGPTRPRFGMGPRMGLVVLIGLGEENTELAIGVRKILFNLITNLPVFHSVGGLDCVKNLPVNTVPEENRFLVKGMGLKTFHMFRGVAGFGSGDWHKKDDNFEKRFFGGFFWLIQLESMMEGGCSDSNDSSFCGSRILFK

SEQ ID NO: 996 - protein, 242 aa, Brassica napus
  misc_feature (177)..(177): Xaa can be any naturally occurring amino acid
MPLAESSPAGKTVCVTGAGGYIASWIVKLLLERGYTVKGTVRNPDDPKNTHLRELEGAKERLILCKADLQDYDALKAAIDGCDGVFHTASPVTDDPEQMVEPAVNGAKFVINAAAEAKVKRVVITSSIGAVYMDPNRDPEAVVDESCWSDLEFCKNTKNWYCYGKMVAEQAAWETAXEKGVDLVVLNPVLVLGPPLQPTINASLFHVLKYLTGSAKTYANLTQAYVDVRDVALAHVLVYEAP

SEQ ID NO: 997 - protein, 173 aa, Brassica napus
  misc_feature (166)..(166): Xaa can be any naturally occurring amino acid
SARKSARHAVSAIMEPEKTGEFDYLPFFYSRVFAFSWQFYGDPVGEVVHFGEFEEGKTFGAYWIKKGHLVGSFLEGGTNEEYDTISKATQLKPAVTDLEELGRVGLGFAETVVSQHIVPEVKEVPSSALVRQASRVVMVEKPLHVWHAATGVLVAASVAAFAFWYXGRRRRRW

SEQ ID NO: 998 - protein, 196 aa, Brassica napus
ALDFCHSRGIMHRDVKPHNVMIDHEQRKLRLIDWGLAEFYHPGKEYNVRVASRYFKGPELLVDLQDYDYSLDLWSLGCMFAGMIFRKEPFFYGHDNYDQLVKIAKVLGTDELNTYLTRYRIELDPNLASLVGRHSRKPWSKFINSENQHLAVPEAVDFVDKLLKYDHQERPTAKEAMAHPYFYPIRNAESSRTPRG

SEQ ID NO: 999 - protein, 181 aa, Brassica napus
YKSPNPNPNPILRFLSNTQSGNPPHMSQIAIGVMIGVKFGTVGTGNIGKTDANLIVALICIYVAGFAWSWGPLGWLVPSEISPLEIRSAAQAINVAVNMFFTFLVAQLFLTMLCHMKFGLFFFFAVFVFIMTIFIYLMLPETKNVPIEEMNRVWKAHWFWGRFIPDEAVGVSAAEMQQKSV

SEQ ID NO: 1000 - protein, 205 aa, Brassica napus
  misc_feature (109)..(109): Xaa can be any naturally occurring amino acid
  misc_feature (167)..(167): Xaa can be any naturally occurring amino acid
GRPFFFFLLERTILRFIIEDTYFPLCVKKAIKNAFLKADYHFADDSSLDISSGTTALAALIFGRRLIIANAGDCRAVLGRRGRAIELSKDHKPNCITEKTRIENLGGVXVYDGYLNGQLSVARAIGDWHMKGPRGSACPLTPEPELQETDLSEDDEFLIMGCDGLWXDVMSSQCAVTIARKALMIHNDPERCSRELVREAGRVGR

SEQ ID NO: 1001 - protein, 581 aa, Brassica napus
MSKQTYKVCFCFNRRFRYTASEAPRDVKTLFDKYSENGVMTVDHLQRFLIDVQKQDKATKEDAQSIINAASSLLHSNGLHLDAFFKYLFGDSNPPLALHEVHQDMDAPISHYFIFTGHNSYLTGNQLSSDCSEVPIIDALKKGVRVIELDIWPNSNKNDIDVLHGRTLTSPVELIKCLRAIKTHAFEVSDYPVVVTLEDHLTPELQSKVAEMVTEIFGEILFTPPVGESLKEFPSPNSLKRRIIISTKPPKEYKEGKDEDVVQKGKALGDEEVWGREVPSFIERNKSGDKDDLDDEEDNDEDDDVEKFKKNAPPQYKHLIAIHAGKPKGSITACLKVDPDKVRRLSLSEEQLEKAAEKYAKQIVRFTQQNLLRIYPKGTRVTSSNYNPLVGWSHGAQMVAFNMQGYGRSLWLMQGMFRANGGCGYIKKPDILLKGGSDSDIFDPKTTLPVKTTLRVTIYMGEGWYFDFRHTHFDQYSPPDFYTRVGIAGVPADTVMKKTKTLEDNWVPSWDEVFEFPLTVPELALLRLEVHEYDMSEKDDFGGQTCLPVWELQEGIRSFPLHNRKEEKYKSVKLLVKVEFV

SEQ ID NO: 1002 - protein, 168 aa, Brassica napus
MLVYTDLLTGDELLSDSFPYKEIENGILWEVEGKWTTKGCVEVNIGANPSAEEGGEDEGVDDSVEKVVDIVDTFRLQEQPTYDKKGFIAYIKKYIKLLTPKLTPEQQEEFKKGIEGATKYLLPKLKDFQFFVGEGMHDDSTIVFAYYKEGATNPTFLYFGHGLKEVKC

SEQ ID NO: 1003 - protein, 161 aa, Brassica napus
  misc_feature (41)..(41): Xaa can be any naturally occurring amino acid
  misc_feature (52)..(52): Xaa can be any naturally occurring amino acid
MRHLKHSSFPYKEIENGILWEVEGKWTTQGCVEVNIGANPXSAEEGGEDEGXVDDSVQKVVDIVDTFRLQEQPTYDKKGFIAYIKKYIKLLTPKLNAEDQEAFKKGIEGATKYLLPKLKDFQFFVGESMHDDSTVVFAYYKEGATNPTFLYFGHGLKEVKC

SEQ ID NO: 1004 - protein, 168 aa, Brassica napus
MLVYTDLLTGDELLSDSFPYKEIENGILWEVEGKWTTKGCVEVNIGANPSAEEGGEDEGVDDSVEKVVDIVDTFRLQEQPTYDKKGFIAYIKKYIKLLTPKLTPEQQEEFKKGIEGATKYLLPKLKDFQFFVGEGMHDDSTIVFAYYKEGATNPTFLYFAHGLKEVKC

SEQ ID NO: 1005 - protein, 265 aa, Brassica napus
VDPRVRASKWLPDLSGNVSAITTPPPTESVTASVMKKRFFVETLIGILPPEKDSVPCNFLLRLLRTAKMVGANANYLTELENRVAWQLDQASLKELMIPSFSHTSGTLLDVELVTRLVKKFVGLDSEGVKTGAALVKVAKLVDSYLAEAALDGGLTLPEFISLIEALPSYARTTEDGLYRAIDTYLKAHPQVLKQERKELCRLIDSRKLSPEAALHAAQNDRLPVRSIIRVLFTEQTKLSRHVDWSGSLTRSPTNPSGSHYFEQE

SEQ ID NO: 1006 - protein, 514 aa, Brassica napus
MKFPLLGLLLLVTLVGSPTRAEEGPVCPKTETLSRASFPEGFMFGTATASYQVEGAVNEGCRGPSLWDIYTKKFPHRVKNHNADVAVDFYHRFREDIKLMKKLNTDALRLSIAWPRIFPHGRMEKGNSKEGVQFYHDLIDELLKNDLTPLVTIFHWDMPADLEDEYGGFLSERVVPDFVEYANFTFHEYGDKVKNWITFNEPWVFSRSAYDVGKKAPGRCSPYIKDFGHLCQDGRSGFEAYVVSHNLLVSHAEAVDAFRKCEKCKGDKIGIAHSPAWFEPEDVEGGQRTVDRVLDFIMGWHLDPTTYGDYPQSMKDAVGARLPKFTKAQKAKLKGSADFVGINYYSSFYAKASEKPDYRQPSWATDSLVEFEPKTVDGSVKIGSQPSTAKMAVYAAGLRKLVKYIKDRYGNPEIIITENGYGEDLGEKDTDHSVALNDHNRKYYHQRHLLSLHQAICEDKVNVTSYFVWSLMDNFEWLDGYTARFGLYYIDFQNNLTRMEKESATCSLNSSNRA

SEQ ID NO: 1007 - protein, 295 aa, Brassica napus
VDPRVRRILAVLGTLPCIVLIPGLFFIPESPRWLAKMGMTDDFETSLQVLRGFETDITVEVNEIKRSVGTSTKRSSTVRFVDLKRRRYYFPLMVGIGLLVLQQLGGINGVLFYSSTIFESAGVTSSNAATFGVGAIQVVATAISTWLVDKAGRRLLLTISSVGMTISLVIVAAAFYLKGFVSHDSDMYSMLSILSVVGVVAMVVSFSLGMGPIPWLIMSEILPVNIKGLAGSIATLANWFISWLITMTANLLLAWSSGGTFTLYGLVCAFTVVFVTLWVPETKGKTLEELQALFR

SEQ ID NO: 1008 - protein, 276 aa, Brassica napus
  misc_feature (216)..(216): Xaa can be any naturally occurring amino acid
MSSLAASLVTGVGLRPERPILYQRTSFPSSRRNTHGVVKASARVDKFSKSDIIVSPSILSANFSKLGEQVKAVELAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPGTPLSAIECVLDSVDLVLIMSVNPGFGGQSFIESQVKKIADLRRMCVXELGVNPWIEVDGGVTPKNAYKVIEAGANALVAGSAVFGAKDYAEAIKGIKTSKRPETVAV

SEQ ID NO: 1009 - protein, 96 aa, Brassica napus
EYYSYNPILGDHRVNFWGYSTIGFFSPMVRYSSASSRNFAGRAINEFKTLVKEAHKRGIEVIMDVVLNHTAEGNEKGPILSFRGVDNSVYYMLAPK

SEQ ID NO: 1010 - protein, 489 aa, Brassica napus
MEKSWFNLMFSKGELEYRGELSKAMDSFAPIEKTTISKDRFIYDMDKNFYGWGERSSYYNNVDLLVNSKDIRNFISDDTFFVRDSNKNSYSIYFDIEKKKFEINNDLSDLEIFFYSYCSSSYLNNRSKGDNDLHYDPYIKDTKYNCNNHINSCIDSYFRSHICINSHFLSDSNNSNESYIYNFICSESGSGKIRESKNDKIRTNSNRNNLMSSKDFDITKNYNQLWIQCDNCYGLKYKKVEMNVCEECGHYLKMTSSERIELSIDPGSWNGMDEDMVSADPIKFHSREEPYKKRIASAQKKTGLTDAIQTGTGQLNGIPVALGVMDFQFMGGSMGSVVGDKITRLIEYATNQCLPLILVCSSGGARMQEGSLSLMQMAKISSVLCDYQSSKKLFYISILTSPTTGGVTASLGMLGDIIIAEPYAYIAFAGKRVIEQTLKKAVPEGSQAAESLLRKGLLDAIVPRNPLKGVVSELFQLHAFFPLNKNEIK

SEQ ID NO: 1011 - protein, 366 aa, Brassica napus
STTRPERSSIQKWLDAGHKTCPKSQETLLHSGLTPNYVLKSLIALWCESNGIELPQNQGSSYRTTRPGGGSSSSDCDRAFVLALLEKLANGSTEHQRAAAGELRLLAKRNADNRVCIAEAGAIPLLVELLSSPDPRTQEHSVTALLNLSINEGNKGAIVDAGAITDIVEVLKNGSMEARENAAATLFSLSVVDENKVAIGAAGAIQALISLLEEGTRRGKKDAATAIFNLCIYQGNKSRAIKGGIVDPLTRVLKDAGGGMVDEALAILAILSTNQEGKAAIGEADTIPVLVEIIRTGSPRNRENAAAILWYLCIGNMERLNVAREVGADVALKELTENGTDRAKRKAASLLEIIQQLEGVVISTVP

SEQ ID NO: 1012 - protein, 73 aa, Brassica napus
MIEVVLNDRLGKKVRVKCNEDDTIGDLKKLVAAQTGTRAEKIRIQKWYNIYKDHITLKDYEIHDGMGLELYYN

SEQ ID NO: 1013 - protein, 82 aa, Brassica napus
VDPRVRGWAQKVKNKRELKAAAAASNGNEGSSQAAPPHNPDSGSSAPAPGAGAGFAGIQLSRLRNNAGETQDEITPAAHNNN

SEQ ID NO: 1014 - protein, 217 aa, Brassica napus
MTTLPYADVDCNLRALAGRAEGFGRFAVGGLHGNLYVVTSLADDGPGSLREGGRRREPLWIVFAVSGTIHLNSYLSVSSHKTIDGRGQRIKITGKGIRLKECEHVIICNLEFEGGRGHDVDGIQIKPKSRHIWIDRCSLRDYDDGLIDITRQSTDITVSRCYFGQHDKTMLIGADPSHVDDRCIRVTIHHCFFDGTRQRHPRLRFGKVHLYNNYTRN

SEQ ID NO: 1015 - protein, 224 aa, Brassica napus
GRVGGRVGEKLVVFEYMSRGSLSALLHGNKGSGRSPLSWETRAGIALGAARAISYLHSRDATTSHGNIKSCNILLSESYEAKVSDYCLAPMISPTSTPNRIDGYRAPEVTDARRISQKADVYSFGVLILELLTGKSPTHQQLNEEGVDLPRWVSSITEQQSPSDVFDPELTRYQAEGNENMIRLLKIGISCTAQYPDSRPSMAEVTRLIEEVSRSSGSHSPLSG

SEQ ID NO: 1016 - protein, 138 aa, Brassica napus
  misc_feature (74)..(74): Xaa can be any naturally occurring amino acid
  misc_feature (123)..(123): Xaa can be any naturally occurring amino acid
RVRTTQLPSGISGNLSPSNRNPNAVIRFGRGSSKRKRLASLSASLREGDGRGKESSVRAVEVKKILEDSPLLPXAETVSNGSRVRVAYQGVRGAYSESASEKAYPNCEAVPCEEFDTAFDAVXRWLVDRAVLPIENSL

SEQ ID NO: 1017 - protein, 131 aa, Brassica napus
HASGGLKTRAQLPEETVSKEEAGVEPNLLAKEKPGVGTEPNPTHEVGLEKGPILGEGEEVIGKKDQVFEGEGQAFEGDELTGGSFSEKNGDSPFEEGEKVVYKVGEGEKAPKGGEAKGEENIEKKTVGMLS

SEQ ID NO: 1018 - protein, 142 aa, Brassica napus
GPTQASNRQLRFAAGYEMNLPASTMRSRLGPTMPPPPISVSNTMDWSGLPSDLQHPKPTTTPGRTPTSARTPALKKPKANEPNKRDMTYEEKQKLSGQLQNLPPEKLDAIVQIVNKRNTAVKLMDEEIEVHIDSVDPETLLE

SEQ ID NO: 1019 - protein, 473 aa, Brassica napus
MSATLTGSGTALGFSCSSKIPKRVSPSSSNRCSIKMSVSVDEKKKSFTLQKSEEAFNAAKDLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTLEFINGLRQLSRDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHAMCGGYISGMFGFFFTEGPVYNFADAKKSDTEKFGRFFRGMLEEGVYFAPSQFEAGFTSLAHTTEDVQFTIAAAERVLGRI

SEQ ID NO: 1020 - protein, 331 aa, Brassica napus
  misc_feature (34)..(34): Xaa can be any naturally occurring amino acid
PGVVVDLPTLTEKDKEDIMKWGVPNQIDMIALSXFVRKGSDLVQVRKLLGDHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMQYSPVPMSPLESLASSAVRTANSARATLIMVLTRGGSTARLVAKYRPGMPILSVVVPEMKTDFFDWSCSDESPARHSLIFRGLIPVLYAGSARASHDESTEEAIEFATQHGKEKQLCKTGDSVVALLRVGNASLIKILTVK

SEQ ID NO: 1021 - protein, 142 aa, Brassica napus
  misc_feature (134)..(134): Xaa can be any naturally occurring amino acid
PAGFRPMGGGGPQNMSMPMGGPMGMGGPMGSIPAVQGLPATGPGGGVPPGYFQGAGPDPMQMQQQQQQQQYLAAVMNQQRAIGNERFQPMMYARPPPAVNYMPAHPHQYPNPYPYPYPYPPHGNDQYSHVFSDXNTSSCDIM

SEQ ID NO: 1022 - protein, 158 aa, Brassica napus
DPRYVFQFEDVTTLSPQIVQLRGSVKQPIFSCKFSRDRVSHVDPLNGYWSSSGDGTELGSERRERKGWNVKIHDLSGSAVAAAFITTPFVPSTGCDWVAKSNPGAWHVVRPDPCRPNSWQPWGKLQAWREPRIRHSVCCRFHILSNGQQVGDVLMSEI

SEQ ID NO: 1023 - protein, 142 aa, Brassica napus
  misc_feature (43)..(43): Xaa can be any naturally occurring amino acid
  misc_feature (105)..(105): Xaa can be any naturally occurring amino acid
  misc_feature (122)..(122): Xaa can be any naturally occurring amino acid
ASAIEFKVAVTVPTDNSVDLLTNDNGVVGLSDENGEPQGFNLXVGGRMGRTHRMESTFARLAEPLGYVPKDDILYAVKAIVVTQREHGRRDDRKYSKMKYLVSSXGIEKFKDVVEQYYGKKXSRPSRELPEWEFKSYLGWHE

SEQ ID NO: 1024 - protein, 111 aa, Brassica napus
MSSSPLASSLFPSPLSTLSAHKHGRSRNFCVSRKEQCLRVRATRLPEGMIVPKVQPKSQPAFLGFTQTAEIWNSRACMIGLIGTFIVELILNKGILELIGVEIGKGLDLPL

SEQ ID NO: 1025 - protein, 126 aa, Brassica napus
LAHGCFPRVKVVHTSRKFLGQIYVPDINWILMILCIAVTAGFKNQSQIGNAYGTAVVIVMLVTTLLMTLIMILVWRCHWVLVLVFTVLSLVVECTYFSAMLFKVDQGGWVPLVIAAAFLLIMSVWH

SEQ ID NO: 1026 - protein, 167 aa, Brassica napus
MAETEQKEVEEKGSLISGLLDKAKGFSAEKLANIPTPEATVDDVDFKGVARQGVDYHAKVSVKNPYPQAIPICQQSYILKSDTRMISVLARLPDPGSLIERVDGSWTVPVKVPYSIAVSLMKDMCLDWDIDYQLDIGLTIDIPIVGDITIPVSTQGEDKLPSLRDFF

SEQ ID NO: 1027 - protein, 223 aa, Brassica napus
  misc_feature (39)..(39): Xaa can be any naturally occurring amino acid
MALMYRRSLLLQHLPCPSVTPFLRNYPLKPLKFSSQPFXHRCRQSPASSSSSSARCCSSSSSMESPPEGYRRNVGVCLMNPSKKIFAASRLDIPSAWQMPQGGIDEGEDPRVAVMRELKEETGVHSAEIIAEAPHWITYDFPPDVREKLKVRWGSDWKGQAQKWFLLKFTGKDEEINLLGDGTEQPEFGEWSWVSPDQLVELAVDFKKPVYKEVMSAFASHLQ

SEQ ID NO: 1028 - protein, 207 aa, Brassica napus
  misc_feature (195)..(195): Xaa can be any naturally occurring amino acid
MDPCPFIRLTINNLALKAPQAAKTSSSVVHPSPSTSFCKIKLKNFPPQTAAIPYIPLDATQFPEIQTLAATFHLSSSDVARLSSRSIFASKPCLKIFIYTGRAGGACGVNPGRHVAEVSVPLDLAGAQGKQCVFHNGWISVGKGAGKESSFHLNVKAEPDPRFVFQFEGEPECSPQVVQIQGSIRQPGFTCNLGXADTSDRTMRSRS

SEQ ID NO: 1029 - protein, 139 aa, Brassica napus
  misc_feature (128)..(128): Xaa can be any naturally occurring amino acid
MTDAHTARTIVGIIGNVISFGLFCSPIPTMIKIWKMKSVSEFKPDPYLATVLNCMMWSFYGLPFVHPDSLLVVTINGTGLFMELVYVTIFFIFATSAIRRKITIAMVVEMIFMAVVIFCTLYFLHTTXQRSMLIGIMCI

SEQ ID NO: 1030 - protein, 92 aa, Brassica napus
MHDFCFTIPYGMLLIGGGFIGYMKKGSITSFAGGAVAGLLLILAGYLSLKAFEKKKNSSIPVVLQTVISAALTLVMGQRYLLTQKVMPAGLI

SEQ ID NO: 1031 - protein, 37 aa, Brassica napus
  misc_feature (18)..(18): Xaa can be any naturally occurring amino acid
DVHVGKVNQAEAEFWKKXEGYTVGWSDQILGFDCGGQ

SEQ ID NO: 1032 - protein, 107 aa, Brassica napus
MVKETEYYDVLGVSPTATETQIKKAYYIKARQVHPDKNPNDPQSAHNFQVLGEAYQVLSDPGQRQAYDTYGKSGVSTEIIDPAAIFAMLFGSELFEEYIRQLAMASM

SEQ ID NO: 1033 - protein, 142 aa, Brassica napus
VKVAVQYMRLVIQKKAKFNIMDLNCLKVSPKTFIPALFGHASGDKFIQPHHSDHILKCYAGDKNIIKFDGDHNSSRPQFYYDSVLIFFYNVLRPPQVSSACSSKLESYSAAGLDENFLYEIISGLRSACIDVASSSSSAPPA

SEQ ID NO: 1034 - protein, 236 aa, Brassica napus
MASSSSYYTPFSALFAVSKPNPSLNPAAFLVPSLKFSTAISNFANLSNGFSLKSPVNPGFLFKSRAFNVQARAAAEKTVHDFTVKDIDGNDVSLNKYKGKVMLIVNVASRCGLTSSNYSELSHLYEKYKSQGFEILAFPCNQFGGQEPGSNPEIKQFACTRFKAEFPIFDKVDVNGPSTAPIYQFLKSNAGGFLGDLIKWNFEKFLIDKKGKVVERYPPTTSPFQIEKDIKKLLAA

SEQ ID NO: 1035 - protein, 99 aa, Brassica napus
  misc_feature (24)..(24): Xaa can be any naturally occurring amino acid
  misc_feature (47)..(47): Xaa can be any naturally occurring amino acid
MCLRELLITCHAWSPNLSSASFFXFANNEVHSYKSSQDQWERLHVLXKDWSSKSNKIVTVSHDRNSYVWNLEGDEWIPTLIILRLSRAAFCVRWSPKGK

SEQ ID NO: 1036 - protein, 185 aa, Brassica napus
  misc_feature (32)..(32): Xaa can be any naturally occurring amino acid
EWVMTELLRQPECLSRLQEEVRTICKEKSSVXEEDIQDMNYLKAVIKETLRLHPPLPLMVPHESTHDVRLRDYRIPAGTQVTINAWAIGRDVATWGPDAEEFRPERHLHSSVDFRGQDFELIPFGAGRRICPAISFAVVLNEVVLANLVHQFGWISTEDQAEVAESTGIAIHRMFPLYAIPSSTS

SEQ ID NO: 1037 - protein, 61 aa, Brassica napus
  misc_feature (9)..(9): Xaa can be any naturally occurring amino acid
  misc_feature (15)..(15): Xaa can be any naturally occurring amino acid
  misc_feature (18)..(18): Xaa can be any naturally occurring amino acid
  misc_feature (23)..(24): Xaa can be any naturally occurring amino acid
GRSYLIAIXDEKKPXMKXIIIDXXLACRPIFRGFIWPVAAYRALLNGDLIAKDVLETKIYI

SEQ ID NO: 1038 - protein, 345 aa, Brassica napus
RPPRPVLVIDLLGPSLEDLFNFCSRKLSLKSVLMLADQMITRVEYFHSKSFLHRDLKPDNFLMGLGRRANQVYIIDFGLAKKYRDNTTHQHIPYRENKNLTGTARYASMNTHLGIEQSRRDDLESLGYILMYFLKGSLPWQGLKAGTKKQKYERISEKKVSTSIESLCRGYPSELASYFHYCRSLRFDDKPDYNYLKRIFRDLFVREGFQLDYVFDWTILKYQKSQLTAPPSRGVVTPAAGTSAGEEERVRPTMDSSRRRASGALDNSAATRAPTMPRESLFAQSAGSSRRVTSEELHYAGGGVRNSAVVSMTEGKRSSSTRKQYDSAMKGIETLQVSDERFHHR

SEQ ID NO: 1039 - protein, 147 aa, Brassica napus
MDEIRGVPTWQEELASLVDAGLRYDGAPIDLTAATESTAKRSSGYLDGSGSEARETLKDQVTGFMKSWGEMLLHLAKACKDIVEQPVVTEDSYVVRKLAKPAAKVSKKLSFMNEYLPEDRDPVHAWPVIFFVFLLALAALSFSPEEE

SEQ ID NO: 1040 - protein, 139 aa, Brassica napus
MTSGGVVEDEKNRSVANDYQHQQQPPHPPPFQGVSNYPPPQQQPPPPGYPQPAQPYVSGYAVNGVTEHDRLPCCGIGIGWLLFILGFFFGAIPWYIGFFLFLFSRNPREKPGYIACAIGAVIATIFIVIGAVRGSGAWS

SEQ ID NO: 1041 - protein, 134 aa, Brassica napus
VVLAAYVIEYADDDGDGGTADEFEEGPGNEGSSSWCTSCILYKMFDNIRNARRNRRRARMLGESRSRRGSRRSSYDNSNSDDSSVASFEFPVYRVDEIDDEFVTTNGLNRSNAMHPRFSLVYNSRRRRSRFYAN

SEQ ID NO: 1042 - protein, 187 aa, Brassica napus
  misc_feature (160)..(160): Xaa can be any naturally occurring amino acid
MEPRVGNKFRLGRKIGSGSFGEIYLGTNIQTNEEVAFKLENVKTKHPQLLYESKLYKVLQGGTGVPNVKWYGAEGDYNVLVIDLLGPSLEDLFNFCSRKLSLKTVLMLADQMINRIEFVHQRSFLHRDIKPDNFLMGLGRRANQVYVIDSGLAKKYRDSXNHQHIPYRENKNLTGTARYASMNTHLG

SEQ ID NO: 1043 - protein, 191 aa, Brassica napus
MEVERAKKDDDLNSADGGGGSAEEISVERIFEESADAPPPWQNQLTFRAMIVSFILSILFTFVVMKLNLTTGIIPSLNISAGLLSFFFVKTWTKILNKAGILKQPFTRQENTVIQTCVVASSGIAFSGGFGSYLFGMSEVVAKQSAEANTPLNIKNPHLGWMIGFLFTGSFLGLFSVGPLRKIMIVDFKLT

SEQ ID NO: 1044 - protein, 296 aa, Brassica napus
  misc_feature (273)..(273): Xaa can be any naturally occurring amino acid
MARKKIREYDSKRLLKEHLKRLANINLQIRSAQVTEATDFTELTNQEPWLSSTKLVVKPDMLFGKRGKSGLVALKLDLAEVAEFVKARLGSEVEMGGCKAPITTFIVEPFVPHDQEYYLSVVSDRLGCTISFSECGGIEIEENWDKVKTVFLPAEKPMTLEVCAPLIATLPLEVRGKIGSFIMGVFAVFQDLDFRFLETYPFTRVDGEPYPLDMRGELDDTAAFKNFNKWGDIEFPLPFGRVLSPTESFIHGLNEKTSVSLKFTVLNPKGRIXWTMAAGSSASVIHADTGGDLGYS

SEQ ID NO: 1045 - protein, 376 aa, Brassica napus
MGWIPCSGKSSGKTKKRSDSDENLSRNCSVSASERSKAKSSVSESRSRGSDNIVAQTFTFSELATATRNFRKECLIGEGGFGRVYKGYLASTGQTAAIKQLDHNGLQGNREFLVEVLMLSLLHHPNLVNLIGYCADGDQRLLVYEYMPLGSLEDHLHDISPSKQPLDWNTRMKIAAGAAKGLEYLHDKTMPPVIYRDLKCSNILLGDDYFPKLSDFGLAKLGPVGDKSHVSTRVMGTYGYCAPEYAMTGQLTLKSDVYSFGVVLLEIITGRKAIDNSRCTGEQNLVAWARPLFKDRRKFSQMADPMIQGQYPPRGLYQALAVAAMCVQEQPNLRPVIADVVTALTYLASQRFDPMSQPVQGSLFGPGTPPRSKRVV

SEQ ID NO: 1046 - protein, 143 aa, Brassica napus
VDPRVRLAIVILAFRDVLSYAFTEGEEVSAAVSDLCPLLALTLVLNGIQPVLSGVAVGCGWQTFVAKVNVGCYYIIGIPLGALFGFYFKFDAKGIWTGMICGTLIQTVILAWITFRTDWTKEVEESAKRLDKWSNKKPEVVPE

SEQ ID NO: 1047 - protein, 851 aa, Brassica napus
  misc_feature (304)..(304): Xaa can be any naturally occurring amino acid
  misc_feature (837)..(837): Xaa can be any naturally occurring amino acid
MKGVRNIYDHHSYTFLLVFVVMILFHPALSIYINTLSSTESLTISNNRTLVSPGDVFELGFFKTTSSSRWYLGIWYKQLPEKTYVWVANRDNPLPNSIGTLKISNMNLVLLDHSNKSVWSTNLTRRNERTPVMAELLANGNFVMRDSNNNDASEFLWQSFDYPTDTLLPEMKLGYNLKKGLNRFLISWRSSDDPSSGDYSYKLEPRRLPEFYLLQGDVREHRSGPWNGIRFSGILEDQKLSYMEYNFTETSEEVAYTFRMTNNSFYSRLTLSSTGYFERLTWAPSSVIWNVFWSSPANPQCDMXQMCGPYSYCDVNTSPSCNCIQGFDPRNLQQWALRISLRGCKRRTLLSCNGDGFTRMKNMELPETTMAIVDRSIGEKECKKRCLTDCNCTAFANADIRNGGTGCVIWTGNLADMRNYVADGQDLYVRLAAADLVKKSNANGKIISLIVGVSVLLLLIMFCLWKRKQNREKSSAASIANRQRNQNLPMNGIVRSSKRQLSGENKIEELELPLIELEAIVKATENFSNSNKIGQGGFGIVYKGILLDGQEIAVKRLSKTSVQGVDEFMNEVTLIARLQHVNLVQILGCCIDADEKMLIYEYLENLSLDSYLFGKTRRSKLNWKERFDITNGVARGLLYLHQDSRFRIIHRDLKVSNILLDRNMVPKISDFGMARIFERDETEANTMKVVGTYGYMSPEYAMGGIFSEKSDVFSFGVMVLEIITGKRNRGFDEDNLLSCAWRNWKEGRALEIVDPVIVNSFSPLSSPFQLQEVLKCIQIGLLCVQELAENRPTMSSVVWMLGNEATEIPQPKSPGCVRRSPYELDPSSSRQRDDDEXWTVNQYTCSVIDAR

SEQ ID NO: 1048 - protein, 91 aa, Brassica napus
  misc_feature (71)..(71): Xaa can be any naturally occurring amino acid
LLDLGINAVELLPVFEFDELELQRRPNPRDHMVNTWGYSTVNFFAPMSRYASGEGDPIKAAKEFKEMVKAXHSAGIEVMLDIVYNHANEAD

SEQ ID NO: 1049 - protein, 134 aa, Brassica napus
  misc_feature (116)..(116): Xaa can be any naturally occurring amino acid
  misc_feature (118)..(118): Xaa can be any naturally occurring amino acid
EKAGYTGKIKIGMDVAASEFFTKDGRYDLNFKKQPNDGAHVLSAESLAELYREFIKDFPIVSIEDPFDQDDWSSWASLQSSVDIQLVGDDLLVTNPTRIAEAIKKKSCNALLLKVXNXLGTVTESIQAALDSKA

SEQ ID NO: 1050 - protein, 127 aa, Brassica napus
ALPSESVFPERPGQLECQFYMKTGDCKFGTVCKFHHPRDRQAPPPDCLLSPIGLPLRPGEPLCVFYSRYGICKFGPSCKFHHPMEVFAYDNTASETDEVVETSGGHSRRVSVFETRQATTSGEDTTN

SEQ ID NO: 1051 - protein, 167 aa, Brassica napus
  misc_feature (9)..(9): Xaa can be any naturally occurring amino acid
  misc_feature (25)..(25): Xaa can be any naturally occurring amino acid
PDFSRLPYXQCVVKESFRLHPPTPXMLPHRSNAHVKIGGYDIPKGSNVHVNVWAVARDPAVWKNPLEFRPERFLEEDVDMKGHDFRLLPFGAGRRVCPGAQLGINLVTSMMSHLLHHFVWTPPQGTKLDEIDMSENPGLVTYMRVPVQAVATPRLPSDLYKRVPYEM

SEQ ID NO: 1052 - protein, 121 aa, Brassica napus
LYENDSIFDKFECCISGNGLRAATGSYSNMFRVFGVSPGSTESATLEASRNPMRRHVPVPSRPSRLGSIARVVGRGSESAGGVDGSSNALDYKTKLLHLAWHPNENSIACAAGNSLYMYYG

SEQ ID NO: 1053 - protein, 150 aa, Brassica napus
  misc_feature (75)..(75): Xaa can be any naturally occurring amino acid
  misc_feature (100)..(100): Xaa can be any naturally occurring amino acid
MDFSALLLTLFTGIIFLYFLRCLISQRRRGSPKPPLPPGTMGWPYVGETFQLYSQDPNVFFASKQKTVGKTHVLXGCPCVMISSPEAVKFVLVTKSHRLXLFKPTFPASKERMLGKQAIFFHQGDYHAKLRKLVLRAFMPEAIRDMVPDI

SEQ ID NO: 1054 - protein, 128 aa, Brassica napus
ASKILIECLAKKVMGDMDPETAKELAICWRKFPSGWFRFPFKIPGMGVYDMMKARKRMMNLLKEVVLKKRASGEEFGEFFKIIFGENERGKEKMSVENAINYIYTFFLIANETTPRILAATVKLISEK

SEQ ID NO: 1055 - protein, 119 aa, Brassica napus
MSASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIIPLGTK

SEQ ID NO: 1056 - protein, 186 aa, Brassica napus
MEPRVGNKFRLGRKIGSGSFGEIYLGTDIQTNEEVAIKLENVKTKHPQLLYESKLYKVLQGGTGVPNIKWYGVEGEYNVLVIDLLGPSLEDLFNFCSRKLSLKTVLMLADQMINRIEFVHQRSFLHRDIKPDNFLMGLGRRANQVYVIDFGLAKKYRDSKYQHIPYRKNKNLTGTARYASMNTHLG

SEQ ID NO: 1057 - protein, 248 aa, Brassica napus
MAGLAFGSFDDSFSLASLRAYLAEFISTLLFVFAGVGSAIAYAKLTSDAALDTPGLVAIAVCHGFALFVAVAVGANISGGHVNPAVTFGLAVGGQITLITGVFYWVAQLLGSTAACFLLKYVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGITYGNVFMTSEHVPLASDF

SEQ ID NO: 1058 - protein, 198 aa, Brassica napus
  misc_feature (104)..(104): Xaa can be any naturally occurring amino acid
  misc_feature (186)..(186): Xaa can be any naturally occurring amino acid
MATVNPFDLLDDDTEDLHKLVAAKPLKSEKTAPVQLGKLPTKPLPPSQAVREGKNGPGGGGRGGGGHGRSGGFNREPRNNDGPANENGYVGGYRRSEEGDGARXRGGSVGGYRGRGGRRGGFNSGESGDFERPRRNFDRQSGTGHGNGFKRDGAGRGNWGTNEDEIPPVTEESAAVVEKSLAAEKXGEATDANKETPV

SEQ ID NO: 1059 - protein, 591 aa, Brassica napus
MPTWWVRKSSKNKDDSHLLQTQTRSVSDKSIRRISADNSKSSPDPVTPSRCTPRCSREFAGASGFSDEKKCHPLPLPSLSNDQVNGSVSGSGSVSSVSSSGSGEDQSQPTAPRKSNAAAASPKAGARPTSPLHNRFSGMTLESSSTGRNDDGRSSEYHPLPLPPGSPTSPSVVLPCSPTSPSSGVQGSWVVGGSEKEISKWKKGRFIGSGTFGKVYQGFNSEEGRICAIKEVKVISDDKNSKECLKQLNQEINVLSQLCHPNIVQYYGSELSEETLSVYLEFVSGGSIYKLLTEYGAFTEPVIQNYTRQILYGLAYLHGRNTVHRDIKGANILVDPNGEIKLADFGMAKHVTAYSTMLSFTGSPYWMAPEVVMHKNGYTLAVDVWSVGCTILEMATAKPPWSQFEGVAAIFKIGNSKDMPEIPDHLSNDAKNFIRLCLQRNPTVRPTAAQLLEHPFLRVHSPRVANTSMHKDVPPRPYDGSSSMPTREPPYSGRHPVFHPIKSPSRENVRAITSLPVSPCSSPLRQLGPAYKSCFLSPPHPSYAFPVQESGYNHQAEFAASPFRFKKDTSLIEPSSYRAQAPSSPFRSRLV

SEQ ID NO: 1060 - protein, 481 aa, Brassica napus
  misc_feature (310)..(310): Xaa can be any naturally occurring amino acid
MRMLTTAVNTLLKRENSLLQRHGFAHVVAQRTNSVHQTETKVPKIPPFSYSPPPYDGPSTGEIIAKRREFLSPALFHFYNTPLNIVEGKKQYVFDETGRRYLDAFGGIATVSCGHSHPEVVESVIKQLKLIQHSTTLYLNHTISDFAEALVSTLPGDLKVVFFTNSGTEANELAMMMARLNTGCNDVVSLRNSYHGNAAATMGATAQSNWKFNVVQSGVHHAINPDPYRGIFGSDGEKYARDVHDLIQFGTSGQVAGFIGESIQGVGGIVELAPGYLPAAYDIVRRAGGVCIADEVQSGFARTGTHFWGXFQSHDVIPDIVTMAKGIGNGIPLGAVVTTPEIAGVLSRRFYFNTFGGNPMCTAAGHAVLRVIQEEKLQENAFLVGSHLKRRLTQLKDKYELIGDVRGRGLMLGVEFVTDRDLKTPAKLETLHLMDQMKEMGVLVGKGGFYGNVFRITPPLCFTLNDADFLVDVMDHALSKM

SEQ ID NO: 1061 - protein, 196 aa, Brassica napus
  misc_feature (170)..(170): Xaa can be any naturally occurring amino acid
MDPCPFIRLTISNLALKLPLAAKSSSSAVHPSSSPCFCKIKLKNFPPQTDAIPYIPLETTQFPEIQTLAATFHLSSSDIKRLASRSIFASKPSLKIFIYTGSAGAACGVNSGGLLAEVSVPLDLAGTQSKPCVFHDGWIAVGKGAGTGKASSAAQFHLNVKAEPDPRFVXQFDGEPECSPQVVQSQGSIPQPVITC

SEQ ID NO: 1062 - protein, 137 aa, Brassica napus
LSDQAGADGFHKNLNGRKYAPSEAEVCHILYVLMVEHTEFDELAASSPVGFTELPTCPICLERLDPDTSGILSTLCDHSFQCSCTSKWTYLSCQVCRLCQQQDDIISCSICGKTDNVWACLVCGFLGCGRYKEGHSI

SEQ ID NO: 1063 - protein, 134 aa, Brassica napus
HASGLLLLDAEKSLAPNLKFLHSRGAPTSELTEILSKVPKILGMKGDKAVGRYYDFVKDIIEADKSSNYEMSCLSALPDGSRQENIIRNVLVLRRLGVPQKLLFSLLISCSHIVSGKDRFEESLKKVVEMGFDP

SEQ ID NO: 1064 - protein, 183 aa, Brassica napus
PGGSTTSGIQDCADTVIGNWHLRGISGGEKRRVSIALEILMRPRLLFLDEPTSGLDSASAFFVTQTLRALSRDGRTVIASIHQPSSEVFELFDRLYLLSSGKTVYFGQASEAYEFFAQAGFPCPALRNPSDHFLRCVNSDFDKVRATLKGSMKLRFEASDDPLEKITTTEAIRLLVDYYHTSD

SEQ ID NO: 1065 - protein, 82 aa, Brassica napus
  misc_feature (63)..(63): Xaa can be any naturally occurring amino acid
  misc_feature (77)..(77): Xaa can be any naturally occurring amino acid
MSASKFIKCVTVGDGAVGKTCMLICYTSNKFPTDYIPTVFDNFSANVSVDGQIVNLGLWDTAXQEDYSTLRPLSYRXADIFV

SEQ ID NO: 1066 - protein, 202 aa, Brassica napus
MNPEYDYLFKLLLIGDSGVGKSCLLLRFADDSYLDSYISTIGVDFKIRTVEQDGKTIKLQIWDTAGQERFRTITSSYYRGAHGIIVTYDVTDQESFNNVKQWLNEIDRYASENVNKLLVGNKNDLTSQKVVSTETAQAFADELGIPFLETSAKNATNVEEAFMAMTAAIKTRMASQPSGGAKPPTVQIRGQPVNQQSGCCSS

SEQ ID NO: 1067 - protein, 262 aa, Brassica napus
  misc_feature (103)..(103): Xaa can be any naturally occurring amino acid
  misc_feature (183)..(184): Xaa can be any naturally occurring amino acid
VDPRVRGSNLLIDSNGVLKIADFGLATFFDPRNSVPLTSRVVTLWYRPPELLLGACHYGVGVDLWSAGCILGELYSGKPILPGKTELHITILNPSRNSTSCFXVEQLHKIFKLCGSPTEDYWRKLKLPPSAAFRPSLPYGRHVAEMFKDLPTNVLSLLEALLSIDPEQRGSAAIALESEYFRXXPFACDPSSLPKYSPIKEIDAKLRDEAKRQQRRPQEKQDSLTRRSHERKLIPPVKANPSLAAATENPYLRRCCPGSFNK

SEQ ID NO: 1068 - protein, 93 aa, Brassica napus
QAFAGHLGDLELAAISIVNNVIIGFGLGLLLGMASALETLCGQAFGAKKYHMLGVYMQRSWIVLFFVVFIIADLSFTTPVSILAQTISLSFWC

SEQ ID NO: 1069 - protein, 230 aa, Brassica napus
SLVRMELDRISEESPIHNLTTQISVSNKNRDVTSYRLKMRAVQLSSDHSTSVEEEVSRIRSEHPEDEQSILKDRVKGQLKVTRAFGAGFLKKPSFNEALLEMFRVDYIGTDPYISCEPCTVHHRLTSSDRFLVLCSDGLYEYFSNEEIVAHVTWFIENVPDGDPAQYLIAELLSRAATKNGMEFHDLLDIPQGDRRKYHDDVSVMVVSLEGRIWRSSGQYYPERKPKFNR

SEQ ID NO: 1070 - protein, 154 aa, Brassica napus
  misc_feature (147)..(147): Xaa can be any naturally occurring amino acid
MAASNGEKSLIVSFGEMLIDFVPTVSGVSLAEAPGFIKAPGGAPANVAIAVSRLGGRAAFVGKLGDDEFGHMLAGILKQNGVSAEGINFDTGARTALAFVTLRSDGEREFMFYRNPSADMLLRPDELNLDLIKSAKVFHYGSISLIXEPCRSAH

SEQ ID NO: 1071 - protein, 135 aa, Brassica napus
MASKALVMLGLFAGLFVISEVAATSEGQSVKSESEDTLQPDHSGGGGQGYNGGGGYNGGGGYNGGGGYNGGGHNGGGGYNGGGHHGGGGGRGGGGYNGGGRGGGYCRHGCCYRGYRGCSRCCSYAGEAVQTQPGH

SEQ ID NO: 1072 - protein, 105 aa, Brassica napus
KKIRTPPLPFSELWGGGPMNPLLCLWGFQPMVSVWGLTWTFSSGGGGIPIVCRGRGCFASFRPRVPFWACFKGNLFSPFFWGGGPLFDPGLGGAKKNSPPLKNLF

SEQ ID NO: 1073 - protein, 146 aa, Brassica napus
DTKSAITDAYNHTDSELLKWENSHNRDAGSTASTAILIGDRLIVANVGDSRAVISRGGNAIAVSRDHKPDQSDERERIENAGGFVMWAGTWRVGGILAVSRAFGDRLLKQYVVADPEIQEEKIDDSLEFLILASDGLWDVFSNEEA

SEQ ID NO: 1074 - protein, 172 aa, Brassica napus
  misc_feature (129)..(129): Xaa can be any naturally occurring amino acid
  misc_feature (135)..(135): Xaa can be any naturally occurring amino acid
MRLITSYYASLGRFLLLCCAIFISRAPSALSLNGSSFDPYPREEEISLPTVMSKARVYTDVNVIRPKEYWDYESLNVEWGELDDYEVVRNVGRGIYSEVVEGINMNSNEKCGIKILKPVQKKKICREIXILQNLXGGPNMVKLLDVVRDQHLKTPSLIFEYVNSTDFKVLYP

SEQ ID NO: 1075 - protein, 316 aa, Brassica napus
PRVREKLKREEIKEIEEAQYQMLISYTKFSVLNIFPTVTKFLLRRKWKEYLELRKSQESVLLKFVNARGREASGDVLCYVDTLLSLEIPTEEDEGKKRKLSDSEIVSLCSEFLNAATDPTATAMQWILAIVVKYPEIQRKVYEEMKSVLEEGEEIREEDLGKLSYLKAVILESLRRHPPGHHLSDHKVTNHTVWGGFLVPRQGTTNFMVAEMGRDPKIWEDPLTFKPERFLENGEAHGFDMTGTREIKMMPFGAGRRMCPGYGLSLLHLEYYVANLVWKFEWKCVEGEEVDLSEKQQFITMVMKTPFKANMYPRRK

SEQ ID NO: 1076 - protein, 147 aa, Brassica napus
SIDQHFQSTPFEKNIPVIVGLLSVWNVSFLGYPARAILPYSQALEKFAPHIQQVSMESNGKGVSIDGLPLPFETGEIDFGEPGTNGQHSFYQLIHQGRVIPCDFIGTVKSQQPVYLEGEVVSNHDELMSNFFAQPDALAYGKTPEQL

SEQ ID NO: 1077 - protein, 364 aa, Brassica napus
VDPRVRLGTAVVLVMLATTLLMILIMLLVWRCHWILVLIFAVLTLVPELSYFSAVIWKINQGGWVPLIIAAISLLVMSVWHYATVKKYEFEVHSKVSMSWILGLGPSLGLVRVPGIGLVYTELASGVPHIFSHFITNLPAIHSVVVFVCVKYLPVYTVPEEERFLVKRIGPKTFRMFRCVARYGYKDLHRKDDDFENKLLNNLFSFIRIETMMEPGSNSSTYSSAYSLNHTQESKDELIHNNNNHHNSNNNNIDEFSSMVDYTVSTLDTIVPADNRMSFSQNNTVEEEEDEEEDELQYLKTCKESGVVHIMGNTVVKARNGSWLPKKIAIDYVYAFLAKICRENSVILHVPHETLLNVGQVFYV

SEQ ID NO: 1078 - protein, 214 aa, Brassica napus
MATYTADDDYDFLYKVVLIGDSGVGKSNLLSRFTRNEFSLESKSTIGVEFATRSIRVDDKVVKAQIWDTAGQERYRAITSAYYRGAVGAFLVYDVTRRVTFENVERWLKELRDHTDANIVCMLVGNKADLRHLRAVSTEDATAFAERESTFFMETSALEALNVEDAFTQVLSQIYRVASKKALDVGGDDHAALPKGQSINVGGKDDVSEVRRWM

SEQ ID NO: 1079 - protein, 124 aa, Brassica napus
GQGEEDKSKGFADEAGTHHQYGTFQGVSNYPPPRPQNSPPVTGFPQPSAPPRVYDSAPPHYAHGYQTVPVHGIAEGRPVHVRQRRLPCCGIGLGWFLFIVGFFLGAIPWYVGMFIMIVGRRIDH

SEQ ID NO: 1080 - protein, 159 aa, Brassica napus
MDGKVNGAVETCFGSFHRYAQYMNFSHPLIKEKFNPKACAWAYGMNFFDLDAWRREKCTEEYHYWQNLNENRALWKLGTLPPGLITFYSTTKPLDKSWHVLGLGYNPSISMDEIRNAAVVHFNGNMKPWLDIAMNQFRPLWTKHVDYDLEFVQACNFGL

SEQ ID NO: 1081 - protein, 151 aa, Brassica napus
  misc_feature (37)..(37): Xaa can be any naturally occurring amino acid
KVDILVAGIGTGGPITGVGRFIKERKPELKVIGVEPXESAILAGGKPGPHKIQGIGAGFIPKNLDQSVVDEYISISSDEAIETAKQLALQEGLLVGISSGAAAAAAIQVAKRPENAGKLIAVVFPSFGERYLSTMLFQSIREECEKMQPEI

SEQ ID NO: 1082 - protein, 198 aa, Brassica napus
  misc_feature (77)..(77): Xaa can be any naturally occurring amino acid
MSASRFIKCVTVGDGAVGKTCLLISYTSNTFPTDYVPTVFDNFSANVVVNGATVNLGLWDTAGQEDYNRLRPLSYRXGADVFILAFSLISKASYENVSKKWIPELTHYAPGVPIVLVGTKLDLRDDKQFFVDHPGAVPITTSQGEELMKLIGAPSYIECSSKSQENVKGVFDAAIRVVLQPPKQKKKKSKAQKACSIL

SEQ ID NO: 1083 - protein, 124 aa, Brassica napus
MATESSSAKRWLPLEANPEVMNQFLWGLGLAPDAAECNDVFGFDDELLEMVPKPVLAVLFLYPITKKSEEERIEQDKEIKEKVHSDKVYFMKQTVGNACGTIGLLHAIGNITSEIKLSEESFLD

SEQ ID NO: 1084 - protein, 52 aa, Brassica napus
  misc_feature (15)..(15): Xaa can be any naturally occurring amino acid
  misc_feature (20)..(20): Xaa can be any naturally occurring amino acid
KKTLPTPLPSQGEKXQNNEXSRSSSSSSSSSSSSSSSDSDSDSSSSSGSEQT

SEQ ID NO: 1085 - protein, 231 aa, Brassica napus
  misc_feature (62)..(62): Xaa can be any naturally occurring amino acid
VDHASALHRHEGGNFYPGTGAADEVGTNGAEGYCVNVPWSCGGVGDKDYIYAFQHVVLPIVXILTGDLPLAASAFSPDFVIVSAGFDAARGDPLGCCDVTPAGYSRMTQMLGDICGGKMLVILEGGYNLRSISSSATAVIKVLLGENPENDDLPIATTPSKAGLETVIEVMNIQMKFWPSLATAYSKLLSEWETRLIENKKNQVKRKLVRVPTLWKWGRKEFMYRFLSARI

SEQ ID NO: 1086 - protein, 253 aa, Brassica napus
RPTRPVRETRSEAMADLEDVQTVDLMSELLRRLKCSQKPDKRLIFIGPPGSGKGTQSPIVKDEFCLCHLSTGDMLRAAVASKTPLGLKAKEAMDKGALVTDELVVGIIDEAMNKPKCQKGFILDGFPRTVAQAEKLDEMLKKRGTGIDKVLNFAIDDSVLEERITGRWIHPSSGRSYHTKFAPPKTPGVDDITGEPLIQRKDDNAEVLRSRLAAFHTQTEPVIDYYAKKAVLTNIHAEKAPQEVTSEVQKALS

SEQ ID NO: 1087 - protein, 119 aa, Brassica napus
TTRPPTRPSMEDVIEMAAPPTTTVKRVRFAVEEEDRYEEDEEAEAELRSELRDLLAAQEAGTAFILGHSHVKAKQGSSVMKRLAVNFGYNFLRRNCRGPDVALKVPPVSLLEVGMVYVI

SEQ ID NO: 1088 - protein, 121 aa, Brassica napus
ADAWANLTGLDVSRTGVNHETVSRLLTSSKSLKVVCALNCPVLEHDADFNPGRFEGKLLIAKFNNTLHGIAPLFFEDNSSSEMMPEDDTRRWLEGNLSRTLLSLTESNLLGLNGFWQKDGA

SEQ ID NO: 1089 - protein, 189 aa, Brassica napus
  misc_feature (123)..(123): Xaa can be any naturally occurring amino acid
MDPAGASVANDIGGEGEKFAVGNIYSVKVITGDEFRGIVMAYDPIPNFVVFEEGSKPRAGHSKNTRMVNASFITGLSYLGKTEDPLLTDNCCVNLDSLRAKEALAIRQAEAEAERLGVGVTAXEAQSIFDSLSKTLPVQWENSDILVMKEVRVRSPYLSDCVFGGTDAANNRVKKVLELVRRRLQLVGT

SEQ ID NO: 1090 - protein, 167 aa, Brassica napus
MIGSFLTRGLVMVFGYAYPAYECYKAVEKNKPEIQQLRFWCQYWILVAALTVFERVGDTFASWVPLYCEAKLAFFIYLWFPKTRGTTYVYDSFFRPYVSKHENEIDRNLVELRTRAGDMAVIYCRKAVCYGQTRVTDILQFVALQSTPKPKPKEKKQTPPEAEEQKQ

SEQ ID NO: 1091 - protein, 157 aa, Brassica napus
MGILRKKKHERNASFKSVLTSILATQAATFLLLISGVSLAGTAAAFIATMPLFVVFSPILVPAGITTGLLTTGLAAAGGAGATAVTIILWLYKQATGKEPPAVLSKVLKKIIPGAAAAPRAAPAAAPAAAPAAAPAAAPAPKPAAAPAPKPAAPPAL

SEQ ID NO: 1092 - protein, 135 aa, Brassica napus
  misc_feature (73)..(73): Xaa can be any naturally occurring amino acid
MNTHQVPEYVETDPTGRYGRFEEVLGRGAMKTVYKAIDEMLGIEVAWSQVQLKEVLRSSVDIQRLYSEVHLLXSTLNHKSIIRFYTSWIDVRSHTLNFITELFTSGTLRQYKNKYLRIDIRAIKSWASQILEGLV

SEQ ID NO: 1093 - protein, 167 aa, Brassica napus
MLSFSSSSLLRPSLHFQPSSHQPVPMSRRSISPFRRKVFCCSTATKFDSLSKSGGGLREPENDSDVLIECRDVYKSFGDKHILKGVSFKIRHGEAVGVIGPSGTGKSTILKIMAGLLAPDKGEVYIRGKKRAGLISDEEISGLRIGLVFQSAALFDSLTVRENVGFL

SEQ ID NO: 1094 - protein, 424 aa, Brassica napus
  misc_feature (228)..(228): Xaa can be any naturally occurring amino acid
  misc_feature (240)..(240): Xaa can be any naturally occurring amino acid
  misc_feature (250)..(250): Xaa can be any naturally occurring amino acid
LILLRRLFLFSLVDRSVRSTEAPSVAVVKSQVVEDAIGSTADVSQPPSHEVDSLRVAGCSDGVVVVSEIPCLTPSDDDFDHGEDRDQDHGDNDDVVVVVPKEDELKQKIIRQVEYYFSDENLPTDKFLLNAMKKNKKGFVPISTIATFHKMKKLTRDHALIVSALKESSFLVVSSDEKKVKRLSPLPEIRDPKIFTVLVENLPEDHTDENIRAIFGKAGSIKSVSHMXDPNAVEESEKGXKKDNFIRTRXLHAFVEYESVEAAEKAAATLNYEQDWRNGLRVKLLEQTGKFAQRRPGRKEVDTVKDNTGQVHDQIGGEENKKSNEHQHHRHHHSDTPADNDSGDKNGNKTKSRGRGRRQNNQGGNGHGSSPSTSSSLHHNYHHHHVEVSKPPPGPRMPDGTRGFTVGRGKPLPAPTSAQTSHEA

SEQ ID NO: 1095 - protein, 213 aa, Brassica napus
  misc_feature (202)..(202): Xaa can be any naturally occurring amino acid
MATNIGMMDSAYFVGRNEILGWINDRLHLNLSRIEEVASGAVQCQMLDMTFPGVVPMHKVNFAAKNEYEMIQNYKVMQEVFTKLKITKPLEVNRLVKGRPLDNLEFLQWLKRFCDSINGGIMNENYNPVERRSRGGKEKSIKGSSKVSKSLQTNNTHHTPTVTASSKPTGPKQARSHAIGGGSNSSAEVQALSKELEDLKVXVDVLEKERDFY

SEQ ID NO: 1096 - protein, 169 aa, Brassica napus
SVNNVTASPDGKLVAVLGDSPECLLADAGSGKVIHALEGHLDYSFSSAWHPNGQILATGNQDTTCRLWDVRNLSKSLKVLKGNMGAIRALRFTFDGRFLAMAEPADFVHVFDTEAGYSQCQEIDMFGEVAGISFSPDTEALFVGVADRTYGSLLEFSRKRNHLYLDSIF

SEQ ID NO: 1097 - protein, 159 aa, Brassica napus
SPNSKGEVCIRGPNVTKGYKNNPDANKAGFEFGWFHTGDIGYFDSDGYLHLVGRIKELINRGGEKISPIEVDSVLLTHPDVSQGVAFGVPDEKYGEEINCAVIPREGTTVTEEDIKTFCKKNLAAFKVPKRVFITDNLPKTASGKIQRRIVAQHFLEKP

SEQ ID NO: 1098 - protein, 243 aa, Brassica napus
MAMYLLYESSSGYGLFEAHGLDEIGQNTEAVRSSVSDLSRFGRVVQLTAFHPFESALDALNQVNAVSEGVMTDELRSFLELNLPKVKEGKKPKFSLGTSEPKLGSHILEATKIPCQSNEFVLELLRGVRLHFDRFIKDLKPGDLEKSQLGLAHSYSRAKVKFNVNRVDNMVIQAIFLLDTLDKDINSFAMRVREWYSWHFPELVKIVNDNYLYARVSKMIDDKSKLTEDHIPMLTEVLGDDDK

SEQ ID NO: 1099 - protein, 159 aa, Brassica napus
  misc_feature (66)..(66): Xaa can be any naturally occurring amino acid
  misc_feature (87)..(87): Xaa can be any naturally occurring amino acid
  misc_feature (130)..(130): Xaa can be any naturally occurring amino acid
MFLTGSSLSNDGPLDCTFHRVRDVDMKRDYAFVEFSDPRDADDARYYLDGRDFDGSRITVEASRGXLPGGSRDSGSRGPPPGSVRCXNCGVDGHWARDCTAGDWKNKCYRCGERGHIERNCKNSPSPKKXRRGGSYSRSPVKSRSPRRRRSPSRSRSYR

SEQ ID NO: 1100 - protein, 95 aa, Brassica napus
MDLLSALPDDVRSHILSFLTTKEAALTSVLSKKWRYLFTRVPILDVDDSVFPYPEGFMDFVDRVLSLQGDSPIERFTLKCEDGVDPDRVNGWICN

SEQ ID NO: 1101 - protein, 849 aa, Brassica napus
MKGVRNIYHHSYTSFLLLFLVMILIHPALSIYINTLSSTESLTISSNRTLVSPGDVFELGFFETNSRWYLGMWYKKLPFRTYVWVANRDNPLSNSIGTLKISGNNLVILGHSNKSVWSTNLTRGIDRSTVVAELLANGNFVMRDSNNNDASQFLWQSFDYPTDTLLPEMKLGNDLKTGLNRFLTSWRSSDDPSSGEFLYELETGRLPEFYLSKGIFPAYRSGPWNGIRFSGIPDDQKLSYLVYNFTENSEEVVYTFRMTNNSIYSKLTVSLSGYFERQTWNASLGMWNVSWSLPLPSQCDTYRRCGPYAYCDVSTSPICNCIQGFNPSNVQQWDQRSWSGGCIRRTRLSCSGDGFTRMENMELPETTMAIVDRSIGVKECKKRCLSDCNCTAFANADVQNGGTGCIIWAGELEDIRNYAADGQDLYVRLAAADLVKRRNANGQIISLTVGVSVLLLLIMFCLWKRKQKRANANATSIANRQRNQNLPMNGMVLSSKREFLEEKKIEELELPLIELETVVKATENFSNCNKLGQGGFGIVYKGRLLDGQEIAVKRLSKTSVQGTDEFMNEVTLIARLQHINLVQIIGCCIEADEKMLVYEYLENLSLDSYLFGKTRRSKLNWKERFDIINGVARGLLYLHQDSRFRIIHRDLKVSNILLDKNMTPKISDFGMARIFARDETEANTVKVVGTYGYMSPEYAMHEIFSEKSDVFSFGVIVLEIVSGKKNSYNLNYKNNLLSYAWSQWEEGRALEIIDPVIVDSLPSTFQPQEVLKCIQIGLLCVQELAEHRPTMSSVVWMLGSEAKEIPQPKQPGHCIGRSPYDLDPSSSSQCDDDESWTVNQYTCSLVDAR

SEQ ID NO: 1102 - protein, 229 aa, Brassica napus
VDPRVRKFFEVPTGWKFFGNLMDAGMCSVCGEESFGTGSDHIREKDGIWAVLAWMSILAHKNKDSIDGDTKLVTVEDIVRQHWATYGRHYYTRYDYENVDAGKAKELMEHLVKLQSSIPEVNKIVKGIRSDVANVSSADEFEYKDPVDGSISKHQGIRYLFEDGSRLVFRLSGTGSEGATIRLYIEQYEKDASKIGRESQEALSPLVEIALKLSKMEEFTGRSAPTVIT

SEQ ID NO: 1103 - protein, 90 aa, Brassica napus
  misc_feature (81)..(81): Xaa can be any naturally occurring amino acid
RPTRPGGIANFTDVAATFNGIIRALKEKEAKLKASRMHIYVRRGGPNYQKGLAKMRSLGDEIGVPIEVYGPETTMTGICKXAIEYITSAA

SEQ ID NO: 1104 - protein, 321 aa, Brassica napus
MDLQPEELQFLTIPQLLQESISIKKRSPRTFYLITLSLIFPLSFAILAHSLFTQPLLAKLDSSDPPNSDRSRHDWTKLLIFQFSYLIFLFAFSLLSTAAVVFTVASLYTGKPVSFSSTISAIPKVFKRLLITFLWVALLMFAYNAVFFVFLVILFVALDMNSVGLAVIAGLLIAVLYFGVHVYFTALWHLGSVISVLEPVYGLAAMRKAYELLKGKVKMATGLVFVYLLLCALIGITFGSIVVHGGGKYGTLTRTLVGGLLVGVLVVVNLVGLLVQSVFYYVCKSYHHQTIDKTALYDHLGGYLGDYVPLKSNIQLENLDI

SEQ ID NO: 1105 - protein, 151 aa, Brassica napus
MQYYETRAKEYYDVAQGQSRQSYGQNHQGYGQSQSRPVYGHSPTLNYRSHGGFLDGLFKGKNGQKGQNGLGSFLGQHKNQDTNQGHGHGKLLGQHQKKTHETNKGVNGLGMFINCGEKKLKKQNEHKKKKKNKDGHASGNESGSSSGSDSD

SEQ ID NO: 1106 - protein, 119 aa, Brassica napus
  misc_feature (24)..(24): Xaa can be any naturally occurring amino acid
  misc_feature (67)..(67): Xaa can be any naturally occurring amino acid
RSTLRVEHASDETSRLFTMPYQKXSDGHEHLAGLSDDVGAGFITGHGNETASSSSELTVDQATDLPXQDETGLTGVSKLITADQKRFIIDRGNSIRSHFLKISEVDGSDRSSIILPLSG

SEQ ID NO: 1107 - protein, 243 aa, Brassica napus
  misc_feature (236)..(236): Xaa can be any naturally occurring amino acid
STHASGADNGSESPDSDRHHEPEIVNENPKPDHKREAKEEEEEQSKCSVLDVQWAQGKAGEDRVHVVVSEENGWVFVGIYDGFSGPDAPDYLLNNLYTAVQKELNGLLCNDEKLRTLGENGDTQIGKRSDKEDSDSGKENFPVTTNIDAVASGARNQEKSVKWRCEWENNDTKSDNDCDQKGSNSTTTNHGDVLRALVQALRKTEEAYLELADTMVEENPELALMGSCVLVTLMKXEDVYVMN

SEQ ID NO: 1108 - protein, 142 aa, Brassica napus
RRDDLESLGYVLMYFLRGSLPWQGLKGGTKKQKYDKISEKKMLTPVEILCKSHPSEFTSYFHYCRSLRFEDKPDYSYLRRLFRDLFIREGYQLDYVFDWTTLKYPQTGSTSRTRLTPRPALEPDPPKTPAEKSEKTTVGQDL

SEQ ID NO: 1109 - protein, 103 aa, Brassica napus
ENLIPHKTFSGNRPSLSLLLPELSAYNVGQLLAIYEHRVAVQGFVWGINSFDQWGVELGKVLATQVRKQLHSSRTQGAAPEGFNYSTTTLLKRYLETSPEPKM

SEQ ID NO: 1110 - protein, 76 aa, Brassica napus
  misc_feature (3)..(3): Xaa can be any naturally occurring amino acid
  misc_feature (8)..(8): Xaa can be any naturally occurring amino acid
RRXRTEEXPAIANDFRVAARKAKEAGSDGVEVHGAHGDLIDQVLKDKGNDRSDQNGGALENRWRFAVEGVKAAGKE

SEQ ID NO: 1111 - protein, 179 aa, Brassica napus
MASYQNRPGAQATDEYGNPIQQLDEYGNPIGRGATGGGGYGTGGGYGGGATGGTYGTGGEGYGAGTGALGAGVGGRHHGQEQLHKESGGGGLGGMLHRSGSGSSSSSEDDGQMGRRKKKGITDKIKEKLPGHHDQSGQSQGMGMGTTTGYDEGGYTGERHEKKGMMEKIKEKLPGGGHH

SEQ ID NO: 1112 - protein, 125 aa, Brassica napus
MSIPQAKMELRPLGNTGLKVSSVGFGASPLGSVFGPVAEVDAVATVREAFRQGINFFDTSPYYGGTLSEKMLGKGLKALQVPRSDYIVATKCGRYEEGFDFSAERVTKSIDESLERLQLDYVDIL

SEQ ID NO: 1113 - protein, 115 aa, Brassica napus
MEEEAREVAVIDKDLKKKIKDTVNKILKRSSLYQITEVKAREEASSELDLDLSKDPYKLIVREAVERFVEKAVMTIESEMGKHHAQIVQDVEGGSEKSTKKKKKKNKTKKEVSAA

SEQ ID NO: 1114 - protein, 165 aa, Brassica napus
MGILRKKKHERKPSFKSVLTAILATHAATFLLLIAGVSLAGTAAAFIATMPLFVVFSPILVPAGITTGLLTTGLAAAGGAGATAVTIILWLYKRATGKAPPKVLEKVLKKIIPGAAAAPAAAPGAAPAAAPAAAPAVAPAAAPAAAPAPKPAAPPAPKPAAAPSI

SEQ ID NO: 1115 - protein, 281 aa, Brassica napus
MSKEVSEEGHTQSHGKDYVDPPPAPFLDMGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSTGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 1116 - protein, 105 aa, Brassica napus
MSAINITNVSVLDNPAPFVSPFQFEISYECLTSLQDDLEWKLVYVGSAEDETYDQTLESVLVGPVNVGNYRFVLQADPPDPSKIREEDIIGVTVLLLTCSYMGQE

SEQ ID NO: 1117 - protein, 116 aa, Brassica napus
MPRFDDRYGNTRLYVGRLSSRTRTRDLERLFSRYGRVRDVDMKRDYAFVEFSDPRDADDARHYLDGRDFDGSRITVEASRGAPCGSRDARDNGSRGPPPGSGRCFNCGVDGHWARD

SEQ ID NO: 1118 - protein, 288 aa, Brassica napus
  misc_feature (222)..(222): Xaa can be any naturally occurring amino acid
MTSTGQTTGTKKVCVIGGTGNLASILIDRLLQSGYEVNTTVRDPENEKKMAVLRVLQEQGDLNIFKADLTDEGSFNSPVSGCEYVFHVATPISFTSQDPEKDMINPAIQGVINVLKSCLNSNSVKRVIYTSSAAAVSINNLSGPGLVMTEENWSDIDFLRKEKPFNWAYPISKALAEKAAYQFAEENNIDLVTVVPALIAGNTLIDDPPPSSLSLSMSLITXGKNMHLNALKEMQKLSGSISFIHVDDLACAHLFLAEKEAASGRDICCSYDPNIPELAHFLSKGYPR

SEQ ID NO: 1119 - protein, 186 aa, Brassica napus
STHASGKYGRFLWMMQGMFKANGGCGYVKKPDVLLSNGPGGETFDPSSKNLQIKTVLKIKIYNGEGWNMDFSQDHFDRYSPPDFYARVGIAGIPLDTTSHKTETDTDEWFPVWDKEFEFPLRVPELALLYIIVKDYDSNTQNDFAGQICLPLSEIRPGIRAVRLHDRAGEVYKHARLLVRFGLEPR

SEQ ID NO: 1120 - protein, 228 aa, Brassica napus
TLNGVDEEVVAAEGAREIGLKKDSKPSFLSRPGSLAVHAGERLGRGIVTDAITTPVVNTSAYHFKNTAELLDFKEKRSVSFEYGRYGNPTTIVLEDKISALEGAESTLVMASGMCASTVMILALVPAGGHIVTTTDCYRKTRIFMETFLPKMGITVTVIDPADIAGLEAAVNKYQVSLFFTESPTNPFLRCVDIELVSEICHKRGTLVCIDGTFATPLNQKALAFGAD

SEQ ID NO: 1121 - protein, 173 aa, Brassica napus
MAVKKASEMFSKSLIEDVHRWGCMKQTGVSLRYMMEFGSTPTERNLLISAQFLHKELPIRIARRAIELETLPYGLSEKPAVLKVRDWYVESFRDMRAFPEIKDTADEKEFTQMIKAVKVRHNNVVPMMALGVNQLKKGMKLYEKLDEIHQFLDRFYLSRIGIRMLIGQHVELH

SEQ ID NO: 1122 - protein, 187 aa, Brassica napus
EDHIPMLTEVLGDEDKAKEVVEAGKASMGQDLSALDLINVQTFAQKVMDLADYRKKLYDYLVSKMSDIAPNLAALIGEMVAARLISHAGSLTNLAKCPSSTLQILGAEKALFRALKTRGNTPKYGLIFHSSFIGRASAKNKGRIARYLANKCSIASRIDCFADGATTAFGEKLREQVEERLDFYDKG

SEQ ID NO: 1123 - protein, 150 aa, Brassica napus
MQYYETREKEYYDVAQGQSRQGYGQNHHQGYDQSHSRPVYGHSPTMNHRSHGGFLDGLFKGKNGQKGQNGLGTFLEHKSHEANKGHGHGKLLGQHQKNTHETNKGVNGLGTFINNGEKKHKKQNEHKKKKNKDGHGSGNESGSSSGSDSD

SEQ ID NO: 1124 - protein, 583 aa, Brassica napus
MRFRSLICLLFLLFFTSSAYARLVSLHPSSTDLISDGVNGEPLINSRSIIKTVVSAEEKEEACEQTYGFMPCTKTALGNVFLILVYGFLMFTAATYLSGGSELLLEILGPGIGGGLFLPMLGALPDAMLIMVSGLSGDAATAQTQVSVGMGLLAGSTGMLLTVIWGPPTRPGKCDLRDSIAVNNRDTKGFHLKDSGVTVDVWTSYAARIMAISVIPFIIVQLPQVLDSTSGRHLAVLGALILSGLMLISYCVYQVFQPWIQRRRLAFAAPDRGISGILKHLKQHALGRLLDDEGQPDEHVIRKLFETIDANKDGHLSAAELKALIIGISFEDIDFDKDDAVGKVLQDFDKTLDEQVDQEEFVRGIKHWLIQAMGAAGPSGPDAGPPTMKFLDHFHVQTKREHALLGDNENGENDEQSGEVADPKWITIKAALLLLLGAAIAAAFADPLVDTVNNFSAATGIPSFFISFIALPLATNSSEAVSAIIFASRKKIRTASLTFSELCGGATMNNILCLSVFLAIVYLRGLTWNFSSEVLVILIVCLVMGGFASFRTTYPLWTCFIAYLLYPFSLGLVYILDYWFGWS

SEQ ID NO: 1125 - protein, 223 aa, Brassica napus
MGGHGEGVSLEFTPTWVVAGVCTIIVAISLAVERLLHHFGTVLKKKKQKPLFEALQKVKEELMLLGFISLFLTVTQGLISKICVREEVLMHMLPCSKQEAELSKHKNVTTTTTEHFQSLIPIVGTTRRLLAEHAAAEAGYCSLKDKTPLLSLEALHHLHIFIFVLAISHVTFCALTVVFGSTRIYQWKKWEDALADESFDPEAALVKKSVTHVHQHAFIKEHF

SEQ ID NO: 1126 - protein, 181 aa, Brassica napus
MASVMLSSATMASSPAHATMVAPFIGLKSSAAFPVTCKANTKVTSITSNGGRVNCMKVWPPVGKKKFETLSYLPDLTDVEIAKEVDYLIRNKWTPCIEFELEHGFVYREHGNIPGYYDGRYWTMWKLPLFGCTDSTQVLKEVKKCKQESPNPFIRIIGFDNNRQAQCISFFAYKPPSFTDA

SEQ ID NO: 1127 - protein, 441 aa, Brassica napus
MVGAKPIENGSDGGASTGLLHGRYELGRLLGHGTFAKVYHARNVTTGKSVAMKVVGKEKVVKVGMVDQIKREISVMRMVKHPNIVELHEVMASKTKIYFAMELVRGGELFAKVAKGRLREDVARVYFQQLISAVDFCHSRGVYHRDLKPENLLLDEEGNLKVTDFGLSAFTEHLKQDGLLHTTCGTPAYVAPEVILKKGYDGAKADLWSCGVILFVLLAGYLPFQDDNLVNMYRKIYRGDFKCPGWLSSDARRLVTKLLDPNPNTRITIDKVMDSHWFKKSSTRSRNEPVAATPEAEEDVDVSVHKSKEETETLNAFHIIALSEGFDLSPLFEEKKKEEKMEMRFATSRPASSVISSLEEAAKVGNKFDVRKSECRVRIEGKQNGRKGKLAVEAEIFAVAPSFVVVEVKKDHGDTLEYNNFCSTALRPALKDIFWTSTTPA

SEQ ID NO: 1128 - protein, 120 aa, Brassica napus
  misc_feature (90)..(90): Xaa can be any naturally occurring amino acid
RSARSGGNSPFKFLGPLLQHFLPPGSKPREALLLTIPPNLVLNPGPTKFLIKSWLKSTVGFVCSAAKSGTQNQSRKAFSTEGVFSSIFFXVPMPAVVVFWGLTPCRGLNHFSRGGRHQFR

SEQ ID NO: 1129 - protein, 138 aa, Brassica napus
MDGGAEGTQQPHLILAHKLFLLTHPDVQDIEKVQLKSDVLDSIKSDGMAPLYETLAASSVLELDQSLLDSMRANNEEELKKLDEKIADAEENLGESEVREAHLAKALYFITISDNETALEQLKLTEGKTVAVGQKMDL

SEQ ID NO: 1130 - protein, 168 aa, Brassica napus
MTKTPPTVVLLLFLLLSAAVPPSTAEIKSLVISSDARPMILFEKFGFTHTGHVTVSVSSVSVVSTSPDPNPDPSRLGFFLLSEESLLQVLLEIQQNARFCVLDSHYVTHLFTFRDLSPPPNSRFNHSYPVTAPPLYRYLFPHCASQTKVSMAVRTEMYYKNPNGSKDY

SEQ ID NO: 1131 - protein, 84 aa, Brassica napus
HASGSIKNKDQTPEETVSKEEAGDETKLIAEEKTEVVTEPNPTHEAGLEEGTIMEEGEEVNGEEEQVYEEEEQAYEGDELTESL

SEQ ID NO: 1132 - protein, 49 aa, Brassica napus
MTLTIPSAPGSSGYLDMYPERRMSYFGNSYILGLTVTAGIGGLLFGYDT

SEQ ID NO: 1133 - protein, 139 aa, Brassica napus
AATMAKGDPEPDAVYNLSVENAFQRNLQAALDGAVEYSSMVGGVSTRGWKHLAAVLSAEKRLKDAESILDFTMEEAGDMEKLDLLKLKAVLQMAQEQPKQALKTCSNFLALIRAQEKSEQSETLLKKYETEAWQDPASV

SEQ ID NO: 1134 - protein, 191 aa, Brassica napus
MYKSSSVRDEGTIPLLQKLSPHEKLHLNKNHSAPLTHFANEAISIAKISLPLVFTGLLLYFRSFVSLFFLGGLGRPTLAGGSLALAFANITGYSLFSGLTMGVESICSQAFGAKRYNLVTATIRRGIVLLLLTSLPVSLLWINIEKILQMLKQDEDLASEAHIFLLYSGPDLGAQSFLHPLRGYLRTQAKT

SEQ ID NO: 1135 - protein, 209 aa, Brassica napus
  misc_feature (74)..(74): Xaa can be any naturally occurring amino acid
  misc_feature (130)..(130): Xaa can be any naturally occurring amino acid
VDPRVRQTVGFGNNAALLSAVITGSINVLSTFVGIYLVDRTGRRFLLLQSSVHMLISQLIIGIILAKDLGITGXTLGKAQAMVVVVFVCAYVMGFAWSWGPLGWLIPSETFPLETRSAGFAVAVSCNMFXFTFVIAQAFLSMLCGMRSGIFFFFSAWIIVMGLFALFFIPETKGVAIDDVRERVWKPHWFWKRYMLAEDDHQDVEKRTE

SEQ ID NO: 1136 - protein, 190 aa, Brassica napus
  misc_feature (35)..(35): Xaa can be any naturally occurring amino acid
  misc_feature (181)..(181): Xaa can be any naturally occurring amino acid
MNGDDEEMVAASADPSPPLEWRFSQVFGERSAGEXEVHEVDVISAIQFDHSGDHLATGDRGGRVVLFERTDARNSSGGARRDLEETDHHPLRHPEFRYKTEFQSHDPEFDYLKSLEIEEKINKIRWCQTANGALFLLSTNDKTINYWKVQDKKMKKVCEVNSDPSKTGALASSSNPSITNXCLGNGGVIS

SEQ ID NO: 1137 - protein, 175 aa, Brassica napus
  misc_feature (143)..(143): Xaa can be any naturally occurring amino acid
MAGGFVSQTPGVRNYNYKLTPKVFVTCFIGAFGGLIFGYDLGISGGVTQMEPFLEEFFPYVYKKMKNAHENEYCRFDSQLLTLFTSSLYLAALVSSLFASTITRVFGRKWSMFLGGFTFFIGSAFNGFAQNIAMLLIRSYLAXGFGVGFANQSVPGYLSEMAPPNLKGAFTMGFQ

SEQ ID NO: 1138 - protein, 130 aa, Brassica napus
SYQAQNLIQAGVDGLRVGMGSGSICTTQEVCAVGRGQATAVYKVCSLAAQSGIPVIADGGISNSGHIVKALVLGASTVMMGSFLAGSTEAPGAYEYKNGKRIKKYRGMGSLEAMTKGSDQRYLGDKTNLK

SEQ ID NO: 1139 - protein, 266 aa, Brassica napus
MEVSAFPFPYLQDDECSHLLGLFQDMDSAPSGFEFENVGNDNTRKRPRKEEEEEVNGSDKAASGDILATLLLLDEEAKQQVNTMDGYYNHDVARPKRQRKAAVEETASPASDIASGSGSGPSHHRRLWVKERTTDWWDRVSRPDFPEEEFRREFRMSRPTFDLICEELDATVTKKNTMLRDAIPAPKRVAVCVWRLATGAPLRHVSERFGLGISTCHKLVIEVWRAIYDVMMPKYLHWPSSDSEIQSTKRKFESNHKIPNVVGSIY

SEQ ID NO: 1140 - protein, 187 aa, Brassica napus
  misc_feature (70)..(70): Xaa can be any naturally occurring amino acid
  misc_feature (164)..(164): Xaa can be any naturally occurring amino acid
GSGAKLSGKVGGIHWHYNTRSHAAELTAGYYNTRNHDGYLPIAKMFNKHGVVLNFTCMEMKDGEQPEHAXCSPEGLVKQVQNATRQAGTELAGENALERYDSSAFGQVVATNRSDSGNGLTAFTYLRMNKRLFEGQNWQQLVEFVKNMKEGGHGRRLSEEDTTXGDLYVGGFVGSKISETVEEAVLV

SEQ ID NO: 1141 - protein, 166 aa, Brassica napus
MAFVTTAEVCDANQDLIRSGQLRALQPCFQIYGRRQIFSGPVVTVKVFEDNGLIRQFLEEKGNGRVLVVDGGGSLRCAILGGNPVVQAQNNGWAGIIVNGCIRDVDEINGCDIGVRALASHPIKASKKGLGEQRVPLNIAGTRICDGEWLYADTDGILVSHIELSV

SEQ ID NO: 1142 - protein, 59 aa, Brassica napus
  misc_feature (40)..(40): Xaa can be any naturally occurring amino acid
GDPRVRGATKCLLPRGGGGQFFVGGGVHDDSTIVFAYYKXGRTNPTFLGFGHGVKEVKC

SEQ ID NO: 1143 - protein, 153 aa, Brassica napus
AEPEDKEMTLEEYEKVLEEKRKALQATKIEERKVDTKVFETMQQLSNKKSNNDEVFIKLGTEKDKRPVEKEEKTKKSLSINEFLKPANGERYRGGYRGGREGRGGRGPREGAEGRGRGPRGADGGENQRAAAPKRVAPAPKIEDAAQFPTLGK

SEQ ID NO: 1144 - protein, 226 aa, Brassica napus
MSTIQARWVPIQSPVEDKAMKPLNYETKKPHNYETILRDADLPIPPSTEQLRSGVLLKKLIKYWVDDRNINCFMIFPRKLSITWSDDPNYWTWLPNDSPNEKGVEAAELNNVCWLDITGKFDTSNLTPGITYEVVFKMKLEDPAYGWDTPVNVKLVFPNGKDKQQEKKVSLREQPRYQWVDIKVGDFKHERDSVGEIIFSMYEHAAGVWKKGLFLKGVAIRPKYNN

SEQ ID NO: 1145 - protein, 284 aa, Brassica napus
  misc_feature (143)..(143): Xaa can be any naturally occurring amino acid
  misc_feature (172)..(172): Xaa can be any naturally occurring amino acid
MSTSLSTSLCCSSTQVNGFALGPQRSLLYQPSSFSFSRRRSHGVVKATARVDKFSKSDIIVSPSILSANFAKLGEQVKAVECAGCDWIHVDVMDGRFVPNITIGPLVVDALRPVTDLPLDVHLMIVEPDLRVPDFIKAGADIXVSVHCEQSSTIHLHRTVNQIKSLGAKAGXLSLNPGTPLSAIEYVLEEVDLVLIMSGRPARPGQSFIESQVKKISDLRRMCVEKGVNPWIEVDGGVTPKNAYKVIEAGANALVAGSAVFGAKDYEEAIKGIKNSKRPEAVAV

SEQ ID NO: 1146 - protein, 649 aa, Brassica napus
MSSAPSPGTGSPPSPPSNSTTTTPPPASAPPPTTPSSPPPPSTIPTSPPPSSRSTPSAPPPSPSPPTPSTPGSPPPLPQPSPPAPTTPGSPPAPVTPPTRNPPPSVPGPPSNPSREGGSPRPPSSPSPPSPSSDGLSTGVVVGIAIGGVALLVIVTLICLLCKKKRRRDEEDAYYVPPPPPPGPKAGGPYGGQQQQWRQQNATPPSDHVVTSLPPPPKAPSPPRQPPPPPPPPFMSSSGGSDYSDRPVLPPPSPGLVLGFSKSTFTYEELARATNGFSEANLLGQGGFGYVHKGVLPSGKEVAVKQLKVGSGQGEREFQAEVEIISRVHHRHLVSLVGYCIAGAKRLLVYEFVPNNNLELHLHGEGRPTMEWSTRLKIALGSAKGLSYLHEDCNPKIIHRDIKASNILIDFKFEAKVADFGLAKIASDTNTHVSTRVMGTFGYLAPEYAASGKLTEKSDVFSFGVVLLELITGRRPVDANNVYVDDSLVDWARPLLNRASEQGDFEGLADAKMNNGYDREEMARMVACAAACVRHSARRRPRMSQIVRALEGNVSLSDLNEGMRPGQSNVYSSYGGSTDYDSSQYNEDMKKFRKMALGTQEYNATGEYSNPTSDYGLYPSGSSSEGQTTREMEMGKIKRTGQGYSGPSL

SEQ ID NO: 1147 - protein, 135 aa, Brassica napus
MDLSSRSLWILVAFLSITTSFAEIRKSEIRSDDRPIIPLDEFGFTHTRRLELDASKISLSNTNPDLDLSKVGFFLCTRDAWVHVIQQLEEEEITCALQSDLVKHVFTFNKLSTNTSFSTVFSENDPDQYPLVFAN

SEQ ID NO: 1148 - protein, 159 aa, Brassica napus
YTTHFFCVASFLWTTTIAFTLHRTVVKHKTDVEDLEAMFHLYVWGTSLVVTVIRSFGNNHSHLGPWCWTQTGLKGKAVHFLTFYAPLWGAILYNGFTYFQVIRMLRNARRMAVGMSDRVDQFDNRAELKVLNRWGYYPLILIGSWAFGTINRIHDFIEP

SEQ ID NO: 1149 - protein, 494 aa, Brassica napus
MGSASKEYEFLSEIGLSSSHNLGNYVGGKWLGNGPLVSTLNPANNQVLPIAQVVEASLEDYEIGLKACEEAAKTWMQVPAPKRGDIVRQIGDALRSKLDYLGRLLSLEMGKILAEGIGEVQEVIDMCDFAVGLSRQLNGSVIPSERPNHMMLEMWNPLGIVGVITAFNFPCAVLGWNACIALVCGNCVVWKGAPTTPLITIAMTKLVAEVLEKNHLPGAIFTAMCGGAEIGEAIAKDTRIPLVSFTGSSKVGLTVQQTVSARSGKTLLELSGNNAIIVMDDADIQLAARSVLFAAVGTAGQRCTTCRRLLLHESVYDKVLEQLLTSYKQVKIGDPLEKGTLLGPLHTPESKKNFEKGIEVIKSQGGKVLTGGKAVEGEGNFVEPTIIEISSDAAVVKEELFAPVLYALKFKTFEEAVAINNSVPQGLSSSIFTRSPDNIFKWIGPMGSDCGIVNVNIPTNGAEIGGAFGGEKATGGGREAGSDSWKQYMRRSTW

SEQ ID NO: 1150 - protein, 130 aa, Brassica napus
PSAYISAATLVIHLVLSWIAVYRLGFGLLALSLIHSLSWWIIVAAQIVYIKMSPKCRRTWEGFSWKAFEGLWDFFRLSAASAVMLCLESWYSQILVLLAGLLKNPELALDSLAICMSISAISFMVFRGIN

SEQ ID NO: 1151 - protein, 175 aa, Brassica napus
MAPSCSPINSLHVAVIGAGAAGLVAARELRRESHSVVVFERNTEVGGLWVYTPQSEPDPLSLDPNRTVVHSSVYDSLRTNLPRECMGYSDFPFVPRPEHDESRDPRRYPTHREVLAYLRDFAREFKLVEMVRFGTEVVLVEQDGRPSPPPTSPTHPPHHPPARLGRPPPPPPPPP

SEQ ID NO: 1152 - protein, 165 aa, Brassica napus
  misc_feature (23)..(23): Xaa can be any naturally occurring amino acid
  misc_feature (40)..(40): Xaa can be any naturally occurring amino acid
  misc_feature (83)..(83): Xaa can be any naturally occurring amino acid
MTVLSSADRDNAEKKVKSSYFDXLSVAISEAIPQSTSPSXSPPCTPYYYHFTDLVTAEGQAVRKRVGEYVDNEVTPLRNEYWXECRSVGFLTLSHTCFGALRFGGGSIKGYGCPGLSITANAIATAEISRVDASCGTFNLVHTSLGMLTKALGCLRDKSVGLETA

SEQ ID NO: 1153 - protein, 101 aa, Brassica napus
  misc_feature (6)..(6): Xaa can be any naturally occurring amino acid
  misc_feature (11)..(11): Xaa can be any naturally occurring amino acid
  misc_feature (21)..(21): Xaa can be any naturally occurring amino acid
  misc_feature (51)..(51): Xaa can be any naturally occurring amino acid
  misc_feature (58)..(58): Xaa can be any naturally occurring amino acid
  misc_feature (62)..(62): Xaa can be any naturally occurring amino acid
  misc_feature (75)..(75): Xaa can be any naturally occurring amino acid
  misc_feature (88)..(89): Xaa can be any naturally occurring amino acid
  misc_feature (92)..(92): Xaa can be any naturally occurring amino acid
  misc_feature (94)..(94): Xaa can be any naturally occurring amino acid
  misc_feature (96)..(96): Xaa can be any naturally occurring amino acid
  misc_feature (98)..(99): Xaa can be any naturally occurring amino acid
EKEEVXAYSMXSSATVVTSPXQATMVVPFTGLKSSSAFPVTRKANNDITSXVSNGGRXNCMXAWPPIGKKKFETXSYLPDLTEAELPXXVDXLXRXKXXPC

SEQ ID NO: 1154 - protein, 175 aa, Brassica napus
  misc_feature (89)..(89): Xaa can be any naturally occurring amino acid
  misc_feature (115)..(115): Xaa can be any naturally occurring amino acid
  misc_feature (151)..(151): Xaa can be any naturally occurring amino acid
RRVKKKKTKAKAGQREEAKSKGFAHEEGTQHHHHHQYGTFQRASNYPPPLPHNSPPVPGLPHPSVPPGVYDSAPPHYAHGCQTVPVHGXLREGRPVHVRQRRLPCCGIGLSGWVXLSYVGFFLGAIPWYVGMFIMIVGRRIDHREKPGYIXACTIAAILATIAVILGVTKGAEDW

SEQ ID NO: 1155 - protein, 151 aa, Brassica napus
  misc_feature (139)..(139): Xaa can be any naturally occurring amino acid
EALPESARSCDDGLYRAIDSYLKAHPTLSEHERKRLCRVMDCQKLSMDACMHAAQNERLPLRVVVQVLFSEQVKISNALANTSLKESTTLGEAMGTTYQPMIPNRKTLIEATPQSFQEGWAAAKKDINTLKFELETVKXKYVELQNEMEVM

SEQ ID NO: 1156 - protein, 137 aa, Brassica napus
MDPTTPLLSHGGKVEDYAPARTWSDVKRVLCTESAKLWLIAAPIGFNVICQYGVSSVTNIFVGHIGEVELSAVSISLSVIGTFSFGFLLGMGSALETLCGQAFGAGQVHMLGIYMQRSWIILFVSCLLLLPIYIFAT

SEQ ID NO: 1157 - protein, 328 aa, Brassica napus
  misc_feature (20)..(20): Xaa can be any naturally occurring amino acid
  misc_feature (50)..(50): Xaa can be any naturally occurring amino acid
MASRIANDVTELIGNTPLVXPNSVAEGCVGRVGAKLEMMEPCSSVKDRIXGFSMISDAEKKGLIKPGESVLIEPTSGNTGVGLAFTAAAKGGKATRARPASMSVERRIILLAFGVELVLTDPAKGMKGAIAKAEEILAKTPNGYMLQQFENPANPKIHYETTGPEIWKGTDGKIDGFVSGIGTGGTITGAGKYLKEQNPNVKLYGVEPIESAILSGGKPGPHKIQGIGAGFIPSVLEVDLIDEVVQVSSDESIDMARLLALKEGLLVGISSGAAAAAAIKLAKRPENAGKLFVAVFPSFGERYLSTVLFDATRKEAESMTFQACIVSP

SEQ ID NO: 1158 - protein, 136 aa, Brassica napus
MIGSFLTRGLVMVFGYAYPAYECYKAIEKNKPEIQQLRFWCQYWILVAALTIFERVGDTFASWVPLYCEAKLAFFIYLWFPKTRGTTYVYDSFFRPYVAKHENEIDRNLVELRTKAGDMTVLFCRKAVCYGQTRFT

SEQ ID NO: 1159 - protein, 202 aa, Brassica napus
  misc_feature (56)..(56): Xaa can be any naturally occurring amino acid
  misc_feature (90)..(90): Xaa can be any naturally occurring amino acid
  misc_feature (131)..(131): Xaa can be any naturally occurring amino acid
  misc_feature (192)..(192): Xaa can be any naturally occurring amino acid
EENKYSFLSFVSLHPSPFRVFFPDSQQPWYGGAEGPQQPHPFLAHKLFPLTHPVVXHIEKFQLKSEDVDSIKYDGVALLYEALTEFSVLXLDQSLLESMRANLEEELSMLDYKSADTEENLGELELRDCSXLIEILYFIQDLREKEKALEQSYTSMNGKAKALEQLKLTEGKSSLLLAKRWNLVFYTLQLAXFFYMDFALAP

SEQ ID NO: 1160 - protein, 190 aa, Brassica napus
  misc_feature (22)..(23): Xaa can be any naturally occurring amino acid
  misc_feature (66)..(66): Xaa can be any naturally occurring amino acid
QVPRRFSRVDPRVRFENPANPXXHYETTGPEIWKGTDGKIDGFVSGIGTGGTITGAGKYLKEQNPXNVKLYGVEPIESAILSGGKPGPHKIQGIGAGFIPSVLEVDLIDEVVQVSSDESIDMARLLARKEGLLVGISSGAAAAAAIKLAKRPENAGKLFVAVFPSFGERYLSTVLFDATRKEAESMTFEA

SEQ ID NO: 1161 - protein, 125 aa, Brassica napus
  misc_feature (87)..(87): Xaa can be any naturally occurring amino acid
  misc_feature (96)..(96): Xaa can be any naturally occurring amino acid
  misc_feature (99)..(99): Xaa can be any naturally occurring amino acid
MRVMRSYRGNSIAGLVSHPARLSPLRSIFTGCRAVMLPRFGGPEVLELRENVPVPNLNPNEVLVRARAVSINPLDCRIRAGYGRSVXQPHLPVVIXRDXWRPNSLIFPLAPPLFLCHPHLLPLSP

SEQ ID NO: 1162 - protein, 111 aa, Brassica napus
MSSSPLASSLFPSSLSTLSAHNHGRSRSFCVSRKEQCLRVRAAKLPEGMIVPKVQPKSQPAFLGFTQTAEIWNSRACMIGLIGTFIVKLILNKGILELIGVEIGKGLDLPL

SEQ ID NO: 1163 - protein, 76 aa, Brassica napus
  misc_feature (58)..(58): Xaa can be any naturally occurring amino acid
MAIRKEDESREEQSNSFLLDALYCEEEKWEDEEEEVEENSSFSSSSPTSPLVLLQQDXFWQDKIWSLSSKEEEQDS

SEQ ID NO: 1164 - protein, 144 aa, Brassica napus
  misc_feature (137)..(137): Xaa can be any naturally occurring amino acid
MDRLTSLPDELLYHILSLLPTKSAVVTSALSKRWLNLWKLNPNLDIDDSVFIHAEDGKGKREEIRQSFVGFVDRVLAMQGDSPINSFSLKCITGIHPDTVNRWICNVLKRGVSDLSLFTDFTCEDTEEDSYQLPREXFFSSTLG

SEQ ID NO: 1165 - protein, 83 aa, Brassica napus
MSVTKFIKCVTVGDGAVGKTCMLICYTSNKFPTDYIPTVFDNFSANVSVDGSIVNLGLWDTAGQEDYSRLRPLSYRGADVFVL

SEQ ID NO: 1166 - protein, 54 aa, Brassica napus
  misc_feature (8)..(9): Xaa can be any naturally occurring amino acid
  misc_feature (27)..(27): Xaa can be any naturally occurring amino acid
MRPPLTGXXGGGGFSGGRGGGGYGGGXGGSSGGRGRGGGRGFGDRGGRGGGRGM

SEQ ID NO: 1167 - protein, 145 aa, Brassica napus
MASYLRVSLSFIFSALLISPAVSQSCSSQTFSGDKSYPHCLALPNLKAFLHYSYDAANTTLAVVFSAPPSKPGGWIAWAINPKATGMAGSQALVALKDSKTGVASVTTLNIISYSSLVPGKLSFEVWDVKAEEEAAGTLRIFAKV

SEQ ID NO: 1168 - protein, 131 aa, Brassica napus
  misc_feature (32)..(32): Xaa can be any naturally occurring amino acid
ACSDSRRAIMSLFSFSLGLTILVIIISGLVFXFTRWNSKTKKRLNLPPGPPGWPVVGNLFQFARSGKQFFEYAEELKKTYGPIFTVRMGTRTMIILSDAALVHEALIQRGSLFATRPAENPTRTIFSCDKF

SEQ ID NO: 1169 - protein, 120 aa, Brassica napus
  misc_feature (40)..(40): Xaa can be any naturally occurring amino acid
MVASKMVAKEAIPLLTTHRMGRFELSHRVVLAPLTRCRSXANVPQPHAAVYYSQRATKGGLLIAEATGVSATAQGYAETPGIWTQQQVDAWKPIVDAVHRKGALFFCQLWHVGRVSTNDF

SEQ ID NO: 1170 - protein, 142 aa, Brassica napus
  misc_feature (120)..(120): Xaa can be any naturally occurring amino acid
SHGHSETTELRGKKHRKIYRFFCNLHSIQFTASKMVAKEAIPLLTPHKMGQFELSHRVVLAPLTRCRSYANVPQPHAAAYYSQRATKGGLLIAEATGVSATPQGYPETPGVWTQQQVDAXKPIVDAVHRKGALFFCQIWHVG

SEQ ID NO: 1171 - protein, 154 aa, Brassica napus
MASMTTPRLPFLPARTRSAVAATSSSSPSSPLPRRSIKCSSSTNANSAPLPSTSRQPRAPVADGVGSADLNGLRAPPIPVADSPLPAYRDPHGLPRPLTSADLMESSGEGLKVAYQGFPGAYSEAAAKKAYPNCQTVPCEHFDTAFQAVQYWIV

SEQ ID NO: 1172 - protein, 107 aa, Brassica napus
MSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRF

SEQ ID NO: 1173 - protein, 143 aa, Brassica napus
  misc_feature (33)..(33): Xaa can be any naturally occurring amino acid
MAAMMIVDFQNYFIFILLCLFSLLCYTLFFRKXKYSRLGFDDLPPSPPSLPIIGHLHIILSLLIHKSLQKLASKYGPLLHLRIFNFPIVLVSSASVAEEIFKTQDVNVSSRSLPTSEGSLYFGSSGFIFAPYGDYWKFMKKLI

SEQ ID NO: 1174 - protein, 100 aa, Brassica napus
MSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQ

SEQ ID NO: 1175 - protein, 152 aa, Brassica napus
MAMIGLLEVFVAFLFFLVFKHFFFHKKSPGQPILKSWPVLGMLPGMLPHIPRIFDWTFEVLEATNLTFFFKGPWFSGTDMLFTADPRNIHHILSLNFGNYPKGPEFKKIFDVLGDGILSADLELWEDLRKSNHAIFHHPDFLKLSASSNTIK

SEQ ID NO: 1176 - protein, 130 aa, Brassica napus
  misc_feature (117)..(117): Xaa can be any naturally occurring amino acid
MAVIPRSDPPPRIHPQPQPQPLEQTDHFDRLPDSVLLLVLNRIADVKSLGRCRAVSRRFHSLVPQVENVVVRVDCVISDEDNSSLSSIKPPSAASSSFSAVFSLVVGGIVKPLQALXQLLGTTSRSSSLS

SEQ ID NO: 1177 - protein, 140 aa, Brassica napus
  misc_feature (22)..(22): Xaa can be any naturally occurring amino acid
  misc_feature (46)..(46): Xaa can be any naturally occurring amino acid
KEMTLEEYEKILEEKKKALQAXKVEERKVDTKVFESMQQLSSKKTXNEEIFIKLGSDKDKRKDAAEKEEKAKKSLSINEFLKPADGERYNPRGGYRGRGGRGQRDGGGRNGGRGQRDEKVNGGAPAPAIGDSAQFPSLGK

SEQ ID NO: 1178 - protein, 217 aa, Brassica napus
MVLREVVMVVGLLVVRLTPVETDLMIQRMDQRMEKGTVGSADTAKEVVLAVTLAHLPRVKLGGLHAHAGPITPRGEDRAKEPEDKEMTLEEYEKILEEKKKALQATKVEERKVDTKVFESMQQLSSKKTNNEEIFIKLGSDKDKRKDAAEKEEKAKKSLSINEFLKPADGERYNPRGGGYRGRGGRNGGRGQRDEKVNEGAPAPAIGDSAQFPSLGK

SEQ ID NO: 1179 - protein, 112 aa, Brassica napus
KERYSGIIDYSSIILWVLESAELAAIALSATSAAAAVGAAVAGGVAADRGIGKDAPTAADSLGKDFYQVILQEEPFRSTTVGTILKSFRYAPFLPVSTESSMLSVLLLLSKY

SEQ ID NO: 1180 - protein, 386 aa, Brassica napus
MAKPVSIEVYNPNGKYRVVSTKPMPGTRWINLLVDQGCRVEICHLKKTILSVEDIINLIGNRCDGVIGQLTEDWGETLFSALSKAGGKAFSNMAVGYNNVDVEAANKYGIAVGNTPGVLTETTAELAASLSLAAARRIVEADGFMRAGLYEGWLPHLFVGNLLKGQTVGVIGAGRIGSAYARMMVEGFKMNLIYFDLYQSTRLEKFVTAYGQFLKANGEQPVTWKRASSMEEVLREADLISLHPVLDKTTYHLVNKERLAMMKKEAILVNCSRGPVIDEVALVNHLRENPMFRVGLDVFEEEPFMKPGLADMKNAIVVPHIASASKWTREGMATLAALNVVGKIKGYPIWSDPNRVDPFLNENASPPNASPSIVNSKALGLPVSKL

SEQ ID NO: 1181 - protein, 92 aa, Brassica napus
TDKYGGSLENRCRFALEVVQAVADEIGADKVGIRLSPFASYSDASDSNPEALGLYMAQALNKLGILYCHMVEPRMVNIGEKLETPHSLRAMR

SEQ ID NO: 1182 - protein, 88 aa, Brassica napus
MGNETKGNGASSLGGGGGFRAKMEHYVYSGEKKHVLAGIGIFTVIFGIPWYLMNRGSNNHRSHQDYMEKADKARKARLSSSPSPSSDK

SEQ ID NO: 1183 - protein, 82 aa, Brassica napus
MSASRFIKCVTVGDGAVGKTCLLISYTSNTYPTDYVPTVFDNFSANVVVNGATVNLGLWDTAGQEDYNRLRPLSYRGADVSS

SEQ ID NO: 1184 - protein, 134 aa, Brassica napus
  misc_feature (112)..(112): Xaa can be any naturally occurring amino acid
MRKLRGIKIRRPIQRISRWILRRIRLRRSRYIRLGPTQPVCKPKAITKLISWGRSLTSHSARFLGSKISNSGYAPIGNDPIQSKPDPVPKGHSAVYVGKKDGDFHRVLVPIXYFNHPLFGELLREAEEEFGFCQ

SEQ ID NO: 1185 - protein, 115 aa, Brassica napus
MEHVIGGKFKLSRKIGSGSFGEIYIGSNVQTGEEVAVKLEPVKTKHPQLHYESKVYMLLQGGSGIPHLKWYGVEGDYNCMAIDLLGPSLEDLFNYCTRSFSLKTVLMLADQLINR

SEQ ID NO: 1186 - protein, 140 aa, Brassica napus
APGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIDSTLPAEAVFAAEVEKLKADQFKPAEQV

SEQ ID NO: 1187 - protein, 161 aa, Brassica napus
  misc_feature (108)..(108): Xaa can be any naturally occurring amino acid
MAEACGVRRMKLGRQGLEGSAQGLGCMGLSAFYGAPTPETNAVALLQHAIKAGVTFLDTSDIYGPETNELLLGKALKDGLREKVELATKFGIIASEDGKFGFRADPEXYVRSACEASLRRLGVSSIDLYYQHRVDTTVPPEVTMGESPTPLHHSHTLPTFP

SEQ ID NO: 1188 - protein, 98 aa, Brassica napus
MAYVRSLLGAKKILGRSVTAAAPTSNRAASAAPKGFLAVYVGEMQKKRYVVPISYLSQPSFQALLSKSEEEFGFDHPMGGLTIPCPEDTFIAVTSRLQ

SEQ ID NO: 1189 - protein, 169 aa, Brassica napus
MMAPPGKKRKGEKAKNGAPPLDPEAIDCEWWDTFFLRNSSLSGVRVPLDEDDAFKYFFRASKTTFSYICSLVREDLISRPPSGLINIEGRLLSVEKQVAIALRRLASGDSQVSVGAAFGVGQSTVSQVTWRFIEALEERAKHHLRWTLIAYHCIYTTIVLTCHLLLIPL

SEQ ID NO: 1190 - protein, 127 aa, Brassica napus
  misc_feature (6)..(6): Xaa can be any naturally occurring amino acid
  misc_feature (110)..(110): Xaa can be any naturally occurring amino acid
  misc_feature (118)..(118): Xaa can be any naturally occurring amino acid
  misc_feature (126)..(126): Xaa can be any naturally occurring amino acid
MAGVSXASPAAAQIGSFLSKKPYAPPSWASHLALAPSHTFSFGHFPTPIHKWNLPNLPEGTEVWIKRDDLSGMQLSGNKVRKLEFLLADAVAQGADCVITVGGIQSNHCXATAVAAKXLNLDCYLXL

SEQ ID NO: 1191 - protein, 113 aa, Brassica napus
PLFSPCPYLGQEYIRRADGIWDAGEKKLGKVIVPDKWKEGASNTNESGGRKINENKLLSKKNRSALPSGLSLPFLAAAVCRAFSPVSRPVAAVDEKRGVRLQQTRLAASSRGR

SEQ ID NO: 1192 - protein, 530 aa, Brassica napus
MGDSTGEPGSSMHGVTGREQTFAFSVASPIVPTDKTAKFDLPVDSEHKATVFKLFSFAKPHMRTFHLSWISFSTCFVSTFAAAPLVPIIRENLNLTKQDIGNAGVASVSGSIFSRLVMGAVCDLLGPRYGCAFLVMLSAPTVFSMSFVSGAAGFITVRFMIGFCLATFVSCQYGMSTMFNSQIIGLVNGTAAGWGNMGGGITQLLMPVVYEIIRRCGATAFTAWRLAFFVPGWLHIIMGVLVLNLGQDLPDGNRSALEKKGEVAKDKFGKIMWYAVTNYRTWIFVLLYGYSMGVELSTDNVIAEYFFDRFHLKLHTAGIIAACFGMANFFARPAGGYASDLAAKYFGMRGRLWALWIIQTAGGVFCVWLGRANTLVTAVVAMVLFSLGAQAACGATFAIVPFVSRRALGIISGLTGAGGNFGSGLTQLIFFSTSRFTTEQGLTWMGVMIVACTLPVTLIHFPQWGSMFLPPSTDPVKGPKEHYYASEWNEQEKEKNMHQGSLRFAKNAKSEGGRRVRSAATPPENTPNNV

SEQ ID NO: 1193 - protein, 128 aa, Brassica napus
  misc_feature (86)..(86): Xaa can be any naturally occurring amino acid
  misc_feature (114)..(114): Xaa can be any naturally occurring amino acid
  misc_feature (123)..(123): Xaa can be any naturally occurring amino acid
MAPIQRTFSDISHQISTDNTLTKEPTPTASATTTTLLALAAISEVEDAKRECCGMSEECTPEYISRVRSKFSGKLICGLWSEAVEXEMEKMNNSESVVEKRREEAVKAHMSACXRGFNRLGPXVYPAL

SEQ ID NO: 1194 - protein, 99 aa, Brassica napus
  misc_feature (5)..(5): Xaa can be any naturally occurring amino acid
  misc_feature (24)..(24): Xaa can be any naturally occurring amino acid
  misc_feature (44)..(44): Xaa can be any naturally occurring amino acid
  misc_feature (50)..(50): Xaa can be any naturally occurring amino acid
MAMIXGFLDIFIAIIFFLVFRCLXLYKQTHKPLPTNWSVLGMLXGLLLQXHRIYDWITELLEATGMTFCFKGPWLSGTDILLTVDPVNIHYILSSNFVN

SEQ ID NO: 1195 - protein, 134 aa, Brassica napus
  misc_feature (6)..(6): Xaa can be any naturally occurring amino acid
  misc_feature (133)..(133): Xaa can be any naturally occurring amino acid
MEAQHXNAKPQAEGEWSTGFCDCFSDCKNCCITCWCPGITFGQVAEIVDQGSTTCGTAGALYTLISCFTGCGCIYSCFYRGKMRAQYNIGGNDCGDCLKHFFCELCALTQQYRELKNRGFNMDLGWAGNVQRXQ

SEQ ID NO: 1196 - protein, 219 aa, Brassica napus
  misc_feature (169)..(169): Xaa can be any naturally occurring amino acid
MHCSRHNNMSLLWITGLCVTALVVVRISNWWYRWSNPKSNGKLPPGSMGFPIIGETFDFFKPHRFYEISPFLKKKMLRYGPLFRTSILGVNTVISTDMDVNLDILRHENEYFNLSYPDGLVKPLGKESMFLKTGNIHKHIKKICMRLLGSENLKRKIIKDMDHVTCEHXSLKVGQGRFDLRDLASSVFFLSFFICLLSSTNINWLLSNLVKILINNLSL

SEQ ID NO: 1197 - protein, 149 aa, Brassica napus
MYSLILRGRRRLQKCRLSLNVTSFSSAARKGQNFTVSYLVDSLGFTPKLAESISKKVSFNNKCNPDSVLNLLRTHGFTDSQISTIITDYPLLLTLDADKSLAPKLQALQSKVSSPSELTETISKVPKILSKDRSLSVYSVSPPPPHPPL

SEQ ID NO: 1198 - protein, 129 aa, Brassica napus
  misc_feature (32)..(32): Xaa can be any naturally occurring amino acid
RTSGEYLTHNGVSTFACSETVKFGSGYFNEKXEQYVEIPSDSGISFNVKPKMKALEIAEKARDAILSGKFDQVRVNLPNSDMVGHTGDIDATVVACEAADVAVKMILDAIEQVKGIYVVTADHGNAEDM

SEQ ID NO: 1199 - protein, 151 aa, Brassica napus
FVIVDDAGKAVGPIVDGDAVVTFNFRADRMVMHAKALDYEDFDKFDRVRFPKIRYAGMLEYDGELKLPSRYLVSPPEIDRTSGEYLTHNGVSTFACSETVKFGHVTFFWNGNRSGYFNEKLEQYVEIPSDSGISFNVKPKMKALEIAEKAR

SEQ ID NO: 1200 - protein, 201 aa, Brassica napus
STHASAEVFMREKVRKGKMPDQTNDLGDVGLKYISTKASPICSKKHYRIYMINSLPKLKVLDNLAIRKSDRDRATETYSENFEHLPYKRKSKESVVRVLEKRETRSSKWKSQSSYTRSLCAARMGSSAWPLLHSIPSFSRVQDEGRSLSPRQFEYHPLDPSLMVYGTLDGEVVVLNHESGKILRYIPSHGAQSSILGLCWL

SEQ ID NO: 1201 - protein, 155 aa, Brassica napus
MKKRTIYSWGAAIVIFVVLMIVTPTIPQSQAYHDFADQRTFFGIPNALNVISNFPFLIIGLIGLVLCFYPDDYFRFSLRGEKLGWTCFFVGVAAVAFGSSYYHLHPDDARLVWDRLPMTIAFTSIMAIFVIERIDEHKGTYSIVPLLLVGLVSIL

SEQ ID NO: 1202 - protein, 168 aa, Brassica napus
  misc_feature (165)..(165): Xaa can be any naturally occurring amino acid
TYPFSSSKREMNGGGKVVCVTGASGYIASWIVKLLLLRGYTVRATVRNPTDTAKTEHLLALEGAKERLKLFKADLLEECSFEQAIEGCDAVFHTASPVKYIVTDPQTELIDPAVKGTLNVLNTCKKTSSVKRVILTSSTAAVLVRPLEPKDVVDETFFSDPSVCXELK

SEQ ID NO: 1203 - protein, 95 aa, Brassica napus
MPRFDDRYGNTRLYVGRLSSRTRTRDLERLFSRYGRVRDVDMKRDYAFVEFSDPRDADDARHYLDGRDFDGSRITVEASRGAPRGSRDARDNGSR

SEQ ID NO: 1204 - protein, 79 aa, Brassica napus
MPRFDDRYGNTRLYVGRLSSRTRSRDLERLFSRYGRVRDVDMKRDYAFVEFSDPRDADDARYYLDGRDFDGSRITVEAS

SEQ ID NO: 1205 - protein, 119 aa, Brassica napus
  misc_feature (12)..(12): Xaa can be any naturally occurring amino acid
  misc_feature (72)..(72): Xaa can be any naturally occurring amino acid
  misc_feature (96)..(96): Xaa can be any naturally occurring amino acid
  misc_feature (99)..(99): Xaa can be any naturally occurring amino acid
  misc_feature (109)..(109): Xaa can be any naturally occurring amino acid
MTSFEDGFPAEXLFSQGYSYTYDDVIFLPHYIDFSTDAVSLSTRLSRRVPLSIPCVSSPMDTVSESHMAAAXASLGGIGIVHYNSDIAAQASVIRXAKXLRHPIASDAXVKLPEYEITS

SEQ ID NO: 1206 - protein, 166 aa, Brassica napus
  misc_feature (57)..(57): Xaa can be any naturally occurring amino acid
  misc_feature (114)..(114): Xaa can be any naturally occurring amino acid
  misc_feature (134)..(134): Xaa can be any naturally occurring amino acid
FLGKGGFGSVSLMRDSKYRLYAEKSSSMDFIKSLEKEHRLMLRFRNHPRIYSPNHEXNLHIGFNLDRCYINMEFASKGTLHNVISQFRGGPMPESLVGRAALMILQGLEALHSXGYVHCDFKPANVLLFPSKTXGEPWDLKLADFGLSKEPGTDSRSSLSGGTPQY

SEQ ID NO: 1207 - protein, 175 aa, Brassica napus
  misc_feature (106)..(106): Xaa can be any naturally occurring amino acid
  misc_feature (159)..(159): Xaa can be any naturally occurring amino acid
VFLPFRHSLPYLIPPQLSSTIHFALVAVSYNALAQSLQARSNCFVPKDLCIKQRSSRCRTSVVVFAASDDNNIALQAKVDKLLDGIKWDDKGLAVVIAQSVDTGAXLMQGFANRDALSTTITSRKATFFSRSRSALWTKGETSNNFINVLDVYLDCDRXSIIYLGTPDGPTCHTG

SEQ ID NO: 1208 - protein, 122 aa, Brassica napus
  misc_feature (69)..(69): Xaa can be any naturally occurring amino acid
MAANIGIMDSAYFVGRTEILAWINSTLHLNLSKVEEACSGAVHCQLMDSVHPGTVPMHKVNFDAKSEYXMIQNYKVLQDVFNKLKLTKHIEVSKLVKGRPLDNLEFMQWMKKYCDSINGGQL

SEQ ID NO: 1209 - protein, 202 aa, Brassica napus
  misc_feature (102)..(102): Xaa can be any naturally occurring amino acid
MNPEYDYLFMLLLIGVSVFGKSCLLLSFADDSYLDSYISTIGVDFKIRTVEQDGKTIKLKIWDTAGQERFRTNTSRYYRGTHRINGTYDVTHQDSFNKVKKXLKEIERDSSENVNKLLVGNKNDLTSQKVVSTETAKAFADELGIPFLETSAKNATNVEEAFMAMTAAIKTRMASQPSGGSKPATVQIRGQPVNQQSGCCSS

SEQ ID NO: 1210 - protein, 407 aa, Brassica napus
  misc_feature (124)..(124): Xaa can be any naturally occurring amino acid
  misc_feature (371)..(371): Xaa can be any naturally occurring amino acid
MARKMLADGELDNAAAAEEATEAHYDFDLFVIGAGSGGVRAARFSANNGAKVGICELPFHPISSEEIGGVGGTCVIRGCVPKKILVYGATYGGELEDARNYGWEINENVDFTWKKLLQKKTDEXILRLNNIYKRLLANAAVKLYEGEGRIVGPNEVEVRQIDGTKISYTAKHILIATGSRAQKPNIPGHELAITSDEALSLEEFPKRAVVLGGGYIAVEFASIWRGMGGTVDLFFRKELPLRGFDDEMRALVARNLEGRGVNLHPQSGLTQLTKTDEGIKVTSSHGEEFMADVVLFATGRNPNTKRLNLEAVGVELDQAGAVKVDEYSRTNIPSIWAVGNATNRLNLTPVALMEATCFANTVFGGNPTKAXYTNVACAVFCIPPLAVVGLIEEDAVEKATGDILVFT

SEQ ID NO: 1211 - protein, 259 aa, Brassica napus
  misc_feature (14)..(14): Xaa can be any naturally occurring amino acid
  misc_feature (136)..(136): Xaa can be any naturally occurring amino acid
LKGRPASDGVGSKXMVILPYKDSLLRTSRYLQQLKCDVTGKEFDLDGNTVMSSVVVYGNKGSTDQHAYIQQLREGVPNFFATFIEVLRDRPPGHDWELEPGVTCGDYLFGMLQGTRSALYANGRESISVTIEESDXPRSVGAIIALYERAVGLYASLVNINAYHQPGVEAGKKAAAEVLALQKRVLSVLNEASCKDPVEPLTLDEIADRCHAPEEIEMIYKIIAHMSANDRVLIAEGSCGSPRSVKVYLGECNVDDMYA

SEQ ID NO: 1212 - protein, 116 aa, Brassica napus
  misc_feature (111)..(111): Xaa can be any naturally occurring amino acid
MGSSEKRSKDVVMNDIPTFSAENFQKNLKVIQNSRTFLSIIAGVLAGIIGFTGLTGFVFYTVVMLITSLGLMAKAGFSADVYFDSWNRVLFDGFLGGLMSFVLFWTFAYDXLVHIF

SEQ ID NO: 1213 - protein, 195 aa, Brassica napus
  misc_feature (59)..(59): Xaa can be any naturally occurring amino acid
  misc_feature (88)..(88): Xaa can be any naturally occurring amino acid
  misc_feature (100)..(100): Xaa can be any naturally occurring amino acid
  misc_feature (123)..(123): Xaa can be any naturally occurring amino acid
CVFWAKSRKCRGSGKKGAKGALKAWRTIDWQGMGKVLVTDEGRIGFSNLPRAFDEVNTXLPPKSSQEPDPSHREFNRKGIGTGIVDLXMEAYDSVEMPKXVENVTPEYKPNFDALSVEQKEAXKKSLKECERLEKEISEIQEISKKLSTMTADGFIKKLSTMTADEYFEKHQNSEAYPGLHTKFDDEIRNDYWGY

SEQ ID NO: 1214 - protein, 97 aa, Brassica napus
  misc_feature (20)..(20): Xaa can be any naturally occurring amino acid
  misc_feature (62)..(62): Xaa can be any naturally occurring amino acid
  misc_feature (87)..(87): Xaa can be any naturally occurring amino acid
REVSKRNVSFEDKGNPDSVXSHGFTDSQISTIVTDYPLLLIEDADKSLGPKLQFLQSRGAYXPISKVPRILGTPGDKIISSYYDFVXEVIEADKKSS

SEQ ID NO: 1215 - protein, 224 aa, Brassica napus
RTNVNLPGVGDDLPTLTDKDIEDIMGWGVPNRIDMIALSFVRKGSDLVNVRRVLGSHAKSIMLMSKVENQEGVVNFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKEMIRATPLPMSPLESLASSAVRTANKAHAKLI

SEQ ID NO: 1216 - protein, 235 aa, Brassica napus
  misc_feature (188)..(188): Xaa can be any naturally occurring amino acid
  misc_feature (191)..(191): Xaa can be any naturally occurring amino acid
  misc_feature (193)..(193): Xaa can be any naturally occurring amino acid
MQLLLRRPLSPSVVSSFFLRRSMSSKSTSTDPINPSNTRIGWIGTGVMGRSMCGHLIKAGYSVTVFNRTVSKAQTLVDMGANLADSPNSLASQSDVVFSIVGYPSDVRRVLLDPSSGALSGLSRGGILVDMTTSEPSLAEEISKAASSVNCISVDAPVSGGDLGAKNGKLSIFAGGDEATVKRLDPLXSFXWXKVNFMGASGKGQFAKLANQVTIASTMVGLVEGIVYAHKAGSM

SEQ ID NO: 1217 - protein, 90 aa, Brassica napus
MDSDSWSDRLASASRRYQLDFLSRSDNFLGFEEAEGEEEFREEYACPFCSDYFDIVSLCCHIDENHPMDTINGVCPVCAVKVSSDMVAHI

SEQ ID NO: 1218 - protein, 240 aa, Brassica napus
  misc_feature (161)..(161): Xaa can be any naturally occurring amino acid
  misc_feature (171)..(171): Xaa can be any naturally occurring amino acid
  misc_feature (184)..(184): Xaa can be any naturally occurring amino acid
  misc_feature (203)..(203): Xaa can be any naturally occurring amino acid
  misc_feature (219)..(219): Xaa can be any naturally occurring amino acid
  misc_feature (228)..(228): Xaa can be any naturally occurring amino acid
MAFRPYGFTISSSLRNASAANGRLFSFLSTSPSSSNLLSSLRGFASSASLYRQHLRHQQQQQSRAKGLDKPETMAQKIGKSIRRAGAPSKARVYADVNVVRPKEYWDYESLAVQWGVQDDYEVVRKVGRGKYSEVFEGIHATDDEKCVIKILKPVKKKKIXKREIKILQNXCGGPSIGKLLDIXVEDQQSKTPSLIFEHGNNXGISKGLYPTLLRLWRXDIISYELLXGGWNFCHSRGNH

SEQ ID NO: 1219 - protein, 137 aa, Brassica napus
MSSKRLNLGSKDFISSLPDCLICHILSFVSTKEAASTSVLAKRWRYLFALTPNLEFNDSIYLNSEIANQRKSTFPWITRKKSKTPRSFVDFVDRVLVLHQNVPLNRFSLKCEDVVHPAIIISWLLKVMDRGVLDLDL

SEQ ID NO: 1220 - protein, 115 aa, Brassica napus
  misc_feature (111)..(111): Xaa can be any naturally occurring amino acid
MAMIEQKPKTKIVCTLGPASRSVEMVEKLLKAGMNVARFNFSHGSHEYHQETLDNLRQAMLNTGILCAVMLDTKGPEIRTGFLKDGKPIQLKQGQEITISTDYDLQGDENXICMS

SEQ ID NO: 1221 - protein, 113 aa, Brassica napus
MPALAKPASRTAKPAAAPKPKPAAAKPKAATAGASHPPYFEMIKEAITALKERTGSSSQAIAKYVGDKHGASLPANFKKMLSIQLRGSAAKGKLVKVKASYKLSDAAKKASPK

SEQ ID NO: 1222 - protein, 115 aa, Brassica napus
  misc_feature (114)..(114): Xaa can be any naturally occurring amino acid
MSAINITNVTALDNPAPFVSPFQFEISYECLTSLKDDLEWKLIYVGSAEDETYDQTLESVLVGPVNVGNYRFVLQADPPDPSKIREEDIIGVTVLLLTCSYMGQEFLRVGYYVXN

SEQ ID NO: 1223 - protein, 98 aa, Brassica napus
FRPNLCVRISRETVTAMAAAGGVSTDDVPILQAENLTSNVKSVYYSRTFLSIIGGVVAGIWGFTGLMGFVFYFLIMMVASIGLLAKSKFSVQAYFDSW

SEQ ID NO: 1224 - protein, 197 aa, Brassica napus
MAKGRGSDEGFREIFKREMGFSHPRSISRRISASEFQGIVKKLDVYGKLNGHEGCVNAVEFSSTGDILVSGSDDLQIMLWNLLNGSRTLTYPSGHCENVFQTKFIPFTDDRTIITSGADGQVRLGQILENGKVETKRLGRHRGRVYKLAVLPGDPNVFYSCGEDGFVQHVVLSHFLYGILISQSQVLNLSLFLHRTV

SEQ ID NO: 1225 - protein, 68 aa, Brassica napus
MYSLILRGRRLIEFQKWSHLRFASPNVLSCLSNSFSSASPADGRKRNNFTVAYLVDSLGFTTKLAESI

SEQ ID NO: 1226 - protein, 79 aa, Brassica napus
  misc_feature (40)..(40): Xaa can be any naturally occurring amino acid
MADFDEYMADEYDMDDLEDEMNAEFDARDIDASDSEVEDXEQLNKAADTSAAQARNGKDIQGIPWDRLSVTRKDYRKTR

SEQ ID NO: 1227 - protein, 155 aa, Brassica napus
MAEKLAPEKLHDFVHNGQKVFEWDQTLEEVNLYITLPPNVHSKAFHCKIQSKHLEVGIKGNPPYLNHDLSAPVKTDCSFWTLEDDIMHITLQKREKGQTWASPILGQGQLDPYATDLEQKRLMLQRFQEENPGFDFSQAQFTGICPDPSSVFGGI

SEQ ID NO: 1228 - protein, 88 aa, Brassica napus
  misc_feature (37)..(37): Xaa can be any naturally occurring amino acid
  misc_feature (50)..(50): Xaa can be any naturally occurring amino acid
  misc_feature (52)..(52): Xaa can be any naturally occurring amino acid
  misc_feature (55)..(55): Xaa can be any naturally occurring amino acid
  misc_feature (61)..(61): Xaa can be any naturally occurring amino acid
  misc_feature (63)..(64): Xaa can be any naturally occurring amino acid
  misc_feature (71)..(71): Xaa can be any naturally occurring amino acid
  misc_feature (75)..(75): Xaa can be any naturally occurring amino acid
  misc_feature (78)..(78): Xaa can be any naturally occurring amino acid
  misc_feature (80)..(80): Xaa can be any naturally occurring amino acid
  misc_feature (82)..(82): Xaa can be any naturally occurring amino acid
MATSGNGITTGTGSPCGACKFLRRKCASDCIFAPYFXSEQGAARFAAIHXVXFGXSNASKXLXXVPIHDRXEAVXTIXYXAXARLHDT

SEQ ID NO: 1229 - protein, 136 aa, Brassica napus
MAPAQNLVSSKHVAVIGAGASGLIAARELHREGHTVVVFEREKQVGGLWIYSPKSESDPLGLDPTRPIVHSSVYESLRTNLPRECMGFRDFPFVPCVDDFSRDSRRYPSHREVLAYLQDFAREFKIEEMVRFETEV

SEQ ID NO: 1230 - protein, 141 aa, Brassica napus
MTKDFAVPPVIFPGANSIQQRRFPPSPFQPPPPRPSSSAIPFMSFDIGSADPAGPFNNRGGSSSFEDEEPLLDELGIHPEQIWSKTRSILNPFRINQTVHRDSDLSGPIFLYLALCLFQLLAGKIQFGWVPRWDAVSPSDL

SEQ ID NO: 1231 - protein, 164 aa, Brassica napus
RLLRIELPAGELGIDDGVLLKWRAEFGSTLENCVILGASSVATDPPPSDGDSAAAAVEDNGSIPESFYTNGGLKLRVVWTISSLIAASARHYLLQPIIAEHKTLDSLVLTDTDGQGVLCMNRDQLEELRVKPLSASSASKRTLVPALNMRLWYAPSLELPDGTV

SEQ ID NO: 1232 - protein, 64 aa, Brassica napus
  misc_feature (25)..(25): Xaa can be any naturally occurring amino acid
  misc_feature (27)..(28): Xaa can be any naturally occurring amino acid
  misc_feature (36)..(36): Xaa can be any naturally occurring amino acid
  misc_feature (44)..(44): Xaa can be any naturally occurring amino acid
  misc_feature (61)..(63): Xaa can be any naturally occurring amino acid
MLVYQDLLTGDELLSDSFPYKEIEXGXXWEVEGKWXTVGAVEVXIGANPSAEEGGEDEGVXXXT

SEQ ID NO: 1233 - protein, 68 aa, Brassica napus
  misc_feature (9)..(9): Xaa can be any naturally occurring amino acid
  misc_feature (37)..(37): Xaa can be any naturally occurring amino acid
  misc_feature (49)..(49): Xaa can be any naturally occurring amino acid
  misc_feature (52)..(52): Xaa can be any naturally occurring amino acid
  misc_feature (56)..(56): Xaa can be any naturally occurring amino acid
  misc_feature (61)..(63): Xaa can be any naturally occurring amino acid
  misc_feature (65)..(67): Xaa can be any naturally occurring amino acid
MAYSMLSSXAVVTSPAQATMVAPFTGLKSSSAFPVTXARPNNDITSIVXNGXKRLXACRWXXXNXXXN

SEQ ID NO: 1234 - protein, 150 aa, Brassica napus
VYVIDFGLAKKYRDLQTHRHIPYRENKNLTGTARYASVNTHLGVEQSRRDDLESLGYVLMYFLRGSLPWQGLKAGTKKQKYDRISEKKVSTPIEVLCKSYPQEFVSYFQYCRSLRFEDKPDYSYLKRLFRDLFIREGYQFDYVFDWTALK

SEQ ID NO: 1235 - protein, 132 aa, Brassica napus
PRVSENGVAPDRALDPAVLSRLKQFSAMNKLKKMALKVIAESLSEEEIAGLREMFQAMDTDNSGAITFDELKAGLRKYGSTLKDTEIHDLMEAADVDNSGTIDYSEFIAATIHLNKLEREEHLVAAFQYFDK

SEQ ID NO: 1236 - protein, 153 aa, Brassica napus
  misc_feature (130)..(130): Xaa can be any naturally occurring amino acid
  misc_feature (142)..(143): Xaa can be any naturally occurring amino acid
  misc_feature (148)..(148): Xaa can be any naturally occurring amino acid
  misc_feature (151)..(151): Xaa can be any naturally occurring amino acid
MQSKIVGGGLPPAFSLFPSLNKTFTFHQILVLIITFLAYASFHASRKPPSIVKSVLGPSVNEQSNSPIDNGWAPFNGTEGTQRLGELDLAFLSSYALGMYFAGHLGDRIDLRLFLVFGMMGSGILTVVFXGLGYWMNVHLLXXFYMTXQIXWG

SEQ ID NO: 1237 - protein, 254 aa, Brassica napus
FIFSLFQVFEPALQDCARIRINSAKPRWKIETMPTPRVMSDTVILPNGDILLVNGGKRGCSGWGYGKDPNFAPTLYKPRAARGKRFRELAATNIPRMYHSVAIAIPDGKVLVAGSNTNDGYKYNVEFPTELRVEKFSPPYLDPALATLRPKIATSPKQIRYGQNFNVKVNLNQKDVTKQSLKLTMLAPSFTTHSISMNMRMLLLGVGGVNPAGGASFEIQTVAPPSGNVAPPGYYLLFAVYKGVPSTGEWIQIV

SEQ ID NO: 1238 - protein, 197 aa, Brassica napus
MSASRFVKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIILVGSKLDLRDDKQFFVDHPGAVPITTAQGEELRKLIDAPTYIECSSKSQENVKAVFDAAIRVVLQPPKQKKKKSKAQKACSIQ

SEQ ID NO: 1239 - protein, 129 aa, Brassica napus
MIGVDRRTTGLTQAHAAGLRRLSARAAAPSTPTVRNSLLPFSTFPDEIITRIKNSGVQIQPGLSDSEFARVEAEFGFVFLPDLRVILSFGLSVDAGFPDWRSPGARRHLRAMIDLPNAAVSLQVAKNSL

SEQ ID NO: 1240 - protein, 105 aa, Brassica napus
  misc_feature (61)..(61): Xaa can be any naturally occurring amino acid
MQDNKLAMQEFMILPIGASAFKEAMKMGVEVYHNLKSVIKKKYGQDATNVGDEGGFAPNIXENKEGLDLLKTAIEKAGYTVKVVIGMDDASFVVYSSDKTYDLNF

SEQ ID NO: 1241 - protein, 248 aa, Brassica napus
  misc_feature (13)..(13): Xaa can be any naturally occurring amino acid
  misc_feature (18)..(18): Xaa can be any naturally occurring amino acid
  misc_feature (23)..(23): Xaa can be any naturally occurring amino acid
  misc_feature (26)..(27): Xaa can be any naturally occurring amino acid
  misc_feature (57)..(57): Xaa can be any naturally occurring amino acid
  misc_feature (142)..(142): Xaa can be any naturally occurring amino acid
  misc_feature (234)..(234): Xaa can be any naturally occurring amino acid
IVTMCTIGYGDIXPLTPXTKILXVVXXLFGFGFLDILLSGVVQYVLDLQESMILTGXQMGSSRGSHRFSAKDYIIDFEKGRMRIRMKVFLALCVVVLCVGVGALVLHFVEGLDLVDSVYLSVMSVTTVGYGDRAFKTLEGRXFAAAWLLVSTLAVARAFIYLAEARIDRRHRRAVKFALNREITVEDLLAADTYQHGFISKSEYIVLKLKEMGKVSDKDINQVVNQFDKLDPNXLGKITLPDLLGGPL

SEQ ID NO: 1242 - protein, 254 aa, Brassica napus
LAVSARSRLHFVLEYAPHGSLASLLFGSSEEECLDWKKRYRVALGVADGLSYLHNDCPRRIIHRDIKASNILLSQDYEAQISDFGLAKWLPENWPHHIVFPIEGTFGYLAPEYFMHGIVDEKTDVFAFGVLLLEIITGRRAVDTASRQSIVMWAKPLLEKSSVEEIVDPKLGNEFDETEMKRVMQTASMCIHHVAAMRPDMNRLVQLLRGGGDDRLAETQQISRRKSLDGCDLQDHTSSSYLNDLTRHRQLLME

SEQ ID NO: 1243 - protein, 55 aa, Brassica napus
PRIRTSSRSRAAARDLQLVGEGMHDDSTIVFAYYNEGATNPTFLYFAHGLNEVKC

SEQ ID NO: 1244 - protein, 441 aa, Brassica napus
DYLNSLEKVFVNDQFLNWDPENRIKVRIVSARAYHSLFMHNMCIRPTPEELESFGTPDFTIYNAGHLSVNRYTHYMTSSTSVDLNLSRREMVILGTQYAGEMKKGLFSVMHYLMPKRRILSLHSGCNMGKEGDVALFFGLSGTGKTTLSTDHNRYLIGDDEHCWTETGVSNIEGGCYAKCVDLSREKEPDIWNAIKFGTVWENVVFDEHTREVDYSDKSVTENTRAAYPIEFIPNAKIPCIGPHPKNVILLACDAFGVLPPVSKLNLVQTMYHFISGYTALVAGTEDGIKEPTATFSACFGAAFIMLHPTKYAAMLAEKMKTQGATGWLVNTGWSGGSYGVGNRIKLAYTRKIIDAIHSGTLLKANYKKTEIFGFEIPTEIEGIPSEILDPINSWSDKKAHKETLLKLGGLFKKNFETFANHKIGVDGKLTEEILAAGPIF

SEQ ID NO: 1245 - protein, 97 aa, Brassica napus
RTVIVHLQEKVEPCYNLILQLPIDHMGLQIETQSCRKRKNRDSSSSLSSPSCVIDSNPFNSNESSNDSWSASSSPPQQQQEPPLKKTKMEKPILHLS

SEQ ID NO: 1246 - protein, 107 aa, Brassica napus
MTLTIPSAPGSSGYLDMYPERRMSYFGNSYILGLTVTAGIGGLLFGYDTGVISGALLYIKDDFDVVKQSSFLQETIVSMALVGAMLGAAAGGWINDYYGRKKSHHVC

SEQ ID NO: 1247 - protein, 280 aa, Brassica napus
  misc_feature (95)..(95): Xaa can be any naturally occurring amino acid
  misc_feature (139)..(139): Xaa can be any naturally occurring amino acid
  misc_feature (161)..(161): Xaa can be any naturally occurring amino acid
MAIAFKSGVCFLHSPKPQVGIRHSSPDSSLSFKRLAPIAALSTSSPTLGLADTFKELKKQGKVAFIPYITAGDPDLSTTTSSPTLLLACVLVRLXGSDIIELGVPYSDPLADGPVIQAAATRSLEKGTNLDSILDVQDXLLFRVVPLEETEFLRKEALNTXIELVLLTTPTTPTERMKRIVDASEGFISLVSSIGVTGARASVSGKVQSLLKDIKEAPAKPVAVGFGISKPEHVKQIAGWGADGVIVGSAMVRLLGDVKSPTEGLKELESLPKSLKSAFF

SEQ ID NO: 1248 - protein, 168 aa, Brassica napus
  misc_feature (130)..(130): Xaa can be any naturally occurring amino acid
MGGVTSSMAAKLAFFPPNPPSYKITRDEATELLLMDPFPHRENVDVLRLPTRRGNEIVVMYIRYPMAVTTLLYSHGNAADIGQMYELFVELSIHLRVNLMGYDYSGYGQSSGKPSEQNTYADIEAAYKCXEETYGAKQENIILYGQSVGSGPTVDLATRLPQLLGMHL

SEQ ID NO: 1249 - protein, 136 aa, Brassica napus
  misc_feature (132)..(132): Xaa can be any naturally occurring amino acid
MEKKGNDKPTNPMVTPLLNDLYQFTMAYAYWKAGKQSERSVFDLYFRKNPFGGEYTIFAGLEECIKFLANFTLTDAEIDFVRDSLPGCEEAFCDYLRGLDCSDIEVYAVSEGSVVFPKVPLLRIEGPVAVVXLLGT

SEQ ID NO: 1250 - protein, 187 aa, Brassica napus
MSGSLSCSAADLAVLLGPNATAAADYICGQLSTVNNKFTDVAFAVDNTYLLFSAYLVFSMQLGFAMLCAGSVRAKNTMNIMLTNVLDAAAGGLFYYLFGYAFAFGSPSNGFIGKHNFGLKDFPSASADYSNFLYQWAFAIAAAGITSGSIAERTQFVAYLIYSSFLTGFVYPVVSHWFWSVDGWASP

SEQ ID NO: 1251 - protein, 109 aa, Brassica napus
MASSMLSSAAVVTSPAQATMVAPFTGLKSSSAFPVTRKANNDITSIVSNGGRVSCMKVWPPVGKKKFERRLISVLKEMVRLQSEFLKPMRPRPKLLKKRLQYQQQEEEE

SEQ ID NO: 1252 - protein, 138 aa, Brassica napus
MAEHLFEDIFHVTRIDPDGKKFDRVNRIEARSEQLEMYMQLDIATDVYPMHMGDKFTMVLAPTLNLDGTPDTGYYTQAGRKTLADKYDYVMHGKLYKISEDNSSKDKGPTKVEIYASFGGLLMLLKGDPSSAANLELD

SEQ ID NO: 1253 - protein, 196 aa, Brassica napus
  misc_feature (25)..(25): Xaa can be any naturally occurring amino acid
  misc_feature (29)..(29): Xaa can be any naturally occurring amino acid
  misc_feature (144)..(144): Xaa can be any naturally occurring amino acid
MCKQRREHALLGDNENGENDEQSGXVADXKWITIKAALLLLLGAAIAAAFADPLVDTVNNFSAATGIPSFFISFIALPLATNSSESVSAIIFASRKKIRTASLTFSELCGGATMNNIHSSWERVSGLWVFLSIVHGRDLSWNFXSEVVVNLRICLGMGGFACFRTTYPLWTCFIAYLLYPFSLGLVYILDYWFGWS

SEQ ID NO: 1254 - protein, 118 aa, Brassica napus
VDPRVRPLATNSSEAVSAIIFASRKKIRTASLTFSELCGGVTMNNILCLSVFLAIVYVRGLTWNFSSEVLVILIVCLVMGCFASFRTTYPLWTCFIAYLLYPFSLGLVYILDYWFGWS

SEQ ID NO: 1255 - protein, 583 aa, Brassica napus
  misc_feature (118)..(118): Xaa can be any naturally occurring amino acid
MRFRSLISLLFLLFFTSSAYARLVSLHPSSTDLISDGVNGEPLINSRSIIKTVVSAEEKEEACEQTYGFMPCTKTALGNVFLILVYGFLMFTAATYLSAGSELLLEILGPGIVGGLFXPMLGALPDAMLIMVSGLSGDAATAQTQVSVGMGLLAGSTGMLLTVIWGTCTRPGKCDLRDNIAVNNRDTKGFHLKDSGVTVDVWTSYAARIMAISVIPFIIVQLPQVLNSTSGRHLAVLVALILSVVMLISYCVYQVFQPWIQRRRLAFAKHKHVISGILKHLKQHALGRLLDDEGQPDEHVIRKLFETIDANKDGHLSAAELKALIIGISFEDIDFDKDDAVGKVLQDFDKTLDEQVDQEEFVRGIKHWLIQAMGAAGPSGPDAGPRTMKFLDHFHVQTKREHALLGDNENGENDEESGEVADPKWITIKAALLLLLGAAIAAAFADPLVDTVNNFSAATGIPSFFISFIALPLATNSSEAVSAIIFASRKKIRTASLTFSELCGGVTMNNILCLSVFLAIVYLRGLTWNFSSEVLVILIVCLVMGGFASFRTTYPLWTCFIAYLLYPFSLGLVYILDYWFGWS

SEQ ID NO: 1256 - protein, 119 aa, Brassica napus
  misc_feature (8)..(8): Xaa can be any naturally occurring amino acid
  misc_feature (22)..(22): Xaa can be any naturally occurring amino acid
  misc_feature (48)..(48): Xaa can be any naturally occurring amino acid
  misc_feature (63)..(63): Xaa can be any naturally occurring amino acid
NDEAAGNXLALTTLYSLESIIXKLKEESSAPQEGKPSWTRRLLTDDAXLCSKIREEADELCRXLEDTEDASRTASEMADVLYHSMVLMSKRDVKFEDVLEVLRKRFSQSGIEEKQNRTK

SEQ ID NO: 1257 - protein, 126 aa, Brassica napus
MASSASKFIKCVTVGDGAVGKTCMLICYTSNKFPTDYIPTVFDNFSANVVVEGTTVNLGLWDTAGQEDYNRLRPLSYRGADVFVLSFSLVSRASYENVFKKWIPELQHFAPGVPLVLVGTKLDLRE

SEQ ID NO: 1258 - protein, 197 aa, Brassica napus
MPRSRINGNFIDKTFTIVADILLRVIPTTSGEKEAFTYYRDGMSAQSEGNYAEALQNCYEAMRLEIDPYDRSYILYNIGLIHTSNGEHTKALEYYFRALERNPFLPQAFNNMAVICHYRGEQAIQQGDSEMAEAWFAQAAEYWKQAITLTPGNYIEAQNWVAITRRFRIRTFSLVLFFLFYNIPFCGFTINCFLVSW

SEQ ID NO: 1259 - protein, 122 aa, Brassica napus
MNPRREPRGGRSSLFDGIEEGGIRAASSYSHEINEHENERALEGLQDRVILLKRLSGDINEEVDTHNRMLDRMGNDMDSSRGILSGTMDRFKTVFETKSSRRMLTLVAAFVGVFLVIYYLTR

SEQ ID NO: 1260 - protein, 249 aa, Brassica napus
MSLTMDSDTLTGLLKNVAEKFPDRRALSVSGKFDLTHARLNVLIERAASRLVSSAGINPGDVVALTFPNTVEFVIMFLAVLRARATAAPLNAAYTAEEFEFYLSDSDSKLLLTSKEGNAPAQEAASKLNISHVTATLLDAGSDLALSVADSDSVSDSASELVNSPDDPALFLHTSGATSRPKGVPLTQLNLVSSVNNIKSVYKLTESDSTVIVLPLFHVHGLLAGLLSSLGAGAAVTLPSCCRFFGTTF

SEQ ID NO: 1261 - protein, 168 aa, Brassica napus
  misc_feature (121)..(121): Xaa can be any naturally occurring amino acid
  misc_feature (157)..(157): Xaa can be any naturally occurring amino acid
  misc_feature (163)..(163): Xaa can be any naturally occurring amino acid
IGCSPLIAMNPAEFLLDLANGNINDISVPSELEDRVQVGNSDREPRTGKPSPAVVHEYLVEAYETRVTEQEKKKLTDPVPLGEEEAKAKVLRLKRQWGASWWEQYCILFARGLKERRHEYXSWLRVTQVLSTAVILGLLWWRSDIRTPRGLQDQAGXLFFIAXFWGIF

SEQ ID NO: 1262 - protein, 113 aa, Brassica napus
  misc_feature (112)..(112): Xaa can be any naturally occurring amino acid
MGDSISSLPDEILGKLLSLVPTKVAASTSVLSKRWRNLLSLVDSLSFDESMVVYPNEEEATIGSQRFCDFVDKTLALLHNSPAIKTFSLYRVAETMSYNDESARLNRWIWTXM

SEQ ID NO: 1263 - protein, 120 aa, Brassica napus
MSASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKL

SEQ ID NO: 1264 - protein, 125 aa, Brassica napus
  misc_feature (6)..(6): Xaa can be any naturally occurring amino acid
  misc_feature (9)..(12): Xaa can be any naturally occurring amino acid
  misc_feature (14)..(16): Xaa can be any naturally occurring amino acid
  misc_feature (18)..(19): Xaa can be any naturally occurring amino acid
  misc_feature (22)..(23): Xaa can be any naturally occurring amino acid
  misc_feature (25)..(25): Xaa can be any naturally occurring amino acid
  misc_feature (28)..(30): Xaa can be any naturally occurring amino acid
  misc_feature (33)..(34): Xaa can be any naturally occurring amino acid
  misc_feature (36)..(38): Xaa can be any naturally occurring amino acid
  misc_feature (40)..(40): Xaa can be any naturally occurring amino acid
  misc_feature (44)..(44): Xaa can be any naturally occurring amino acid
  misc_feature (48)..(48): Xaa can be any naturally occurring amino acid
  misc_feature (52)..(52): Xaa can be any naturally occurring amino acid
  misc_feature (56)..(56): Xaa can be any naturally occurring amino acid
  misc_feature (63)..(63): Xaa can be any naturally occurring amino acid
  misc_feature (84)..(84): Xaa can be any naturally occurring amino acid
  misc_feature (87)..(87): Xaa can be any naturally occurring amino acid
  misc_feature (100)..(100): Xaa can be any naturally occurring amino acid
  misc_feature (110)..(110): Xaa can be any naturally occurring amino acid
  misc_feature (112)..(114): Xaa can be any naturally occurring amino acid
  misc_feature (117)..(124): Xaa can be any naturally occurring amino acid
DQSSMXSSXXXXTXXXQXXMVXXFXVLXXXAAXXVXXXAXNDIXSIAXNGGXVSCXKVWPPVXKKKFETLSYLPDLTEVELGLXKSXTLLRNKCIPCVEXELEHGFCAPXSXXXPPXXXXXXXXM

SEQ ID NO: 1265 - protein, 84 aa, Brassica napus
MELLRFGEKGLSNSPHRRKKWILLIAISGVVSGYGAYKVYHLPSVTRKRRRLMKILGAFLSVAELISESAETMTVVSRDMKEFL

SEQ ID NO: 1266 - protein, 132 aa, Brassica napus
  misc_feature (115)..(116): Xaa can be any naturally occurring amino acid
MARSVSYVSAAKLVSMARGNPRLAIIDVRDEERSYQAHIAGSHHFASGSFEARMPELVRAASGKDTLVFHCALSQVRGPTCARMFSDYLSETKEDSGIKNIMVLERGFNGWEVSXXQPVCSCTDAHCKGTCS

SEQ ID NO: 1267 - protein, 148 aa, Brassica napus
MVRYIEENITKMLETKIISKSEVLYAGGDDGDTSPATKVFQDFQINEEDVGRGGGGLIRSWVDSMRACSPSHLKPFNKQSSWIKEHPSALNMFEEILHESEGKQIVMFLDYDGTLSPIVDDPDRAFMSNKMRNTVRKLAMCFPTVIVS

SEQ ID NO: 1268 - protein, 259 aa, Brassica napus
  misc_feature (62)..(62): Xaa can be any naturally occurring amino acid
  misc_feature (100)..(100): Xaa can be any naturally occurring amino acid
  misc_feature (106)..(106): Xaa can be any naturally occurring amino acid
  misc_feature (137)..(138): Xaa can be any naturally occurring amino acid
  misc_feature (145)..(145): Xaa can be any naturally occurring amino acid
  misc_feature (154)..(154): Xaa can be any naturally occurring amino acid
  misc_feature (163)..(163): Xaa can be any naturally occurring amino acid
  misc_feature (166)..(166): Xaa can be any naturally occurring amino acid
  misc_feature (172)..(172): Xaa can be any naturally occurring amino acid
  misc_feature (179)..(179): Xaa can be any naturally occurring amino acid
  misc_feature (182)..(185): Xaa can be any naturally occurring amino acid
  misc_feature (188)..(189): Xaa can be any naturally occurring amino acid
  misc_feature (197)..(197): Xaa can be any naturally occurring amino acid
  misc_feature (199)..(200): Xaa can be any naturally occurring amino acid
  misc_feature (203)..(203): Xaa can be any naturally occurring amino acid
  misc_feature (205)..(205): Xaa can be any naturally occurring amino acid
  misc_feature (207)..(207): Xaa can be any naturally occurring amino acid
  misc_feature (210)..(211): Xaa can be any naturally occurring amino acid
  misc_feature (213)..(219): Xaa can be any naturally occurring amino acid
  misc_feature (221)..(222): Xaa can be any naturally occurring amino acid
  misc_feature (225)..(228): Xaa can be any naturally occurring amino acid
  misc_feature (232)..(234): Xaa can be any naturally occurring amino acid
  misc_feature (236)..(236): Xaa can be any naturally occurring amino acid
  misc_feature (239)..(242): Xaa can be any naturally occurring amino acid
  misc_feature (244)..(249): Xaa can be any naturally occurring amino acid
  misc_feature (251)..(257): Xaa can be any naturally occurring amino acid
LQMATETVLATAVSNGVGKACCKSGPGYATPLAAMSGPPEKLIYVTALYSGTGREQPDYLAXTVDVDPNSPTYSTVIHRLPMPYIGDELHHTGWNSCSSXHGDPSXASRRYLVLPGLISGRIYAIDTMTDPKAPSLXXKVVEPKXEISEKTGLXFPHTSHWLXSGXKMVGLXALGDKEXNAXXXXGFXXSLTLDFTXKXXGGXNXDXPQXXGXXXXXXXPXXKKXXXXFFGXXXKXFSXXXXSXXXXXXFXXXXXXXFG

SEQ ID NO: 1269 - protein, 114 aa, Brassica napus
MGSSEKRSKDVMSDIPTFSGENLQKNLKVIQNSRTFLSIIAGVLAGIIGFTGLTGFVFYFVVMLITSVGLMAKAGFSADLYFDSWNRVLFDGFLGGLMSFVLFWTFAYDLVHIF

SEQ ID NO: 1270 - protein, 113 aa, Brassica napus
  misc_feature (110)..(110): Xaa can be any naturally occurring amino acid
MAAGAGARAKAAGALALALVLALAGANSEGDALSALRRSLRDPGGVLQSWDPTLVNPCTWFHVTCDRDNRVTRLDLGNLNLSGHLVPELGKLEHLQYLELYKNSIQGTIXSEL

SEQ ID NO: 1271 - protein, 155 aa, Brassica napus
PTRPLSFTPLLTNPLSPTFYYVRLKSISVNGAKLRIDPSVWETDGSGNGGTVVDSGTTLAFLADPAYRLVVATVRRRIRLPIAAELTPGFDLCVNVSGVLKPEKMMPRLKFGFAGGAVFVPPPRNYFIETEEHIQCLAIQSVNPKVGFSVIGKLM

SEQ ID NO: 1272 - protein, 100 aa, Brassica napus
  misc_feature (87)..(87): Xaa can be any naturally occurring amino acid
MYKERSGGGGGSSRSEIVGGAIDRKRINDALNKRLEKSSTSASKDKHQLPDVESETDSEEGSDVSGSEGDDDDDTSWISWFCNLRGXDFFCEVDEDYIQD

SEQ ID NO: 1273 - protein, 137 aa, Brassica napus
  misc_feature (127)..(127): Xaa can be any naturally occurring amino acid
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADEFKKGVEGATKFLLSKLKDXIFVGESMRDD

SEQ ID NO: 1274 - protein, 116 aa, Brassica napus
MLGDFIIRLLVLILGYTYPAFECYKTVEKNKVDIEELRFWCQYWILLALISSFERVGDIFISWLPLYGEMKVVFFVYLWWPKTKGTRLVYETLLKPVIAQHETEIDRKIMELRARV

SEQ ID NO: 1275 - protein, 127 aa, Brassica napus
MAFVTTAEVCDANQDLIRSGELRALQPVFQIYGRRQIFSGPVVTVKVFEDNGLIRQFLEEKGNGRVLVVDGGGSQRCAILGGNPVVQAQNNGWAGIIVNGCIRDVDEINGCDIGVRALASHPIKASK

SEQ ID NO: 1276 - protein, 75 aa, Brassica napus
MAVARAPLGAVAMAVAALVFAILMPAAAAAQAPAPAPTSDGTSIDLGIAYILMLVALVLTYLIHPLDASSPYKLF

SEQ ID NO: 1277 - protein, 217 aa, Brassica napus
MTTLPYADVDCNLRALAGRAEGFGRFAVGGLHGNLYVVTSLADDGPGSLREGGRRREPLWIVFAVSGTIHLNSYLSVSSHKTIDGRGQRIKITGKGIRVKECEHVIICNLEFEGGRGHDVDGIQIKPKSRHIWIDRCSLRDYDDGLIDITRQSTDITVSRCYFGQHDKTMLIGADPSHVDDRCIRVTIHHCFFDGTRQRHPRLRFGKVHLYNNYTRN

SEQ ID NO: 1278 - protein, 121 aa, Brassica napus
  misc_feature (68)..(68): Xaa can be any naturally occurring amino acid
MSDNKDHNSDSDSDGAPEEFTQEQAQLRKIHRENKARVAREKKESRRRLAEKITPRKSRKVDTFDDIXEEEEEHEEDPEALANKGFLSKNIIDFLAQREKHKNSSDSEEEEANKEHPRKKK

SEQ ID NO: 1279 - protein, 123 aa, Brassica napus
GGWEFLNMEASDSETEDTEESDQGYVPSDAEPESESEDDDSDSESLVESDDDDEESDEDSEEEKGKTWEELEREASNADREHGAESDSEEERRRRKAKTFGKSRAPERSSFKGAPPSKKPKFR

SEQ ID NO: 1280 - protein, 138 aa, Brassica napus
  misc_feature (8)..(8): Xaa can be any naturally occurring amino acid
  misc_feature (44)..(44): Xaa can be any naturally occurring amino acid
  misc_feature (105)..(105): Xaa can be any naturally occurring amino acid
  misc_feature (120)..(120): Xaa can be any naturally occurring amino acid
  misc_feature (123)..(123): Xaa can be any naturally occurring amino acid
  misc_feature (134)..(135): Xaa can be any naturally occurring amino acid
MAATYHVXSCSLPARLHSNGLNHIQQLLIKLPTDDKSSLSFLSXLYDSLSNLFKESPASLLLPHHSFFTHLLYLSLVHLDLCSKLRDITCRIKDSIRDLRSAFRXRRHGGDSTIQCHVKXFTXSRRLIHKDLAXXLLL

SEQ ID NO: 1281 - protein, 101 aa, Brassica napus
  misc_feature (25)..(25): Xaa can be any naturally occurring amino acid
  misc_feature (44)..(44): Xaa can be any naturally occurring amino acid
  misc_feature (48)..(48): Xaa can be any naturally occurring amino acid
  misc_feature (76)..(76): Xaa can be any naturally occurring amino acid
MSNYQGDAPAEYIEDVDDEMEDGGXEWGWKEFRADDDDDLAASXDSDXEEFDYSNNKIADTSAEQARKGKDIQGIXPWDRLSISREKYRQTRVRADLLLLY

SEQ ID NO: 1282 - protein, 126 aa, Brassica napus
  misc_feature (10)..(10): Xaa can be any naturally occurring amino acid
  misc_feature (45)..(45): Xaa can be any naturally occurring amino acid
CLLYFLISCXLSFFFFLQIFLPPSSGHLQTKTFLSFHLSKQPPLXNTLHPTTKPDPSSSLVQIPILDLDHLALDLILDLLPPSALASMAMVWSCLRERCGSDHLWEKQLEIICGKVHGPGAHSQWK

SEQ ID NO: 1283 - protein, 147 aa, Brassica napus
MSSSPDIAGILENTKELDRLRKEQEEVLVEINKMHKKLQATPEVVEKPGDTSLSKLKILYIQAKELSESEVTVSNILLTQLDSLLPSGPTGQQRRKLVAEGNDQKRKRMKVESDVQRVSPSVRNQIEAYASLRGEQVAARITADDAG

SEQ ID NO: 1284 - protein, 158 aa, Brassica napus
MAKLLSRSTASRVANRFFSTSRAAAPSRSNLISRRSSPALFQAMGFIPDSTRLTTIRTRMDRSGGSYSPLKSGSNFSDRAPTEMAPLFPGCDYEHWLIVMEKPGGENASRQQMIDCYVQTLAKIVGSEEEAKRKIYNVSCERYFGFGCEIDEETSNKL

SEQ ID NO: 1285 - protein, 387 aa, Brassica napus
  misc_feature (157)..(157): Xaa can be any naturally occurring amino acid
  misc_feature (171)..(171): Xaa can be any naturally occurring amino acid
MVAHKETVCVTGASGFIGSWLVMRLLERGYFVRATVRDPGNLKKVQHLLDLPNAKTQLTLWKADLSDEGSYDDAINGCDGVFHIATPMDFESKDPENEVIKPTVNGVLGIMKACDKAKTVRRIVFTSSAGTVNVEEHQKNVYDENDWSDLDFIMSKXKMTGWMYFMSKTLXAEKAAWDYAKEKGIDFISIIPTLVIGPFITTSMPPSLITALSPITRNEAHYSIIRQGQYVHLDDLCNAHIFLYEQAAAKGRYVCSSHDATILTISEFLRQKYPEYNVPSTFEGVDENLKSIMFSSKKLIDMGFNFKYSLEDMLVESIETCRQKGFLPVTLPEHLKSEDKVPGSDDNKEIKNGSAGLTDGMVACKKTEPGMAGEKADSHMSAQQICA

SEQ ID NO: 1286 - protein, 385 aa, Brassica napus
MVAHKETVCVTGASGFIGSWLVMRLLERGYFVRATVRDPGNLKKVQHLLDLPNAKTQLTLWKADLSDEGSYDDAINGCDGVFHIATPMDFESKDPENEVIKPTVNGVLGIMKACDKAKTVRRIVFTSSAGTVNVEEHQKNVYDENDWSDLDFIMSKKMTGWMYFMSKTLAEKAAWDYAKEKGIDFISIIPTLVIGPFITTSMPPSLITALSPITRNEAHYSIIRQGQYVHLDDLCNAHIFLYVDPRVRGRVGCSSHDATILTISEFLRQKYPEYNVPSTFEGVDENLKSIMFSSKKLIDMGFNFKYSLEDMLVESIETCRQKGFLPVTLPEHLKSEDKVPGSDDNKEIKNGSAGLTDGMVACKKTEPGMAGEKADSHMSAQQICA

SEQ ID NO: 1287 - protein, 279 aa, Brassica napus
  misc_feature (262)..(262): Xaa can be any naturally occurring amino acid
MAISYNALAQSLPGRSSFFVPKALCIKQRSRSTVVFASNDKNIIALQAKVDTLLDRIKWDEKGLAVAIAQNVDTGAVLMQGFANREALSTTLTSRKATFFSRSRSTLWTKGETSNNFINVLDVYLDCDRDSIIYLGTPDGPTCHTGAETCYYTSVLDQLNNDEASGEKLASTTLYSLESIISKRKEESTVPQEGKPSWTRRLLTDDALLCSKIREEADELCRTLEDKEEVSRTASEMADMLYHAMVLLSKRDVKFEDVLEVXRKRFSQSGIEEKQSRSK

SEQ ID NO: 1288 - protein, 146 aa, Brassica napus
  misc_feature (138)..(138): Xaa can be any naturally occurring amino acid
MTKKRKLEAQLSEGSEPSEKQIAINNEVKQEVEYEEVEEEHEDDDDNDEEEEIENRMVVAATSGSGNLDDDDDEPIQDLLEPFSKEQLLSLLKEAAEKHRDVANRIREVADEDPVHRKIFVHGLGWDTKTETLIEAFXEYGEIEDC

SEQ ID NO: 1289 - protein, 75 aa, Brassica napus
MPQSYLNAAFLGLIGDSIYDLYARRHFLFPSLSIEDYNDRVIALVRCEAQYALLKKLVYDDFLTKEERDVLKWGK

SEQ ID NO: 1290 - protein, 120 aa, Brassica napus
MISDSITNASATSAPSARDFAKKKRNNKSAAKLKQNKLGLRREQWLSQVAVTNKVCKEEKSAKPDQRDKPVERREEDSNGGSVDVRHESFMESPSNSSMGGTDISTNFSGSSSTSSDFCS

SEQ ID NO: 1291 - protein, 112 aa, Brassica napus
MAPRVPSSLLLVGAALLLGLAAGAARASNEEGDALYALRMRLSDPNGVLQSWDPTLVNPCTWFHVTCDSASRVVRLDLGNSNVSGSIGPELSRLVNLQYLELYRNNLNGEIP

SEQ ID NO: 1292 - protein, 117 aa, Brassica napus
  misc_feature (28)..(28): Xaa can be any naturally occurring amino acid
  misc_feature (31)..(31): Xaa can be any naturally occurring amino acid
MPAGGFVAGDGQKAYPGKLTPFVLFTCXVAXMGGLIFGYDIGISGGVTSMPSFLRRFFPSVYRKQQEDATTNQYCQYDSPKLTLFTSSLYLAALISSLVASTVTRKFGRRLSMLFGG

SEQ ID NO: 1293 - protein, 143 aa, Brassica napus
MAVIHRSDPLSRIHPEPLDPPDFFDHLPDSILLLVFNRIGDVKALGRCGVVSKRFHSLVPQVENVVVRVDCVISDDDDPSSLSPDKPRSSASPFSAIFRLIFKPLHALTQLLSTKRSSSSSSSPSPSSPLPITGGGLPRPPAH

SEQ ID NO: 1294 - protein, 155 aa, Brassica napus
PQSSASSGKKQALISLSDKKDLATLGNGLQELGYTIVSTGGTASTLENAGVSVTKVETLTHFPEMLDGRVKTLHPNIHGGILARRDVEHHMEALNEHGIGTFDVVVVNLYPFYNKVTAPGGISFEDGIENIDIGGPAMIRAAAKNHKDVLIVVDS

SEQ ID NO: 1295 - protein, 393 aa, Brassica napus
RPTRPVLSKPPNMRYNALSFVFLQVRELSWLQWHPFSVSSSPLDGKHHVAVLIKVLGGWTAVLPRLRSKLYEAENPDQLLSPLSYPKITTCVEGPYGHESPYHLAYENLVLVAGGIGISPFFAILSDILQRKRDGKACLPKKVLVIWAIKNSDELSLLSSIDIPSLCPSFSQKINLEINIYVTRQSEPLLEDGMVHKMVNPSVKPRSNGCPMSVLVGTGDNIWAGLYLVSSTIGFVLMITLLDIFYINKFNITAWWYKGLLFVVCMVASVLIFGGLVVVFWNLWGEKAGDVEPNGHDKVTTNGEELHNPSAELKGLNTEDDIQSFITTRYGTRPDFKEIFESLNEKWGSVDVGVIVCGPASLQSTVAKEIRSHSIWRSTNHPLFHFNSHSFDL

SEQ ID NO: 1296 - protein, 168 aa, Brassica napus
MDSGLQHLALRFFILLCCLFQATAEDGSWKIATATLSRDKDGSSSVTTGGACGYGDLRQSSYGGYSAGLSGKLFNRGSSCGACLEVRCVNHIRWCLQGSPSVVVTATDFCPPNSGLSSDYGGWCNFPKEHLELSHAAFTGIAETRAEIIPVQYRRVKCGRRGGVRFSL

SEQ ID NO: 1297 - protein, 138 aa, Brassica napus
  misc_feature (124)..(125): Xaa can be any naturally occurring amino acid
MNPEIHHSKVISHVFFTGSAKQGSPGPPIGLVDIGESDIAYLFRVSLPGIHKNLNKIKCEIQREGRVCIQGVVPEIAIPSDSGCLYRMQVQQLCPPGPFSITFNLPGQVDPRLFSPKFRPDGIXXVVVVKLGVRVLLL

SEQ ID NO: 1298 - protein, 216 aa, Brassica napus
  misc_feature (160)..(160): Xaa can be any naturally occurring amino acid
  misc_feature (166)..(166): Xaa can be any naturally occurring amino acid
  misc_feature (173)..(173): Xaa can be any naturally occurring amino acid
  misc_feature (175)..(175): Xaa can be any naturally occurring amino acid
  misc_feature (178)..(179): Xaa can be any naturally occurring amino acid
  misc_feature (187)..(187): Xaa can be any naturally occurring amino acid
  misc_feature (196)..(196): Xaa can be any naturally occurring amino acid
MDSSSWINHPSVISSRRCQSRSDLYIGGGYEDLEGEDESKSEFICPFCADVFDIVGLCCHIDEEHPVEAKNGVCPVCTKRVGLDIVGHITTQHANFFKVQRRRRLRKGGYGSPYLALKKELREANLQSFFGGFTRFTSSTNLDYDPLLSSFMFSSPSTKXVTPVVXGTSATKXSXKEXXKREIQEAXLSGEDQEKXKKSEFVRGLLLSTMLGVGDS

SEQ ID NO: 1299 - protein, 99 aa, Brassica napus
MDQEIEIPTFFLCPISLDIMKDPVIVSTGITYDRDSIEKWLFTGKKNTCPVTKQVITETDLTPNHTLRRLIQSWCTLNASHGIERIPTPKPPISKSEIE

SEQ ID NO: 1300 - protein, 142 aa, Brassica napus
YFLDDRINRAEVLFPGVACFLIAVCFGSAVHKSNAADNKSKLQGFKSLETTSSFQIETGPADSGLAKGKAKEGTAAYLIELEKQRAIKVFGKSTIIGLAITFFAGICFSLFSPAFNLATNDQWHTLKHGVPKLNVYTAFFYF

SEQ ID NO: 1301 - protein, 126 aa, Brassica napus
MSEHLFEDTFVVTRLDPDGKKFDRVSRVEARSEQLDMYMQLDVATDVYPMHAGEKFNMVIAPTLNLDGTPDTGYYTQAGRKTLADNYEYVMQGKLYKISEDTSSSQNAKVEMYASFGGLLMLLRGD

SEQ ID NO: 1302 - protein, 111 aa, Brassica napus
MALEKEQEESQTGQNAAFCALDELYCEEECGFAEEDLVGLDENVVKFQFLPLKDMFLWDDDELQSLISKENEANHHPYQTLDECLVSRRKEALDWVLRVKSHYGFASSTAL

SEQ ID NO: 1303 - protein, 122 aa, Brassica napus
MDLALSKKGFNFVLRNKKWILLTATGYGAFKVYHSQKRKRISKLFALLLNLVEAASHSAEAVSVIAKDLTEFLRSDSDQIPNSFKQISKLAKSDELNSSVIGLTQAVTVGLLRGSRNDDSGS

SEQ ID NO: 1304 - protein, 150 aa, Brassica napus
MRPPLTGGRGGGGFSGGRGGGGFSGGRSGGRGRAGGRGFGDRGGGGGRSGRGMRGRGERGRNGRGAPGRGGMKGGSKVIVEPHRHPGVFIAKGKEDALVTKNLVPGEAVYNEKRISVQNEDGTKTEYRVWNPFRSKLAAAILGGVDNIYI

SEQ ID NO: 1305 - protein, 629 aa, Brassica napus
MSSTYARFDTVFLLSRFAGAKYSPLWPSSSSSSHSSLLSSGIHLRAKPNSRLRSVTGASSSSSGPIIAGSESIEIKSLPTKPIEGQKTGTSGLRKKVKVFMQDNYLANWIQALFNSLPLEDYKDATLVLGGDGRYFNKEASQIIIKIAAGNGVGKILVGQEGILSTPAVSAVIRKRKANGGFIMSASHNPGGPEYDWGIKFNYSSGQPAPESITDKIYGNTLSISEIKVAEIPDIDLSHVGVTKYGNFSVEVIDPISDYLELMEDVFDFDLIRGLLSRSDFGFMFDAMHAVTGAYAKPIFVDNLEAKPDSISNGVPLEDFGHGHPDPNLTYAKDLVDVMYRDDGPDFGAASDGDGDRNMVLGNKFFVTPSDSVAIIAANAQEAIPYFRAGPKGLARSMPTSGALDRVAEKLKLPFFEVPTGWKFFGNLMDAGKLSICGEESFGTGSDHIREKDGIWAVLAWLSILAHRIKDKKPGEKLVSVADVVNEYWATYGRNFFSRYDYEECESEGANKMIEYLRDIVAKSKAGENYGNYVLQFADDFSYKDPVDGSVASKQGVRFVFTDGSRIIYRLSGNGSAGATVRIYIEQFEPDVSKHDVDAQIAIKPLIDLALSVSKLKEFTGREKPTVIT

SEQ ID NO: 1306 - protein, 188 aa, Brassica napus
  misc_feature (161)..(161): Xaa can be any naturally occurring amino acid
  misc_feature (172)..(172): Xaa can be any naturally occurring amino acid
  misc_feature (184)..(184): Xaa can be any naturally occurring amino acid
MSSDKKDHNSDSDSDGPPEEFTQEQAKVEDAALRRIQRENKARVAREKKESRRHLLEKITPKKSRKIETFEEEEAEEEEDPEALANKGFLSKNIIDFLAQREKQKNGSDSEQEEANKQHPRKKKQKSSGIETVLYKEIPPPECLKTGLAFLKKRKAQVPRXSSILNNSSQAXRLITGAASANKXRQKK

SEQ ID NO: 1307 - protein, 124 aa, Brassica napus
  misc_feature (99)..(99): Xaa can be any naturally occurring amino acid
  misc_feature (115)..(115): Xaa can be any naturally occurring amino acid
  misc_feature (122)..(122): Xaa can be any naturally occurring amino acid
MEPQAEPKPIPLMTPYKMGASLDLAHRVVLAPLTRQRSYGNVPQPHAAVYYGQRATPGGMLITEATGVSDTAQGYTDTPGVWTAEQAEAWRPVVDAVHXKGALFFCLWHVGRVSXYGSQPGXAA

SEQ ID NO: 1308 - protein, 190 aa, Brassica napus
  misc_feature (158)..(158): Xaa can be any naturally occurring amino acid
  misc_feature (181)..(181): Xaa can be any naturally occurring amino acid
MAPYFPINSFSFSAPTFRSLPPHALTSKRRISIKASSSGLSSPPLLSLSRSNLKGRAFASDGSTQESPSVVCFGEMLIDFVPTTSGLSLAQAPAFKKAPGGAPANVAVGIARLGSSSGFIGKVGEDEFGYMLANILKENNVNNEGMRFDPGARPALAXVTLTNEGEREFMFYRNPSADMLXERSELDLDL

SEQ ID NO: 1309 - protein, 504 aa, Brassica napus
  misc_feature (117)..(117): Xaa can be any naturally occurring amino acid
  misc_feature (128)..(128): Xaa can be any naturally occurring amino acid
MGTRFQSFLLLFLLSCLIFISATSSEQKGDGTLRIGLKKRKLNRANRLASQLFLKNRGSWSSKGFFHLNDGNSDTVPLKNYLDAQYYGDITIGTPPQKFTAIFDTGSSNLWMPSSKXYLSLDNFLHLXYTASSEPTNRSELRDRYGTGAISSYFSNDDVKVGGLVIKDQEFIEATSEPGITFLLAKFDGILGLGFKEIAVGNSTPVWYNMVEKGLVKEPIFSFWLNRNPEDPEGGQIVFGGVDPKHFKGEHTYVPVTRKGYWQFDMGDLNIAGKPTGYCAKGCSAIADSGTSLLTGPSTVITMINHAIGAVGIASQECKTVIGQYGQTMLDSLVSQVDPRKVCSQIGLCGFDGTHSVSMGIKSVVEDGVSGLLNEAMCSACEMASVWMQSELSQNQTQERILAYAAELCDHIPNPNQQSAVDCERVSSMPIVTFTIGGKPFDLSPQDYIFKIGDGVQAQCTSGFTAMDIPPPRGPLWILGDIFMGPYHTVFDYGKTRVGFAKAT

SEQ ID NO: 1310 - protein, 132 aa, Brassica napus
  misc_feature (130)..(131): Xaa can be any naturally occurring amino acid
MGPRCSKLSLCWWQTHHKSSLNDASDLENGNDDSASFSEFSFDQLRTATSGFSTDSIVSEHGVKAPNVVYKGRLEDERWIAVKRFNRSAWPDTRQFLEEAKAVGQLRSERLANLIGFCCEGDERLLVAEXXP

SEQ ID NO: 1311 - protein, 114 aa, Brassica napus
  misc_feature (70)..(70): Xaa can be any naturally occurring amino acid
MPPTNVSGEPPYTSASPPPPKPKTKILSLFLVGVIMISIFFLFLLLLGIASLLLLPFILSSLHRHLRRRXRNRRHVSSDGLSSRFVKKIPQFKFYEPTTRHGSDCVVCLDGFRQ

SEQ ID NO: 1312 - protein, 157 aa, Brassica napus
ILQNLCGGPNIVKLLDIVRDQQSKTPSLIFEHVNNKDFKVLYPTLSDYDVRYYIYELLKALDFCHSRGIMHRDVKPHNVMIDHEQRKLRLIDWGLAEFYHPGKEYNVRVASRYFKGPELLVDLMDYDYSLDLWSLGCMFAGMIFRKEPFFYGHDNYD

SEQ ID NO: 1313 - protein, 106 aa, Brassica napus
MEPIPLLTPYKMGQLNLAHRIVLAPLTRQRSYGNVPQPHAALYYSQRASAGGLLITEATGVSDTAQGYRDTPGVWTAEHVEAWKPIVDAVHAKGALIFCQIWHVGA

SEQ ID NO: 1314 - protein, 118 aa, Brassica napus
  misc_feature (94)..(94): Xaa can be any naturally occurring amino acid
  misc_feature (105)..(105): Xaa can be any naturally occurring amino acid
MAVIPRSDPPSRIHPEPQTLGIDHFDHLPDSILLLVFNKISDVKSLGRCCVVSRRFHSLVTQVENVLIRVDCVISDDDNSSLSSIKSRSSASGXFSSIFRLVVGXIVKPLQALGQFPR

SEQ ID NO: 1315 - protein, 158 aa, Brassica napus
  misc_feature (108)..(108): Xaa can be any naturally occurring amino acid
  misc_feature (120)..(120): Xaa can be any naturally occurring amino acid
MQYAKESIPLLTPYKMGRFNLSHRVVLAPLTRQRSYGNVPQPHAVLYYSQRTSPGGFLITEATGVSDTAQGYQDTPGIWTKEHVEAWKPIVDAVHAKGGVFFCQIWHXVGRVSNRGFQPXNGQAPISCSNKSLIPQARTESIKEVLFTPPRRLSTEEI

SEQ ID NO: 1316 - protein, 155 aa, Brassica napus
  misc_feature (18)..(18): Xaa can be any naturally occurring amino acid
  misc_feature (28)..(28): Xaa can be any naturally occurring amino acid
DVANAVLDGSDSILLGAXTLRGLYPVEXISIVGKICAEAEKVFNQDLYFKKTVKYVGEPMTHLESIASSAVRAAIKVKASVIICFTSSGRAARLIAKYRPTMPVISVVIPRVKTNQLKWSFSGAFEARQSLIVRGLFPMLADPRHPAESTSATKR

SEQ ID NO: 1317 - protein, 151 aa, Brassica napus
  misc_feature (145)..(145): Xaa can be any naturally occurring amino acid
STDMVAYKNVNDVPQPRDLMIQVDQKNEALLLPIYGSLVPFHVSAIRTVSNQHESSQNNYIRIIFNVPGTPFNPPDSNTLKNQGAIYLKEVSFRSKDSKHSSEVVQAIKTLRRQVNARESERIERATLVTQEKLQLAGNKFKPLXLSDLWI

SEQ ID NO: 1318 - protein, 145 aa, Brassica napus
MTGLTPETQTVPTTAPATKHVPELGPPLKPKRNKYAFACAILASMTSILLGYDIGVMSGALIYIKRDFKITDLQVSILAGILNIFSLIGSCAAGKTSDWIGRRNTIVFAGAIFFAGAILMGLAPNYDFLMFGRVVAGVGVGYALM

SEQ ID NO: 1319 - protein, 165 aa, Brassica napus
  misc_feature (24)..(24): Xaa can be any naturally occurring amino acid
  misc_feature (156)..(156): Xaa can be any naturally occurring amino acid
MAKSLSRSTVSRVATRIFPTSRAXPLPSNLISRRSSPTLFGFIPTSSRLTTIRTRMDRSGGGSYSPVKSNLSDRQPTEMAPLFPGCDYEHWLIVMDKPGGENASPQQMIDCYVQTLAKIVGSEEEAKRKIYNVSCERYFGFGCEIDEETSNKLEGXPGVLFVLPD

SEQ ID NO: 1320 - protein, 129 aa, Brassica napus
MAKSLSRSTVSRVATRIFPTSRAASPSPLPSHLISRRSSPKLFGFIPTSTRLTTIRTRMDRSGGGSNFSDRQPTEMAPLFPGCDYEHWLIVMDKPGGENASPQQMIDCYVQTLAKIVGSEEEAKRKIYN

SEQ ID NO: 1321 - protein, 90 aa, Brassica napus
MATLNPFDLLDDDAEDPSQLAAAKPLKVEKAAPAQPAKLPSKPLPPSQAVREGKNGPGGGSGGRARSGGFNRNNDAPANENGYGGGYRRS

SEQ ID NO: 1322 - protein, 103 aa, Brassica napus
MGACVSRESMRGDSAKLILLDGTLQEFSTPVKVWQILQKYPSSFVCNSDEMDFDDAVSAVSGDEELRSGQLYFVLPLTWLNHPLRAEEMAALAVKASSALTRA

SEQ ID NO: 1323 - protein, 177 aa, Brassica napus
  misc_feature (171)..(171): Xaa can be any naturally occurring amino acid
MNGGGKVVCVTGASGYIASWIVKLLLLRGYTVKATVRDPKDQKKTDHLLALDGARERLQLFKASLLEEGSFEHAIDGCDAVFHTASPVKIIATDPQAELIEPAVKGTINVLATCTKVSSVKRVILTSSMATLYSPNFPLGPNVLLDETTFSDPSVCEEEKQWYILSKTLAXNAAWTF

SEQ ID NO: 1324 - protein, 111 aa, Brassica napus
MALEEEEETQNAPFCMLFCEEESISVFEEDESVVKSPSFHLGFPDHDMLWDDDELLGLISKQDELKPCLSDKALDEFKSLCRENALGWIFRVKGYYGFSSLTALLAVNYFD

SEQ ID NO: 1325 - protein, 127 aa, Brassica napus
  misc_feature (123)..(123): Xaa can be any naturally occurring amino acid
MGACVSRESMRGDSAKVILFDGTLQEFSSPVKVWQILQKYPTSFVCNSDEMDFDDAVSAVSGNEELRLGQLYFVLPLTWLNHPLRAEEMAALAVKASSALAKSGGVGWVSVDDSDVDGKVYQXKNIA

SEQ ID NO: 1326 - protein, 151 aa, Brassica napus
  misc_feature (6)..(6): Xaa can be any naturally occurring amino acid
  misc_feature (12)..(12): Xaa can be any naturally occurring amino acid
  misc_feature (16)..(16): Xaa can be any naturally occurring amino acid
  misc_feature (19)..(19): Xaa can be any naturally occurring amino acid
  misc_feature (21)..(21): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(32): Xaa can be any naturally occurring amino acid
  misc_feature (38)..(38): Xaa can be any naturally occurring amino acid
  misc_feature (55)..(55): Xaa can be any naturally occurring amino acid
  misc_feature (58)..(58): Xaa can be any naturally occurring amino acid
  misc_feature (68)..(68): Xaa can be any naturally occurring amino acid
  misc_feature (77)..(77): Xaa can be any naturally occurring amino acid
  misc_feature (80)..(80): Xaa can be any naturally occurring amino acid
  misc_feature (85)..(85): Xaa can be any naturally occurring amino acid
  misc_feature (87)..(87): Xaa can be any naturally occurring amino acid
  misc_feature (92)..(93): Xaa can be any naturally occurring amino acid
  misc_feature (97)..(97): Xaa can be any naturally occurring amino acid
  misc_feature (102)..(102): Xaa can be any naturally occurring amino acid
  misc_feature (104)..(104): Xaa can be any naturally occurring amino acid
  misc_feature (106)..(106): Xaa can be any naturally occurring amino acid
  misc_feature (108)..(109): Xaa can be any naturally occurring amino acid
  misc_feature (115)..(115): Xaa can be any naturally occurring amino acid
  misc_feature (125)..(126): Xaa can be any naturally occurring amino acid
  misc_feature (130)..(130): Xaa can be any naturally occurring amino acid
  misc_feature (135)..(135): Xaa can be any naturally occurring amino acid
  misc_feature (142)..(143): Xaa can be any naturally occurring amino acid
  misc_feature (146)..(147): Xaa can be any naturally occurring amino acid
MASSMXSSAAVXTSPXQAXMXAPFXGLXSSAXFPVTRXANNDITSIASNGGRVSXMKXWPPVGKKKFXTLSYLPDLXEVXLGKEXYXLLRNXXIPCXEFELXHXFXYXXHGTTPXYYDGRYWTMXXLPLXFGCTXSAQVLKXXQEXXTEYP

SEQ ID NO: 1327 - protein, 134 aa, Brassica napus
MERDEESSGPMMEVCTNGGGEETSNRRPIISGEPLDIEAYATLYKGRTKIMRLLFIASHCGGNQTMQLEALRMAYDEIKKGENTQLFRDVVNRINGRLGDKYNMDSAWCESVDRRAEQKKGRLENELSSYRTNL

SEQ ID NO: 1328 - protein, 149 aa, Brassica napus
LYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIP

SEQ ID NO: 1329 - protein, 154 aa, Brassica napus
AMWKPRKFKSIYLMATLYVFTLTLPSASAVYWAFGDQLLNHSNAFSLLPKTRFRDAAVILMLIHQFITFGFACTPLYFVWEKAIGMHHTKSICLRAIVRLPVVVPIWFLAIIFPFFGPINSAVGALLVSFTVYIIPALAHMLTYRTASARRNAA

SEQ ID NO: 1330 - protein, 290 aa, Brassica napus
  misc_feature (137)..(137): Xaa can be any naturally occurring amino acid
  misc_feature (162)..(162): Xaa can be any naturally occurring amino acid
  misc_feature (174)..(174): Xaa can be any naturally occurring amino acid
MGKTAGNRDWAQIYAIYGIEQWQTLVFLLFHAFVFSLLSVLFLIYFDQICFFLDSFFLPGAARLAAGFTGAVTALSAVCLLFAAANFLYSDVPLQYEMAQRMVSSVSDWSCVKTALDLGCGRGILLNAVATQLKKTXGSSRRVVGLDRSKRTTLSTLRTANXEGVQEYVTCREXDVRTLPFGDNYFDVVVSSVFVHTVGKEHGQKTVEAAAERMRVLGEIVRVVKPGGLCVVWDLLHVPEYVRRLQELKMEDIRVSERVTAFMAASHIVSFRKPSELVAGPREVRLDWRC

SEQ ID NO: 1331 - protein, 103 aa, Brassica napus
MADGISSFWGPVTSTIECCEKNYAYSSYIAEFYNTISGLPGILLALIGLVNALRQRFEKRFSILHISNMILAIGSMLYHATLQHVQQQSDETPMVWEILLYMY

SEQ ID NO: 1332 - protein, 258 aa, Brassica napus
VDPRVRHVFHLVTDKLNFAAMNMWFLLNPPGKATIHVENVDEFKWLNSSYCPVLRQLESAAMKEYYFKADHPSSGSSNLKYRNPKYLSMLNHLRFYLPEVYPKLNKILFLDDDIIVQKDLTPLWEVNLNGKVNGAVETCGESFHRFDKYLNFSNPHIARNFNPNACGWAYGMNMFDLKEWKKRDITGIYHKWQNMNENRTLWKLGTLPPGLITFYGLTHPLDKSWHVLGLGYNPSIAKKDIQNAAVVHYNGNMKPCWS

SEQ ID NO: 1333 - protein, 135 aa, Brassica napus
MANTACFMIVARNDIPIYEAEVGSAAKREDVAQLHQFILHAALDVVQDLAWTTSAMFLKSVDRFNDLVVSVYVTAGHTRLMLLHDSRNEDGIKSFFQEVHELYIKILLNPLYLPGSRITSTHFDTKVRALARKYL

SEQ ID NO: 1334 - protein, 150 aa, Brassica napus
  misc_feature (33)..(33): Xaa can be any naturally occurring amino acid
TNTGAELAANQVKCLGKYLSLSLVWSCFKWFFXGVGDACGFDNFPTLGLTLFKNTFYFDFSPTYVGCGLICPHIVNCSVLLGAIISWGFLWPFVSQHAGDWYPADLGSNDFKGLYGYKVFIAIAIILGDGLYNLVKIIAVTVKELCSNSS

SEQ ID NO: 1335 - protein, 187 aa, Brassica napus
  misc_feature (166)..(166): Xaa can be any naturally occurring amino acid
MALEAWLMDDSNEDQRLPLHPNPKDLLTIDYLAELGVLHWKLNPENYEHDSELGKIRDERGYDYMDMLDLCPEKVSNYEEKLKNFFTEHIHKDEEIRYCLAGSGYFDVRDKDDRWIRIWMKPGDLIVLPAGIYHRFTLDTGNYIKLMRLFVGEPVWTPYNRPQEEXPVRKEYIKSLTPKFGESIQAH

SEQ ID NO: 1336 - protein, 149 aa, Brassica napus
SAKSAIEKLNGKILNDKQIFVGPFLKKEERESAADKMKFTNVYVKNLSETTTDDELKSTFGQYGGISSAVVMRDGDGRSRCFGFVNFENAEDAARAVEGLNGKKFDDKEWYVGKTQKKSERELELSRRYEQGARETGNSFDGLNLYVKN

SEQ ID NO: 1337 - protein, 117 aa, Brassica napus
  misc_feature (86)..(86): Xaa can be any naturally occurring amino acid
VEWIIFINQGEEDDPKHMATSKKVITRDEWEKKLNAVKLRKEDMNTLVMNFLVTEGFVEAADKFQRESGTKPEIDLATITDRMAVXKAVQNGNVEDAIEKVYDLNPEILDTNPELFF

SEQ ID NO: 1338 - protein, 197 aa, Brassica napus
  misc_feature (41)..(41): Xaa can be any naturally occurring amino acid
  misc_feature (47)..(47): Xaa can be any naturally occurring amino acid
EALKSLCTIKASNGSVNLSLVPSETKNGKPGLVQPLTNTDXSPAPSXGSTLHVAYQGVPGAYSEAAAGKAYPNSEAIPCDQFDVAFQAVELWIADRAVLPVENSLGGSIHRNYDLLLRHRLHIVGEVQIPVHHCLLALPGVRAGCITRVISHPQALAQTEGSLNKQSPKHKCKDLYKKRMKGRWNETMKKGLKSIID

SEQ ID NO: 1339 - protein, 203 aa, Brassica napus
  misc_feature (172)..(172): Xaa can be any naturally occurring amino acid
  misc_feature (187)..(187): Xaa can be any naturally occurring amino acid
MSQSIQFSTPSRTPHLLHLPNSRFHRPLTSLSFRQFPLKYTSIRASSSPDLGSSSSSQVLHSPNGTGAAKPEERSVVATAVSTDTAAIDVDTVTEAELKENGFRSTRRTKLICTIGPATCGFEQLEALAEGGMNVARLNMCHGTREWHRDVIRSVRKLNEEKGFAVAIMMDXEGSEIHMGDLGGESXAKSEVLSSLFSISIRA

SEQ ID NO: 1340 - protein, 159 aa, Brassica napus
MVDLISNLADEILGKILSLVPTKVAASTSVLSKRWRNLLGLIDSLCFEEPEEAASGSHRFFDFVDKTFALLSESPIIKKLSLSHIPTSGRDDDYSRVNRWIWTALERGLSELHLHATPRSPRPLLPAARFTSPSPLKLSPPPASPPTSSLFPPPFSLPP

SEQ ID NO: 1341 - protein, 140 aa, Brassica napus
  misc_feature (11)..(12): Xaa can be any naturally occurring amino acid
  misc_feature (28)..(28): Xaa can be any naturally occurring amino acid
  misc_feature (32)..(32): Xaa can be any naturally occurring amino acid
  misc_feature (35)..(35): Xaa can be any naturally occurring amino acid
  misc_feature (39)..(39): Xaa can be any naturally occurring amino acid
  misc_feature (46)..(47): Xaa can be any naturally occurring amino acid
  misc_feature (52)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (64)..(64): Xaa can be any naturally occurring amino acid
  misc_feature (72)..(72): Xaa can be any naturally occurring amino acid
  misc_feature (75)..(75): Xaa can be any naturally occurring amino acid
  misc_feature (78)..(78): Xaa can be any naturally occurring amino acid
  misc_feature (81)..(82): Xaa can be any naturally occurring amino acid
  misc_feature (85)..(85): Xaa can be any naturally occurring amino acid
  misc_feature (87)..(87): Xaa can be any naturally occurring amino acid
  misc_feature (90)..(91): Xaa can be any naturally occurring amino acid
  misc_feature (93)..(93): Xaa can be any naturally occurring amino acid
  misc_feature (97)..(98): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(109): Xaa can be any naturally occurring amino acid
  misc_feature (111)..(111): Xaa can be any naturally occurring amino acid
  misc_feature (113)..(113): Xaa can be any naturally occurring amino acid
MASSMLSSAAXXTSPAQGTMVAPFTGLXSSAXFPXTRKXNNDITFXXSNGRXVXCMKXXXPVGXKKIENLSXLSXLTXMNXXKGXDXPFXXKXVSCXXIQMXHGXFXXXGXGXTPPILIGVLKGNFLGRADGGQKGKTKF

SEQ ID NO: 1342 - protein, 130 aa, Brassica napus
MASATSVIAWGSGEDGQLGLGTYEEKEWACVVEALDPFAVRSVVGGSRNSLAICDGGKLFTWGWNQRGTLGHPPDKKTESVPSLVKSLANVKITQAAIGGWHCLAVDDQGRAYAWGGNEYGQCGEEPSKD

SEQ ID NO: 1343 - protein, 73 aa, Brassica napus
  misc_feature (30)..(30): Xaa can be any naturally occurring amino acid
  misc_feature (43)..(43): Xaa can be any naturally occurring amino acid
  misc_feature (60)..(60): Xaa can be any naturally occurring amino acid
KVTDTEPDLFTYLEGCQSGQVTCFIVGGQXYIYNGSVDKTIKXVWYLGTLECTMTLRQHXGTVTYLLCRDQSL

SEQ ID NO: 1344 - protein, 63 aa, Brassica napus
  misc_feature (12)..(12): Xaa can be any naturally occurring amino acid
MAGGRVAHATLXGPSVVKEIFIGLTLGLVAGGMWKMHHWNEQRKTRSFYDMLEKGQISVVVEE

SEQ ID NO: 1345 - protein, 149 aa, Brassica napus
FASTPKDTGGNRRKPTSIGEVSVYVPGLRIPRPVEFSQAVGDQLPKTLVERLTALRTRIVVMANQEGPTITRTRRKTQHGSTLSDLHQALVDYLPVLLELTKDGSHLQFKVHFIWVNQEDEEEETAMSNIWYEVLSVLHLMAMLQMSQA

SEQ ID NO: 1346 - protein, 172 aa, Brassica napus
  misc_feature (140)..(140): Xaa can be any naturally occurring amino acid
  misc_feature (152)..(152): Xaa can be any naturally occurring amino acid
MPRYDDRYGNTRLYVGHLSSRTRTRDLERLFNRYGRVRDVDMKRDYAFVEFSDPRDADDARHYLDGRDFDGSRITVEFSRGAPRGSRDYDSRGPPPGAGRCFNCGVDGHWARDCTAGDWKNKCYRCGERGHIERNCKVLXPSRSYSRSPVKXRSPSRSRSTVSGILPKPGGI

SEQ ID NO: 1347 - protein, 129 aa, Brassica napus
MEPPKDQPPSSAYPPSGSCNNCGGPTISEPAPQASLPDMSPPPNYRPIRAPAINVPHNPQAIILSPVPHAEKVPVVTPPYQFQRPVKRIHSPDDIRRFQESASFKNFLGFVVSLSESIDGHKIADPCHV

SEQ ID NO: 1348 - protein, 98 aa, Brassica napus
MALVRSLLGAKKILGRSVTATASTSKRAASAAPKGFLAVYVGENQKKRYVVPVSYLSQPSFQALLSKSEEEFGFDHPMGGLTIPCPEDTFINMTSRLQ

SEQ ID NO: 1349 - protein, 147 aa, Brassica napus
  misc_feature (16)..(16): Xaa can be any naturally occurring amino acid
MTKTPLTVVAFLLLFXAAIPPSTAEIKSLAISDDARPMILFEKFGFTHTGHVTISVSSVSVASSSDPNPDPSRLGFFLLSEESLLQVLLEIQQNSRFCVLDSHYVTHLFTFRDLSPPPNSRFNQSYPVTSPNEYSLFFANCLPETKV

SEQ ID NO: 1350 - protein, 130 aa, Brassica napus
RQLRFCRGEDFDKFDRVRFPKIRYAGMLQYDGELKLPSHYLVSPPLIDRTSGEYLAHNGVRTFACSETVKFGHVTFFWNGNRSGYFNEKLEKYVEIPSDSGISFNEQPKMKALEIAEKARDAILSGNFDQ

SEQ ID NO: 1351 - protein, 227 aa, Brassica napus
CLLNKLIRFIFSLFINFFFKKACNEAMFPCRSPPNWWTEELCILNIDFFSDVLASMKQRGLKPSSLASAIITYTERSLRDLVRDHSGRGVKFSDPENNDSEERSQQRDLVESIVSLLPSDKGLFPINFLCSLLRCAVFLEASLASKNELEKRISVVLEHVTVDDLLIPSFTYDGERLLDLDSVRRIISTFVEKEKNVGVFNGGDFNKGLFSASLQRVARTVDSYLAE

SEQ ID NO: 1352 - protein, 84 aa, Brassica napus
  misc_feature (2)..(2): Xaa can be any naturally occurring amino acid
MXTAIPVMVGTKFDEFIQLPIDLQWTIASQARTYAKALNATLFFSSASYNINVNKIFKFVTAKLFDLPWTVERNLTIGEPIIDY

SEQ ID NO: 1353 - protein, 136 aa, Brassica napus
  misc_feature (76)..(76): Xaa can be any naturally occurring amino acid
  misc_feature (133)..(133): Xaa can be any naturally occurring amino acid
MAFRPIGFTISSLRNASAANDLRFSFLSISSPSPAKKKSLLSFLRGFASLYRQQPRVNKSETLAQKIGKSIRRAGXPSKARVYADVNVIKPKDYWDYESLAVQWGSQDDYEVVRKVGRGKYSEVFEGIHATDXEKC

SEQ ID NO: 1354 - protein, 151 aa, Brassica napus
  misc_feature (9)..(9): Xaa can be any naturally occurring amino acid
  misc_feature (11)..(11): Xaa can be any naturally occurring amino acid
  misc_feature (18)..(18): Xaa can be any naturally occurring amino acid
  misc_feature (21)..(21): Xaa can be any naturally occurring amino acid
  misc_feature (29)..(29): Xaa can be any naturally occurring amino acid
  misc_feature (34)..(35): Xaa can be any naturally occurring amino acid
  misc_feature (38)..(40): Xaa can be any naturally occurring amino acid
  misc_feature (47)..(49): Xaa can be any naturally occurring amino acid
  misc_feature (53)..(53): Xaa can be any naturally occurring amino acid
  misc_feature (57)..(59): Xaa can be any naturally occurring amino acid
  misc_feature (67)..(68): Xaa can be any naturally occurring amino acid
  misc_feature (79)..(79): Xaa can be any naturally occurring amino acid
  misc_feature (82)..(82): Xaa can be any naturally occurring amino acid
  misc_feature (91)..(91): Xaa can be any naturally occurring amino acid
  misc_feature (96)..(96): Xaa can be any naturally occurring amino acid
  misc_feature (99)..(99): Xaa can be any naturally occurring amino acid
  misc_feature (101)..(101): Xaa can be any naturally occurring amino acid
  misc_feature (103)..(103): Xaa can be any naturally occurring amino acid
  misc_feature (105)..(106): Xaa can be any naturally occurring amino acid
  misc_feature (119)..(119): Xaa can be any naturally occurring amino acid
  misc_feature (121)..(121): Xaa can be any naturally occurring amino acid
  misc_feature (123)..(123): Xaa can be any naturally occurring amino acid
  misc_feature (127)..(127): Xaa can be any naturally occurring amino acid
  misc_feature (135)..(135): Xaa can be any naturally occurring amino acid
  misc_feature (142)..(142): Xaa can be any naturally occurring amino acid
  misc_feature (144)..(144): Xaa can be any naturally occurring amino acid
MASSMLSSXAXVTSPAQXTMXAPFTGLKXSAAFXXTRXXXNDITSFXXXGGRXSCMXXXPPVGKKKXXTLSYLPDLTEXELXKEVDYLLRXKWIPXVEXEXEXGXXYREHGSTPGYYDXRXWXMGKXPLFGCTDXAQVLKEXQXCKTEYPN

SEQ ID NO: 1355 - protein, 141 aa, Brassica napus
  misc_feature (138)..(138): Xaa can be any naturally occurring amino acid
MAVHGGDYLRRFVAETEWYNEVVLNAVAPGDWWRGLPHPVQSWMRNCVGGYLLYFISGFLWCFVIYYWKRHAYIPKDAIPTNEAMKKQIAVASKAMPFYCALPTLSEYMIESGWTRCYFNISEMGFSAYLCYMAMYLXFVE

SEQ ID NO: 1356 - protein, 120 aa, Brassica napus
MVKENEYYDILAVKTDASEADIKKAYYLKARNVHPDKNPGDPQAAKNFQVLGEAYQVLSNPEKRAAYDKYGKEGVQQDAMVDPAAVFGMLFGSEVFEEYVGQLALAYLASIEADLESYEP

SEQ ID NO: 1357 - protein, 171 aa, Brassica napus
  misc_feature (23)..(23): Xaa can be any naturally occurring amino acid
  misc_feature (32)..(33): Xaa can be any naturally occurring amino acid
  misc_feature (48)..(48): Xaa can be any naturally occurring amino acid
  misc_feature (162)..(162): Xaa can be any naturally occurring amino acid
LKTVLMLADQMLNRVEYMHIRGXLHRDIKPDXXLMGVGRRANQVYIIXYGLAKKYRDLQTHKHIPYRENKNLTGTARYASVNTHLGIEQSRRDDLESLGYMLMYFLRGSLPWQGLRAGTKKEKYDRISEKKRLTPVEVLCKSFPPEFTSYFLYVRSLRFEDXPDYSYLKRL

SEQ ID NO: 1358 - protein, 130 aa, Brassica napus
MDMLKKRRLDENGIGLLNDGHVTTISTRLTPHDARKIIDRFSNDQLLDILQEAVARHPDVLDLVRSTADSDISQRKLFIRGLAAETTTEGLRSLFSTYGDPEEAIVILDKVTAKSKGYGFVTFKHVDGAL

SEQ ID NO: 1359 - protein, 174 aa, Brassica napus
  misc_feature (138)..(138): Xaa can be any naturally occurring amino acid
  misc_feature (162)..(162): Xaa can be any naturally occurring amino acid
  misc_feature (167)..(167): Xaa can be any naturally occurring amino acid
MLLVSSVSSSLQAAMINFEFQNSFILFLLSFFSLLSFLGFFFFKKPKVDLESPPSPPSLPIIGHLHHFLSPLIHKCFQKISSKYGPYLHLRIFHLPIVLVSSASMASEIFKSHDVNISSRGLPPIDESLFFGETGFFXLPHGDYWKFMKKLLITKLLGPHAXERLRXVRAEELE

SEQ ID NO: 1360 - protein, 124 aa, Brassica napus
MQITPFSVFFSSVYDDESALMITISSAVVALLVVLLQWRLHRKKQRWKLPPGSMGWPYIGETLRLYTENPNSFFATRQNKYGEISKTHILGCPCVMISSPEAARMVLVSKAHMFKPTYPASKER

SEQ ID NO: 1361 - protein, 103 aa, Brassica napus
  misc_feature (12)..(12): Xaa can be any naturally occurring amino acid
  misc_feature (15)..(15): Xaa can be any naturally occurring amino acid
  misc_feature (22)..(22): Xaa can be any naturally occurring amino acid
  misc_feature (29)..(29): Xaa can be any naturally occurring amino acid
  misc_feature (34)..(34): Xaa can be any naturally occurring amino acid
  misc_feature (39)..(39): Xaa can be any naturally occurring amino acid
  misc_feature (49)..(49): Xaa can be any naturally occurring amino acid
  misc_feature (54)..(54): Xaa can be any naturally occurring amino acid
  misc_feature (58)..(58): Xaa can be any naturally occurring amino acid
  misc_feature (61)..(61): Xaa can be any naturally occurring amino acid
  misc_feature (69)..(69): Xaa can be any naturally occurring amino acid
  misc_feature (74)..(74): Xaa can be any naturally occurring amino acid
MASSMLSSAAVXTSXPAQVTMXAPFTGLXKTSAXFPVTXKANNDITSIXSNGGXVSCXKVXPPVGKKKXETPPXPPLTTRSLNCVEAHYLPLIFAISATPLSR

SEQ ID NO: 1362 - protein, 137 aa, Brassica napus
MYTLLLHGRRLVELQKWRNLRVSATLLQNASFSSPSDVSPRNGQNFTVSSYLVDSLGLTRKLADSISKKVTFEEKGHPDSVLTLLRTHGFTNSQISTIITDYPLLLVADADESLAPKLKLLQNRGASTSELTEVLSK

SEQ ID NO: 1363 - protein, 165 aa, Brassica napus
  misc_feature (162)..(162): Xaa can be any naturally occurring amino acid
HDVITNTLLHPIRIYLRAQGIIHPVTLASLSGAVFHLPANVFLVSYLRLGLTGVAVASSVTNLFVVAFLICYVRASGLHVPTWTDPTRDCFRGWAPLLRLAGPSCVSVCLEWWWYEIMIVLCGLLVNPRSTVAAMGVLIQTTSFLYVFPSSLSFAVSTRVGXELG

SEQ ID NO: 1364 - protein, 136 aa, Brassica napus
  misc_feature (120)..(120): Xaa can be any naturally occurring amino acid
  misc_feature (124)..(124): Xaa can be any naturally occurring amino acid
MGCCQSLCSDEHQPLGKDGAQPPQATQNHRGGATTADNGGAGGVAGGGIPSFSEFSFSDLKAATNNFSSDNIVSESGEKAPNLVYKGRLQNRRWIAVKKFTKMAWPDPKQFAEEAWGVGXFRHXRLANLIGYCCDG

SEQ ID NO: 1365 - protein, 148 aa, Brassica napus
MEVFGKSPMVSSANVIYLSAILGRDCDASHKCDWKCENENVFGNMYRCKLTGLTHVCDNNCNQRILYDNHTSLCRASGRVFPLSPAEEQAVRGVRRKLDNSESLPPTEGCSFKRRRRDVSQFKASPFERSFTAVSPICSPAGDGMDLS

SEQ ID NO: 1366 - protein, 118 aa, Brassica napus
  misc_feature (114)..(114): Xaa can be any naturally occurring amino acid
MMSGKRIAHLAKKWQRMAAQRRQRLTWGGAGAAAKQAGESCSSVASKGHCAVYTADWARFEVPLACLSTLVFRELLEMSQEEFGFSGGDGSGRITLPCDTAVMEYAMCLLRRSXSAEL

SEQ ID NO: 1367 - protein, 125 aa, Brassica napus
MDHLPVEVIGNILSRLRGARDVVIASATCRKWREAYRKHLHTLSFNSADSPFYRDLSTNRLEILITQTIFQTTGLQGLSVMMDDASKFSAATVIAWLMYTRDTLRWLSYNVRTTPNVNVLDICGR

SEQ ID NO: 1368 - protein, 174 aa, Brassica napus
  misc_feature (158)..(158): Xaa can be any naturally occurring amino acid
  misc_feature (164)..(165): Xaa can be any naturally occurring amino acid
SPTYPSSPSESPPIPSRRRRKEHGEMSSGMGKVVCVTGGSGYIASWLVKLLLHRGYTVRATVRDTADPKKTLHLQALDGAKDRLHLFKASLLEEGSFDAAIAGSDCVFHTASPFYHNVKDPKAELLDPAVNGTLNVLRSCKKASIKRVIITSSMAAVXYNGKPXXPDVVVDETG

SEQ ID NO: 1369 - protein, 98 aa, Brassica napus
  misc_feature (87)..(87): Xaa can be any naturally occurring amino acid
ARIVALNSSFFLKTGGHFNISIKVSSSTSVFILDMLINVHSSIVTQRIFLSCLQQANCIDSTVPAEAVFQSEVKKLQQEQFKPAEQXTLEPFERDHAC

SEQ ID NO: 1370 - protein, 166 aa, Brassica napus
  misc_feature (11)..(11): Xaa can be any naturally occurring amino acid
  misc_feature (19)..(19): Xaa can be any naturally occurring amino acid
  misc_feature (21)..(21): Xaa can be any naturally occurring amino acid
  misc_feature (31)..(31): Xaa can be any naturally occurring amino acid
  misc_feature (36)..(36): Xaa can be any naturally occurring amino acid
  misc_feature (39)..(40): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(48): Xaa can be any naturally occurring amino acid
  misc_feature (51)..(51): Xaa can be any naturally occurring amino acid
  misc_feature (55)..(55): Xaa can be any naturally occurring amino acid
  misc_feature (60)..(60): Xaa can be any naturally occurring amino acid
  misc_feature (63)..(63): Xaa can be any naturally occurring amino acid
  misc_feature (67)..(69): Xaa can be any naturally occurring amino acid
  misc_feature (75)..(76): Xaa can be any naturally occurring amino acid
  misc_feature (88)..(89): Xaa can be any naturally occurring amino acid
  misc_feature (91)..(93): Xaa can be any naturally occurring amino acid
  misc_feature (95)..(96): Xaa can be any naturally occurring amino acid
  misc_feature (100)..(102): Xaa can be any naturally occurring amino acid
  misc_feature (105)..(107): Xaa can be any naturally occurring amino acid
  misc_feature (115)..(115): Xaa can be any naturally occurring amino acid
  misc_feature (119)..(120): Xaa can be any naturally occurring amino acid
  misc_feature (139)..(139): Xaa can be any naturally occurring amino acid
  misc_feature (147)..(148): Xaa can be any naturally occurring amino acid
  misc_feature (151)..(151): Xaa can be any naturally occurring amino acid
  misc_feature (153)..(153): Xaa can be any naturally occurring amino acid
  misc_feature (155)..(156): Xaa can be any naturally occurring amino acid
  misc_feature (159)..(163): Xaa can be any naturally occurring amino acid
SEKKKKKKSVXASSMLSSXAXVTSPAHATMXAPFTXLKXXAXFPXTRXANXDITXIASNXGRXSCMXXXPPVGKXXVETLSYLPDLTXXEXXXEXXYLLXXXWIXXXEVELEHGXVYRXXGSTPVYYDGRYWTMWKLPXFGCTDSAXXLKXAXNXXGEXXXXXRDI

SEQ ID NO: 1371 - protein, 137 aa, Brassica napus
MLSLILHGRKSLELQRWRNLRFAVNPLQYSSAFSSASASLQDGRKGHNFTASYLVTSLGFTTKLAESISKKVSFEDNVNPQSVLSLLRGYGFRDSHISSIITNYPGLLTLDAERDLDPKLKFLKSRGASTSELTEIL

SEQ ID NO: 1372 - protein, 225 aa, Brassica napus
  misc_feature (37)..(37): Xaa can be any naturally occurring amino acid
  misc_feature (90)..(90): Xaa can be any naturally occurring amino acid
  misc_feature (150)..(150): Xaa can be any naturally occurring amino acid
  misc_feature (168)..(168): Xaa can be any naturally occurring amino acid
  misc_feature (183)..(183): Xaa can be any naturally occurring amino acid
  misc_feature (192)..(192): Xaa can be any naturally occurring amino acid
VDRSASSKPSSVVFGNAAVSRTAKFTPLLSNPKLDTXYYVELLGISVGGTRVPRVAASLFKLDQIGNGGVIIDSGTSVTRLVRPAYVAMXHAFRVGAKSLKRAPDYSLFDTCFDLSHQNEVKVPTVVLHFRGADVSLPATNYLIPVDTNXKFCFAFAGTMSGLSIIGXIQQQGFRVVYDLMGXRVGFAPRGXCLILTRPDPVRIMYFVSFFQISCIRRDLCFSDK

SEQ ID NO: 1373 - protein, 424 aa, Brassica napus
  misc_feature (396)..(396): Xaa can be any naturally occurring amino acid
GRPTRPGCGRNCLGACCLNGARLPLYSCKKLENSGTGEKLVISHEAREPPVAFLESLVLGEWEDRFQRGLFRYDVTACETKVIPGKYGFVAQLNEGRHLKKRPTEFRVDKVLQSFDGNKFNFTKVGQEELLFQFEAGEDSEVQFFPCMPLDAENSPSVVAINVSPIEYGHVLLIPRVLDCLPQRIDHKSLLLALHMAAEAANPYFRLGYNSLGAFATINHLHFQAYYLAMPFPLEKAPSKKMITTASGVKISELLSYPVRSLLFEGGSSMQDLSDTVSDACVCLQNNNIPFNILIADCGRQIFLMPQCYAEKQALGEVSPELLETQVNPAVWEISGHMVLKRKEDYEGASEENAWRLLAEASLSEERFKEVNALIFEAIGCSNQEERLEGILVANXSGSVNQTSNRTLGGPITNGTASECLVLQ

SEQ ID NO: 1374 - protein, 145 aa, Brassica napus
  misc_feature (135)..(135): Xaa can be any naturally occurring amino acid
MATNSAWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSXGGVHSRLGPA

SEQ ID NO: 1375 - protein, 149 aa, Brassica napus
SRIEIPPTTSVPLPFPPLARRLHADPGDMPRYDDRYGGTRLYVGRLATRTRSRDLEHLFGRYGRIREVELKRDYAFIEFSDHRDADEARYQLDGRDVDGSRIVVEFAKGVPRGSGGSREYMGRGPPPGTGRCFNCGVDGHWARDCKAGD

SEQ ID NO: 1376 - protein, 86 aa, Brassica napus
  misc_feature (7)..(7): Xaa can be any naturally occurring amino acid
  misc_feature (12)..(12): Xaa can be any naturally occurring amino acid
  misc_feature (15)..(15): Xaa can be any naturally occurring amino acid
  misc_feature (22)..(22): Xaa can be any naturally occurring amino acid
  misc_feature (34)..(34): Xaa can be any naturally occurring amino acid
  misc_feature (41)..(41): Xaa can be any naturally occurring amino acid
  misc_feature (54)..(54): Xaa can be any naturally occurring amino acid
  misc_feature (66)..(66): Xaa can be any naturally occurring amino acid
  misc_feature (69)..(69): Xaa can be any naturally occurring amino acid
  misc_feature (85)..(85): Xaa can be any naturally occurring amino acid
KRRQEVXVYSMXSSXAVVTSPXQATMVAPFTGLXSSSAFPXTRKANNDITSIVXNGGRVNCMQGWXPPXEKKKFETLSYLPDLTXS

SEQ ID NO: 1377 - protein, 111 aa, Brassica napus
  misc_feature (34)..(34): Xaa can be any naturally occurring amino acid
  misc_feature (36)..(36): Xaa can be any naturally occurring amino acid
  misc_feature (38)..(42): Xaa can be any naturally occurring amino acid
  misc_feature (48)..(50): Xaa can be any naturally occurring amino acid
  misc_feature (59)..(59): Xaa can be any naturally occurring amino acid
MAYSMLSSAAVVTSPAQATMVAPFTGLKSSSAFXVXRXXXXXFTSIVXXXRRVSCMPVXSLLSPVPPRRYPPVAPLFACALPARAFGPSAGLAFLPRLPPPARCRRRAFVS

SEQ ID NO: 1378 - protein, 120 aa, Brassica napus
METPNEIKASPGNNLRNRGAVGNDSKKDMIFRADRIDLKNLDIQLEKHLSRVWSRNIEKNPKPKEEWEIELAKLEMSNVIARGAYGIVYKGIYDGQDVAVKVLDWGEDGYATTAETSALR

SEQ ID NO: 1379 - protein, 232 aa, Brassica napus
LQQLGDLKIFKADLTDEGSFTSPISGCEYVFHVATPISFTSQDPEKDMIKPAIQGVINVLKSCLKSNSIKRVIYTSSAAAVSINSISEPGLVMTEENWSDIDFLRKEKPFNWAYPISKTLAEKAAYQFAEENNIDLVTVVPALIAGNTLIDDLPPSSLSLSMSLITRKEMHLNALKEMQKLSGSISFIHVDDLACAHLFLAEKETASGRYICCSYNPNIPELAHFLSKRYPR

SEQ ID NO: 1380 - protein, 181 aa, Brassica napus
IFHVATPISFTSQDPEKDMIKPAVQGVINVLKSCLKSNSIKRVIYTSSAAAVSINNLSEPGLVMTEENWSDVDFLTKEKPFNWGYPVSKTLAEKEAYKFAEENKIDLVTVVPALIAGNSLLSDPPSSLSLSMSLITGKEMHLSGLKEMQKLSGSISFIHVDDLARAHMFLAEKETASGRYI

SEQ ID NO: 1381 - protein, 123 aa, Brassica napus
MHDFCFTIPYGMLLMVGGSMGYFKKGSIASLAGGAGTGLLVLLAGFITLKAFEKKKKSPVFAVVLQTVISAGLTFVMGQRYLKTQKIMPAGLVSGISGLMTCFYLYKILTGGNHIPKTTTKAE

SEQ ID NO: 1382 - protein, 128 aa, Brassica napus
  misc_feature (2)..(2): Xaa can be any naturally occurring amino acid
  misc_feature (10)..(11): Xaa can be any naturally occurring amino acid
  misc_feature (22)..(22): Xaa can be any naturally occurring amino acid
  misc_feature (26)..(26): Xaa can be any naturally occurring amino acid
  misc_feature (35)..(35): Xaa can be any naturally occurring amino acid
  misc_feature (53)..(53): Xaa can be any naturally occurring amino acid
  misc_feature (65)..(65): Xaa can be any naturally occurring amino acid
  misc_feature (71)..(71): Xaa can be any naturally occurring amino acid
  misc_feature (83)..(84): Xaa can be any naturally occurring amino acid
  misc_feature (86)..(86): Xaa can be any naturally occurring amino acid
  misc_feature (93)..(94): Xaa can be any naturally occurring amino acid
  misc_feature (99)..(99): Xaa can be any naturally occurring amino acid
  misc_feature (101)..(102): Xaa can be any naturally occurring amino acid
  misc_feature (105)..(107): Xaa can be any naturally occurring amino acid
  misc_feature (111)..(111): Xaa can be any naturally occurring amino acid
MXSSMLSSAXXVTSPDQATMVXPFTXLKSSAAFPXTRKANNDITSIASNGGKXSCMKVRTPVGKXKFETLXLTFPDLTEVELXXEXDYPSPHXXIPCVXFXXEHXXXHRDXREAPPYAHVEFPTPSRF

SEQ ID NO: 1383 - protein, 177 aa, Brassica napus
  misc_feature (35)..(35): Xaa can be any naturally occurring amino acid
  misc_feature (65)..(65): Xaa can be any naturally occurring amino acid
  misc_feature (91)..(91): Xaa can be any naturally occurring amino acid
  misc_feature (135)..(135): Xaa can be any naturally occurring amino acid
  misc_feature (151)..(151): Xaa can be any naturally occurring amino acid
MAKTLSRSTASRVPNRLPVSTFSTIPPSPLPSHSXLISRRSSPSLLHAIGFIPDSTRLTTIRTRXMDRSGGSDSPLNSGSSFSDRAPTEMXAPLFPGCDYEHWLIVMDKPGGENATRQQNDRIAMFKSLPKVDGXEEEAKRRIYNVSCERXFGFGCQIDEDTSNKPEGIPGVLLVLP

SEQ ID NO: 1384 - protein, 161 aa, Brassica napus
  misc_feature (29)..(29): Xaa can be any naturally occurring amino acid
  misc_feature (151)..(151): Xaa can be any naturally occurring amino acid
MRTLLPSSPMLRYSQTPATVTASRRRFIXCGKRSDSSAVGSSRSDWQSSWAILSSKVVSQEQSESLLSSVNGHSNGSLNLVPFDNNSLAPNQQSKKTTPLSITDLSPAPMHGSNLRVAYQGVPGAYSEAAAGKAYPNCQAIPCDQFEVAFXQAVELWIADR

SEQ ID NO: 1385 - protein, 110 aa, Brassica napus
MNGPRGSSSLRSAFSYCVQQVRNYDYHHYLCLLELPPQMRKAAFALRAFNVETARAMDVASDPKIGLMRLLWWQEAIDKLYTKKTVNHPPALALSPVQALPLLFTYPPNP

SEQ ID NO: 1386 - protein, 132 aa, Brassica napus
NKERLAMMKKEAILVNCSRGPVIDEVALVDHLRENPMFRVGLDVFEEEPFMKPGLADMKNAIVVPHIASASKWTREGMATLAALNVLGRIKGYPILSDPNRVDPFLNENSSPPNASPSIVNSKALGLPVSKL

SEQ ID NO: 1387 - protein, 137 aa, Brassica napus
MEVEGKPQADGEWSTGFCDCLSDCSNCCMTFWCPCVIFGQIAEIVDQGSSSCGTTGALYMLLAWFTGCGCIYSCFYRTKMRKQYNLKGSECGDCLKHFFCELCALTQAYRELTNRGFDVALEPRSPVVLPPGGEVGC

SEQ ID NO: 1388 - protein, 123 aa, Brassica napus
MAVHAVRSPTTQLPSGISGNLSPSNRNPNAVIRFGRGSSKRNRLASLSASLREGDGRGKESSVRAVEVKKILEDSPLLPKPLSSNQLAETVSNGSRVRVAYQGVRGAYSESAAEKAYPNCEAV

SEQ ID NO: 1389 - protein, 138 aa, Brassica napus
NVMVIDLLGPSLEDLFNYCNRKLSLKTVLMLADQLINRVEYMHTRGFLHRDIKPDNFLMGLGRKANQVYIIDFGLGKKYRDLQTHRHIPYRENKNLTGTARYASVNTHLGVEQSRRDDLEAVGYVLMYFLKGSLPWQG

SEQ ID NO: 1390 - protein, 219 aa, Brassica napus
  misc_feature (28)..(28): Xaa can be any naturally occurring amino acid
  misc_feature (35)..(35): Xaa can be any naturally occurring amino acid
  misc_feature (42)..(42): Xaa can be any naturally occurring amino acid
  misc_feature (45)..(46): Xaa can be any naturally occurring amino acid
  misc_feature (57)..(57): Xaa can be any naturally occurring amino acid
  misc_feature (64)..(64): Xaa can be any naturally occurring amino acid
  misc_feature (69)..(69): Xaa can be any naturally occurring amino acid
  misc_feature (75)..(75): Xaa can be any naturally occurring amino acid
  misc_feature (78)..(79): Xaa can be any naturally occurring amino acid
  misc_feature (81)..(82): Xaa can be any naturally occurring amino acid
  misc_feature (91)..(91): Xaa can be any naturally occurring amino acid
  misc_feature (93)..(93): Xaa can be any naturally occurring amino acid
  misc_feature (97)..(97): Xaa can be any naturally occurring amino acid
  misc_feature (109)..(110): Xaa can be any naturally occurring amino acid
  misc_feature (113)..(113): Xaa can be any naturally occurring amino acid
  misc_feature (120)..(120): Xaa can be any naturally occurring amino acid
  misc_feature (123)..(123): Xaa can be any naturally occurring amino acid
  misc_feature (127)..(127): Xaa can be any naturally occurring amino acid
  misc_feature (132)..(132): Xaa can be any naturally occurring amino acid
  misc_feature (143)..(143): Xaa can be any naturally occurring amino acid
  misc_feature (147)..(147): Xaa can be any naturally occurring amino acid
  misc_feature (150)..(150): Xaa can be any naturally occurring amino acid
MISLIIRERKQLALQKWRNFRVSLYFLXNPSAFSXSFSSADXSPXXGKNFTVSYLVXSLGFTTXLAESXLRKVTXEDXXCXXDSVLTLLRXDXFTDXHLSTIIRTYPRXXSLXAESSLAXELXVLAXRGASXSELTEILSKVXKILXIKXDKALSRYYDFVREIITATDERYYSLAGEARGTNWGKRYWKGPPKGGSPPWSFSKQHVGGKKKLEKLLQK

SEQ ID NO: 1391 - protein, 190 aa, Brassica napus
  misc_feature (155)..(155): Xaa can be any naturally occurring amino acid
  misc_feature (189)..(189): Xaa can be any naturally occurring amino acid
ENSVLNISKHTEKERESRSERRMSSEEEKTVCVTGASGYIASWIVKLLLLRGYTVKASVRDPNDPRKTEHLLALEGAEERLQLFKANLLEEGSFDSAIDGCQGVFHTASPFYHDVKDPQAELLDPAVKGTINVLSTCLKTPSVKRVVLTSSIAAXAFNGMPRTPDTIVDESWFADPEYCRAAKLWYVLXK

SEQ ID NO: 1392 - protein, 181 aa, Brassica napus
  misc_feature (37)..(37): Xaa can be any naturally occurring amino acid
  misc_feature (119)..(119): Xaa can be any naturally occurring amino acid
LLSTACFDVLEFQSSVLSFRSSTSRLSAKTSGDASSXCLRKRCSSGSIGRLRVATEDASSLSTGDVADDYYAVLGLLPDATPEEIKKAYYNCMKSCHPDLSGNDPETTNFCMFINDVYXDEIHGYAVTATNPFLDDSSPKDHVFVDEFACIGCKNCANVAPDIFKIEEDFGRARACNQRGN

SEQ ID NO: 1393 - protein, 150 aa, Brassica napus
  misc_feature (46)..(46): Xaa can be any naturally occurring amino acid
AIVIPLTRFLLTQGLVLPLLYCAVTTLLFHISVCWILVFKFGLGSXGAALSISVSFWFYAVILACYVRFSTSCGMTRTFVSDDFVSCVKQFFHYGVPSAAMLCLEWWLFELLILSSGLLPNPKLETSVLSICLTTETLHYVISNGVAAAV

SEQ ID NO: 1394 - protein, 90 aa, Brassica napus
MDRLSSLPDELLYHILSLLPTKSAVVTSSLSKRWLNLWKLNPNLDIDDSLFIHPQHGKGESQHIRQSFVRFVDSVLAMQGDSPINTFSLK

SEQ ID NO: 1395 - protein, 136 aa, Brassica napus
  misc_feature (18)..(18): Xaa can be any naturally occurring amino acid
  misc_feature (22)..(22): Xaa can be any naturally occurring amino acid
  misc_feature (64)..(64): Xaa can be any naturally occurring amino acid
  misc_feature (84)..(85): Xaa can be any naturally occurring amino acid
  misc_feature (94)..(95): Xaa can be any naturally occurring amino acid
  misc_feature (97)..(98): Xaa can be any naturally occurring amino acid
  misc_feature (101)..(101): Xaa can be any naturally occurring amino acid
  misc_feature (115)..(115): Xaa can be any naturally occurring amino acid
RTNQQSRLRVDLGIQQLXYGSXGVMFGSGVGSKRQRMMQSNPPYGGFPVVRLRGLPFNCADVDXFKFFAGLDIVDVLLVSKNGXXSGEAFVVFXXPXXVEXALPRDRQNMGRRYXEVFRCYKQDYYNAVAAEEEEG

SEQ ID NO: 1396 - protein, 123 aa, Brassica napus
  misc_feature (35)..(35): Xaa can be any naturally occurring amino acid
HRTTITLLDTNELLLGKALQGGLLATGGAGVQVAXKFGVKFTEAPPGWEFCGSPAYVRQACEASLRRLGVDCIDLYYQHRIDTRLPIEITISLMGELKKLVGEGKIKYVGLSEASASTIRRAT

SEQ ID NO: 1397 - protein, 154 aa, Brassica napus
  misc_feature (115)..(115): Xaa can be any naturally occurring amino acid
MDLLNNPPTTTVGLSETFARLKSQRKVALIPYITAGDPDLSTTAKALKVLDSCGSDIIELGVPYSDPLADGPAIQAAARRSLLKGTNFNSIITMLKEVIPQLSCPIALFTYYNPXILRGGIENYMTIIKDAGVHGLLVPGGPSWAVLFLMFHLK

SEQ ID NO: 1398 - protein, 96 aa, Brassica napus
  misc_feature (91)..(92): Xaa can be any naturally occurring amino acid
MASSMLSSAAVVTSPAQAAMVAPFTGLKSSAAFPVTRKSNTDITSIASNGGRVSCMKVWPPVGKKKFETLSYLPDLTDVELAKEVDYLLRXXWIPC

SEQ ID NO: 1399 - protein, 190 aa, Brassica napus
  misc_feature (41)..(41): Xaa can be any naturally occurring amino acid
  misc_feature (52)..(52): Xaa can be any naturally occurring amino acid
  misc_feature (99)..(99): Xaa can be any naturally occurring amino acid
  misc_feature (154)..(154): Xaa can be any naturally occurring amino acid
WLPLCFPAAAVVTSPAQATMVAPFTGLKSSAAFPVTRQSKXNDITSIASNGXGELAGMKVWPPVGKKKFETLSYLPDPYRKLNGGKEVDYLLRNKWIPXCLNSSWEAPGFVYPWSTESTPGILTMGRYWDNVGSFPCSGCTGLCSKWLKEVQEXKRSTPNAFIRIIGFDNNRQVQCISFIAYKPPSFTGA

SEQ ID NO: 1400 - protein, 160 aa, Brassica napus
  misc_feature (15)..(15): Xaa can be any naturally occurring amino acid
  misc_feature (17)..(17): Xaa can be any naturally occurring amino acid
  misc_feature (21)..(21): Xaa can be any naturally occurring amino acid
  misc_feature (30)..(32): Xaa can be any naturally occurring amino acid
  misc_feature (34)..(34): Xaa can be any naturally occurring amino acid
MVSGLGSHRAAFPVXRXSITXITSIAATSXXXSXLKVWPPVGKKKFETLSYLPDLTDVELAKEVDYLLRNKWIPCVEFELEHGFVYREHGNTPGYYDGRYWTMWKLPLFGCTDSAQVLKEVQECKTEYPNAFIRIIGFDNNRQVQCISFIAYKPPSFTGA

SEQ ID NO: 1401 - protein, 181 aa, Brassica napus
  misc_feature (9)..(9): Xaa can be any naturally occurring amino acid
  misc_feature (12)..(12): Xaa can be any naturally occurring amino acid
  misc_feature (23)..(23): Xaa can be any naturally occurring amino acid
  misc_feature (37)..(37): Xaa can be any naturally occurring amino acid
  misc_feature (54)..(54): Xaa can be any naturally occurring amino acid
MAYSMLSSXAVXTSPAQATMVAXFTGLKSSSAFPVTXKANNDITSIVSNGGRVXCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 1402 - protein, 181 aa, Brassica napus
MASSMLSSAAVATSPAQATMVAPFTGLKSSAAFPVTRKSNTDITSIANNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 1403 - protein, 181 aa, Brassica napus
MAYSMLSSAAVVTSPAQATMVAPFTGLKSSSAFPVTRKANNDITSIVSNGGRVSCMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 1404 - protein, 127 aa, Brassica napus
  misc_feature (21)..(21): Xaa can be any naturally occurring amino acid
MGCFASKPTDSGGNRRKPTSXIGDVSVYVPGLRIPKPVEFSQSLGDQLPKTLVERLTALRTEIVVMANQEGPTITRTRRKTLHGGSTLADLHQALEDYLPVLLGLTNDGSQLQRKRKQPCQMKHRPH

SEQ ID NO: 1405 - protein, 99 aa, Brassica napus
  misc_feature (24)..(24): Xaa can be any naturally occurring amino acid
  misc_feature (94)..(94): Xaa can be any naturally occurring amino acid
MALVSLLDISIAFFCFLIFQIFLXISKKPHPSFLTNWPFLGMLPGLILEIPRVYDFITEVLEHGNLNYLFKGPFLGGLDMLFTVDPANIHHIMXSNFSN

SEQ ID NO: 1406 - protein, 149 aa, Brassica napus
MALPISGTRHLTRSLFPSTTLASPPKLPSTVRCGGFSSGRDSVGSRLPSSTRFTSIRCLANRSGSAYSPLNSGSNFSDRPPTEMAPLFPGCDYEHWLIVMDKPGGEGATKQEMIDCYVQTLAKVVGSEEEAKKRIYNVSCERYLGFGCE

SEQ ID NO: 1407 - protein, 211 aa, Brassica napus
  misc_feature (60)..(60): Xaa can be any naturally occurring amino acid
  misc_feature (80)..(80): Xaa can be any naturally occurring amino acid
  misc_feature (88)..(88): Xaa can be any naturally occurring amino acid
MAFRRNCGLELLVASLTLTLALIQLVEANSDGDALYALRQSLSDPDHVLQSWDPTLVNSXVTWFHVSCNQDNRVTRVDLXGNSNLSGXILHPELGKLEHLQYSESCNKNLKTLISFHFYNNNLTGKIPSSLGKLKSLVFLRLNDNKLTGPIPKELTKIASLKVVDVSNNDLCGTIPTEGPFAHIPLQNFENNSRLEGPELIGLASYDTNCN

SEQ ID NO: 1408 - protein, 114 aa, Brassica napus
MYSLTLHGTRSLVQLQKWRSFSVSVTLFQNTSTSVDVGPRDGPKGKSFTVSYLVGSLGLATKLAESISRRVSFEDKGNPDSVLSLFRSHGFTDSQISTIITDHPRLLLLDAEKA

SEQ ID NO: 1409 - protein, 104 aa, Brassica napus
MAASANPSGNNQEGSSAAAQKVSSSSAAAANGAAVNSVDNGLNSAVDNSQTISALRHNPGISVDWTHEEQSLLEDLLAKYASEPTIVRYAKIAMKMKDKTVRDV

SEQ ID NO: 1410 - protein, 136 aa, Brassica napus
  misc_feature (31)..(31): Xaa can be any naturally occurring amino acid
IGLRFMTLNPGTVPRMYHSTANLLPDGRILXAGSNPHYFYKFNAEFPTELRIEAFSPEYLSQDRANLRPELREIPQIVRYGEVFDVFVTVPLLVVETIQINWGSAPFATHSFSQGQRLVKLTVGPSIPDGEGRYRI

SEQ ID NO: 1411 - protein, 142 aa, Brassica napus
MTNQNVIVSDRNPILGSKTITVSVSNSPLFSSPPTYFTFPRRKFLELLEAADKNNNNKNNLGAGKISSWVDSMRDSSPTRLRSSSRDSDSDNDEKTSWIVRFPSALNMFDKIMNAAKGKQIVMFLDYDGTLSPIVEDPDKAY

SEQ ID NO: 1412 - protein, 141 aa, Brassica napus
MAPACSRINSLHVAVIGAGAAGLAAARELRRESHSVVVFERGTQIGGLWVYTPQTEPDPLSLDPNRTIVHSSVYDSLRTNLPRECMGYRDFPFVPRDDDGSRDPRRYPSHSEVLAYLQDFAREFKLEEMVRFETEVVCVEP

SEQ ID NO: 1413 - protein, 163 aa, Brassica napus
TSFDFMMSNNSNTLHGPFSSSSTSFSYLTSKEDALTQKKLKIGMNMDTNPEEDQDVLGVSKKASEDIEIGVFGAEKYFNGDMDSDHGSSLVSPSIERIFAGPKQSSKNSSETPSLRSESSWNSQSLLLQNKKKKNHNNSPSCNSYLQEKDVSTSNQKASSKKS

SEQ ID NO: 1414 - protein, 146 aa, Brassica napus
  misc_feature (51)..(51): Xaa can be any naturally occurring amino acid
  misc_feature (56)..(56): Xaa can be any naturally occurring amino acid
  misc_feature (67)..(67): Xaa can be any naturally occurring amino acid
  misc_feature (83)..(83): Xaa can be any naturally occurring amino acid
  misc_feature (104)..(104): Xaa can be any naturally occurring amino acid
  misc_feature (116)..(116): Xaa can be any naturally occurring amino acid
MAYSMLSSAAVVTSPAQATMVAPFTGLKSSSAFPVTRKANNDITSIVSNGXGRVSXALQVWPPIGKXKKFETLSYLPDPYRKXMGVREVDYLLRNKWDFLCVEXFELEQRDFVYRXEHGSTPELLTMGRYWTNGESFPLVRMHCSG

SEQ ID NO: 1415 - protein, 111 aa, Brassica napus
  misc_feature (77)..(77): Xaa can be any naturally occurring amino acid
MMNTSNGTISGPSSSSSPAANPQAPGIKTYFKTPEGKYKLHYEKTHSSGLLHYAHGKTVTQVTLAQLKERAAPSTPXGTSSGYSASSGFRSATARLLTGNGNRALSFVGGN

SEQ ID NO: 1416 - protein, 473 aa, Brassica napus
MSATLTGSGTALGFSCSSKISKRVSSSPSTRCSIKMSVSVDEKKKSFTLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTPEFINGLRQLTKDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHPMCGGYISGMFGFFFAEGPVYNFADAKKSDTEKFGKFFRGMLEEGVYFAPSQFEAGFTSLAHTSEDIQFTISAAERVLGRI

SEQ ID NO: 1417 - protein, 153 aa, Brassica napus
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNM

SEQ ID NO: 1418 - protein, 130 aa, Brassica napus
  misc_feature (38)..(38): Xaa can be any naturally occurring amino acid
  misc_feature (40)..(40): Xaa can be any naturally occurring amino acid
  misc_feature (42)..(42): Xaa can be any naturally occurring amino acid
  misc_feature (45)..(47): Xaa can be any naturally occurring amino acid
  misc_feature (50)..(50): Xaa can be any naturally occurring amino acid
  misc_feature (53)..(54): Xaa can be any naturally occurring amino acid
  misc_feature (57)..(57): Xaa can be any naturally occurring amino acid
  misc_feature (62)..(62): Xaa can be any naturally occurring amino acid
  misc_feature (64)..(64): Xaa can be any naturally occurring amino acid
  misc_feature (69)..(69): Xaa can be any naturally occurring amino acid
  misc_feature (71)..(71): Xaa can be any naturally occurring amino acid
  misc_feature (73)..(75): Xaa can be any naturally occurring amino acid
  misc_feature (78)..(78): Xaa can be any naturally occurring amino acid
  misc_feature (80)..(81): Xaa can be any naturally occurring amino acid
  misc_feature (83)..(83): Xaa can be any naturally occurring amino acid
  misc_feature (89)..(91): Xaa can be any naturally occurring amino acid
  misc_feature (93)..(93): Xaa can be any naturally occurring amino acid
  misc_feature (95)..(95): Xaa can be any naturally occurring amino acid
  misc_feature (99)..(101): Xaa can be any naturally occurring amino acid
  misc_feature (104)..(105): Xaa can be any naturally occurring amino acid
  misc_feature (109)..(110): Xaa can be any naturally occurring amino acid
IRFYSHRSYRERIAISGVHCILLTGDELLSDSFPYKEXEXGXLWXXXGKXTTXXCAXVNIGXEXLCCNXVXRXXXVDXSXXRXVDIVDXXXLXEXTDPXXXKEXXSAYXXKESWTPQNIETIQSFAPQGN

SEQ ID NO: 1419 - protein, 96 aa, Brassica napus
  misc_feature (53)..(53): Xaa can be any naturally occurring amino acid
MGWSCFNSTSCSYIDVEVEVSDECEERLKRLFDQALLIFLEEEGNNRPLPAVXGEGKTVDLFKLFVLVREGGGFDSVSRKGLWDSLAERLGLDCSV

SEQ ID NO: 1420 - protein, 120 aa, Brassica napus
  misc_feature (30)..(30): Xaa can be any naturally occurring amino acid
  misc_feature (32)..(32): Xaa can be any naturally occurring amino acid
  misc_feature (38)..(38): Xaa can be any naturally occurring amino acid
  misc_feature (41)..(41): Xaa can be any naturally occurring amino acid
  misc_feature (61)..(61): Xaa can be any naturally occurring amino acid
  misc_feature (71)..(71): Xaa can be any naturally occurring amino acid
  misc_feature (80)..(80): Xaa can be any naturally occurring amino acid
  misc_feature (95)..(95): Xaa can be any naturally occurring amino acid
  misc_feature (97)..(97): Xaa can be any naturally occurring amino acid
  misc_feature (109)..(109): Xaa can be any naturally occurring amino acid
VNKRLGNGPLLNHKRLVFEGFAICHVTLTXCXESFVTXLRXLKSLRFITLASLGIWGNIPXKLHRLTSLEXLDLSNKFLXGSVPPKFYTIVKLEXFXFDYNFFNGTLPXWSDSQKFLIWH

SEQ ID NO: 1421 - protein, 126 aa, Brassica napus
MVDVDRRMTGLRPSHAAGLRRLSARASAPTTPRVRNSLVSFSSLAHQVISHLHTSRIQVQPGLTDAEFARAEAEFSFSFPPDLRAVLAAGLPVGAGFPDWRSPGARLHLRAMIDLPVAAVGTYTPQ

SEQ ID NO: 1422 - protein, 159 aa, Brassica napus
MEPPKDQHTPEKSSTDPPSSAYPPSGCCTNCGGPTISEPSPLASLPEMSPPPNYRPIRAPAINLPHNSQAIILSPVPHAERVPVVSPPYQFERPVKRIHSPDDIRRFQESPSFKNFLGFVVSLSESIRGHKISDPCLVSPTVAAVVSILETLLQWIDEI

SEQ ID NO: 1423 - protein, 131 aa, Brassica napus
MAPSLSPIRSHHVAVIGAGAAGLVAARELRREGHSVVVFERQKQVGGTWIYTDHVEPDPLSVDPTRPVVHSSVYATLRTNLPRECMGYRDFPFVARSGDQRRFPSHGEVLAYLQEFAKEFAIEEVIRFETA

SEQ ID NO: 1424 - protein, 130 aa, Brassica napus
MALSLPISGTRHLTLLPLLSSSILVAPPQTSSSVNCSGFSSGCDVIGSRLACSTRFVSIRCRANRSGSAYSPLNSGSNFSDRPPTEMAPLFPGCDYEHWLIVMDKPGGEGATKQEMIDCYIQTLAKVVGR

SEQ ID NO: 1425 - protein, 114 aa, Brassica napus
MPRAGLSAGSSKVDVAIDLGNPLLNRTVDGFLKIGAVGAFRVAAEDAFDCLQSGSVSKRKLEKTLEKMCKEGAYWGAVAGVYVGMEYGVERVRGEYDWKNALIGGIASGALISA

SEQ ID NO: 1426 - protein, 147 aa, Brassica napus
MYPKLFNLHDNPYSVLKTMKNEKDQNVETKETSRIGEREREDEDEEEKRIDTFFKLIKSYQEARKRRREDLAENSGDVRKKTNVGEASGAVVPAFQPEDFSQCGTDVKPLMAVSDHKEGDVKVKEEEEEEAKEEEEEDKGLDLNLAL

SEQ ID NO: 1427 - protein, 142 aa, Brassica napus
SDDPTIWTWLPNDSPNEKGVEAAELNNVCWLDITGKFDTSNLTPGITYEVVFKVKLEDPAYGWDTPVNVKLVLPNGKDKPQEKKVSLREQPRYQWVDIKVGEFKHERDSVGEIIFSMYEHAAGVWKKGLFLKGVAIRPKYNN

SEQ ID NO: 1428 - protein, 141 aa, Brassica napus
RKSHAAHCVGTPEFMAPEVYEEAYNELVDIYSFGMCILEMVTFDYPYSECTHPAQIYKKVMSGKKPDALYMVKDPEVKYFIEKCLATVSLRVSARELLDDPFFRIDNGEFDLRSVDMDYPVAPPLVRQPHHHLADYYNRQY

SEQ ID NO: 1429 - protein, 141 aa, Brassica napus
MSASRFIKCVTVGDGAVGKTCLLISYTSNTYPTDYVPTVFDNFSANVIVDGNTINLGLWDTAGQEDYNRLRPLSYRGADVFLLAFSLVSKASYENVAKKWVPELRHYAPGVPIILVGTKLDLRDDKQYFVEHPGALPISTA

SEQ ID NO: 1430 - protein, 94 aa, Brassica napus
RLVDLPPQEEISGMGMSKVIRADQKRFFFDLGSNNRGHYLRISEVAGVDRSSIILPLSGLKQFHEMVGHFVDIMKDRLEGMTGANVRTVESSQR

SEQ ID NO: 1431 - protein, 166 aa, Brassica napus
MASTEQKEVEENGSMISGLLDKAKGFFAEKLANVPTPEAAVDNVDFKGVTRQGVDYHAKVSVKNPYSQTIPICQISYVLKSATRTIASGTIPDPGSLVGNKTTVLDVPVKVAYSIAVSLMKDIGSDWDIDYQLDIGLTFDIPVVGDITIPVSTQGEIKLPSLRDFF

SEQ ID NO: 1432 - protein, 132 aa, Brassica napus
MAVHTVRSPATHLHTGTSRNISPSHRNPNDAIRFSFRSPKLRRSISVSSSLREGNEHGKENSVRALEVKNIPEESPLLPKPLSSNQLAEPVSNGSRVRVAYQGVRGAYSESAAEKAYPNCEAVPCEEFDTAF

SEQ ID NO: 1433 - protein, 84 aa, Brassica napus
PSLGACSFRATRGEIQELPAMVKDSAYYDVLGLSVDASPAEIKKAYYIKAKLVHPDKNPGNPDAALKFQELGEAYQVLSDPGKK

SEQ ID NO: 1434 - protein, 123 aa, Brassica napus
MGGVTSSMAAKLAFFPPNPPSYKIIRDEATELLLMDPFPHRENVDVLRLPTRRGTEIVAMYIRYPMAVTTLLYSHGNAADIGQMYELFIELSIHLRVNLMGYDYSGYGQSSGKPSEQNTYADI

SEQ ID NO: 1435 - protein, 124 aa, Brassica napus
MDEEAAKPRDTTINQQQQYYYGTFQGVANYPPPAPPPLPHQPIVTSPLLPPVHGHGGGFVNYAQGYPVVPEYTVVEVRPVREHDVPCCGFGMGWFLFIMGFLFGGIPWYLGAVIILFTSVDHPV

SEQ ID NO: 1436 - protein, 87 aa, Brassica napus
  misc_feature (20)..(20): Xaa can be any naturally occurring amino acid
  misc_feature (22)..(22): Xaa can be any naturally occurring amino acid
  misc_feature (32)..(32): Xaa can be any naturally occurring amino acid
  misc_feature (40)..(40): Xaa can be any naturally occurring amino acid
  misc_feature (44)..(44): Xaa can be any naturally occurring amino acid
  misc_feature (47)..(48): Xaa can be any naturally occurring amino acid
  misc_feature (55)..(56): Xaa can be any naturally occurring amino acid
  misc_feature (59)..(60): Xaa can be any naturally occurring amino acid
  misc_feature (64)..(65): Xaa can be any naturally occurring amino acid
  misc_feature (69)..(70): Xaa can be any naturally occurring amino acid
  misc_feature (72)..(73): Xaa can be any naturally occurring amino acid
MPSSTFSGTVSSPKLSVAVXTXNPFLNLTVDXFLKIGAVXVTKXSLXXDTYKAIXXGKXXPRAXXEHVXXRXXALKVLWPALWQGSL

SEQ ID NO: 1437 - protein, 323 aa, Brassica napus
  misc_feature (38)..(38): Xaa can be any naturally occurring amino acid
  misc_feature (60)..(60): Xaa can be any naturally occurring amino acid
  misc_feature (70)..(70): Xaa can be any naturally occurring amino acid
  misc_feature (78)..(78): Xaa can be any naturally occurring amino acid
  misc_feature (80)..(80): Xaa can be any naturally occurring amino acid
  misc_feature (116)..(116): Xaa can be any naturally occurring amino acid
  misc_feature (124)..(124): Xaa can be any naturally occurring amino acid
LVDGGGGGFSGGRGGGGFSGGRSGGRGRAGGRGFGGAXGGRGGRRGRGMRGREERGRSGXGAPEPGRMKXVTKVIVEXPXHPGVFFSRGWEDPLVNKSLVPGLRLYTTRRGISVQXNEDGTMLXLGGVDPFYIKVGVIVLYLGAASGTTVSHVSDIVGPEGCVYAVEFSHRSGRDLVNMAKKRTNIIPIIEDARHPAKYRMLVGMVDVVFADVAQPDQARIVALNSSFFLKTGGHFIISIKANCIDSTVPAEAVFQSEVKKLQQEQFKPAEQVTLEPFERDHACVVGTYRAPKKTKVAAYKFLPCVGIWFVFFFRFFYPVLRL

SEQ ID NO: 1438 - protein, 107 aa, Brassica napus
  misc_feature (46)..(46): Xaa can be any naturally occurring amino acid
MAEDRNSGNNTLDPLLQYMTIPRMREPPPILFPVPEEGEVAIPMPXTPKEVKDRLIFGPFSGSPGGLLLSGIRLPPLKKPFFSPATATGGRRRPGKKFPKALKPAEP

SEQ ID NO: 1439 - protein, 103 aa, Brassica napus
MSVTAGVSEAALATRAKLRGGIGQTKVKRYWPGKAPEWADEPEEDEDVRMQKVDALDRKHDDLGVARKDDSRLRRLAQTRAENREEVRADHRRVRQAEIVSTE

SEQ ID NO: 1440 - protein, 104 aa, Brassica napus
MAANAGAGAGGSKIRNAKLVLLGDVGTGKSSLVLRFVKGQFVEFQESTIGAAFFSQTLAVNDETVKFEIWDTAGQERYHSLAPMYYRGAAAAIVVYDITNAASF

SEQ ID NO: 1441 - protein, 242 aa, Brassica napus
VDPRVRLVRLLGCCIDGEEKLLIYEFMVNKSLDSFLFDSTLKLQIDWPKRFNIIEGVARGLLYLHRDSCLKVIHRDMKVSNILLDENMNPKISDFGLARMFQGTQHQDSTLRVVGTIGYMSPEYAWTGMFSEKSDIYAFGVVLLEIISGMKISSFNCGKEGKTLLEYAWESWLETDGVDLLDQDIASSCSPVEVARCVQIGLLCIQQQAVDRPNIAQVVFMITTTTDLSRPKPPVFALQIHD

SEQ ID NO: 1442 - protein, 167 aa, Brassica napus
MDQTKGKVCVTGASGFLASWLVKRLLIEGYEVTGTVRDPGNEKKAAHLWKLEGAKERLRLVEADLMEDGSFDNAIMGCHGVFHTASPVLKPTSNPEEEILKPAIEGTLNVLRSCRKNQSLKRVVLTSSSSTVRIRDDFDPNIPLDESVWTSVELCKRFQVWYALSKT

SEQ ID NO: 1443 - protein, 212 aa, Brassica napus
  misc_feature (109)..(109): Xaa can be any naturally occurring amino acid
  misc_feature (205)..(205): Xaa can be any naturally occurring amino acid
NTLKSSPPRARAHQKKNVCSNTHGGFSHEELRITTRIMSATASPMADFLTKSPYTPPPWASHLRPLPSHTFSLAHRPTPIHRWNLPNLPNGTELWIKRDDFTGMELSGXNKVRKLEFLMADAVEQQADTVITIGGIQSNHCRATPVASNYLNLHTHLILRTSKLLADGDPGLVGNFLVERLVGANVHLISKEEYSSIGSEALTSXLKEKLEK

SEQ ID NO: 1444 - protein, 160 aa, Brassica napus
NSKSRKALSKVAIDLIVQKRRHRRYCPPTTMIYRGYGDGSEMGPKRQRMIEQAPPPVTFYGPHPGSAFMFNPYGFVPPLPVFPVVRLRGLPFDCAELDVVEFFRGLDVVDVLFVHKNNKVTGEAFCVLGVPLQVDFALHKNRQNMGRRYVEVFRSTKQEY

SEQ ID NO: 1445 - protein, 93 aa, Brassica napus
MLYVFELWIVIVSLLVLNLCHWIYQWRNPKCNGKLLPGSMGFPIIGETFEFMKPNDVLQFPSFGKKRVIRHGPGFWTSLLGSKVIISMDIELN

SEQ ID NO: 1446 - protein, 160 aa, Brassica napus
  misc_feature (122)..(122): Xaa can be any naturally occurring amino acid
  misc_feature (150)..(150): Xaa can be any naturally occurring amino acid
MFSSILNTRRSRELHQWRNLISPLSNLLLPQASPALASPFSSATASDPTPEDERKRKSFTVHYLINSLGLTPKLAESISSKANFDSKQNPDSVLKLLRSYGFADPQISTIIATYPRFLVENXEKTLRAKLHFLKLNGASSSEITEIVSKXPKILGKRGHV

SEQ ID NO: 1447 - protein, 96 aa, Brassica napus
QTEGSFIPRNNVEEAILLLMLLLRKVNQKRISWDASILDHLSFALTMAGDLTALAKQLEELSPEILDQRELYHTLSLCYHGAGEGLVALGLLRKLF

SEQ ID NO: 1448 - protein, 121 aa, Brassica napus
MVNQAPQDDYDDEKSARQKEIEDWLPITSSRNAKWWYSAFHNVTAMVGAGVLGLPYAMSQLGWGPGVAVLVLSWVITLYTLWQMVEMHEMVPGKRFDRYHELGQHAFGEKLGLYIVVPQQL

SEQ ID NO: 1449 - protein, 52 aa, Brassica napus
MSGAGKKVADVAFKASRTIDWEGMAKVLVTDEARREFSNLSFYLFFGFKNYI

SEQ ID NO: 1450 - protein, 113 aa, Brassica napus
  misc_feature (102)..(102): Xaa can be any naturally occurring amino acid
SDFFLFKKFVKAKKDGIVTVVCVFVYTLIGMDLWKGKQVHSHVYRVLDPFRDEVVVVVGGFISGPDISIELVKVAKEVHVSVKSLDVSPGVSKAITKHQSLXLQPQIESLEED

SEQ ID NO: 1451 - protein, 164 aa, Brassica napus
  misc_feature (149)..(149): Xaa can be any naturally occurring amino acid
MDSSQYDGVYQPLLYPPADGTVPLSPSTESSNGELERVLSDVETPFFHRLREATMIESKLLFKLAAPAVIVYMIGNLELAAASLGNTGIQISAYGLMLGMGSAVETLCGQAFGGRKYEMLGIYLQRSTVLLTLTGLLLTLIYVFSKPIXLLFLGESPEIASAAS

SEQ ID NO: 1452 - protein, 89 aa, Brassica napus
  misc_feature (53)..(53): Xaa can be any naturally occurring amino acid
MSASRFVKCVTVGDGAVGKTCLLISYTSNTFPTDYVPTVFDNFSANVVVNGSXTVNLGLGDTARREGYNRLRPLGYRGAEVFILAFFLI

SEQ ID NO: 1453 - protein, 141 aa, Brassica napus
  misc_feature (139)..(139): Xaa can be any naturally occurring amino acid
MGTCSSSESRRTETAKLILPDGTLQEFSSPVKVWQILQKNPTSFVCNSDDMDFDDAVVAVGGSEDLRPGELYFVLPLTWLNHPLRAEQMAALAVKASSALTKSGWSCSHEGEGRRVSGGECRVKRVKRNGCGGRGCGGXGR

SEQ ID NO: 1454 - protein, 112 aa, Brassica napus
MGEEKSLLQFRSIPSLKTSDFALTTEPSWRLPSRGNTRSGGVLSNFASLSVAIRRDRRESGGAFASVSVVIPTKEEDDVFAPTSAQLLKNPVALLSFVPKDAALSFAGAFAG

SEQ ID NO: 1455 - protein, 73 aa, Brassica napus
MYSLILHVKRSNTELQKLVFSSATTLSRKGQNFTVSTYLIESLGFTTKLAESISKKVSFEDQGINPDSVLTLF

SEQ ID NO: 1456 - protein, 149 aa, Brassica napus
  misc_feature (11)..(11): Xaa can be any naturally occurring amino acid
  misc_feature (16)..(16): Xaa can be any naturally occurring amino acid
  misc_feature (35)..(35): Xaa can be any naturally occurring amino acid
  misc_feature (45)..(45): Xaa can be any naturally occurring amino acid
  misc_feature (47)..(47): Xaa can be any naturally occurring amino acid
  misc_feature (52)..(52): Xaa can be any naturally occurring amino acid
  misc_feature (60)..(60): Xaa can be any naturally occurring amino acid
  misc_feature (62)..(62): Xaa can be any naturally occurring amino acid
  misc_feature (65)..(65): Xaa can be any naturally occurring amino acid
  misc_feature (79)..(79): Xaa can be any naturally occurring amino acid
  misc_feature (89)..(89): Xaa can be any naturally occurring amino acid
  misc_feature (91)..(91): Xaa can be any naturally occurring amino acid
  misc_feature (93)..(93): Xaa can be any naturally occurring amino acid
  misc_feature (98)..(98): Xaa can be any naturally occurring amino acid
  misc_feature (102)..(102): Xaa can be any naturally occurring amino acid
  misc_feature (108)..(108): Xaa can be any naturally occurring amino acid
  misc_feature (115)..(116): Xaa can be any naturally occurring amino acid
  misc_feature (126)..(126): Xaa can be any naturally occurring amino acid
  misc_feature (130)..(130): Xaa can be any naturally occurring amino acid
MASSMLSSAAXGTSPXQATMVAPFTGLKTSAAFPXTRKANNDITXIXSNGGXVSCMKVWXPXGKXKFETLSYLPDLTEXVELGKEDDYXLXAXRGIPXVEFXLEHGFXVYREHEXXPRNYDGRYWXTMGXLPLVKLTLLGKGPKREKGP

SEQ ID NO: 1457 - protein, 93 aa, Brassica napus
MNPRREPRGGRSALFDGIEEGGIRAASSSSYTSHEINEHENERALEGLQDRVILLKRLSGDINEEVDAHNRMLDRMGNDMDSLRGILSGTMDR

SEQ ID NO: 1458 - protein, 133 aa, Brassica napus
MAGGGFVVGDGQKPYPGKLTPFVLFTCVVAAMGGLIFGYDIGISGGVTSMPSFLRRFFPSVYRKQQEDATTNQYCQYDSPTLTLFTSSLYLAALISSLVASTVTRKFGRRLSMLFGGILFCAGALINGFAKHV

SEQ ID NO: 1459 - protein, 154 aa, Brassica napus
MDEESKVKIEETVREILNESDMTEMTEFKVRNLASERLGIDLSDKSHKAFVRGIVKSFLEEVESKQQQQQEEDEEEEDRAKEGNKELDDDGDLIICRLSDKRRVTIQEFRGKSLVSIREYYKKDGKELPSSKGISLTDEQWSTFKKNIPAIEDA

SEQ ID NO: 1460 - protein, 143 aa, Brassica napus
MGGGFFVTDSSHREEYEEGGVTSFVVIACIVAAMGGLLFGYDIGISGGVTSMEEFLTRFFPDMQRQMQNETGRETEYCKYDNELLTLFTSSLYLAALFASFLASSITRLFGRKVSMTIGGLAFLSGALLNGFAISLEMLIIGR

SEQ ID NO: 1461 - protein, 244 aa, Brassica napus
  misc_feature (217)..(217): Xaa can be any naturally occurring amino acid
  misc_feature (227)..(228): Xaa can be any naturally occurring amino acid
  misc_feature (236)..(236): Xaa can be any naturally occurring amino acid
MAAAACGQLNLEEPTPIRGSRSVDCFEKLEQIGEGTYGQVYMAKDIKTGEIVALKKIRMDNEREGFPITAIREIKILKKLHHENVIHLKEIVTSPGRDRDDQGKPDNNKYKGGIYMVFEYMDHDLTGLADRPGLRFTVPQIKCYMKQLLTGLHYCHVNQVLHRDIKGSNLLIDNEGNLKLADFGLARSYSHDHSGNLTNRVITLWYRPPELLSGATXYGPAIDMWSXXCIFAELLXGKPICLAN

SEQ ID NO: 1462 - protein, 132 aa, Brassica napus
  misc_feature (102)..(102): Xaa can be any naturally occurring amino acid
MAVLSFQSPTNFSASAIPGSSRRRFDSTAGSPSSFTGDGPISSMILRFPPNFVRQLSIKARRNCSNIGVAQIVAAKWSNNPSSGLQSAAAAASSVSAAASAXAAAVTPPVVALNGVDEEVVAAEGAGEIGLK

SEQ ID NO: 1463 - protein, 170 aa, Brassica napus
MELNFLSRALSSFILVLTILASFSSSSFISDGVFEPQNLAIGRNLLQTKKACPVNFEFMNYTIITSLCKGPKFPAKECCGAFKDFACPYADDLSDLSNDCATTMFSYINLYGKYPPGLFANQCQEGKEGLECPATSPTSASDVNAATTTAASSRLWLAASAAFLVFVKLL

SEQ ID NO: 1464 - protein, 102 aa, Brassica napus
  misc_feature (84)..(84): Xaa can be any naturally occurring amino acid
  misc_feature (86)..(86): Xaa can be any naturally occurring amino acid
  misc_feature (88)..(89): Xaa can be any naturally occurring amino acid
  misc_feature (91)..(95): Xaa can be any naturally occurring amino acid
MESDLGKLFIGGISWDTDEERLREYFTNYGDVVEAVIMRDRATGRARGFGFIVFADPSVAERVILEKHIIDGRTVEAKKAVPRXHXHXXLXXXXXIAVHLFL

SEQ ID NO: 1465 - protein, 142 aa, Brassica napus
MKAAVFRNEAGDEEEEEESVCNVFDGDVETTSSHDTKNNLKGFFTSLLLMEEHEKQDQEARTVASRRELSEFQSNYRKRARTMSEYYSDLNAHYEENGDIKTKKPRASRASRAVACVSAAATECFELEGESSEITGSGSAGT

SEQ ID NO: 1466 - protein, 152 aa, Brassica napus
MFKKIMKGGHKKPSKSESNEPSSYNLGGSNVVVSHASRGALAPPSQVTTATPPPPITSVTPLPLFRDVPVSERQSLFLRKLQNCCFHFDFTDTTKIVREKEIKRQTLLELVDFIQSGASKIISESCQEEMIKMVSLNLFRCLPPASHENTGQ

SEQ ID NO: 1467 - protein, 82 aa, Brassica napus
MEAEKIPPATTTTEKKPEQEVKNDDLPTNSPYVDESGSLEDYKMKAYGAQGHQEVKAGLGGGSTDAPTPSGGVTTATAEKAP

SEQ ID NO: 1468 - protein, 132 aa, Brassica napus
MELNFLSRALLVSLLLAIVSSFSSSTVISDGVLESQDLVIGRNLLQAKKKCSLNLEFMNYTIITSQCKGPKFPAKECCSSFLEFACPYAEQLNDLSTDCASTMFSYINIYGKYPAGLFSSQCIWEIPGWTFR

SEQ ID NO: 1469 - protein, 163 aa, Brassica napus
  misc_feature (151)..(151): Xaa can be any naturally occurring amino acid
MAAATRRLIQRVSTTRLSTAGARRSYGGLPESNSKAPSSSSSQRLMELESKFSAHNYHPVPVVFSRGNGSTIWDPEGKKYIDFLAAYSAVNQGHCHPKIIKALQEQVEKLTLSSRAFYNDKFPVFAERLTNMFGYEMVLPMNTGAEGVETXLKVARKWGHEKN

SEQ ID NO: 1470 - protein, 148 aa, Brassica napus
RSFFPFDLGLLQLLCAFWARSPRRRSRAVDEFVVVAVRGVTSSSAASLAVVPPPPPPLGSLSARRPPLLPLSFPAVPPPPPVDVLKLRTRRGNEIVAIYVKHPKANGTLLYSHGNAADLGQMFELFVELSSRLRLNLMGYDYSGYGQS

SEQ ID NO: 1471 - protein, 93 aa, Brassica napus
  misc_feature (18)..(18): Xaa can be any naturally occurring amino acid
MDPQAFIRLSVGSLALRXPKYLLNPASTSDEKKNSCSQCSCEIKLRGFPVQTTSIPLMPSLDAAPDHHSVSTSFYLEESDLRALLTPGCFYNP

SEQ ID NO: 1472 - protein, 155 aa, Brassica napus
  misc_feature (147)..(147): Xaa can be any naturally occurring amino acid
  misc_feature (149)..(149): Xaa can be any naturally occurring amino acid
  misc_feature (151)..(151): Xaa can be any naturally occurring amino acid
MGDEDRAILTFHRMPSLNSSILTSSPSKSSTVQFRHRVLRSSAPGDVGFGSKFACITMAEKCEQREFSPTPAQLLSNPLAILALVPKDAAIFAAGAIAGAAAKTVTAPLDRIKLLMQTHGIRIGHQSAKKAIGFVEAITLIGKEGRXRXFXRLSM

SEQ ID NO: 1473 - protein, 114 aa, Brassica napus
  misc_feature (108)..(108): Xaa can be any naturally occurring amino acid
  misc_feature (111)..(112): Xaa can be any naturally occurring amino acid
MSLFRIFINQDDDDDDMATSKKVITREEWEKKLNAVKLRKEDMNTLVMNFLVTEGYVDAAAKFQRESGTKPEIDLATITDRMAVKKAARGDLCAGALREEQQWAPEIXGAXXRK

SEQ ID NO: 1474 - protein, 155 aa, Brassica napus
NNRSRSEKFNPHPEEVASGFPIDPPRSSSQAFEPNRESQGNIMVPHKRASHSSPLTRRSASAKGGRRNYQDPSQKVLSIAAADYSAIPGFAATRTSASQQETCRGMTRLPGSFKETSEEANQEENGRSNKKDSVLLGYGSKGHKIHYSGPLVVPS

SEQ ID NO: 1475 - protein, 166 aa, Brassica napus
MILLTETAAGFALFRVMRDNVELQDLENEFSTLESAQEMVALIGFKKFEDTDEAHLEISRVVFDLAISEDFLNFLRANCQQHEILGVAYQPLARAIHVKSLNTEHTIICECSPRTMALGRGVRLQLAGLIDDQNLDTLTRSLSHSIAVQNFRSLSHSIGVQNYGPA

SEQ ID NO: 1476 - protein, 148 aa, Brassica napus
  misc_feature (6)..(6): Xaa can be any naturally occurring amino acid
  misc_feature (12)..(12): Xaa can be any naturally occurring amino acid
  misc_feature (14)..(14): Xaa can be any naturally occurring amino acid
  misc_feature (17)..(20): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (42)..(42): Xaa can be any naturally occurring amino acid
  misc_feature (47)..(48): Xaa can be any naturally occurring amino acid
  misc_feature (53)..(56): Xaa can be any naturally occurring amino acid
  misc_feature (59)..(59): Xaa can be any naturally occurring amino acid
  misc_feature (68)..(68): Xaa can be any naturally occurring amino acid
  misc_feature (71)..(71): Xaa can be any naturally occurring amino acid
  misc_feature (73)..(73): Xaa can be any naturally occurring amino acid
  misc_feature (77)..(77): Xaa can be any naturally occurring amino acid
  misc_feature (99)..(99): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(107): Xaa can be any naturally occurring amino acid
  misc_feature (109)..(109): Xaa can be any naturally occurring amino acid
  misc_feature (111)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (119)..(119): Xaa can be any naturally occurring amino acid
  misc_feature (126)..(126): Xaa can be any naturally occurring amino acid
  misc_feature (128)..(128): Xaa can be any naturally occurring amino acid
  misc_feature (131)..(131): Xaa can be any naturally occurring amino acid
  misc_feature (139)..(139): Xaa can be any naturally occurring amino acid
  misc_feature (144)..(144): Xaa can be any naturally occurring amino acid
KREQVXASSMFXSXAVXXXXAQATMVAPFTGXLKSSXAXPVXRKANXXITSIXXXXGRXSCMKVWPPXGKXKXESLXYLPDLTEVELGKEVDYLLRNKXIPXVEXEXEXGXXYXEXGSXPGYYDGXYXTMXNLPLVGCXDSAQXLEGS

SEQ ID NO: 1477 - protein, 254 aa, Brassica napus
MARKFFVGGNWKCNGTAEEVKKIVNTLNEAQVPSQDVVEVVVSPPYVFLPLVKSILRPDFYVAAQNCWVKKGGAFTGEVSAEMLVNLNIPWVILGHSERRALLNETNEFVGDKVAYALAQGLKVIACVGETLEQREAGSTMDVVAAQTKAIADRVSNWPNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 1478 - protein, 129 aa, Brassica napus
MIVKANAGTVTNFEVLDLLNSKGASKDTTRVMGLKDKVSSSEYKVYDYLMETAASTQTRESVTKFSDKCKDFKLVKAEILNIINLRPSSDVELTPIIEKPDEREIDTEGILELVQQLLPPLPTLESEQE

SEQ ID NO: 1479 - protein, 121 aa, Brassica napus
MAIRSKETEEENKRINEIDEPEEDEDKKMEMFFNLIRNYQEARKRRRQELIEDSGETAPNPTKRSDNGEKSGVAPPVFRAEDFTHCIDLNLEPIVSTEEEKQEEEEEETREENVLDLNLAL

SEQ ID NO: 1480 - protein, 139 aa, Brassica napus
  misc_feature (47)..(47): Xaa can be any naturally occurring amino acid
  misc_feature (72)..(72): Xaa can be any naturally occurring amino acid
VALRASSARASANNHKGYDQSHSRPVYGHISTLESPVAMVGFFEGLXKSKKGQNGLGSFLGHKKKEETKRGXKGEGYENIRRQHQKTQKEIKRVDNCLKTIKRREKKKNKNKKKKKKKKNSGGHGSGNESGSSSGSDSD

SEQ ID NO: 1481 - protein, 119 aa, Brassica napus
  misc_feature (26)..(29): Xaa can be any naturally occurring amino acid
  misc_feature (31)..(32): Xaa can be any naturally occurring amino acid
  misc_feature (37)..(37): Xaa can be any naturally occurring amino acid
SLSMSYKAPRRCSNGRNFGVERHQDXXXXIXXTRPYXKKGPNKWSRNLVWTASDGNKPRKNGNTYGSTKSQVSGTAASVSQQRKNAGYGQVSDTRGWGSSNRGSPKSKECVCKFWKAGN

SEQ ID NO: 1482 - protein, 63 aa, Brassica napus
MAGHKIAHATLKGPSVVKELVIGLALGLAAGGMWKMHHWNEQRKTRAFYDLLDKDEISVVVAE

SEQ ID NO: 1483 - protein, 117 aa, Brassica napus
  misc_feature (108)..(108): Xaa can be any naturally occurring amino acid
  misc_feature (110)..(110): Xaa can be any naturally occurring amino acid
MPVLYEQDKHVSSAIMTGQERGVLRCQERTSLLHHWKLTKEQIDLVDKAGFGWFRLIGSISLNNSLISALVERWRRETNTFHFPCGEMTITLDEVSLILGLAVDGKPXVXGGKERNE

SEQ ID NO: 1484 - protein, 119 aa, Brassica napus
  misc_feature (68)..(68): Xaa can be any naturally occurring amino acid
  misc_feature (94)..(94): Xaa can be any naturally occurring amino acid
  misc_feature (105)..(105): Xaa can be any naturally occurring amino acid
  misc_feature (109)..(109): Xaa can be any naturally occurring amino acid
  misc_feature (111)..(112): Xaa can be any naturally occurring amino acid
  misc_feature (115)..(115): Xaa can be any naturally occurring amino acid
MKALRRIHTSTSSGNSSSPLPSSTSLLSTSSTSPPSSNSSSSSSSASSSSWIHLRPVLFVANLSSPSXVRQWRSLSTPEGKLRDGGVGFLKRVXESRGVDPSIPXQKFXSXXLGXYEFE

SEQ ID NO: 1485 - protein, 86 aa, Brassica napus
  misc_feature (11)..(11): Xaa can be any naturally occurring amino acid
  misc_feature (13)..(13): Xaa can be any naturally occurring amino acid
  misc_feature (52)..(52): Xaa can be any naturally occurring amino acid
  misc_feature (61)..(61): Xaa can be any naturally occurring amino acid
  misc_feature (72)..(72): Xaa can be any naturally occurring amino acid
YLGFGCEIDEXTXTKLEGLPGVLFVLPDSYVDPENKDYGAELFVNGEIVQRXPERQRRVEXQPQRAQDRPRXNDRTRYSRRRENTR

SEQ ID NO: 1486 - protein, 120 aa, Brassica napus
MNYRRENRASRTSLFDGLDGLEEGRLRASSSYSHDTTERDNDEALESLQDRVSFLKRVTGDIHEEVESHNRMLDKVGNKMDSARGIMSGTINRFKLVFEKKSNRKTCKLIGYFVLLFLVM

SEQ ID NO: 1487 - protein, 166 aa, Brassica napus
MAETEQKEVEEKGSLISGLLDKAKGFFAEKLANIPTPEATVDDVHFKGVTRQGVDYHAKVSVKNPYPQHIPICQISYILKSDTRMIASGTIPDPGSLIANGSTVLDVPVKVPYSIAVSLMKDMCLDWDIDYQLDIGLTIDIPIVGDITIPVSTQGEDKLPSLRDFF

SEQ ID NO: 1488 - protein, 66 aa, Brassica napus
VDPRVRVPVKVPYSIAVSLMKDMCLDWDIDYQLDIGLTIDIPIVGDITIPVSTQGEMKLPSLRDFF

SEQ ID NO: 1489 - protein, 184 aa, Brassica napus
MESAALSRIGLAGLAVMGQNLALNIAEKGFPISVYNRTTSKVDETLDRAAVEGNLPVSGQYSPRDFVLSLQRPRSLIILVKAGAPVDQTIAAFSEYMEPGDCIIDGGNEWYQNTERRISEAEQKGLLYLGMGVSGGEEGARNCPSLMPSWSSHAYDNIKHLLGKVSAQVDDWPCVTYIREGRSG

SEQ ID NO: 1490 - protein, 146 aa, Brassica napus
  misc_feature (131)..(131): Xaa can be any naturally occurring amino acid
IELVDEAEKKVKSSYFDLPAMDVSVAFPQATPASKFPPCTSDYYHFNELLTPEEQAVRKRVREFMEKEVAPIMTEYWEKAEFPFHIIPKLGALGVVGGSIKGYGCPGLSITANAIATAEISRVDASCGTFXFVHTSFGMLTIELWD

SEQ ID NO: 1491 - protein, 152 aa, Brassica napus
  misc_feature (141)..(141): Xaa can be any naturally occurring amino acid
MASVPEIKIVRSESLGHRSEVSSPEAKLGMRVEDLWDEQKPQLSPDEKLNACFESIPVSAFPLSSDSQEDIEIRSDTSLAEAVETLSKLKVLSAPVVDVDAPEDASWIDRYIGIVEFPGIVVWLLHQLDPTSPRSPAVAGXNGTSHDFTAHG

SEQ ID NO: 1492 - protein, 149 aa, Brassica napus
MSIPNMNSLRCFYTRANSLLLLRSSFSPVTIPPSPLLRFRLSLSNQTANSISDVDSKTQTTCGIAKGAISSREDKPEEKHRKTAGSSARGWDPGEVVMNKKKGKVKTSWVCESCGHSEGQWWGRCRACNKVGTMRRFSEGSSEFVSGGW

SEQ ID NO: 1493 - protein, 88 aa, Brassica napus
  misc_feature (31)..(31): Xaa can be any naturally occurring amino acid
  misc_feature (72)..(72): Xaa can be any naturally occurring amino acid
MSASRFIKCVTVGDGAVGKTCMLISYTSNTXPTDYVPTVFDNFSANVVVDGSTVNLGLWDTAGQEDYNRLRXLSYRGADVFLLAFSLI

SEQ ID NO: 1494 - protein, 80 aa, Brassica napus
  misc_feature (10)..(12): Xaa can be any naturally occurring amino acid
  misc_feature (16)..(16): Xaa can be any naturally occurring amino acid
  misc_feature (18)..(18): Xaa can be any naturally occurring amino acid
  misc_feature (27)..(27): Xaa can be any naturally occurring amino acid
  misc_feature (49)..(49): Xaa can be any naturally occurring amino acid
  misc_feature (51)..(52): Xaa can be any naturally occurring amino acid
  misc_feature (59)..(59): Xaa can be any naturally occurring amino acid
  misc_feature (61)..(61): Xaa can be any naturally occurring amino acid
  misc_feature (64)..(64): Xaa can be any naturally occurring amino acid
MAYSMLSSAXXXTSPXQXTMDAPFTGXLKPSSAFPVTRKVNNDITSIAXSXXGRVSCMXVXPPXGKNKFETLSYLPDLTE

SEQ ID NO: 1495 - protein, 123 aa, Brassica napus
MEGNSGGGAATGGGGGGSDVELVSKTLQVEHKLFYFDLKENPRGRYLKISEKTSATRSTIIVPSSGIPWFLDLFNYYVNSEEHELFSKELQLDSKVFYFDIGDNRRGRFLKVSEASVSRNRST

SEQ ID NO: 1496 - protein, 226 aa, Brassica napus
  misc_feature (37)..(37): Xaa can be any naturally occurring amino acid
  misc_feature (164)..(164): Xaa can be any naturally occurring amino acid
MAPKKVETGGRDLISSLPDELLSEILSLLPTQTAGSXNLDFDESTMVFDPSLPKAGLRFIDFVRRTLVLLGDSPIHKFSLEWKSEKAQHLIYPLIYNALQREVLELHLISPKRQFVPSELFFSKTLVKLTLALGCFARETTTFSVLFPALKSLSLFSVMFAASXEMYGVLLASPLLEEIHIFYDGPYSSFWIKQVWGSSIKRITIFYRSCDLDDSCFIFKTKKKKK

SEQ ID NO: 1497 - protein, 239 aa, Brassica napus
  misc_feature (111)..(111): Xaa can be any naturally occurring amino acid
  misc_feature (189)..(189): Xaa can be any naturally occurring amino acid
  misc_feature (204)..(204): Xaa can be any naturally occurring amino acid
  misc_feature (224)..(224): Xaa can be any naturally occurring amino acid
MEMLKKQRLDENDSGILHDEHITSLTTHHARKHLERLSTADLLHILQNAVAPHPHVLQLVLTTPDADITQKKILIRGSRAGPTRKASRSLFSTYGDPEEAIVILDKVTAKXQRGAAGASFRHVDGALLALKDPSKKIDGRVTVTQLAAAGNQGRGGAAAAANGSDVSMRKIYVANVPVDMPADRLLNLXLAYGEIEEGPLGFDXVTGKSRGFALFVYKSPESAXAALADPTKVGDGKHL

SEQ ID NO: 1498 - protein, 143 aa, Brassica napus
ASLMDGGLQYDDGSPIGQDSRSGFESVVDGSGSGSESTESLKEQVTGFMKSWGEMLMDLAVGCKDVVQQTLVSEDSVVVRKLRKPAAKLRFLNEYLPEDRDPAHAWPVIFFVFLIALAGIVSIVSYYFKAVFLQCHSHTLNSY

SEQ ID NO: 1499 - protein, 147 aa, Brassica napus
  misc_feature (143)..(143): Xaa can be any naturally occurring amino acid
MASGFEDGFSAEKLFAQGYSYTYDDVIFLPHYIDFSTDAVSLSTRLSKRVPLSIPCVASPMDTVSESHMAAAMAALGGIGIVHYNCDIATQASVIRHAKSLRVPIASDAVFKCPENLIGSVDDFGPFFLRFCLSEGKLTPSLXGYVS

SEQ ID NO: 1500 - protein, 138 aa, Brassica napus
MGGQMPDADGKARSADSSSSYGYPPSAPPQHQYGTFGPPSGASGEFPQPAVGFPQPAPPPGMQHYPQPPPASYAVYPPPQQPYSIVAPYYTQGYQIAQGYIPVVEGRPVRMRPLPCCGLGMGWFLFILGFFFAAISMV

SEQ ID NO: 1501 - protein, 135 aa, Brassica napus
  misc_feature (38)..(38): Xaa can be any naturally occurring amino acid
  misc_feature (52)..(52): Xaa can be any naturally occurring amino acid
  misc_feature (75)..(75): Xaa can be any naturally occurring amino acid
  misc_feature (101)..(101): Xaa can be any naturally occurring amino acid
GSYSSSSSISNILFFLFFTSSVYARFVTVRPSTGIDGXSLGSGSVIKTVVSXEEKEEACEQTYGFMALGNLFLIXVYGFLMFTAAMYLSAESELLLEILPXIVGGLFLSMFGAHPEAILIMGPEVAAARVDSETT

SEQ ID NO: 1502 - protein, 90 aa, Brassica napus
  misc_feature (86)..(86): Xaa can be any naturally occurring amino acid
MAVVDVHRFAESITCHAWSPDLSMVALCPNNNEVHIYKSSQEQDQWERLHVLEKHDQIVSGIDWSSKSNRIVTVSHDRNSYVWSLXGGEW

SEQ ID NO: 1503 - protein, 137 aa, Brassica napus
MGRFKNNKKGRVNVKPIAKNNQANVDHVTGDKIPKSFVFSRTKLPGSVKQLQMDLRKLMLPYTALSLKEKKRNTLRDFLNVSGPMGVTHFLMLKKTASALSLRVARTPQGPTLTFKIHQYSLASDIAQSQTPQCPRP

SEQ ID NO: 1504 - protein, 135 aa, Brassica napus
  misc_feature (2)..(2): Xaa can be any naturally occurring amino acid
  misc_feature (12)..(12): Xaa can be any naturally occurring amino acid
  misc_feature (26)..(28): Xaa can be any naturally occurring amino acid
  misc_feature (33)..(33): Xaa can be any naturally occurring amino acid
  misc_feature (43)..(43): Xaa can be any naturally occurring amino acid
  misc_feature (45)..(45): Xaa can be any naturally occurring amino acid
  misc_feature (49)..(50): Xaa can be any naturally occurring amino acid
  misc_feature (55)..(55): Xaa can be any naturally occurring amino acid
  misc_feature (58)..(60): Xaa can be any naturally occurring amino acid
  misc_feature (62)..(62): Xaa can be any naturally occurring amino acid
  misc_feature (64)..(64): Xaa can be any naturally occurring amino acid
  misc_feature (67)..(67): Xaa can be any naturally occurring amino acid
  misc_feature (71)..(73): Xaa can be any naturally occurring amino acid
  misc_feature (79)..(80): Xaa can be any naturally occurring amino acid
  misc_feature (82)..(83): Xaa can be any naturally occurring amino acid
  misc_feature (85)..(85): Xaa can be any naturally occurring amino acid
  misc_feature (93)..(93): Xaa can be any naturally occurring amino acid
  misc_feature (99)..(100): Xaa can be any naturally occurring amino acid
  misc_feature (104)..(104): Xaa can be any naturally occurring amino acid
  misc_feature (107)..(109): Xaa can be any naturally occurring amino acid
  misc_feature (122)..(122): Xaa can be any naturally occurring amino acid
  misc_feature (125)..(125): Xaa can be any naturally occurring amino acid
  misc_feature (130)..(130): Xaa can be any naturally occurring amino acid
  misc_feature (133)..(134): Xaa can be any naturally occurring amino acid
MXSSMLSSAAVXTSPAQATMVAPFTXXXSSAAXPVTRKANNDXTXIASXXGRVSXMKXXXPXAXKKXETLXXXPDLTEXXLXXEXDYLLRNKXIPCVEXXLEHXLVXXXHGSTPGYYDGRDXTMXKLPLXFGXXD

SEQ ID NO: 1505 - protein, 139 aa, Brassica napus
MSLTIPTNLVLNPRPNKKTLTQSLPKSTARFVCSTDDNKSMKAFSAAVALSSILLSSPMPAAADISGLTPCKESKQFAKREKQQIKKLQSSLKLYAPESAPALALNAQIEKTKRRFDNYGKYGLLCGADGLPHLIVNGD

SEQ ID NO: 1506 - protein, 140 aa, Brassica napus
  misc_feature (133)..(133): Xaa can be any naturally occurring amino acid
MTMINSLRRMARSSQVTLQSRYAASSSSGSRIFTTEASPQKQTIVGSKGHDMLAPFTAGWQSADLHPLIIAKSEGSYVYDDHGKKYLDSLAGLWCTALGGNEPRLVSAAVEQLKTLPFYHSFWNRTTKPSLDXAKDLLDM

SEQ ID NO: 1507 - protein, 107 aa, Brassica napus
MYSSLLLHGKRCIELHRSYTFRVISVKLLQNASPFSSASTESSGKDSVLNLLTSYGFTSPQISKIITAYPRLLTLDAETSLLPKLQSLQSRGASTSDLTEIISKVPK

SEQ ID NO: 1508 - protein, 97 aa, Brassica napus
MSGEEDATVREPLDLIRLSLDERIYVKLRSDRELRGKLHAFDQHLNMILGDVEEVITTVEIDDETYEEIVRTIKRNIQYLFVRGDGVILVSPPLRTP

SEQ ID NO: 1509 - protein, 97 aa, Brassica napus
MSGEEDATVREPLDLIRLSLDERIYVKLRSDRELRGKLHAFDQHLNMILGDVEEGITTVEIDDETYEEIVRTTKRNIQFLFVRGDGVILVSPPLRAP

SEQ ID NO: 1510 - protein, 144 aa, Brassica napus
MEGTVFTPCLEGMKNVKSEQGEMLTKPFLDLCKTILPVIDKFGAAMTLVKADIGGNISRLEKNYLSDPDKYKYLYTFVQGEIESKTAKGSSSCTNGLLWLTRAMDFLVELFRNLVAHQDWSMSQACGESYQKTLKKWHGWLASS

SEQ ID NO: 1511 - protein, 128 aa, Brassica napus
MSVSNIGMMDGAYFVGRNEILAWINTTLQLSLAKVEEAASGAVACQLMDAAHPGAVPMHKVNFDAKNEYDMIQNYKVLQDVFNKLKITKHIEVNKLIKGRPLDNLEFMQWMKRYCDSVNGGFMTSYNA

SEQ ID NO: 1512 - protein, 138 aa, Brassica napus
MAARIWIFSVAVALFLSFSSVHDLQIVNAERRIDLSSHIVNAFLTLKVENIGKDPAADMLLAFPPTQIKHLSMVQAMAITGKKKKKTYLPLDVRPTEQPDAPNDPGYFLVSFATPLTRGETVTLEVLYILTHSLEPFP

SEQ ID NO: 1513 - protein, 127 aa, Brassica napus
MGREFFVGGHWKCNGTTDQVEKIVNPLGGGRGPPSPALGLPARPPYVFLPVVKSQLRQEFHVAAQNCWVKKGGAFTGEVSAEMLVNLGVPWVILGHSERRALLGESNEFVGDKVAYALSQGLKVIAC

SEQ ID NO: 1514 - protein, 131 aa, Brassica napus
FHDSQHKRRKKKKRPSSGDGETSGVKTKELDEEKRHIESLMEAFCSVSREEATSAYKEAAGDLNKAAELLTDLVENGDDPSTSSGQETGSTSEYGAGSSSSCCGDDVARESLFKGGRSKQSRVIAATGMVS

SEQ ID NO: 1515 - protein, 115 aa, Brassica napus
MSTLNPFDLLGGDAEDPSQIVVSLPKKVEKEAPAQPAKGAKLQTKQAPTSQAERESRNAPSGVRGGGGGGAGRGPPRGSFNPGGDRLHDPKDGERTSGFRRYRESGGRGGQRGGL

SEQ ID NO: 1516 - protein, 121 aa, Brassica napus
MIFPKSLIEDLHKWGCMKQTGVSLRYMMEFGSTPTEKNLLISAQFLHKELPIRVARRAIELETLPYGLSEKPAVLKVRDWYLESFRDMRAFPEIKDTADEKDFTQMIKAVKVRHNNVVPMM

SEQ ID NO: 1517 - protein, 199 aa, Brassica napus
  misc_feature (88)..(88): Xaa can be any naturally occurring amino acid
  misc_feature (133)..(133): Xaa can be any naturally occurring amino acid
MSSGEEKGLRIEESLLVDPKLLFIGSKIGEGAHGKVYQGRYGSLIVAIKVLHRGSNPDDKSSLHSRFIREVNMMSRVKHHNLVKFIGXACKDPLMVIVTELLPGMSLSKYLTSIRLTSLISPVALSFALDIAXALDCLHANGIIHRDLKPDNLLGSRRITNPSSFGWILALAPNWPGNDEPLRLLPGWVLTGTLTFGFG

SEQ ID NO: 1518 - protein, 133 aa, Brassica napus
  misc_feature (105)..(105): Xaa can be any naturally occurring amino acid
KLLGHSLDLVFSIHADKEDGSPLGSSLPPPFPGPCTLGTALAKYADLLNPPRKSALVALAAYATEPSEAKKLKHLTSPDGKDEYSQWIVASQRSLLEVMAAFPSXAKPPLGVFFAAIAPRLQPRYYSISSSPR

SEQ ID NO: 1519 - protein, 158 aa, Brassica napus
  misc_feature (123)..(123): Xaa can be any naturally occurring amino acid
  misc_feature (127)..(128): Xaa can be any naturally occurring amino acid
  misc_feature (146)..(146): Xaa can be any naturally occurring amino acid
  misc_feature (151)..(151): Xaa can be any naturally occurring amino acid
KKTKDVQFYVEVMDVVQSLGGGRRSAYDPDEIDEEQRERARKNKIGMDFNHFASRVNDMWQQPQFASLDLEFDQPLRELGFYGVPHKTNAFIIPTSSCLVEITEMPFFVVSLSEIEIVNLERXGFGXXNFDMAIIFKDFKKDVLRXDSIPXTSLEGIK

SEQ ID NO: 1520 - protein, 357 aa, Brassica napus
  misc_feature (176)..(176): Xaa can be any naturally occurring amino acid
MGEVLKKEAYGLAVKDESGVISPFHFSRRETGENDVRFKVLFCGICHTDLSMAINEWGFTSYPLVPGHEIVGVVTEVGAKVTKFNAGDKVGVGYMVSSCGSCETCIDDQENYCPKMILTSGGKYYDDTITYGGYSDHMVCEEDYIIRIPENLPLDATAPLLCAGTTVYSPMKYHGXDKPGMHIGVVGLGGLGHVAVKFAKAMGTKVTVISTSDRKRDEALTRLGADLFLVSRDPEQMKDAMGTMDGIIDTVSASHPVLPILDLLKYKGKLIMVGAPDKPLELPVLPLIFGKKMVVGSMVGGIKETQEMMDLAGKHNITADIELISADYVNTAMERLQKADVRYRFVIDVANTLKPSP

SEQ ID NO: 1521 - protein, 148 aa, Brassica napus
  misc_feature (35)..(35): Xaa can be any naturally occurring amino acid
  misc_feature (49)..(49): Xaa can be any naturally occurring amino acid
DVGGQWLYQPNVEEEDPLGITKTLKVHSSIYSSDXLRLISPREVMGFSXFPITVKEGRDTRRFPGHEELWLYLKDFGEVFGLREMIRFNVRVEFVGMVDDDKDVDDNMKRWMVKSVEKKTGEVIEEVFDAVVVASGHYSYPRLPSIKG

SEQ ID NO: 1522 - protein, 143 aa, Brassica napus
  misc_feature (78)..(78): Xaa can be any naturally occurring amino acid
  misc_feature (87)..(87): Xaa can be any naturally occurring amino acid
  misc_feature (89)..(89): Xaa can be any naturally occurring amino acid
  misc_feature (93)..(93): Xaa can be any naturally occurring amino acid
  misc_feature (107)..(107): Xaa can be any naturally occurring amino acid
  misc_feature (114)..(114): Xaa can be any naturally occurring amino acid
  misc_feature (117)..(117): Xaa can be any naturally occurring amino acid
  misc_feature (125)..(125): Xaa can be any naturally occurring amino acid
  misc_feature (129)..(132): Xaa can be any naturally occurring amino acid
  misc_feature (134)..(134): Xaa can be any naturally occurring amino acid
  misc_feature (136)..(136): Xaa can be any naturally occurring amino acid
  misc_feature (138)..(138): Xaa can be any naturally occurring amino acid
  misc_feature (142)..(142): Xaa can be any naturally occurring amino acid
PSIFLEEMSNDDGTTVEITHKTIGPSRPSRIRVASRIKVRDLRNAIAEKGRFPVTNLRMILRGKALQDEEDGEDVYVXLKDEDSLTXAXIPKXPVGVETYDDDDDDXELKFKLXPPXAKQGGRGXFYYXXXXKXKXPXIILXG

SEQ ID NO: 1523 - protein, 160 aa, Brassica napus
VAVAAAIGAKFGVDGNPGVLPKWYAIVVVLFICIYVAAFAWSWGPLGWLVPSEIFPLEIRSAAQSVTVSMNMIFTFIIAQVFLMMLCHMKFGLFIFFAFFVAVMSVFIYVFLPETRGVPIEEMNQVWRSHWYWSRFVDGDENGRVEMGKVHQRTKKSICF

SEQ ID NO: 1524 - protein, 120 aa, Brassica napus
MAAGALGLALVAAFALALAGANSEGDALSALRRSLRDPGGVLQSWDPTLVNPCTWFHVTCDRHNRVTRLDLGNLNLSGHLVPELGKLEHLQYLELYKNNIEGTIPSELGDLKNLISLDLY

SEQ ID NO: 1525 - protein, 136 aa, Brassica napus
  misc_feature (113)..(113): Xaa can be any naturally occurring amino acid
  misc_feature (127)..(127): Xaa can be any naturally occurring amino acid
MEWVRGETIGHGTFSTVSLATPTNNAYGAFPQVMAVKSADSHGAASLANEKWVLDILGNDCDGLVRCLGEDRTVENGEEMHNLFLEYASRGSLASHLKKLNGEGLPESTVRRXHTGSVLRGLRHIHXGFAHCDLNS

SEQ ID NO: 1526 - protein, 140 aa, Brassica napus
KPGDKFKDLVGSAYYVAPEVLKRNYGPEADIWSAGVILFILISGVPPFWGENETGIFDAILKGELDFSADPWPTVSAGAKDLVKKMLKYDPKDRLTASEVLNHPWIKEDGEASDKPLDNAVLSRMKQFRAMNKLKKMALN

SEQ ID NO: 1527 - protein, 75 aa, Brassica napus
  misc_feature (3)..(3): Xaa can be any naturally occurring amino acid
  misc_feature (13)..(13): Xaa can be any naturally occurring amino acid
  misc_feature (23)..(23): Xaa can be any naturally occurring amino acid
  misc_feature (25)..(25): Xaa can be any naturally occurring amino acid
  misc_feature (33)..(33): Xaa can be any naturally occurring amino acid
  misc_feature (38)..(38): Xaa can be any naturally occurring amino acid
  misc_feature (43)..(43): Xaa can be any naturally occurring amino acid
  misc_feature (56)..(57): Xaa can be any naturally occurring amino acid
  misc_feature (71)..(72): Xaa can be any naturally occurring amino acid
  misc_feature (74)..(74): Xaa can be any naturally occurring amino acid
MAXSMLSSAAVVXSPAQATMVAXFXGLKSSAAXPVTRXANNDXTSITSNGGRVSCXXVWPPVGKKKFETLXXLXD

SEQ ID NO: 1528 - protein, 281 aa, Brassica napus
  misc_feature (59)..(59): Xaa can be any naturally occurring amino acid
  misc_feature (153)..(153): Xaa can be any naturally occurring amino acid
  misc_feature (165)..(165): Xaa can be any naturally occurring amino acid
MGKTAGNRDWAQIDAIYGIEQWQTLVFLFFHAFFFSLLSVLFLIYFDQSSPALDSFLLXFTGAVTALSDVCLLFAAANFLYSDVPLQYEMAQRMVSSVSDWSCVKTALDLGCGRGILLNAVATQLKKTRSSGRVVGLDRSKRTTLSTLRTANXEGVQEYVTCREXDVRTLPFGDNYFDVVVSSVFVHTVGKEHGQKTVEAAAERMRVLGEIVRVVKPGGLCVVWDLLHVPEYVRRLQELKMEDIRVSERVTAFMAASHIVSFRKPSELVAGPREVRLDWRC

SEQ ID NO: 1529 - protein, 204 aa, Brassica napus
  misc_feature (54)..(54): Xaa can be any naturally occurring amino acid
MEKIDDHLKPSHSVSAGAATEKWEEVSTGIRTAETMLRLAPVGLCVAALVILLXDSQTNEYGEVSYSNLTAFRYLVHANGICAGYSLLSAAIAAMPGSSSTMPRVWTFFCLDQILTYVVLAAGAVYTEVLYLAYKGDDAITWSDACSSFGSFCHKASASVIITFVVVCFYVVLSLISSYKLFTRFDPPATVDSNKNVEVAVFGS

SEQ ID NO: 1530 - protein, 128 aa, Brassica napus
  misc_feature (3)..(3): Xaa can be any naturally occurring amino acid
  misc_feature (119)..(119): Xaa can be any naturally occurring amino acid
MEXSDDHLKPSHGVSGGAATEKWEEGSTGIRTAETMLRVAPVGLCVAALVIMLQDSQANEFGAISYSNLSAFRYLVHANGICAGYSLLSAAISAMPGSSSTMPRVWTFFCLDQILTYVXLAAGAVSTE

SEQ ID NO: 1531 - protein, 284 aa, Brassica napus
MYYQEEKHDPESAKQLASLADLYVNDAFGTAHRAHASTEGVTKFLKPSVAGFLLQKELDYLVGAVSSPKRPFAAIVGGSKVSSKIGVIESLLEKCDILLLGGGMGFTFYKAQGLSVGSSLVEEDKLELATSLLAKAKAKGVSLLLPTDVVVADKFAPDANSKVVPASGIEDGWMGLDIGPDSIKTFNEALDTTQTVIWNGPMGVFEMEKFAAGTEAVANKLAELSEKGVTTIIGGGDSVAAVEKVGVAGVMSHISTGGGASLELLEGKVLPGVIALDEAITVTV

SEQ ID NO: 1532 - protein, 106 aa, Brassica napus
MGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEA

SEQ ID NO: 1533 - protein, 126 aa, Brassica napus
  misc_feature (31)..(31): Xaa can be any naturally occurring amino acid
MSASRFIKCVTVGDGAVGKTCLLISYTSNTXPTDYVPTVFDNFSANVIVDGNTINLGLWDTAGQEDYNRLRPLSYRGADVFLLAFSLVSKASYENVSKKWVPELRHYAPGVPIILVGTKLDLRDDK

SEQ ID NO: 1534 - protein, 193 aa, Brassica napus
MSLKAIHVTEVPSLDNFPENPSLCASRFSPGGLSSFKIPKFLVVGHRGHGMNMLQSTDPRFSAFKENSILSFNAASKLPLDFIEFDVQVTRDGCPVIFHDDFIYSEDNGVVYEKRVTEVSSSEFMSYGKQRETEKSGKPLLRKTKEGSFFLSHVSFGVGSLLFFFFLHVTAGHNTWGLFVDFSSIFFVMENLE

SEQ ID NO: 1535 - protein, 315 aa, Brassica napus
  misc_feature (309)..(309): Xaa can be any naturally occurring amino acid
MASVAASPAFSLLKSTGATASSAATRARASLLPIPSSKSISARPLGFSAVLDSRRFSLHVSSKVQSVRGRGSRGVVSMAKKSVGDLTSADLKGKKVFVRADLNVPLDDNQTITDDTRIRAAVPTSRYLRPNGAKVILSTHLGRPKGVTPKFSLAPLVPRLSELLGIEVKKADDCIGPEVESLVASLPEGGVLLLENVRFYKEEEKNDPDFAKKLASLADLYVNDAFGTAHRAHASTEGVTKFLKPSVAGFLLQKELDYLVGAVSSPKRPFAAIVGGSKVSSKIGGIESLLEKCDILLLGGGMNFTFYKXQGLSVG

SEQ ID NO: 1536 - protein, 115 aa, Brassica napus
  misc_feature (102)..(102): Xaa can be any naturally occurring amino acid
MSLKFVSGALFFCLLLSIFPSFSSASFISDGVFGSQALVTGRNLLQTKKTCPVNFEFMNYTIITSQCKGPKFPVKECCSAFLDFACPYTEQLNDLSNDCATXMFSYINLYGKYPP

SEQ ID NO: 1537 - protein, 143 aa, Brassica napus
  misc_feature (32)..(32): Xaa can be any naturally occurring amino acid
KSKKLVASISTLLIRRRISHPSSSTLRCNPLXAISTNPQTDLNPVKTLAVSIRRLQFSGRAFSSESSDKRISSVCWNCGFSSDKAAFLFCDSCRSIQPVDDSVNYFQIFGLENKYELEGGSLEGKYKDWQKKLHPDLVHNKSQ

SEQ ID NO: 1538 - protein, 164 aa, Brassica napus
  misc_feature (14)..(14): Xaa can be any naturally occurring amino acid
  misc_feature (42)..(42): Xaa can be any naturally occurring amino acid
  misc_feature (53)..(53): Xaa can be any naturally occurring amino acid
  misc_feature (135)..(135): Xaa can be any naturally occurring amino acid
LQNRCKFALDIVEXVANEIGPDRVGIRLSPFADYMESADTNXQALALHMAQSXNKYGILYCHVIEARMKTMGEITECPHLLVPMRKAFQGTFISAGGFTRTDGNEAVEEGRTDLVAYGRWFLANPDLPKRFEVDXPLNKYDRPTFYTSDPVVGYTDYPFLESKA

SEQ ID NO: 1539 - protein, 115 aa, Brassica napus
MPCLNISTNVSLDGVDTSSILSEATSSVAKIIGKPENYVMIVLKGSVPMAFGGTEDPAAYGELVSIGGLNPDVNKQLSAAVSAILETKLSVPKSRFFLKFYDTKGSFFGWNGSTF

SEQ ID NO: 1540 - protein, 144 aa, Brassica napus
MPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGGRGGDREYMGRGPPPGSGRCFNCGIDGHWTRDCKAGDWKNRCYRCG

SEQ ID NO: 1541 - protein, 98 aa, Brassica napus
MGGVTSSIAAKFAFFPPTPPSYEVVADESCGGRLYIPEIPRRDDVDILKLRTRCGNEIVAVYVKHSKANCTILYSHGNAADVGQMFELFVELSNRLRV

SEQ ID NO: 1542 - protein, 113 aa, Brassica napus
  misc_feature (46)..(46): Xaa can be any naturally occurring amino acid
  misc_feature (66)..(66): Xaa can be any naturally occurring amino acid
  misc_feature (79)..(79): Xaa can be any naturally occurring amino acid
MHAFCFSPPDGLLAYDGCFLGFLKTGSITRCAVVACAGLLLLLSQXLCHKAFDKVKSSLITVFLQXSISSALMLVLAQXFTCSIKMSMPAGLVAVISALMTCFYVSFFSHGCI

SEQ ID NO: 1543 - protein, 161 aa, Brassica napus
  misc_feature (2)..(2): Xaa can be any naturally occurring amino acid
  misc_feature (20)..(20): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(30): Xaa can be any naturally occurring amino acid
  misc_feature (33)..(33): Xaa can be any naturally occurring amino acid
  misc_feature (36)..(36): Xaa can be any naturally occurring amino acid
  misc_feature (38)..(38): Xaa can be any naturally occurring amino acid
  misc_feature (42)..(42): Xaa can be any naturally occurring amino acid
  misc_feature (48)..(52): Xaa can be any naturally occurring amino acid
  misc_feature (54)..(54): Xaa can be any naturally occurring amino acid
  misc_feature (58)..(58): Xaa can be any naturally occurring amino acid
  misc_feature (60)..(63): Xaa can be any naturally occurring amino acid
  misc_feature (78)..(78): Xaa can be any naturally occurring amino acid
  misc_feature (80)..(80): Xaa can be any naturally occurring amino acid
  misc_feature (86)..(86): Xaa can be any naturally occurring amino acid
  misc_feature (92)..(95): Xaa can be any naturally occurring amino acid
  misc_feature (99)..(99): Xaa can be any naturally occurring amino acid
  misc_feature (104)..(105): Xaa can be any naturally occurring amino acid
  misc_feature (109)..(109): Xaa can be any naturally occurring amino acid
  misc_feature (121)..(121): Xaa can be any naturally occurring amino acid
  misc_feature (123)..(124): Xaa can be any naturally occurring amino acid
  misc_feature (127)..(127): Xaa can be any naturally occurring amino acid
  misc_feature (129)..(129): Xaa can be any naturally occurring amino acid
  misc_feature (131)..(134): Xaa can be any naturally occurring amino acid
  misc_feature (143)..(145): Xaa can be any naturally occurring amino acid
  misc_feature (148)..(148): Xaa can be any naturally occurring amino acid
  misc_feature (150)..(150): Xaa can be any naturally occurring amino acid
  misc_feature (152)..(152): Xaa can be any naturally occurring amino acid
  misc_feature (155)..(156): Xaa can be any naturally occurring amino acid
  misc_feature (160)..(160): Xaa can be any naturally occurring amino acid
MXSSMLFLRCVSPTSPGHAXMVAXFXGLKXSAXFPXTXLADXDITSIXXXXXRXSCMXVXXXXGKKKFETLSYLPDLXEXELTEEXEYLLRXXXXPCVXFELQXXFVYXEHVCTPGYDDGXYXXRWXVXLXXXXDSARVMKEXXXVKXGXPXAFXXIIGXD

SEQ ID NO: 1544 - protein, 106 aa, Brassica napus
  misc_feature (21)..(21): Xaa can be any naturally occurring amino acid
  misc_feature (36)..(38): Xaa can be any naturally occurring amino acid
  misc_feature (40)..(40): Xaa can be any naturally occurring amino acid
  misc_feature (83)..(83): Xaa can be any naturally occurring amino acid
  misc_feature (91)..(91): Xaa can be any naturally occurring amino acid
MASVRLSSATMTSSLAHATMXAPFIGLKSSAAFPVXXXAXTEITSITSNGGRINCMKVWPPVGKKKFETLSYLPGLTDVEIAXEIDYLIRXKWTPCIEFEVEHGFV

SEQ ID NO: 1545 - protein, 181 aa, Brassica napus
MASVMLSSATMTSSLAHSTMVAPFIGLKSSAAFPMTCKANTEITSITSNGGRVNCMKVWPPVGKKKFETLSYLPDLTDVEIAKEVDYLIRNKWTPCIEFELEHGFVYREHGNIPGYYDGRYWTMWKLPLFGCTDSTQVLKEVKKCKQEYPNAFIRIIGFDNNRQAQCISFIAYKPPSFTDV

SEQ ID NO: 1546 - protein, 237 aa, Brassica napus
MHSSHLLLEEPIRMASILEPSKSSFFPALTKIVGTLGPKSRSVETLSGCLKSGMSVARFDFSWGDAEYHQETLDNLKIAVKSTKKLCAVMLDTVGPELQVINKSGKAITLKADGLVTLTPSQDQEASSEVLPINFNGLAKAGKKGDTIFVGQYLFTGSETTSGGLEGDELKGDDVIGLSRNADTLAGSLWTLHASQVHIDLPTLTEKDEEVISTWRVQNKIDSLSLSYCRHAEDVRQ

SEQ ID NO: 1547 - protein, 148 aa, Brassica napus
  misc_feature (142)..(142): Xaa can be any naturally occurring amino acid
MATSIESSDVEVGFAKLQGEDFEYYMQTYSIVLGRNSKKSTVDVDLSSLGGRMNISRNHARIFYDFTRRRFALEVLGKNGCLVEGVLHLPGNPAVKLDSQDLLQIGDKEFYFLLPVRSILGGPRHVVSGPVGPYNQYPGSGXGKRGGR

SEQ ID NO: 1548 - protein, 102 aa, Brassica napus
  misc_feature (23)..(23): Xaa can be any naturally occurring amino acid
  misc_feature (33)..(34): Xaa can be any naturally occurring amino acid
EEPGDDEEGGGQRTYKLSMSCIXPFPKRNDPSXXQEFLPGKPVLAVYPGTTALYKATVISTPRKRKSDEYLLEFDDDEEDGALPQRTVPFHKVVALPEGHRQ

SEQ ID NO: 1549 - protein, 116 aa, Brassica napus
  misc_feature (25)..(25): Xaa can be any naturally occurring amino acid
  misc_feature (65)..(65): Xaa can be any naturally occurring amino acid
  misc_feature (72)..(72): Xaa can be any naturally occurring amino acid
  misc_feature (94)..(94): Xaa can be any naturally occurring amino acid
GSYSSSFSISNILFFIFFTSSVYAXFVTVRPSTTDLISDGIDCGSLGSGSVIKTVVSDEEKEEAXGNVFLIXVYGFLMFTAAMYLSAESEILPXIVGGLFFSMLGAQPEAILIMGR

SEQ ID NO: 1550 - protein, 118 aa, Brassica napus
  misc_feature (32)..(32): Xaa can be any naturally occurring amino acid
  misc_feature (41)..(41): Xaa can be any naturally occurring amino acid
  misc_feature (77)..(77): Xaa can be any naturally occurring amino acid
  misc_feature (91)..(91): Xaa can be any naturally occurring amino acid
  misc_feature (102)..(102): Xaa can be any naturally occurring amino acid
MAVVDVHRFAESITCHAWSPDHSMVAFCPNNXEVHIYKSVXDQWERLHVLEKHDQIVSGIDWSSKSNKIVTVSHDRXSYVWSLEGGEWVPXLLLLLRLNRAXALCVQWNPPVSTPSPH

SEQ ID NO: 1551 - protein, 146 aa, Brassica napus
MDSRTKVKKGAGGRRGGGPKKKPVSRSVKAGLQFPVGRIGRYLKKGRYSKRVGTGAPVYLAAVLEYLAAEVLELAGNAARDNKKNRIIPRHVLLAVRNDDELGKLLKGVTIAHGGVLPNVNPVLLPKKSAKAASTTKVIKSPSKAT

SEQ ID NO: 1552 - protein, 144 aa, Brassica napus
  misc_feature (124)..(124): Xaa can be any naturally occurring amino acid
RGRINNANLLDKRKSFGAGKLAGGPKPEGSGSGVGLKDVKREPGQYLAQSSSINPYCQAIPICDLRFTIHSAGRGIGKGKIPDPGSRKAEDMAVLDVPSVVPDSILFNVPRDVGADWDIGYWLXLGLSIALPLPGDFASPAVFY

SEQ ID NO: 1553 - protein, 93 aa, Brassica napus
  misc_feature (36)..(36): Xaa can be any naturally occurring amino acid
SVEEDATVREPLDLIRLSIEERIYVKLRSDRELRGXFDQHLNMILGDVEEVITTVEIDDETYEEIVRKLKRKVLFLFLRGDGVILVSPPLRTT

SEQ ID NO: 1554 - protein, 118 aa, Brassica napus
MADRINTATPLLTDHEGGGNDRGRRSSSWVQKLIDVEESKAQIIYSLPMIFTNLFIYCIPLTSVMFASHLGQLELAGATLANSWATVTGFAFMTGLSGALETLCGQGFGAKSYRMLGI

SEQ ID NO: 1555 - protein, 131 aa, Brassica napus
  misc_feature (42)..(42): Xaa can be any naturally occurring amino acid
MTKMPPAIAILLFSVALLAAIPPSTAEIKSLVISDDARPMIXFEKFGFTHTGHVTVSVSSVSVVSTSSDPNPDPSRLGFFLLSEESLLQVLLEMQQNARFCVLDSHYVTHLFTFRDLSPPPNSRFNHSYPV

SEQ ID NO: 1556 - protein, 162 aa, Brassica napus
GHWNVTDVCNGLLGGFAAITGGCSVVEPWAAIICGFVAALVLLGCNKLAEKLKYDDPLEAAQLHGGCGAWGLIFTALFAREKYLNQIYGEKPGRPHGLFMGGGGKLLGAQLIQILVITGWVSATMGTLFFILKKMKLLRISAEDEMAGMDTTRHGGSAYMYY

SEQ ID NO: 1557 - protein, 129 aa, Brassica napus
MAQLMDKAKGFVAEKISGVQKPEADLSDMSVQHVGRDGATLSGRLDVRNPYSHTIPICEISYSLKSAGRDVASGTMPDPGSLVASDTTSLDIPVKVPYDFLVSLVKDAGKDWDLDYEMRVGLTVDLPIV

SEQ ID NO: 1558 - protein, 134 aa, Brassica napus
MSLDKHMEKVLYSAEVIAERVAQLGSEITSEFSGDSDPPVFVGVATGACLFLADLVRRIDLPISIDFIRADSYGSGTVSNGSPRISFDLKLDITDKHVILVEDIVDTGNTVSCLIEHMTLKKASSVSVCTFLDK

SEQ ID NO: 1559 - protein, 132 aa, Brassica napus
  misc_feature (12)..(12): Xaa can be any naturally occurring amino acid
  misc_feature (26)..(28): Xaa can be any naturally occurring amino acid
  misc_feature (36)..(37): Xaa can be any naturally occurring amino acid
  misc_feature (44)..(44): Xaa can be any naturally occurring amino acid
  misc_feature (54)..(54): Xaa can be any naturally occurring amino acid
  misc_feature (60)..(60): Xaa can be any naturally occurring amino acid
  misc_feature (62)..(63): Xaa can be any naturally occurring amino acid
  misc_feature (70)..(70): Xaa can be any naturally occurring amino acid
  misc_feature (72)..(72): Xaa can be any naturally occurring amino acid
  misc_feature (74)..(74): Xaa can be any naturally occurring amino acid
  misc_feature (76)..(76): Xaa can be any naturally occurring amino acid
  misc_feature (78)..(79): Xaa can be any naturally occurring amino acid
  misc_feature (83)..(83): Xaa can be any naturally occurring amino acid
  misc_feature (85)..(85): Xaa can be any naturally occurring amino acid
  misc_feature (87)..(87): Xaa can be any naturally occurring amino acid
  misc_feature (90)..(90): Xaa can be any naturally occurring amino acid
  misc_feature (94)..(94): Xaa can be any naturally occurring amino acid
  misc_feature (103)..(106): Xaa can be any naturally occurring amino acid
MDLLNNPPTTTXGLSETFARLKSQRXXXLIPYITAXXDPDLSTXAKALKGLDSXGSDIIXLXXLYSDPLXDXPXIXAXXRRSXLXGXSFXSIIXMVKEVYPQXXXXLDWFTYYNPDKEGWKTLRVWKFLPRG

SEQ ID NO: 1560 - protein, 110 aa, Brassica napus
MISDSITNASASAAPSARDMGKKKRTNRAAKLKQSKLGLRREQWLSQVAMINKGDKEETVPNRKTVVQRDLPVEKLNEQRGEGEAHHHESFIESLSNSPNSTLSGITSAL

SEQ ID NO: 1561 - protein, 164 aa, Brassica napus
ITIGILVASVLNFFFSKIPGGWGWRLSLGGAVVPALIITVGSLILPDTPNSMIERGRFKQAETKLRKIRGVDNVEDEMDDLIAASEASKLVEHPWRNLLQRKYRPHLTMAILIPSFQQLTGINVIMFYAPVLFQTIGFGNDAALMSAVVTGLVNVGATVVSIYG

SEQ ID NO: 1562 - protein, 426 aa, Brassica napus
GRPTRPGCGRNCLGACCLNGARLPLYSCKKLENSGTGEKLVISHEAREPPVAFLESLVLGEWEDRFQRGLFRYDVTACETKVIPGKYGFVAQLNEGRHLKKRPTEFRVDKVLQSFDGNKFNFTKVGQEELLFQFEAGEDGEVQFFPCMPLDAENSPSVVAINVSPIEYGHVLLIPRVLDCLPQRIDHKSLLLALHMAAEAANPYFRLGYNSLGAFATINHLHFQAYYLAMPFPLEKAPSKKLATTASGVKISELLSYPVRSLLFEGGSSMQDLSDTVSDACVCLQSNNFPFNILIADCGRQIFLMPQCYAEKQALGEVSPEVLETQVNPAVWEISGHMVLKRKEDYEGASEENAWRLLAEASLSEERFKEVNALIFEAIGCSDQEEELEGTVVEQDNPSGSRNPKRNRTHGAPITNGTASECLVLQ

SEQ ID NO: 1563 - protein, 138 aa, Brassica napus
  misc_feature (130)..(130): Xaa can be any naturally occurring amino acid
MAHSNRDPTTSRHVAVIGAGAAGLVTARELRREGHSVVVLERGSQIGGVWTYTSQVEPDPLSLDPTRPVVHSSVYKSLRTNIPRECMGFTDFPFAARPHDGSRDPRRHPGHSEVLAYLRDFAKEFDVQEXMIRFQTEC

SEQ ID NO: 1564 - protein, 123 aa, Brassica napus
MSNDTARNPLLPKDHSAPMAQDFSINSRTSSRKRRLRRSRSAPRGDFTYNDNDVKLDEPHPHPSKIPMFRDLNPNLRRVILLLALYLTVGTLCFYLVRNQISGHKTNGVLDAVYFCIVTMTTV

SEQ ID NO: 1565 - protein, 237 aa, Brassica napus
PRVRGRVGGNVQAATDLMSSGKIAAVFVEPIQGEGGVYSATKEFLQSLRSACDAAGSLLVFDEVQCGLGRTGNLWAYEAFGVTPDIMTVARPLAGGLPIGAVLVTEKVAETIKYGDHGSTFAGNPLVCSAAIAVVDKVSKPSFLASVSSKGIYFKELLVKKLGGNSHVKEVRGEGLIIGVELDVPASPLVDACRATGPLILTAGKGNVVRIVPPLIILEEEIERAVEIIFQKLTALG

SEQ ID NO: 1566 - protein, 94 aa, Brassica napus
MANQTPESNQPSNTQTYGFPIYAADWIPEETVRSKIDKDQDNSEDVGGESSSSTSRSCIVLAGGGGEGRSGIKNVIVICRVDLDTKSLAEQPLG

SEQ ID NO: 1567 - protein, 129 aa, Brassica napus
  misc_feature (16)..(16): Xaa can be any naturally occurring amino acid
  misc_feature (34)..(34): Xaa can be any naturally occurring amino acid
MAKEFPVPPVVFTPSXADAPPVPSPGRGGLPSAXFAPPRPSTSSAANPLPFMSFDVSAAAASSSSAPPLFAGPIGVAGSGSSFEDEPPLLEELGINTRQIWRKTISILHPLRSADPSLHADADLSGPFL

SEQ ID NO: 1568 - protein, 83 aa, Brassica napus
  misc_feature (46)..(46): Xaa can be any naturally occurring amino acid
MSASRLIKCVTVGDGAVGKTCLLISYTSNTFPTDYVPTVFDNFTAXGPVKAPTPHLGACHAAGHHHYNRLRPLSYRGADGFIL

SEQ ID NO: 1569 - protein, 95 aa, Brassica napus
MKHKSQQQKRKKKRSSAAPSGGGAAAAASDGNKKDVERESEKVEKQNIESLMEAFCSVSVEEATAAYREAGGDLNRAADVLSNLVDDDPSTISVA

SEQ ID NO: 1570 - protein, 149 aa, Brassica napus
  misc_feature (41)..(41): Xaa can be any naturally occurring amino acid
  misc_feature (79)..(79): Xaa can be any naturally occurring amino acid
MGRAFVYVILGGGVAAGYAALEFTRRGVSEGELCIISEEPXAPYERPALSKGFLLPEDPARLPSFHTCVGANDEKLTPXWYKEHGIELVLGTRVKSVDVRRKTLLSSTGETISYKFLIIATGARALKLEEFGVEGSDAENVCYLRDLSD

SEQ ID NO: 1571 - protein, 136 aa, Brassica napus
TKVFDSMQQLSSKKSNNDEVFIKLGTEKDKRPVEREEKTKKSLSINEFLKPANGESYRGGNRGGRVSRGPREGADRGGRGPREGADRGGRGPRGADRGGRGPRRDNGGGEQKAAAPKFVAPAPKIEDAAQFPTLGK

SEQ ID NO: 1572 - protein, 105 aa, Brassica napus
  misc_feature (100)..(100): Xaa can be any naturally occurring amino acid
MATVVSHQAITSQRTSSNFKASHFLKEPLNVPIKLRQKRFKIQATASQAPLLDPVLSPSKTIPQSYKKKSNEASLILIRHGESLWNEKNLFTGCVDVPLXEKGVA

SEQ ID NO: 1573 - protein, 140 aa, Brassica napus
  misc_feature (36)..(36): Xaa can be any naturally occurring amino acid
  misc_feature (50)..(50): Xaa can be any naturally occurring amino acid
  misc_feature (71)..(71): Xaa can be any naturally occurring amino acid
  misc_feature (81)..(81): Xaa can be any naturally occurring amino acid
  misc_feature (125)..(125): Xaa can be any naturally occurring amino acid
  misc_feature (130)..(131): Xaa can be any naturally occurring amino acid
PPVPFEHACPVNKDVLPTGHKVDANSKIIIPLYALXRMKAVWGQDASEFXPERWVSNTGSLRHEPSFKFLXFNAGPRSCLXKQLAMNMMKTVIVEILQNYDIHVIKGQKIETFPGLMLLMTHGFXVTITXXDSALQSIVN

SEQ ID NO: 1574 - protein, 131 aa, Brassica napus
  misc_feature (107)..(107): Xaa can be any naturally occurring amino acid
MATAGNKNINAKLVLLGDVGAGKSSLVLRFVKDQFVEFQESTIGAAFFSQTLAVNDATVKFEIWDTAGQERYHSLAPMYYRGAAAAIIVFDITNQGSFERAKKWVQXLQAQGNPNMVMALAGLNAACWKQS

SEQ ID NO: 1575 - protein, 277 aa, Brassica napus
  misc_feature (7)..(7): Xaa can be any naturally occurring amino acid
  misc_feature (39)..(40): Xaa can be any naturally occurring amino acid
  misc_feature (42)..(42): Xaa can be any naturally occurring amino acid
  misc_feature (72)..(72): Xaa can be any naturally occurring amino acid
MRREDDXEKVKDKSEPLLLPENGSDVSEEEGASWMVCLXXFXAVCGSYEFGTCVGYSAPTQFGIMEELNLSXSQFSVFGSILNVGAVLGAITSGKISDFIGRNGAMRLSSVISAIGWMIIYFSKGDIPLDFGRFLTGYGCGTLSYVVPVFIAEISPRKLRGALATLNQLFLVIGLASMFLIGAVVNWRALALTGVVPCVILFFGTWFIPESPRWLEMVGRHRDFEIALQKLRGPNANIAREADEIKEYLATIAHLPKTTLLDLIDKKNIRFVLVGVG

SEQ ID NO: 1576 - protein, 225 aa, Brassica napus
  misc_feature (123)..(123): Xaa can be any naturally occurring amino acid
  misc_feature (151)..(151): Xaa can be any naturally occurring amino acid
  misc_feature (167)..(167): Xaa can be any naturally occurring amino acid
  misc_feature (174)..(174): Xaa can be any naturally occurring amino acid
  misc_feature (178)..(179): Xaa can be any naturally occurring amino acid
  misc_feature (185)..(185): Xaa can be any naturally occurring amino acid
  misc_feature (189)..(190): Xaa can be any naturally occurring amino acid
  misc_feature (197)..(197): Xaa can be any naturally occurring amino acid
  misc_feature (204)..(204): Xaa can be any naturally occurring amino acid
MSYLLRPDPVSRIHPEPQPSDDTDHFDLLPDSLLLLIFDKVADVKDLGRCCIVSRRFHSLVPFVENVLVRVDCVISDDDSSASGDDDRRFSLNTASISDASAGGSFSALFRLVFAPIFKPFQXLGQFLGPRRSLSSLEDETDQSGVTHHSXPTQVLKNFAGRIGFLXIELANGXKLGXXKNGILXKGEXXDFGSTLXNWMILGXPGSGHKRGPLPPPRKKRGVPK

SEQ ID NO: 1577 - protein, 214 aa, Brassica napus
  misc_feature (208)..(208): Xaa can be any naturally occurring amino acid
EVDEVKGDDVICLSRNAATLAGSMFTLHASQVHIDMPTLTEKDKEVISTWGVQNKIDFLSLSYCRHAEDVRQTREMLKKLGDLSQTQIFAKIENVEGLNHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKXFNQDLY

SEQ ID NO: 1578 - protein, 289 aa, Brassica napus
  misc_feature (268)..(268): Xaa can be any naturally occurring amino acid
MSTDLTEEESLSGKDYQDPPRVKIFEARELGKWSFYRAVIAEFIATLLFLYVTVLTVIGFKSQTDLQTGGGACASVGLLGISWAFGGMIFILVYCTAGISGGHINPAVTFGLFLASKVSLVRAISYIVAQCLGATCGVGLVKVFQKTYYNRYGGGANVLADGYNVGVGVGAEIIGTFVLVYTVFSATDPKRNARDSHIPVLAPLPIGFSVFMVHLATIPITGTGINPARSFGAAVIYNNQKAWDDQWIFWVGPFVGAAIAALYHQFVXLRAGAMKAYGSVRSQLHELHA

SEQ ID NO: 1579 - protein, 126 aa, Brassica napus
MLVLFETPGGFALFKVLDEGKLSNVEDLGNVFSSADSARKMVKLKAFDKFDNTSEALEAVAKLLEGAPSKGLRKFLKANCEGETLAVADSKLGNIIKEKLKIDCVHNNAVMELLRGVRSQLSELIS

SEQ ID NO: 1580 - protein, 128 aa, Brassica napus
  misc_feature (22)..(22): Xaa can be any naturally occurring amino acid
  misc_feature (35)..(37): Xaa can be any naturally occurring amino acid
  misc_feature (41)..(43): Xaa can be any naturally occurring amino acid
  misc_feature (45)..(45): Xaa can be any naturally occurring amino acid
  misc_feature (51)..(52): Xaa can be any naturally occurring amino acid
  misc_feature (54)..(55): Xaa can be any naturally occurring amino acid
  misc_feature (63)..(63): Xaa can be any naturally occurring amino acid
  misc_feature (65)..(67): Xaa can be any naturally occurring amino acid
  misc_feature (73)..(75): Xaa can be any naturally occurring amino acid
  misc_feature (79)..(80): Xaa can be any naturally occurring amino acid
  misc_feature (82)..(83): Xaa can be any naturally occurring amino acid
  misc_feature (86)..(87): Xaa can be any naturally occurring amino acid
  misc_feature (94)..(94): Xaa can be any naturally occurring amino acid
  misc_feature (97)..(99): Xaa can be any naturally occurring amino acid
  misc_feature (105)..(105): Xaa can be any naturally occurring amino acid
  misc_feature (107)..(111): Xaa can be any naturally occurring amino acid
  misc_feature (113)..(113): Xaa can be any naturally occurring amino acid
  misc_feature (116)..(118): Xaa can be any naturally occurring amino acid
  misc_feature (120)..(120): Xaa can be any naturally occurring amino acid
  misc_feature (127)..(127): Xaa can be any naturally occurring amino acid
MAVHAVRSPTTQLPSGISGNLXPSNRNPNAVIRFXXXSSKXXXLXSLSASXXKXXGRGKESSXRXXXVKKILXXXPLLXXTXXSNXXAETVSNXSRXXXAYQEVXGXXXXXAXEKXXXNXEAVPCEXI

SEQ ID NO: 1581 - protein, 119 aa, Brassica napus
MENSATNQTIPLLTPFSMRNFNLSHRIVMAPMARMRSYGSIPQPHAALYYSERATPGGLLISEATGVSETAMAYHDMPGIWTKNQIEAWKPIVDAVHSNGAVSFLLPSSGSDSPPATAP

SEQ ID NO: 1582 - protein, 166 aa, Brassica napus
  misc_feature (54)..(54): Xaa can be any naturally occurring amino acid
  misc_feature (60)..(60): Xaa can be any naturally occurring amino acid
  misc_feature (68)..(72): Xaa can be any naturally occurring amino acid
  misc_feature (74)..(74): Xaa can be any naturally occurring amino acid
  misc_feature (76)..(76): Xaa can be any naturally occurring amino acid
  misc_feature (82)..(82): Xaa can be any naturally occurring amino acid
  misc_feature (85)..(85): Xaa can be any naturally occurring amino acid
  misc_feature (90)..(90): Xaa can be any naturally occurring amino acid
  misc_feature (103)..(105): Xaa can be any naturally occurring amino acid
  misc_feature (107)..(115): Xaa can be any naturally occurring amino acid
  misc_feature (119)..(119): Xaa can be any naturally occurring amino acid
  misc_feature (121)..(121): Xaa can be any naturally occurring amino acid
  misc_feature (124)..(124): Xaa can be any naturally occurring amino acid
  misc_feature (130)..(132): Xaa can be any naturally occurring amino acid
  misc_feature (135)..(135): Xaa can be any naturally occurring amino acid
  misc_feature (142)..(142): Xaa can be any naturally occurring amino acid
  misc_feature (148)..(148): Xaa can be any naturally occurring amino acid
  misc_feature (150)..(150): Xaa can be any naturally occurring amino acid
  misc_feature (152)..(152): Xaa can be any naturally occurring amino acid
  misc_feature (155)..(155): Xaa can be any naturally occurring amino acid
  misc_feature (157)..(160): Xaa can be any naturally occurring amino acid
  misc_feature (162)..(162): Xaa can be any naturally occurring amino acid
  misc_feature (164)..(164): Xaa can be any naturally occurring amino acid
PKNKVGRSTTDRLILPFHFSLFSIPSVVLGEIEKKWSGAGKKGGDVAFKASRTXDGEGRXKVLVPDEXXXXXFXNXRRAFRXGQXAASRXKFSQEPKPMGWDXXXRXXXXXXXXXGKEXLXGVXIPKDGXXXTPXKKPKFGXWGGELXKXKXNPXKXXXXLXKXIF

SEQ ID NO: 1583 - protein, 267 aa, Brassica napus
MAAAANTAVFVSPSQPLSSKRNFLYSPTVSPIQRRFPRRKLELQVKAVATTLAPLEEIKEYKLPSWAMFEMGTAPVFWKTMNGLPPTAGEKLKLFYNPAATKLTPNEDYGVAFNGGFNQPIMCGGEPRAMLKKDRGKADSPIYTMQICIPKHAVNLIFSFTNGVDWDGPYRLQFQVPKRWQNKPIEFFNEGLAKELSQDGACERAIFPDSNIVATRCTMIANLTVEGGDRCNLDLVPGCMDTNSEHFNPLANVDDGSCPLELSDSDE

SEQ ID NO: 1584 - protein, 137 aa, Brassica napus
MAAPLILKYHIDHQQDPNPTRLFSSIQEAKSIAKISLPIILTGLLLYSRSMISMLFLGRLNDLPALSGGSLALGFANITGYSLLSGLSTGMEPICVQAFGAKRFKLLGLALQRTILLLLLCSLPVSILWLNIKKILL

SEQ ID NO: 1585 - protein, 109 aa, Brassica napus
  misc_feature (45)..(46): Xaa can be any naturally occurring amino acid
  misc_feature (98)..(98): Xaa can be any naturally occurring amino acid
MNPENHPTTTHSKVISHVFFTGTAKQGCAGPPLGLVDIGVSDIAXXFRVSLPGIAKNQDKIKCEIQREGRVCIQGVVPEIAIPSDSGCLYRMQVQQLXPPGPFSITFNL

SEQ ID NO: 1586 - protein, 145 aa, Brassica napus
  misc_feature (134)..(134): Xaa can be any naturally occurring amino acid
AKGRQLRFLANIDPVDVARNISGLNPETTLVVVVSKTFTTAETMLNARTLRNWITTALGAPAVAKHMVAVSTNLALVEKFGIDPNNAFAFWDWVGGRYSVCSAVGVLPLSLQYGFSVVEKFLKGASSIDKHFQXTPFEKNIPVLL

SEQ ID NO: 1587 - protein, 158 aa, Brassica napus
  misc_feature (12)..(12): Xaa can be any naturally occurring amino acid
  misc_feature (14)..(16): Xaa can be any naturally occurring amino acid
  misc_feature (19)..(19): Xaa can be any naturally occurring amino acid
  misc_feature (21)..(22): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (50)..(50): Xaa can be any naturally occurring amino acid
  misc_feature (54)..(55): Xaa can be any naturally occurring amino acid
  misc_feature (57)..(57): Xaa can be any naturally occurring amino acid
  misc_feature (60)..(62): Xaa can be any naturally occurring amino acid
  misc_feature (65)..(65): Xaa can be any naturally occurring amino acid
  misc_feature (92)..(92): Xaa can be any naturally occurring amino acid
  misc_feature (94)..(94): Xaa can be any naturally occurring amino acid
  misc_feature (100)..(100): Xaa can be any naturally occurring amino acid
  misc_feature (105)..(105): Xaa can be any naturally occurring amino acid
  misc_feature (114)..(115): Xaa can be any naturally occurring amino acid
  misc_feature (118)..(118): Xaa can be any naturally occurring amino acid
  misc_feature (121)..(121): Xaa can be any naturally occurring amino acid
  misc_feature (126)..(126): Xaa can be any naturally occurring amino acid
  misc_feature (137)..(140): Xaa can be any naturally occurring amino acid
  misc_feature (144)..(144): Xaa can be any naturally occurring amino acid
  misc_feature (149)..(149): Xaa can be any naturally occurring amino acid
MVSSMLSSAAVXTXXXQDXMXXPFTXLKSSAXFPXTRKANNDITSIASPXGRVXXMXVGXXXGKXKFETLSYLPDLTEVELYKEVDYLLRNXWXPCDEFXLQNGXVYREHGSTXXYYXGRXYWTMXKLPLVACADSXXXXNESXECKTXYPNAFIKII

SEQ ID NO: 1588 - protein, 140 aa, Brassica napus
MAALTASIATSTAFAAKPRLARPPARLSVSCSASSGDNTTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDG

SEQ ID NO: 1589 - protein, 95 aa, Brassica napus
  misc_feature (7)..(7): Xaa can be any naturally occurring amino acid
MEVNGEXKRSYRREDEEKEVYYPLLNSPCSAFHKTVQAILKCLGLESSSIPPSSSSSEDPGTETVQETGFMAMVARLTRRRPRPPYSSGQPGQIN

SEQ ID NO: 1590 - protein, 143 aa, Brassica napus
  misc_feature (23)..(24): Xaa can be any naturally occurring amino acid
  misc_feature (26)..(26): Xaa can be any naturally occurring amino acid
  misc_feature (28)..(29): Xaa can be any naturally occurring amino acid
  misc_feature (31)..(32): Xaa can be any naturally occurring amino acid
  misc_feature (34)..(34): Xaa can be any naturally occurring amino acid
  misc_feature (39)..(39): Xaa can be any naturally occurring amino acid
  misc_feature (49)..(49): Xaa can be any naturally occurring amino acid
  misc_feature (53)..(53): Xaa can be any naturally occurring amino acid
  misc_feature (58)..(64): Xaa can be any naturally occurring amino acid
  misc_feature (66)..(66): Xaa can be any naturally occurring amino acid
  misc_feature (70)..(71): Xaa can be any naturally occurring amino acid
  misc_feature (78)..(78): Xaa can be any naturally occurring amino acid
  misc_feature (82)..(83): Xaa can be any naturally occurring amino acid
  misc_feature (87)..(87): Xaa can be any naturally occurring amino acid
  misc_feature (89)..(90): Xaa can be any naturally occurring amino acid
  misc_feature (93)..(94): Xaa can be any naturally occurring amino acid
  misc_feature (96)..(96): Xaa can be any naturally occurring amino acid
  misc_feature (103)..(106): Xaa can be any naturally occurring amino acid
  misc_feature (109)..(109): Xaa can be any naturally occurring amino acid
  misc_feature (111)..(116): Xaa can be any naturally occurring amino acid
  misc_feature (118)..(118): Xaa can be any naturally occurring amino acid
  misc_feature (126)..(126): Xaa can be any naturally occurring amino acid
  misc_feature (131)..(132): Xaa can be any naturally occurring amino acid
  misc_feature (134)..(134): Xaa can be any naturally occurring amino acid
  misc_feature (141)..(141): Xaa can be any naturally occurring amino acid
NVKRKEEEEVVVASSMLSSAAVXXSXAXXTXXAXFTGLXASAAFPVTRXAYNXITSIXXXXXXXSXMKVXXPVEKKKXETLXXLPDXTXXELXXEXDYLLRNXXXXCGXFXXXXXXVXREHGNTPXYYDGXXWXMWKLPLXGC

SEQ ID NO: 1591 - protein, 183 aa, Brassica napus
  misc_feature (150)..(152): Xaa can be any naturally occurring amino acid
  misc_feature (154)..(156): Xaa can be any naturally occurring amino acid
  misc_feature (173)..(173): Xaa can be any naturally occurring amino acid
MVADLCLEDDVKGEDNVKAEFICPFCADEFDILGLCCHIDEEHPVEAKNGVCPVCSKKVGLDIVGHITTQHCNVFKVQRRRRLRRGGYSSNYLTLRKSLGVGGASTFIPSSNLDSDPLLSSFMFRPPLANELVIPITEGDSVTKVSPKDXXXRXXXSNEDQEKARKSEFVRDXLWSTMLEDKF

SEQ ID NO: 1592 - protein, 137 aa, Brassica napus
RNLVRLLGFCLEGEERVLVYEYVPNKSLDYFLFDPAKQAQLDWSRRYKIIGGVARGILYLHQDSRLTIIHRDLKASNILLDADMNPKIADFGMARIFGLDQTQENTTRIVGTYGYMSPEYAMHGQYSMKSDVYSFGV

SEQ ID NO: 1593 - protein, 153 aa, Brassica napus
MASAVGGGSDVEVGFAKLQGEDFEYYMQSYSIMLGRNSKKSTVDVDLSSLGGGMNISRNHARIFYDFTRRRFSLEVLGKNGCFVEGVLHLPGNPNVKLDSQDLLQIGDKEILGGPRLVVSRPVGPCHKYPGSGASPCSARGPPLTSPFPPLPP

SEQ ID NO: 1594 - protein, 230 aa, Brassica napus
DESSSAKRWLPLEANPDVMNQFLWGLGLAPDAAECNDVFGLDDELLEMVPKPVLAVLFLYPITKKSEEERIEQDKEIKEKVHIDKVYFMKQTVGNACGTIGLLHAIGNITSEIKLSEGSFLDKFFKASSNMTPMERGRFLENDSQIEDAHSAAVTAGETPASDDVNTHFICLACVDGELYELDGRKAGPISHGASSPATLLKDSTKVIKKIIEKNPDTLNFNVMAIYKRT

SEQ ID NO: 1595 - protein, 125 aa, Brassica napus
  misc_feature (11)..(12): Xaa can be any naturally occurring amino acid
  misc_feature (28)..(28): Xaa can be any naturally occurring amino acid
  misc_feature (113)..(113): Xaa can be any naturally occurring amino acid
  misc_feature (115)..(115): Xaa can be any naturally occurring amino acid
MFGRSALQRAXXFCPENLGQNALNLIGXIGFSLFVVGVLVFTIIAATYEPEDPLFHPSDKITTFLTSTSNATLRSDDSVVKTGEDFMAVNQTAFAAFINITDVEATANEENAXGXQVDCDASVPL

SEQ ID NO: 1596 - protein, 327 aa, Brassica napus
  misc_feature (132)..(132): Xaa can be any naturally occurring amino acid
  misc_feature (201)..(201): Xaa can be any naturally occurring amino acid
  misc_feature (234)..(234): Xaa can be any naturally occurring amino acid
  misc_feature (303)..(303): Xaa can be any naturally occurring amino acid
MGEKPISGNLKKLTIETGRSETLVVCFGEMLIDFVPTVGGVSLAEAPAFKKAPGGAPANVAVGVSRLGGSSAFVGKVGDDEFGKMLAEILKLNNVDNSGMRFDHKARTALAFVTLRADGEREFLLFLLPRAXYFHYGSISLIKEPCRSTHLAAMKIAKAAGSLLSYDPNLRLPLWPSEEAARKEIMSIWDLADVIKISEDXITFLTGGDDPYSDEVVLQKLFHPNLKLLVVSEXPNGCRYYTKEFKGRVGGVKVKAVDTTGAGDAFVSGLLHSLASDLTLLTDEKKLREALLFANACGAITVXTERGAIPAMPPMDAVQELLKSSGS

SEQ ID NO: 1597 - protein, 149 aa, Brassica napus
SVTQSLIIGIIFSVLVVFFHDQIGWIFSSSETVIEAVNDLSILLAFTILLNSIQPVLSGVAVGSGWQSFVAYINLGCYYFVGLPLGYVMGWIFKSGVKGIWAGMIFGGTAIQTLILISIVMRCDWEKEARKASMRIQNWSVSDATKKSE

SEQ ID NO: 1598 - protein, 201 aa, Brassica napus
  misc_feature (111)..(111): Xaa can be any naturally occurring amino acid
  misc_feature (186)..(186): Xaa can be any naturally occurring amino acid
MAKVLDLSLVLFVLCVSTAAIAMARNLGEESSDDTEFIKSSCEIATYPELCFQSLSSYASEIKKRPLQLAETALAVSMARPKSAKTYISDMTDYKGITKRQHEAVLDCVEXMGDTVDRLSKSLKELKNLEEGESKEDFWFCLSNVRTWTSAALTDETTCLDGFGGKGMDGELKSLVKAHIVRVAQXTSNALALINVYASKH

SEQ ID NO: 1599 - protein, 142 aa, Brassica napus
KFWDISFPVAAMSLLNYLKNMTSVACMGRLGSLELAGGALAVGFTNITGYSVLSGLATGMEPLCGQAIGSKNPSLASLTLKRTIFLLLLASLPISLLWLSLQPLMLILRQQEDITRVASLYCSFSLPDLLANSFLHPLRIYL

SEQ ID NO: 1600 - protein, 69 aa, Brassica napus
MAIPKEEESREEHSTSFLLDALYCEEEKWDDEEVVEENSSYSSSSSTTSPFVLLEQDLFWEDEDLVALF

SEQ ID NO: 1601 - protein, 128 aa, Brassica napus
  misc_feature (48)..(48): Xaa can be any naturally occurring amino acid
ELIGCLLTCDPGLSCGIAKSFISPSNACPSHYVGVFQDSPSSTQSPIXADDTSRFIWNFLADRTSTLAVNASSCTGKCNNESEVCVGGEVEGGGLCVVSTTRYVPAYSTRLKFEDNAWHVLPANSSDP

SEQ ID NO: 1602 - protein, 155 aa, Brassica napus
TDGVYQPLLQPDQLSALPESKNCELERVLADVETPLFLRLRKATMIETKLLFNLAAPAVVVYMINYLMSMSTQIFSGHLGNLELAAASLGNRGIQVFAYGLMLGMGSAVETLCGQAFGGRKYEMLGVYLQRSIVLLTLTGVLLTSIYVFSENILL

SEQ ID NO: 1603 - protein, 158 aa, Brassica napus
  misc_feature (8)..(8): Xaa can be any naturally occurring amino acid
  misc_feature (48)..(48): Xaa can be any naturally occurring amino acid
MYSLILHXRRSVELQKWRNLRVSLNILQNAFSFSNSFSSANVSPQGNXFTVSYLVESLGLTTKLAESISRKVTFEDKLNPDSVLNLLRSNGFEDSQISRIVTTYPRLLVEDAETSLRPKLQALQHRGASSSELAEIVSKVPKILEKRVGKSLSLYYDF

SEQ ID NO: 1604 - protein, 320 aa, Brassica napus
  misc_feature (51)..(51): Xaa can be any naturally occurring amino acid
  misc_feature (72)..(72): Xaa can be any naturally occurring amino acid
VTELIGNTPLVDLNNVAEGWMGRVAGNLEMKEASLMVKDRNGFSMISDAEXKGLIKPGESVLIEPTSGNTGXVGLAFTAAAKGYKLIITMPASMSVERRIILLAFGVELVLTDPAKGMKGAIAKAEEILAKTPNGYMLQQFENPANPKIHYETTGPEIWKGTDGKIDGFVSGIGTGGTITGAGKYLKEQNPNVKLYGVEPIESAILSGGKPGPHKIQGIGAGFIPSVLEVDLIDEVVQVSSDESIDMARLLALKEGLLVGISSGAAAAAAIKLAKRPENAGKLFVAVFPSFGERYLSTVLFDATRKEAESMTFQACIVSP

SEQ ID NO: 1605 - protein, 340 aa, Brassica napus
  misc_feature (119)..(119): Xaa can be any naturally occurring amino acid
  misc_feature (152)..(152): Xaa can be any naturally occurring amino acid
SLSHSPSCLTPHSLQLTTFSLFSFLFPCRCHPTVCSFSLRPPSLSPLPRPCLLLHPPLPLSRPFHLPLRLVSSSPLSPGPVAGKAWSGGFWMGEDFKCSMTKVSSDNIVPTLDSATFEXDVDVVGVHRSVCTSPVESTLTERILICGQNSWXLGKGGAFTGEISVEQLKDIGCKWVILGHSERRHVIGEKDEFIGKKAAYALSEGLGVIACIGEKLEEREAGKTFDVCFDQLKAFADAVPSWDKVVVAYEPVWAIGTGKVASPQQAQEVHVAVRDWLKKNVSEEVASKTRIIYGGSVNGGNCAELAKEEDIDGFLVGGASLKGPEFATIVNSVTSKKVAA

SEQ ID NO: 1606 - protein, 174 aa, Brassica napus
  misc_feature (173)..(173): Xaa can be any naturally occurring amino acid
MKENAGNPLHLTSLNHVSLLCRSIEESMVFYQKVLGFFPIRRPESLNFEGAWLFGHGIGIHLLRSSEPEKLPKKTEINPKDNHISFQCESMSAVEKKLEEMEIEYVRAIVEEGGIQVDQLFFHDPDGFMIEICNCDSLPVVPLIGGMARSCSRVKLHQMVQPQPQTQIHQVVXP

SEQ ID NO: 1607 - protein, 399 aa, Brassica napus
  misc_feature (46)..(46): Xaa can be any naturally occurring amino acid
  misc_feature (74)..(74): Xaa can be any naturally occurring amino acid
  misc_feature (95)..(95): Xaa can be any naturally occurring amino acid
  misc_feature (144)..(144): Xaa can be any naturally occurring amino acid
SIGTLKGKDLMGKGVFVRFLWKITPTDTSNTSVEPRFRPAIPTIKXRWITGSMVALCCPLGRPNPVSPKFSLKXLRPRLSDLLGVGCCGHRMTSXEEVQKAGRWPTCQGGVSSLVENRWFSTRKEKKNTPELPKSLPPLPAVYXHHASATAHRAHASTQGAAKYLKPSVAGFLMQKELDYLVGAVANPKKPFAAIVGGSKVSTKIGVIESLLSTVDILLLGGGMIFTFYKAQGHSVGSSLVEEDKLDLAKSLMEKAKAKGVSLLLPTDVVIADKFAPDANSKIVPATAIPDGWMGLDVGPDSIKTFSEALDTTQTIIWNGPMGVFEFEKFAAGTEAVAKQLAELSGKGVTTIIGGGDSVAAEEKVGLADKMSHISTGGGASLELLEGKPLPGVLALDDA

SEQ ID NO: 1608 - protein, 211 aa, Brassica napus
MATKRSVGTLKEADLKGKSVFVRVDLNVPLDDNSNITDDTRIRAAIPTIKYLMENGSRVVLCSHLGRPKGVTPKFSLKPLVPRLSELLGVEVVMANDSIGEEVQKLVAGLPEGGVLLLENVRFYKEEEKNDPEFAKKLAALADVYVNDAFGTAHRAHASTEGVAKYLKPSVAGFLMQKELDYLVGAVANPKKPFAAIVGGSKVSTKIGVIE

SEQ ID NO: 1609 - protein, 123 aa, Brassica napus
MAGGGFATAPANGVEFEAKITPIVIISCIMAATGGLMFGYDVGVSGGVTSMPDFLKKFFPVVHRKVEAGADKNSNYCKYDNQGLQLFTSSLYLAGLTATFFASYTTRTLGRRPTMLIAGVFFI

SEQ ID NO: 1610 - protein, 311 aa, Brassica napus
  misc_feature (41)..(41): Xaa can be any naturally occurring amino acid
LLATLNCYRVSAPFFNSVSCSTSKSLSFSAPRWRALEVSPXPSSKSAYRVIYRAGSLTVGDYATDTVTFGTHGKVNDVALGCGHDNQSIFTGAVWVLGLGGGALSMKEKSFATSFSYCLVDRDSGKSSSLDFNSVQAGSGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKSIDLPAKNYLIPVDDAGTFCFAFAPTSSSLSIIGNVQQQGTRITYDLANNLIGLSANQC

SEQ ID NO: 1611 - protein, 308 aa, Brassica napus
  misc_feature (223)..(223): Xaa can be any naturally occurring amino acid
  misc_feature (230)..(230): Xaa can be any naturally occurring amino acid
  misc_feature (233)..(233): Xaa can be any naturally occurring amino acid
  misc_feature (235)..(235): Xaa can be any naturally occurring amino acid
  misc_feature (246)..(246): Xaa can be any naturally occurring amino acid
  misc_feature (256)..(256): Xaa can be any naturally occurring amino acid
  misc_feature (268)..(268): Xaa can be any naturally occurring amino acid
  misc_feature (277)..(278): Xaa can be any naturally occurring amino acid
LASRRVRETHGESVDPVVRYLSLTCSAPQCASLRASACRSDKCLYQVRYGDGSFTVGEYATDTVTFGSSGKVDNVALGCGRDNEGLFTGAAGLLGLGGGALSMTSQIKAKSFSYCLVDRDSGKSSSLDFNSVQVGAGDATAPILRNSKIDTFYYVGFSGFSVGGQQVSIPSSVFAVDASGAGGVILDCGTAVTRLQTQAYNSLRDAFVKLTANLKKGTSSISXFDTCYDXSSXSXVKVPTVAFHFXGGKSIDLPAXNYLIPVDDAGTXCFAFAPTSXXLSIIGNVQQQGTRITYDLANNLIGLSANQC

SEQ ID NO: 1612 - protein, 262 aa, Brassica napus
VDHASGSFTVGDYATDTVTFGTNGKVNDVALGCGHDNEGLFTGAAGLLGLGGGALSMTNQIKATSFSYCLVDRDSGKSSSLDFNSVQAGTGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKSIDLPAKNYLIPVDDAGTFCFAFAPTSSSLSIIGNVQQQGTRITYDLANNLIGLSANQC

SEQ ID NO: 1613 - protein, 305 aa, Brassica napus
MDHEEIPSMPSTPATTPGTPGAPLFGGFDGKRSGHNGRYTPKSLLKSCKCFSVDNEWALEDGRLPPVSCALPPPNVSLYRKLGAEFVGTLILIFAGTATAIVNQKTDGAVTLIGCAASAGLAVMIVILSTGHISGAHLNPAVTISFAALKHFPWKHVPVYIGAQVLASVCAAFALKAVFEPTMSGGVTVPTVALSQAFALEFIISFNLMFVVTAVATDTRAVGELAGIAVGAPVMLNILIAGPATSASMNPVRTLGPAIAANNYRAIWVYLTAPILGALIGAGTYTVVKLPEEDEEHKEKRSFRR

SEQ ID NO: 1614 - protein, 159 aa, Brassica napus
LFSPSSLTLSHSDPGKSSWRCNDNLIVIRFPISSNEDMDLFCGECSSGESTAEFSSEEVESWPDDSIASCIEDERHFVPGLDYLSRFHSQSLDASAREESVTWILQVQAFYSFQPLTAYLAVNYMDRFLYARRLPETSGWPMQLLAVACLSLAAKMEEV

SEQ ID NO: 1615 - protein, 125 aa, Brassica napus
  misc_feature (103)..(103): Xaa can be any naturally occurring amino acid
  misc_feature (119)..(119): Xaa can be any naturally occurring amino acid
MNPANATATEAGGGDEYEVGKTYEVKLTTGIEFKGIVLAYDSDPHVIIFQEGTSRGNCKSMTTRTVNASFISKANLIGKCKDPLDSNKKKCFVDLNGLLEKEXIAIRKIESIGVGVTAXAQKIFD

SEQ ID NO: 1616 - protein, 146 aa, Brassica napus
  misc_feature (9)..(9): Xaa can be any naturally occurring amino acid
  misc_feature (21)..(21): Xaa can be any naturally occurring amino acid
  misc_feature (28)..(28): Xaa can be any naturally occurring amino acid
  misc_feature (31)..(31): Xaa can be any naturally occurring amino acid
  misc_feature (40)..(40): Xaa can be any naturally occurring amino acid
  misc_feature (45)..(45): Xaa can be any naturally occurring amino acid
  misc_feature (59)..(59): Xaa can be any naturally occurring amino acid
  misc_feature (107)..(107): Xaa can be any naturally occurring amino acid
PEVEQEPEXKEMTLEEYEKIXEEKKKAXQAXKVEERKVDXKVFEXMQQLSNKKSNDEEXFIKLGSDKDKRKDAAEKEEKAKKSLSINEFLKPANGETYNPRGGYRGXGGRGQRDGKVNGGGNQRNGGASAPAPAIGDSAQFPSLAS

SEQ ID NO: 1617 - protein, 125 aa, Brassica napus
QEENSHEFKKRPCKCTRGSETVYHLFVRERGTFDMESIFLRDGDLTLEALESAVLTKFKSLRHEPIWKKERPASLRGDGVLRVHAMYPLGLTQRRALYNFKFGKNSSLSTHIQSNPCPKFEVVFV

SEQ ID NO: 1618 - protein, 311 aa, Brassica napus
  misc_feature (271)..(271): Xaa can be any naturally occurring amino acid
  misc_feature (308)..(308): Xaa can be any naturally occurring amino acid
MAKSPETEHPNKAFGWAAKDKSGVLSPFHFSRRDNGDNDVTVKILYCGVCHTDLHTIKNDWGFSYYPVVPGHEIVGIATKVGKNVTKFREGDRVGVGVITGSCQSCESCNQDLENYCPQMSFTYNSIGSDGTKTYGGYSESIVVDQRFVLQFPEGLPSDSGAPLLCAGITVYSPMKYYGMTEPGKHLGVAGLGGLGHVAVKIGKAFGLKVTVISSSPSKEDEAINRLGADSFLVSSDPQKMKAAIGTMDYIIDTVSAVHALFPLLGLLKVXLGLPEKPLELPIFPLVLGRKMVGGSDIGGMKETQEMXEFC

SEQ ID NO: 1619 - protein, 152 aa, Brassica napus
KELGNKKENQTERIWRESKMCLRYSICLILFSLISLQAFAKKTGDVSELQIGVKFKPATCEVKAHKGDMIKVHYRGKLTDGTVFDSSFERDEPFEFELGSGQVIKGWDQGLLGACVGEKRKLKIPAKLGYGEQGSPPTIPGGATLIFDKDVI

SEQ ID NO: 1620 - protein, 135 aa, Brassica napus
MDLSSRFTSILVVFLTITTSFAEIRKSEIRSDDRPIIPLDEFGFTHTGRLELDASKISLSNTNPDLDLSKVGFFLCTRDAWVHVIQQLEEGEITCALQSDLVKHVFTFNKLNRNTCFSTVFSENDADQYSLVFAN

SEQ ID NO: 1621 - protein, 138 aa, Brassica napus
  misc_feature (18)..(18): Xaa can be any naturally occurring amino acid
VLNPKGRIWTMVAGGGAXVIYADTVGDLGYASELGNYAEYSGAPNQEEVLQYARVVLDCATADPDGRKRALLIGGGIANFTDVAATFSGIIQALREKESKLKASRMHLYVRRGGPNYQTGLAKMRKLGAEIGVPIEVY

SEQ ID NO: 1622 - protein, 158 aa, Brassica napus
RVSLCFVLIESEFRMESSRSRKRTRQAHDCAAAPPPEREVVARGGASPPWREDDRDGHFVFDLGENLTRRYKILSKMGEGTFGRVLECWDRETHEYVAIKVVRSIRKYRDAAMIEIDVLNRLAENEKYRSLCVQIQRWFDYRNHICIICMSCGLSTLI

SEQ ID NO: 1623 - protein, 139 aa, Brassica napus
  misc_feature (7)..(7): Xaa can be any naturally occurring amino acid
  misc_feature (9)..(10): Xaa can be any naturally occurring amino acid
  misc_feature (12)..(12): Xaa can be any naturally occurring amino acid
  misc_feature (16)..(18): Xaa can be any naturally occurring amino acid
  misc_feature (21)..(22): Xaa can be any naturally occurring amino acid
  misc_feature (29)..(29): Xaa can be any naturally occurring amino acid
  misc_feature (34)..(38): Xaa can be any naturally occurring amino acid
  misc_feature (45)..(49): Xaa can be any naturally occurring amino acid
  misc_feature (51)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (62)..(63): Xaa can be any naturally occurring amino acid
  misc_feature (65)..(65): Xaa can be any naturally occurring amino acid
  misc_feature (82)..(82): Xaa can be any naturally occurring amino acid
  misc_feature (85)..(87): Xaa can be any naturally occurring amino acid
  misc_feature (91)..(91): Xaa can be any naturally occurring amino acid
  misc_feature (101)..(101): Xaa can be any naturally occurring amino acid
  misc_feature (111)..(111): Xaa can be any naturally occurring amino acid
  misc_feature (115)..(115): Xaa can be any naturally occurring amino acid
  misc_feature (118)..(119): Xaa can be any naturally occurring amino acid
  misc_feature (121)..(122): Xaa can be any naturally occurring amino acid
  misc_feature (127)..(127): Xaa can be any naturally occurring amino acid
  misc_feature (131)..(131): Xaa can be any naturally occurring amino acid
  misc_feature (133)..(133): Xaa can be any naturally occurring amino acid
MASSMLXSXXGXTSPXXXTMXXPFSGLKXSAAFXXXXXGNNDITXXXXXGXXVXCMKXXXPXXKXKFETLSYLPDLTEVELXKEXXXLLRXKWIPCVEFEXQHGFAYREHXSTPXYYXXRXXTMWKXPLFXCXDSAQVL

SEQ ID NO: 1624 - protein, 89 aa, Brassica napus
  misc_feature (84)..(84): Xaa can be any naturally occurring amino acid
MFYRGYGDGPDGRETGPKRQRMSAQGPPGPFYGPHPGSAFMYNPYGFVPPPVFPVVKLRGLPFDCAERDVLDFFGGLDVVDVLXVHKNG

SEQ ID NO: 1625 - protein, 35 aa, Brassica napus
MFDDQDLGFFANFLGIFIFILVIAYHFVVADPKFE

SEQ ID NO: 1626 - protein, 386 aa, Brassica napus
  misc_feature (263)..(263): Xaa can be any naturally occurring amino acid
  misc_feature (285)..(285): Xaa can be any naturally occurring amino acid
MARKKIREYDSKRLVKEHFKRLSGKELPIRSVQINQETDLNELVEKEPWLSSEKLVVKPDMLFGKRGKSGLVALKLDFAEVATFVKDRLGKEVEMSGCKGPITTFIVEPFVPHNEEFYLNIVSDRLGCSISFSECGGIDIEENWDKVKTITVPTGSSLTPEICAPLVATLPLEIKGELEDFIQVIFTLFQDLDFTFLEMNPFALVDGKPYPLDMRGELDDTAAFKNFKKWGDIEFPMPFGRVMSPTESFIHGLDEKTSASLKXTVLNPKGRIWTMVAGGGASLIXADTVCVISGMHRSCGNYAEYSGAPKEDEVLQYARVVIDCATANSDCITRALLIGGGIANYTDVCATFNGIILALKEKETKPKAARMHIYVRRGGPNYQKGL

SEQ ID NO: 1627 - protein, 150 aa, Brassica napus
ADEEQVWSWGAGTDGQLGTAKLQDEHLPQLLSLTSLPSISMLACGGAHVIALTSGGKVFTWGRGNSGQLGHGDNLNASLPKPLFFFDDDYVISQASAGWSHSAFVSDSGSLFTCGNGSFGQLGHGDNISLTSPAKVSYFVDKSVKMVACG

SEQ ID NO: 1628 - protein, 134 aa, Brassica napus
  misc_feature (90)..(90): Xaa can be any naturally occurring amino acid
  misc_feature (121)..(121): Xaa can be any naturally occurring amino acid
  misc_feature (123)..(123): Xaa can be any naturally occurring amino acid
  misc_feature (125)..(128): Xaa can be any naturally occurring amino acid
  misc_feature (130)..(130): Xaa can be any naturally occurring amino acid
  misc_feature (133)..(133): Xaa can be any naturally occurring amino acid
MGNNETSASETAAAKQKKVDDWLPITSSRNAKWWYSAFHNVTAMVGAGVLSLPYAMSNLGWGPGVTLMIMSWVITLYTLWQMVEMHEIVXPGKRFDRYHELGQEAFGEKLGLWIIVPQQLXIXEXXXXIXYMXT

SEQ ID NO: 1629 - protein, 124 aa, Brassica napus
MENLPPGYRPNVGVCLINSDNLVFVASRLNVPGAWQMPQGGIEDGEDPKSAAMRELQEETGVVSAAIIAEVPTWLTYDFPPAVKAKVNRLWGGEWHGQAQKWFLVRLINDEDEREINLANNEAD

SEQ ID NO: 1630 - protein, 119 aa, Brassica napus
MAGGRGKAKPLEFTPTWIVASVCSIIVIISLLFERLLHRLGKRLKKSQKKPLYEALLKVMEELMLLGFISLLLNVFQAPLGKVCVRRSAMRHMLPCKPPPRRPHKTEHFAHAVFTGVMG

SEQ ID NO: 1631 - protein, 46 aa, Brassica napus
  misc_feature (10)..(10): Xaa can be any naturally occurring amino acid
  misc_feature (12)..(12): Xaa can be any naturally occurring amino acid
  misc_feature (26)..(26): Xaa can be any naturally occurring amino acid
DRSSIILPLXGXRQFHEVIGHFVEIXKDKIDGMTGANVRTIDPPHR

SEQ ID NO: 1632 - protein, 156 aa, Brassica napus
  misc_feature (148)..(155): Xaa can be any naturally occurring amino acid
MALEEEEEIQNAPFCMLFCEEDSSGFDEEDEDSCDDKSDEKFPFFHLGFLDRCMSWEEDELSSLISKENEFRPSLTEEGVLDDEYLALCREKAVDWILRVKSHYGFSSLTALLAVNYFDRFITSRKFQTEFPWMSQLTALACLSLAAXXXXXXXXP

SEQ ID NO: 1633 - protein, 120 aa, Brassica napus
MYMIESKGGAIVCMLLALLFLGTWLAIMTLTERRGRLPQHTYLDYTITNLLAAVIIAFTLGQIGPSRPNFITQLSQDNWQSVMFAMAGGIVLSLGNLATQYAWAFVGLSVTEVVTSSITV

SEQ ID NO: 1634 - protein, 193 aa, Brassica napus
MTNKTSLGLSVFFFLLTLAAVTSDLESDRRALIALRDGVHGRPLLWNLTAPPCTWGGVQCNAGRVTALRLPGVGLSGPLPIAIGNLTKLETLSFRFNALTGPLPADFANLTLLRYLYLQGNAFSEEIPSFLFDLPNVIRINLAQNNFSGQIPVNVNSATRLATLYLEDNQLTGPIPEIKLKLQQFNVSSNQLN

SEQ ID NO: 1635 - protein, 338 aa, Brassica napus
  misc_feature (65)..(65): Xaa can be any naturally occurring amino acid
  misc_feature (124)..(124): Xaa can be any naturally occurring amino acid
  misc_feature (141)..(141): Xaa can be any naturally occurring amino acid
MDAKEASPTDLKQPSEAADNAAAAASMETENGDQTKEPDCVSSLIPGWFSEMSPMWPGEAHWLKXEKVLFQGYFDYQDFFVLRVCSTMVRVFGNCMEYSNSSSQTNSALSREMIPHLPLCSFPXPYMTVLVIRGGRVEGVXRGVGQMATSAPFCARYPNPKKVLVIGGGDGGVAIGFEDPRVNLVIGDGVAFLKNAAEGSYDAVSPDSSDPIGPAKELFEKPFFQSVARALRPGGVVCTQAESLWLHMDIIEDIVSNCREIFKGSVNYAWTSVPTYPSGVIGFMLCSTEGPDVDFKHPVNPIDDSKSSGPLKFYNAEIHSAAFCLPSFAKKVIESKTN

SEQ ID NO: 1636 - protein, 274 aa, Brassica napus
  misc_feature (107)..(107): Xaa can be any naturally occurring amino acid
  misc_feature (148)..(148): Xaa can be any naturally occurring amino acid
  misc_feature (151)..(151): Xaa can be any naturally occurring amino acid
  misc_feature (159)..(161): Xaa can be any naturally occurring amino acid
  misc_feature (165)..(165): Xaa can be any naturally occurring amino acid
  misc_feature (173)..(174): Xaa can be any naturally occurring amino acid
  misc_feature (176)..(177): Xaa can be any naturally occurring amino acid
  misc_feature (179)..(182): Xaa can be any naturally occurring amino acid
  misc_feature (200)..(200): Xaa can be any naturally occurring amino acid
  misc_feature (251)..(251): Xaa can be any naturally occurring amino acid
MARKKIREYDSKRLLKEHLKRLANINLQIRSAQVTEATDFTELTNQEPWLSSTKLVVKPDMLFGKRGKSGLVALKLDLAEVAEFVKARLGSEVEMGGCKAPITTFIXVEPFVPHDQEYYLSVVSDRLGCTISFSECGGIEIEENWDKXKTXFLPCGKVXXXLEVXAPLIATLXXLXXKXXXXLLEPYPLDMRGELDDTAXAFKNFNKGGDIEFPLPFGRVLSPTESFIHGLNEKTSVSLKFTVLNPKGRIXWTMAAGSSASVIHADTGGDLGYS

SEQ ID NO: 1637 - protein, 151 aa, Brassica napus
MVKESEYYDVLGVKTDASAADIKKAYYIKARQVHPDKNPNDPQAAKNFQALGEAYQVLSDPEKRTAYDNYGKEGVQQDAMVDPAAVFGMLFGSELFEDYIGQLALASIASLDAEVESHEPEIRKKLLQDKIKAMQKEREDKLVTTLKSKLE

SEQ ID NO: 1638 - protein, 189 aa, Brassica napus
SLAFSGSLRLGPTAQPVRVKYTQLLRNPRRSSLYYVNLVAIRVAKKVVDIPPAAIAFNPTTGAGTIFDSGTVYTRLSKPVYEAVRNEFRKRVKPRTAVVTSLGGFDTCYSGKITVPTITFMFKGVNMTMPADNLMLHSSAGSLSCLAIASSPENVNSVVNVIASMQQQNHRVLIDVPNGRLGLARERCS

SEQ ID NO: 1639 - protein, 75 aa, Brassica napus
  misc_feature (7)..(7): Xaa can be any naturally occurring amino acid
  misc_feature (45)..(45): Xaa can be any naturally occurring amino acid
  misc_feature (53)..(53): Xaa can be any naturally occurring amino acid
  misc_feature (59)..(59): Xaa can be any naturally occurring amino acid
EKEEVVXAYSMLSSAAVVTSPAQATMGAPFTGLKSSSAFPVTRKXNNDITSIXSNGGRXVPSIFASINLPSLPLP

SEQ ID NO: 1640 - protein, 147 aa, Brassica napus
  misc_feature (142)..(142): Xaa can be any naturally occurring amino acid
MEKSADHHKTSHACSGGAAAEKWEEVSTAFRTAETMLRLAPVGLCLAALVITLKDSQNNEFGSVSYSNLSAFGYLVHANGICAGYSLLSAAIAAMPGSSSTMPRVWTFFCLDQVLTYVVLAAGAVSTEVLYLAYKGDNAITXSDACS

SEQ ID NO: 1641 - protein, 69 aa, Brassica napus
  misc_feature (57)..(57): Xaa can be any naturally occurring amino acid
MADWGPVVIATVLFVLLTPGLLFQLPAHGRIVGFGTMHTSGIAILVHAVLYFALITXFLIAIGVHIYAD

SEQ ID NO: 1642 - protein, 95 aa, Brassica napus
  misc_feature (33)..(33): Xaa can be any naturally occurring amino acid
LVEGETPVEMVLVMTVEPGFGGQKFMPNMMDKXLRQKYPTLDIEVDGGLGPSTIEAAAAAGANCIVAGSSVFGAPESGKVISLLRTSVEKAQPTT

SEQ ID NO: 1643 - protein, 289 aa, Brassica napus
  misc_feature (18)..(18): Xaa can be any naturally occurring amino acid
  misc_feature (20)..(20): Xaa can be any naturally occurring amino acid
  misc_feature (44)..(44): Xaa can be any naturally occurring amino acid
  misc_feature (46)..(46): Xaa can be any naturally occurring amino acid
  misc_feature (75)..(75): Xaa can be any naturally occurring amino acid
  misc_feature (78)..(78): Xaa can be any naturally occurring amino acid
  misc_feature (96)..(96): Xaa can be any naturally occurring amino acid
  misc_feature (115)..(115): Xaa can be any naturally occurring amino acid
  misc_feature (119)..(119): Xaa can be any naturally occurring amino acid
  misc_feature (221)..(221): Xaa can be any naturally occurring amino acid
  misc_feature (269)..(271): Xaa can be any naturally occurring amino acid
  misc_feature (273)..(274): Xaa can be any naturally occurring amino acid
  misc_feature (276)..(276): Xaa can be any naturally occurring amino acid
IRNWFDYRNHICIVFEKXGXSLYDFLRKNSYRSFPIDLVRELGXRXLLESVAYMHDLRLIHTDLKPENILLVSSXYIXIPDYKFLSRPTKDGSYFXNLPKSSAIKLIDFGSTTFXHQDXNYIVSTRHYRAPEVILGVGWNYPCDLWSIGCILVELCSGEALFQTHENLEHLAMMERVLGPLPPHMVLRADRRSERYFRRGAKLDWPEGATSRDSLKAVWKXPRLPNLIMQHVDHSAGDLIDLLQGLLRYDPAVRLKAREALNHPFFTRXXXQXXPXNPNPGPFLYNHKN

SEQ ID NO: 1644 - protein, 141 aa, Brassica napus
MPRSLKPLDLGIQIPYHFRCPISLQLMRDPVTVCTGQTYDRTSIESWVSTGTDTTCPVTRAPLSDFTLIPNHTLRRLIQEWCVANRSNGVERIPTPKQPADPTSVRALLSQASAACGTHVSVRSRAAALRRLRAFARDSEK

SEQ ID NO: 1645 - protein, 113 aa, Brassica napus
MSGAGKKVADVAFKASRTIDWEGMAKVLVTDEARREFSNLRRAFDEVNTQLQTKFSQEPEPIDWDFYRKGIGAGIVDMYKEAYDSIEIPKYVDNVTPEYKPKFDALLVELKEA

SEQ ID NO: 1646 - protein, 118 aa, Brassica napus
MSGAGKKVADVAFKASRTIDWEGMAKVLVTDEARREFSNLRRAFDEVNTQLQTKFSQEPEPIDWDFYRKGIGSGIVDMYKEAYDSVEIPKYVDNVTPEYKPKFDALLVELKEAEQKSL

SEQ ID NO: 1647 - protein, 168 aa, Brassica napus
MSGAGKKVADVAFKASRTIDWEGMAKVLVTDEARREFSNLRRAFDEVNTQLQTKFSQEPEPIDWDFYRKGIGSGIVDMYKEAYDSVEIPKFVDTVTPEYKPKFDALLVELKEAEQKSLKESERLEKEIVDVQEISKKLSTMTADEYFEKHPELKKKFDDEIRNDYWGY

SEQ ID NO: 1648 - protein, 112 aa, Brassica napus
  misc_feature (10)..(11): Xaa can be any naturally occurring amino acid
  misc_feature (99)..(99): Xaa can be any naturally occurring amino acid
  misc_feature (106)..(106): Xaa can be any naturally occurring amino acid
MFSLIISGRXXLELHKWRYLRDSLAFLQNPSAFSISFSSASAAADVSRRKGNNFTVSYLVESLGFNTKLAESIWRKVTTEEAKCCNPDSVLTLLRSHGXTDSHISXIIRTYP

SEQ ID NO: 1649 - protein, 151 aa, Brassica napus
  misc_feature (60)..(60): Xaa can be any naturally occurring amino acid
  misc_feature (70)..(70): Xaa can be any naturally occurring amino acid
  misc_feature (115)..(115): Xaa can be any naturally occurring amino acid
MATVNPFDLLDDDTEDLHKLVAAKPLKVEKTAPVQLGKLPTKPLPPSQAVREGKNGPGGXGGRGGGARGXGGRDRGGLGSTGGPKEHMMATDALRKEMERGRGGSVGGYRGRGGXGRGGFNSGESGDFERPRRNFDRQSGTGHGNGFKRDG

SEQ ID NO: 1650 - protein, 82 aa, Brassica napus
  misc_feature (39)..(39): Xaa can be any naturally occurring amino acid
  misc_feature (48)..(48): Xaa can be any naturally occurring amino acid
  misc_feature (50)..(51): Xaa can be any naturally occurring amino acid
  misc_feature (54)..(55): Xaa can be any naturally occurring amino acid
  misc_feature (58)..(58): Xaa can be any naturally occurring amino acid
  misc_feature (61)..(61): Xaa can be any naturally occurring amino acid
  misc_feature (63)..(64): Xaa can be any naturally occurring amino acid
  misc_feature (70)..(70): Xaa can be any naturally occurring amino acid
  misc_feature (75)..(75): Xaa can be any naturally occurring amino acid
MAASANPPGNNQEGSSAAQKGTSSSPAANGAAVKSVDNXGNTTVDNSXTXXAAXXHNXGIXVXXTPEEPXLLQQXPPQKPNN

SEQ ID NO: 1651 - protein, 123 aa, Brassica napus
  misc_feature (11)..(11): Xaa can be any naturally occurring amino acid
  misc_feature (20)..(20): Xaa can be any naturally occurring amino acid
  misc_feature (25)..(25): Xaa can be any naturally occurring amino acid
  misc_feature (29)..(29): Xaa can be any naturally occurring amino acid
  misc_feature (32)..(32): Xaa can be any naturally occurring amino acid
  misc_feature (35)..(38): Xaa can be any naturally occurring amino acid
  misc_feature (41)..(43): Xaa can be any naturally occurring amino acid
  misc_feature (46)..(46): Xaa can be any naturally occurring amino acid
  misc_feature (49)..(49): Xaa can be any naturally occurring amino acid
  misc_feature (53)..(55): Xaa can be any naturally occurring amino acid
  misc_feature (59)..(59): Xaa can be any naturally occurring amino acid
  misc_feature (61)..(61): Xaa can be any naturally occurring amino acid
  misc_feature (71)..(71): Xaa can be any naturally occurring amino acid
  misc_feature (74)..(74): Xaa can be any naturally occurring amino acid
  misc_feature (76)..(76): Xaa can be any naturally occurring amino acid
  misc_feature (78)..(78): Xaa can be any naturally occurring amino acid
  misc_feature (85)..(85): Xaa can be any naturally occurring amino acid
  misc_feature (87)..(87): Xaa can be any naturally occurring amino acid
  misc_feature (89)..(89): Xaa can be any naturally occurring amino acid
  misc_feature (97)..(101): Xaa can be any naturally occurring amino acid
  misc_feature (107)..(107): Xaa can be any naturally occurring amino acid
  misc_feature (109)..(111): Xaa can be any naturally occurring amino acid
MAYSMLSSAGXVTSPAQATXGAPFXGLKXSSXFPXXXXGQXXXTFXVSXGRRXXXVEVXPXGGKKKFENLXYLXDXTXVNGVKEXYXLXPKGDSCGXXXXXHGFFYXEXXXPPQGGELTPKPP

SEQ ID NO: 1652 - protein, 107 aa, Brassica napus
MGGVTSSVAAKFAFFPPSPPSYKVVTDELTGLLLLAPFPHRENVEIHKLQTRRGTEIMAMYVRHPMATSTLLYSHGNATDLGQMYELFIELGIHLKVNLMGYDYSGY

SEQ ID NO: 1653 - protein, 132 aa, Brassica napus
  misc_feature (2)..(2): Xaa can be any naturally occurring amino acid
  misc_feature (11)..(11): Xaa can be any naturally occurring amino acid
  misc_feature (16)..(16): Xaa can be any naturally occurring amino acid
  misc_feature (32)..(32): Xaa can be any naturally occurring amino acid
  misc_feature (35)..(35): Xaa can be any naturally occurring amino acid
  misc_feature (40)..(40): Xaa can be any naturally occurring amino acid
  misc_feature (47)..(47): Xaa can be any naturally occurring amino acid
  misc_feature (51)..(51): Xaa can be any naturally occurring amino acid
  misc_feature (60)..(61): Xaa can be any naturally occurring amino acid
  misc_feature (65)..(65): Xaa can be any naturally occurring amino acid
  misc_feature (67)..(67): Xaa can be any naturally occurring amino acid
  misc_feature (70)..(70): Xaa can be any naturally occurring amino acid
  misc_feature (75)..(75): Xaa can be any naturally occurring amino acid
  misc_feature (84)..(85): Xaa can be any naturally occurring amino acid
WXSSMLSSAAXVTSPXQATMVAPFTGLKSSAXFPXHPAKXTTNITSXASNXRKELTCMKXXPPPXKXKVXNLSYXPDLTEIELXXEVEYPPPRGFPWVPWKGFPGSGKGLGFGKGENFPPFGRPQRGPKGKG

SEQ ID NO: 1654 - protein, 65 aa, Brassica napus
  misc_feature (31)..(31): Xaa can be any naturally occurring amino acid
MSASRFIKCVTVGDGAVGKTCLLISYTSNTXPTDYVPTVFDNFSANVIVDGNTINLGLWDTAGKL

SEQ ID NO: 1655 - protein, 39 aa, Brassica napus
MLSKMFDDQDLGFFANFLGIFIFILVIAYHFLVADPKFE

SEQ ID NO: 1656 - protein, 210 aa, Brassica napus
WYSSHATLSDGKFFIIGGRDAMNYEYIPEEGQNNRKIYDSLLLKQTDDPEENNLYPFVWLNTDGNLFIFANNRSILLSPKTNQVIKEFPQLPGGSRNYPGSGSSALLPIHLYMKNPKVIPAEVLVCGGTRHDAYYRASKKVFEPALQDCARIRINSAKPRWKIETMPTPRVMSDTVILPNGDILLVIGGKRACSGWGYGPDPNFAPTLYK

SEQ ID NO: 1657 - protein, 203 aa, Brassica napus
  misc_feature (161)..(161): Xaa can be any naturally occurring amino acid
  misc_feature (187)..(187): Xaa can be any naturally occurring amino acid
MATVNPFDLLGVDAEDPSQIAVALPKKVEKAAPVLPAKLQSKHAPPSQAVRGESRNAPSGGRGPPRGSFNPGGNRPYDPKDGPKDGERNGGFRGYRESGGRGGQVGGFANGRTGDVEQRTKRVYDRHSRTGRSNDLKREGGGRGNWGTTEDDIPPPTEEPXTEVEKSPVAENESGEDDTTDAKKDSXAAEQEEKEPEDKEMTL

SEQ ID NO: 1658 - protein, 99 aa, Brassica napus
MAVDAAYLMQFVDETSFYNRIVLSHLLPSTLWDPLPHFLQTWLRNYLAGTLLYFISGFLWCFYIYYLKLNVYLPKDAIPTRKAMLLQIYVAMKAMPWYT

SEQ ID NO: 1659 - protein, 198 aa, Brassica napus
MAVDAAYLMQFVDETSFYNRIVLSHLLPSNLWDPLPHFLQTWLRNYLAGTLLYFISGFLWCFYIYYLKLNVYLPRDAIPTRKAMLLQISVAMKAMPWYTLLPTVSEHMIESGWTKCYSRIGEVSWVLYFGCIAVYLVLVEFGIYWMHRELHDIKPVYKYLHATHHMYDKQDTLSPFAGLAFYPLDGILFALPPVVSFV

SEQ ID NO: 1660 - protein, 117 aa, Brassica napus
  misc_feature (35)..(35): Xaa can be any naturally occurring amino acid
GPGGFWLRKLKGVGTGLTDNSGDFLTKDIEVGVVXNKNGEPQGLNFNVGGGLGRTHKMEFIFAGLAKQLGFVPKEDILIAVKVMVVTQRDHGRGDNVNFSRMKFLVSSWGIEKFKDV

SEQ ID NO: 1661 - protein, 141 aa, Brassica napus
AWADAWGESGKFLVSLGGPLCRVWDVKASAAIASLSKEKDEMFAYCRFSVDNAGNEVLYIAANTERGGSVITWDTATWKRRRSKLMKNYSISAFNVSADGKLLALGNMEGDVLIIDSTKMKTHQLVKKAHLGLVTALTFSP

SEQ ID NO: 1662 - protein, 135 aa, Brassica napus
  misc_feature (127)..(127): Xaa can be any naturally occurring amino acid
NIIAGSLTYYTRKHLPGLKRRRGGPEASGRFSSSGNVLSEEEQKHLLEEIQDLLSMQKGLVPTKVFVDMLRVAKILKASPTCIANLEKRIGMQLDQAGVEDLVMPSFTHTMETLYDVDSVQRIFDHXLGTDQIMT

SEQ ID NO: 1663 - protein, 66 aa, Brassica napus
  misc_feature (32)..(32): Xaa can be any naturally occurring amino acid
MLKIKRVPTVVSNYQKDESADESVGCGRNCLXACCINGARLPLVACKKLDKSGVGEKPVAFLESLV

SEQ ID NO: 1664 - protein, 140 aa, Brassica napus
RASNVVYLRCAAELLEMTEEYGEGNLISQTETFFNQVVLKSWEDSVKALQSCDEVLEYADELNITKKCIESLAMRAFTDPNLFGWPVVEHGGGPMQSPGGSVLWNGISTGARPRQTNSDWWYEDASMLSFPLFQRLITVM

SEQ ID NO: 1665 - protein, 135 aa, Brassica napus
TDGRLFIFANNRAILLDYVGDTVVKTYPAIPGGDPRSYPSTGSAVLLPLKNLEAVKIDAEVLVCGGAPKGSYLLAFRRKTFVKALDTCARIKINDENPQWMVEKMPRARVMGDMTLLPNGDVLIINGGASGSAAW

SEQ ID NO: 1666 - protein, 185 aa, Brassica napus
MSCTATDLAVLLGPNATAAADYICGQLGTVNSKFTDVAFAVDNTYLLFSAYLVFSMQLGFAMLCAGSVRAKTTMNIMLTMTNVLDAAAGGLFYYLFGYAFAFGSPSNGFIGKHNFGLKDFPSASADYSNFLYQWAFAIAAAGITSGSIAERTQFVAYLIYSSFLTGFVYPVVSHWFWSVDGWASP

SEQ ID NO: 1667 - protein, 175 aa, Brassica napus
MSLSNRDPLVVGRVVGDVLECFTRSIDLRVTYGQREVTNGLDLRPSQVLNKPRVEIGGEDLRNFYTLVMVDPDVPSPSNPHLREYLHWLVTDIPATTGTNFGNEIVSYESPRPNSGIHRIVLVLFRQLGRQTVYEPGWRQQFNTREFASLYNLGLPVAAVFYNCQRESGCGGRRS

SEQ ID NO: 1668 - protein, 175 aa, Brassica napus
MSVNNRDPLVVGGVIGDVLERFTRSIDLRVTYGQREVTNGLDIRPSQILNKPRVEIGGEDLRNFYTLVMVDPDVPSPSNPHLREYLHWLVTDIPATTGTNFGNEIVSYENPRPTSGIHRIVLVLFRQLGRQTVYEPGWRPQFNTREFAALYNLGLPAAAVYFNCQRDNGCGGRRC

SEQ ID NO: 1669 - protein, 222 aa, Brassica napus
  misc_feature (151)..(151): Xaa can be any naturally occurring amino acid
MFTYRDRVKKGEPKLLDTPRNYEASPKNAKVPISPSTEQLRSHAFLKPKNLNNGHIKSWMDEKNSNFMLSPRNLSITWSDDPNYWTWFLNKESPNEVGVEAVALKNVCWLDITGKFDTKNLTPGITYEVVFKVKLEDPAYGWDAPVNIKLXVLPSGEDKPREREGSLGEIPRYQWVDIIVGEFKPEKNSAGEIVFSMYEHESGVWKKGLFLKGVEICPKYTN

SEQ ID NO: 1670 - protein, 132 aa, Brassica napus
KGGRFPGDQKEWTESVAELLIGRINARSIWPSKGLVFLLAKSKTFDFGRSPKVFGWGQPCLPVGQSVFLRAGPGKIYCPNGEDFFSPRPNSQGTLNGASFGPPFPHLFLLTPGLLKPQRASKSFVPRGFGFK

SEQ ID NO: 1671 - protein, 229 aa, Brassica napus
  misc_feature (200)..(200): Xaa can be any naturally occurring amino acid
MRASTRVIWTVSVLMLAAVSDAIFPLPFLPFLPGFNNGIHDNDALKVAKPVATGGKAGGKRRSGGAPEAQTNWPGKWELFLENSGVSAMHAGLMPLINQVQFYDATIWRISKIKLPPGVPCHVVNAKTNKIDCWAHSVLIDVNNGAIKPLSLATDTWCSSGGLTVNGTMVSTGGYGGGANTARYLAACPNCQWHEYPQAXAAKRWYSTQATLPDGKFFIIGGRDAMNYE

SEQ ID NO: 1672 - protein, 55 aa, Brassica napus
SSAPIFVRQSNFKLPSDSKVPIIMIGPGTGLAPFRGFLQERLSLVESGVELGPSV

SEQ ID NO: 1673 - protein, 141 aa, Brassica napus
IYFGIRATITAVKVGQIFDGRGNPTVEVDVHTSTGVKVPAAVLRGASTGFYKVFNLRDGGFDYLGRGVFKVVGNVNNIIGPVLMGRDPTKQTVMDNLMVHELDGPQNKWGWCKQKLEAKAILAGSFAACKAGAVVSGILFT

SEQ ID NO: 1674 - protein, 179 aa, Brassica napus
  misc_feature (116)..(116): Xaa can be any naturally occurring amino acid
MAEASGVKRMKLGSQGLEVSAQGLGCMGLSSFYGTPKPESDAMALLHHAIESGVTFLDTSDIYGPQTNELLLGKALKNGFREKVELASKFGISYGEGKREIKGDPFYVRAACEASXLKRLDVDCIDLYYQHRIDTRVPIEITMGELKKLVEEGKIKYIGLSEASASTIRRAHAVHPITA

SEQ ID NO: 1675 - protein, 99 aa, Brassica napus
  misc_feature (12)..(12): Xaa can be any naturally occurring amino acid
VDPRVRRNIHHXPKYFSNPEVFDPSRFEVNPKPNTFMPFGSGVHACPGNELAKLQILIFLHHLVSKFRWEVVGGEGGIEYVPFPIPRNGLLATFRQHSL

SEQ ID NO: 1676 - protein, 206 aa, Brassica napus
TKLPLFVSLLLLLSAASFITRTSAETKSLTISDDDRPMILFEKFGFTRSGHVSVSVSSVSVTSPSAAAIPDPSRLGFFLMSEESLLQVLLEIQQNPSFCVLDSPHVLHLFTLHDLSPPPSSSYEHVYPVTSPNEYSLFFVNCVRDTKISMKVRTEMYNLDPNGSKDYLPAGSTRLPELYFLFFIGYIAFLGLWGYVCWVNKRVVHR

SEQ ID NO: 1677 - protein, 213 aa, Brassica napus
RPTRPGTLQSPGGSILWNGINTGARMRSSGSDWWYEDVSYLSVDLFRRLIKTMETKGIRAESLVGAMVYYARKYLPGLGRWQSRTSGSNNNKSRTSVVSFSLAAASSSSSSMSPVDQIALLETILSLLPEKRGRSFCKFLLCLLRVAFILGVDGSCVKQLERRIGMQLELATLENLLILNYSDSDTLYNVDCVERMIRHFVSSSSSSELSDFS

SEQ ID NO: 1678 - protein, 575 aa, Brassica napus
MDRIIARMKKSSGRRGDKTPTRRLERRDALKHINYDAASTSTWSAEDISASLVTRSLELPDRTSFRIFGGGDVEMDQIYKSLGLSGPDDLAISFDAWEACKKRSSSDVINRFKSFELDLHNFPVPSLSEAAPSYGGMGENKPCLERTPTITVKSRGYLVPNHGDVASGGGAGEDKRGLVRTPTITVKSRGYLVPNQSDVGIKGVRPPVLKPPPAKRPPIDHQGSSWDFLTHFAPEDGIVRRPSSSSTSDNGEETLEEEVDTGDEACSFSTNEGGGDSSSTVSNTSPIYANGGSIITSWQKGGLLGRGSFGSVFEGISGDGDFFAVKEVSLLEQGSQAQECIQQLEGEIALLSQLQHQNIVRYRGTAKDGSNLYIFLELVTQGSLSKLYQRYQLMDSVVSTYTRQILDGLKYLHDKGFIHRDIKCANILVDANGAVKLADFGLAKVSKLNDIKSCKGTPFWMAPEVINPKRTDGYGSSADIWSLGCTVLEMLTGQIPYCDLENPVQALYRIGRGVLPDIPDTLSLDGRDFITECLKVDPEERPTAAELLNHPFVRRPLAYSGSGLGSASPHVHRRG

SEQ ID NO: 1679 - protein, 86 aa, Brassica napus
  misc_feature (31)..(31): Xaa can be any naturally occurring amino acid
  misc_feature (40)..(40): Xaa can be any naturally occurring amino acid
  misc_feature (50)..(50): Xaa can be any naturally occurring amino acid
ESTDHRSGDERHSDSFTYNEIANGNLWDSCXKWTSKGCVXVIIGAKPSAXEGCDDDGVHHSVENVVDTVDTFRRQEQRSYDKRGFI

SEQ ID NO: 1680 - protein, 289 aa, Brassica napus
  misc_feature (281)..(281): Xaa can be any naturally occurring amino acid
MSAENCFGGGGGDQSTKGLATHGGQYVQYNVYGNIFEVTRKYVPPLRPSRPAPPPTRPAATNSETGEEVAIKKIGNAFDNIIDAKRTLREIKLLKHMDHENVIAVKDIIRPPLRENFNDVYIVYELMDTDLHQIIRSNQPLTDDHCRFFLYQLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVXQLPQYPRQ

SEQ ID NO: 1681 - protein, 135 aa, Brassica napus
PPVRDDESNGPMMELCTNGGGEETSNRRPIITGEPLDIEAYAAMYKGRTKIMRLIFVANHCGGNQTMQLEALRMAYDEVKKGENTQLFRDVVNKINGRLGDKYGMDSAWCEAIDRRAEQRKGKLETELSSYRTNL

SEQ ID NO: 1682 - protein, 151 aa, Brassica napus
  misc_feature (117)..(117): Xaa can be any naturally occurring amino acid
  misc_feature (136)..(136): Xaa can be any naturally occurring amino acid
PTRPRTRGVKNLAESTTDDDLKNAFAEYGEITSAVVMKDGEGGKSKGFGFVNFENADDAAKAVESLNGKMFDDKEWYVGRAQKKSERETELRVRREESLREAAERFQSSNLYVKNLXDSSVSDETLKEMFSPFGTXVTSCKVMRDPSGISK

SEQ ID NO: 1683 - protein, 107 aa, Brassica napus
VKDWGLLQRNPNNPWLRNQLMLRQKYIYYFSMVLNLVLRLAWLQTVLHSSFEHVDYRVTGLFLAALEVIRRGHWNFYRLENEHLNNAGKFRAVKTVPLPFREVDEED

SEQ ID NO: 1684 - protein, 139 aa, Brassica napus
RTRGRTRGLPRVAAPPPPPVQPPPPQPVSKVESAPQPPQPVNQVEASPLEVGEAPNGRKGKLPKPKAKDPNKREMTMEEKAKLGVNLQELPPEKLGQLIQILKKRTTNLPQDGDEIELDIEELDNETLWELDRFVTNYK

SEQ ID NO: 1685 - protein, 226 aa, Brassica napus
MDLVFYTLQLAFFYMDFDLVSKSIDKAKKLFEEGGDWERKNRLKVYEGLYCMSTRNFKKAASLFLDSISTFTTYEIFPYETFIFYTVLTSIITLDRVSLKQKVVDAPEILTVLGKIPFLSEFLNSLYECQYKAFFSAFAGMAEQIKFDQYLNPHFRFYMREVRTVVYSQFLESYKSVTVDAMANAFGVSVDFIDQELSRFIAAGKLHCKIDKVAGVLETNRPDAKN

SEQ ID NO: 1686 - protein, 114 aa, Brassica napus
MASYQNRPGAQATDEYGNPIQQLDEYGNPIGGGGYGTGGGLGATGGGGYGTGGGYGGGATGGTYGTGGEGYGAGTGALGAGAGDRHHGQQQLHKESGGGLGGMLHRSGSGSSSS

SEQ ID NO: 1687 - protein, 144 aa, Brassica napus
  misc_feature (137)..(137): Xaa can be any naturally occurring amino acid
GLKEENDAIILAVGSTKPRDLPVPGRDLSGVHFAMEFLHANTKSLLDSNLEDGNYISAKGKKVVVIGGGDTGTDCIGTSIRHGCTNIVNLELLPQPPSTRAPGNPWPQWPRVFRIDYGHQEAATKFGKDPRTYEVLXKRFIRDD

SEQ ID NO: 1688 - protein, 346 aa, Brassica napus
  misc_feature (161)..(161): Xaa can be any naturally occurring amino acid
STHASAGLKPMRHPYSLSVGQSVFRPGRVTHALNGDALAQALMDSNHPTGGLANYEEWTIDLRKLHMGPAFAQGAFGKLYRGTYKGEDVAIKLLERPENSPEKAQALEQQFQQEVSMLAFLKHPNIVRFIGACVKPMVWCIVTEYAKGGSVRQFLTKRQNXAVPLKLAVKQALDVARGMDPRDERNFIHRDLKSDNLLISADRSIKIADFGVARIEVQTEGMTPETGTYRWMAPEMIQHRPYTQKVDVYSFGIVLWELITGLLPFQNMTAVQAAFAVVNRGVRPTVPADCLPVLGEIMTRCWDANPEVRPCFAEVVNLLEAAETEIMTTARKARFRCCMTQPMTID

SEQ ID NO: 1689 - protein, 97 aa, Brassica napus
MDLVSSLPEEVLCHILSFMSTKEAALTSVLSKRWLSLWTLVPNLDVDDSVFLHPEEGKREREGILQSFMDFVERVLALQGDSPIKRFSLKCKTGIDP

SEQ ID NO: 1690 - protein, 237 aa, Brassica napus
  misc_feature (182)..(182): Xaa can be any naturally occurring amino acid
  misc_feature (196)..(196): Xaa can be any naturally occurring amino acid
  misc_feature (221)..(221): Xaa can be any naturally occurring amino acid
VDPRVRSMNTHLGIEQSRRDDLESLGFVLMYFLKGSLPWQGLKAGNKKQKYERISEKKVSTSIESLCRGYPSEFASYFHYCRSLRFDDKPDYAYLKRLFRDLFIREGFQFDYVFDWTILKYQQSQISAPPPRPHGAGVGPSSGLPPAIASAERPSGCGEEVRPSGWLLGNPRRSSGHIFNSXSSAKQKAPVSSDPXISKDVVLSSSSFSRATGSSRRATVXSSREPAVPGTDSEPSK

SEQ ID NO: 1691 - protein, 106 aa, Brassica napus
  misc_feature (77)..(77): Xaa can be any naturally occurring amino acid
  misc_feature (86)..(86): Xaa can be any naturally occurring amino acid
VIDWATGDPGGRKKALFIGGGIANFTDVAATFNGIIRALREKETRLKASRMHIYVRRGGPNYQTGLARMRALGDELXVPLEVYGPXEATMTGICKRAIDCIMLPDA

SEQ ID NO: 1692 - protein, 122 aa, Brassica napus
  misc_feature (101)..(101): Xaa can be any naturally occurring amino acid
  misc_feature (110)..(110): Xaa can be any naturally occurring amino acid
  misc_feature (115)..(115): Xaa can be any naturally occurring amino acid
MEQLVNFIIRPPRAEYDPEHDLLEKDFMMKGRWYQRKDLEVIKNSRGDVLQCSHYMPVERPEGKPLPCVIYCHGNSGCRADGSEAAIMLLPSNITVFTLDXFGSGLSGGXHVTLXLNEKDDL

SEQ ID NO: 1693 - protein, 140 aa, Brassica napus
MPRYDDRYSSNDRYGGARLYVGHLSSRTRERDLEHLFSKYGRIRDLDMKRDYAFIEFSDPRDADDARYRLDGRDFDGSRITVEFARGTPRGSRDFSSSSRGPPSPGSGRCFNWGLDGHWARDCSAGDWKNKCYRCGDRGH

SEQ ID NO: 1694 - protein, 75 aa, Brassica napus
MASRNFQWEFLAASLTLTLALIHLVEANSEGDALYALRRSLSDPDHVLQSWDPTLVSPCTWFHVTCNQDNRVTRV

SEQ ID NO: 1695 - protein, 257 aa, Brassica napus
STHASGGIPNFCAVALALNELGYKAVGIRLDSGDLAYLSTEARKFFCGVERELNVPDFGKMIITASNDLNEETVDALNKQGHEVDAFGIGTNLVTCYSQAALGCVFKLVEINNQPRIKLSEDVTKVSIPCKKRTYRLFGKEGYPLVDIMTGENEPPPKVGERLLCRHPFNESKRAYVVPQRVEELLKCYWRGNADEAREELKPLKEIRNRCIKQLENMRPDHMRRLNPTPYKVSVSAQLYDFIPFLWVNEAPVGELH

SEQ ID NO: 1696 - protein, 53 aa, Brassica napus
MSATATQPQQHEQKKKQSEPVEDALKKNTDCVYFSHLLTCNKGAECEYRHSQL

SEQ ID NO: 1697 - protein, 192 aa, Brassica napus
  misc_feature (185)..(185): Xaa can be any naturally occurring amino acid
MFGRSSCHWSSNRSVFIFTFQEEKKKQNPKPDSSCKIETLSESHFFFFLFNPQSVVRNSRKMVVSPKIAPSMLSSDFANLAAEAKRMVDLGADWLHMDIMDGHFVPNLTIGAPVIESLRKHTSAYLDCHLMVTNPMDYVEQMGKAGASGFTFHVEVAKENWQELVRKVKSAGMRPGVALKPGTPXVEEVYPL

SEQ ID NO: 1698 - protein, 129 aa, Brassica napus
MASLSTLNPSSPSLKQSTVKAFTSPTTRGDSFSFPDTSKPTTHLPLTLSASRADISHSDAAAAAKKELIKDPDALWKRYLDWLYQQKDIGLYLDVSRVGFTDEFVVEMEERFKSAFKAMEELEKGSIAN

SEQ ID NO: 1699 - protein, 142 aa, Brassica napus
  misc_feature (32)..(32): Xaa can be any naturally occurring amino acid
GLCALASFDLSELKAKVIDGSNFRDFGGLVPXVRELINDFYSSRYASCLEYLGSLRANLLLDIHLHDHVDTLYDQIRKKALIQYTLPFVSVDLSRMADAFKTSVSGLEKELEALITDNQIQARIDSHNKILYAKHADQRNAT

SEQ ID NO: 1700 - protein, 297 aa, Brassica napus
MGVMVNHHLLAIIFGILGNAISFLVFLAPVPTFYRIYKNKSTESFQSLPYQVSLFSCMLWLYYALTKQDAFLLITINSFGCVVETIYIAMFFTYATKEKKMAAIKLFLTMNVAFFSLIIMVTHFAVKRPSLQVSVIGWICVAISVSVFAAPLMIVARVIKTKSVEFMPFTLSFFLTISAVMWFAYGAFLHDICIAIPNVVGFILGLVQMVLYGVYRNSGEKLDIGKRNNSSSEQLKTIVVMSPLGLSEMHPVDVTVTEPVIPLSYTVHHEDPSKITKEEEPSTEAGQSHVETAPSRI

SEQ ID NO: 1701 - protein, 131 aa, Brassica napus
TSESEPSFWGGYNPRDYSKALMSSADPFATSQGSSADPFATSYGSSDSEPCDPQKVLESLFNIPRSPKHEPKAMNWRNVAKKMQSLGGIDGSSSSGEGYQPNTLVKDDGYHELRKGANDQWNVTKSYYQKA

SEQ ID NO: 1702 - protein, 513 aa, Brassica napus
QTLSQLLDPTTAILIIVSLFIFIGLITRRRRSYPPGPRGWPIIGNMLMMDQLTHRGLANLAKKYGGLCHLRMGFLHMYAVSSPHVARQVLQVQDSIFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGISKRLVKARNDLDGFIDDIIDEHMKKKENQNTVDDGDVGDTDMVDDLLAFYSEEAKLVSETTDLQNSIKLTRDNIKAIIMDVMFGGTETVASAIEWALTELLRSPEDLKRVQQELAEVVGLDRRVEESDIEKLTFLKCTLKETLRLHPPIPLLLHETAEDTEIDGYFVPKKSRVMINAFAIGRDPKSWPDAETFRPSRFLEPGVADFKGSNFEFIPFGSGRKSCPGMQLGLYALELAVAHILHCFTWKLPDGMKASELDMNDVFGLTAPKATRLFAVPSTRLICAV

SEQ ID NO: 1703 - protein, 520 aa, Brassica napus
MESSISQTLSQVIDPTTGILIVVSLFIFIGLITRRRRPPYPPGPRGWPIIGNMSMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGINKRLVKARNDLDGFIDDIIDEHMKKKENQNSVDAGDVVDTDMVDDLLAFYSEEAKLVSETADLQNSIKLTRDNIKAIIMDVMFGGTETVASAIEWALTELLRSPEDLNRVQQELAEVVGLDRRVEESDIEKLTFLKCTLKETLRLHPPIPLLLHETAEDTEIDGYFVPKKSRVMINAFAIGRDKNSWVDPETFRPSRFLEPGVPDFKGSNFEFIPFGSGRRSCPGMQLGLYALELAVAHILHCFTWKLPDGMKPSELDMSDVFGLTAPKATRLYAVPSTRLICSV

SEQ ID NO: 1704 - protein, 310 aa, Brassica napus
MAFKVTLPSTSPIDGQKPGTSGLRKKVKVFKQPNYLENFVQATFNALTPEKVKGATLVVSGDGRYYSKDAVQIIIKMAAANGVRRKYAGKNTLMSTPAVSAVIRERSGADGSKATGAFILTASHNPGGPTEDFGIKYNMENGGPAPESITDKIYENTKTIKEYPIAEDLPNVDISAVGVTSFEGPEGKFDVEVFDSADDYVKLMKSIFDFESIRKLLSSPQFTFCYDALHGVAGAYAHRIFVEELGAQESALLNCVPKEDFGGGHPDPNLTYAKELVARMGLSKSDTGGEPPEFGAAADGDADPYMILGK

SEQ ID NO: 1705 - protein, 245 aa, Brassica napus
  misc_feature (97)..(97): Xaa can be any naturally occurring amino acid
  misc_feature (242)..(242): Xaa can be any naturally occurring amino acid
MNSIQRFSLTRRLSSVESYLRHLCGGAFRVGVKDEGDWFYSQEWWDPHERGHTVSQSSSSRGNGLVSVVAHPSSLPSRESWAETEGWLDNRYMEIMXKETVRSFKILGYQWRSLRFNDDTRQSTVKVMAACRALQPSSIFYMQHPHCLAVPYLKSMVSVGLTSLAASKYDMTNAAIGKKQMRILCVGHGGGSLPLFLANHILGAVVDIVEIDPVVISESVRAMGFPAFSVMTATGKRALPTXDII

SEQ ID NO: 1706 - protein, 122 aa, Brassica napus
  misc_feature (78)..(78): Xaa can be any naturally occurring amino acid
LNSSSQISFLPTGSKTRVAWWLTIPTNLVLNPGSTKFLIKSWLKSTGGFVGSDDKSGTQNQSMKVFSAEVVFFSILLXVPMPAVVVFWGWPPCRGSKQFARGGRHQIRKLQSFFKLYAPEGA

SEQ ID NO: 1707 - protein, 145 aa, Brassica napus
  misc_feature (128)..(128): Xaa can be any naturally occurring amino acid
IELQLCRNSIDLVNLLRNASAFSSDVSSLQGGRKGKTFTVSYLVHSLGLTRKLSETISTKVNLEDKGNPDSVLSLLRSHGFTDSQLSSIVTNYPRLLTADAEGSLSPKLKFLKSRGASSSELSETLSXVPRILGVKKEKSISVYY

SEQ ID NO: 1708 - protein, 330 aa, Brassica napus
  misc_feature (30)..(30): Xaa can be any naturally occurring amino acid
MDATREASVTDLKRPREEDDNNNTAAVASXETKEPACFSSVIPGWFSEMSPMWPGEAHSLKVEKVLFQGKSDYQDVIVFQSATYGKVLVLDGVIQLTERDECAYQEMITHLPLCSIPNPKKVLVIGGGDGGVLREVARHSSVEQIDMCEIDKMVVDVSKQFFPNVAIGFEDPRVNLVIGDGVAFLKNAAGGSYDAARPDSSDPIGPAKELFEKPFFQSVARALRPGGVVCTQAESLWLHMDIIEDIVSNCREIFKGSGDYAWTSVPTYPSRVIGFMLCPPQAPDVDFKHPVNPIHHTKSSGPFKFYNAQIHSAAFCLPSFAKKVIESKTN

SEQ ID NO: 1709 - protein, 177 aa, Brassica napus
MEPPPPSLSSTAVASTVVPTTTVPVPPPPHATTSYPESLDSSPRSRTTDGWDDLNAPSAVPSKLRLMCSYGGHILPRPHDKSLCYMGGDTRIVVVDRNSSLSSLVARLSNKLLDGRSFTLKYQLPSEDLDSLISVTTDEDLENMIEEYDRTISAPNSTKPSRLRLFLFTSKPEATQS

SEQ ID NO: 1710 - protein, 98 aa, Brassica napus
  misc_feature (39)..(39): Xaa can be any naturally occurring amino acid
  misc_feature (72)..(72): Xaa can be any naturally occurring amino acid
VRTAAFTSFSNWGDINFPMPFGKLLSPTQTLTHGQKNNXNASVKVTVLNPLGKIWTIVTGRGASVIYADTVXGDLGYATDLGYYAEYSGAPDVHHVLH

SEQ ID NO: 1711 - protein, 76 aa, Brassica napus
  misc_feature (44)..(44): Xaa can be any naturally occurring amino acid
SYSAMYKGRSNQLRGIFIAKDCGLSHFIHLEPLWMAYDEVTQGXNTHLFIYVVNKINGRLGDKYWMDSAWCEPIDR

SEQ ID NO: 1712 - protein, 444 aa, Brassica napus
MATITVVKARQIFDSRGNPTVEVDVHTSTGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNFKEENNNGSQKISGDALKDLYKSFVSEYPIVSIEDPFDQDDWEHYAKMTAECGDNVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 1713 - protein, 360 aa, Brassica napus
MQAVSPTFSCDLKPMIQTNLTAKIARYSHVNRNRVSVRCSYKSESFSFPNGVGSSRADWQSSCAILASKVASAENSSSITGSLADQVAAVNGHSNDSVNLSLVPSNTQNGKPGLIQPLTNTDLSPAPSHGSTLRVAYQGVPGAYSEAAAGKAYPKSEAIPCDQFDVAFQAVELWIADRAVLPVENSLGGSIHRNYDLLLRHRLHIVGEVQIPVHHCLLALPGVRPDCVRRVISHPQALAQTEGSLNKLTPKAAIEAFHDTAAAAEYIAANNLRDTAAVASARAAELYGLQILADGIQDDAGNVTRFLMLARDPIIPRTDRPFKTSIVFAAQEREGTSVLFKVLSAFAFRNISLTKIESRP

SEQ ID NO: 1714 - protein, 569 aa, Brassica napus
MAFNLTHQLGALAGTPIKSGEMTAPSAESSLSVSPPSARMPISMNMNYTSNRNVSPPMSPVLGSRRADLSVACKAFAVETVEEQRTYKEGGIGGEKGKGGVPVFVMIPLDSVTIGNTVNRRKAMRASLQALKSAGVEGIMIDVWWGLVEREAPGAYNWGGYNELLEMAKKVGLKVQAVMSFHQCGGNVGDSVTIPLPQWVVEEVDKDPDLAYTDQWGRRNHEHISLGADTLPVLKGRTPVQCYSDFMRAFRDNFKHLLGDTIVEIQVGMGPAGELRYPSYPEQDGHEVPRDWSLPVLRQDSLSSLKAAAEAYGKPEWGGTGPTDAGHYNNWPEDTQFFKKEDGGWNTEYGDFFLTWYSQMLLDHGERILSSAKSIFQDTGVKISVKVAGIHWHYGTRSHAPELTAGYYNTRFRDGYLPIAQMLARHNAIFNFTCIEMRDHEQPQDALCAPEKLVNQVALATLAAEVPLAGENALPRYEDYAHEQILKASALSFDQNSEGENREMCAFTYLRMNPELFKADNWGKFVGFVKKMGEGRDSDRCREEVEREAEHFVHVTQPLVQEAAVALTH

SEQ ID NO: 1715 - protein, 194 aa, Brassica napus
  misc_feature (19)..(19): Xaa can be any naturally occurring amino acid
  misc_feature (71)..(71): Xaa can be any naturally occurring amino acid
  misc_feature (93)..(93): Xaa can be any naturally occurring amino acid
  misc_feature (111)..(111): Xaa can be any naturally occurring amino acid
  misc_feature (142)..(142): Xaa can be any naturally occurring amino acid
STHASEKLEGAPSMLSSAXVATSPAQAPWMLPFTGCEVHHVAIPQRTPRIATLMLLLSQAAGGRVSCMKAXHPLGKRKLETLSYLPDLTGAEXGIEADYLVRNKRMTCVEXQLEHGFVYREHGSTPAILRWPVIDTMRKLPXCGCTDYAQVLNEVQESMTEDPSPSIKIIGYDNNRQEQRISLIDYKPPSLTAA

SEQ ID NO: 1716 - protein, 76 aa, Brassica napus
GRPHASAEKSKRVSGHRVAHATLKGPSVVKELIIGMALGLAAGGLWKMHHWNEQRKTRAFYDLLERGEISVIAAEE

SEQ ID NO: 1717 - protein, 520 aa, Brassica napus
MESSISQTLSQVLDPTTGILIVVSLFIFIGLITRRRRPPYPPGPRGWPIIGNMSMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGINKRLVKARNDLDGFIDDIIDEHIKKKENQNSVDAGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTFLKCTLNETLRLHPPIPLLLHETAEDTEIDGYFVPKKSRVMINAFAIGRDKNSWVDPETFRPSRFLEPGVPDFKGSNFEFIPFGSGRRSCPGMQLGLYALELAVAHILHCFTWKLPDGMKPSELDMSDVFGLTAPKATRLYAVPCTRLICSV

SEQ ID NO: 1718 - protein, 262 aa, Brassica napus
RPTRPAMRARGARVTDIAIIVVAADDGIRPQTNEAIAHAKAAGVPIVIAINKIDKDGASPERVMQELSSIGLMPEDWGGDVPMVQISALKGENIDDLLETVMLVAELQELKANPHRNAKGIVIEAGLDKAKGPFATFIVQKGTLRRGDVIVCGEAFGKVRALFDHSGERVDEAGPSIPVQVIGLNNVPIAGDEFEIVSSLDVAREMAEARAVSLRDERISAKAGDGKVTLSSLASAVSAKKMSGLDLHQLNIILKGRCTRDP

SEQ ID NO: 1719 - protein, 293 aa, Brassica napus
  misc_feature (141)..(141): Xaa can be any naturally occurring amino acid
  misc_feature (148)..(148): Xaa can be any naturally occurring amino acid
STHASAVNKNLTGTARYASVNTHLGVEQSRRDDLEAVGYVLMYFLKGSLPWQGLKAGTRKQKYDRISEKKVSTPIEVLCRNQPSEFVSYFRYCRSLRFDDKPDYSYLKRLFRDLFIREGYQFDYVFDWTVLKHPQTGFSSXSSPRPRXHTTGKPELTAGKPERTAGNRLSGAVEAFSRRHATPRDRSASRNSDDVPVGGGESERRGSSSRNGSSSRRAIASSSRPSSAGGPSDSRSSSRLVTSSGGGGMGSTSQRMGPGGYESKKSSTLSRGARNTRGDPLRRSFELLSLRKS

SEQ ID NO: 1720 - protein, 203 aa, Brassica napus
MSYKKLPVDVQPGHTILCADGSISLAVLSCDPKSGTVRCRCENTAMLGERKNVNLPGVVVDLPTLTEKDVEDILKWGVPNKIDMIALSFVRKGSDLVNVRKVLGSHSKSIMLMSKVENQEGVLNFDEILRETDAFMVARGDLGMEIPIEKIFLAQKMMIYKCNLAGKPVVTATQMLESMIKSPRPTRAEATDVANAVLDGTDC

SEQ ID NO: 1721 - protein, 397 aa, Brassica napus
MGSYLGIYTILVLCLLGYSANAEVFTAGGPPNSDITAAVLKAFTSACQAPAPSQVLIPKGDFKLGETVMTGPCKSPIEFTLQGNVKADGGSTQGKDRWVVFEKINGFKLNGGGTFDGEGNAAWKANNCHKTFECKKLPISVRFDFVDNAEIKDVTSLDAKNFHFNVISGKNMTFDNIKIIAPAESPNTDGIHLGRCEGVKILNTKIATGDDCISVGDGMKNLLIEKVVCGPGHGISVGSLGRYGWEQDVTDITVKNCTLEGTSNGLRIKTWPSAACTTTAAGIHFEDIILNKVSNPILIDQEYCPWNQCNKNKPSTIKLVDITFRNIRGTSENKDAVKLLCSKGHPCENVEIGDINIEYTGPDGPPTFECTNVTPKLVGAQNPKACVGPVVKAPGKE

SEQ ID NO: 1722 - protein, 216 aa, Brassica napus
  misc_feature (131)..(131): Xaa can be any naturally occurring amino acid
EMLKPMIRSFFGENPKESGCLSRIVTKKHLQRVARLLNDPGVQASIVCGGSMDEEKLYIEPTILLDPPLDSEIMNEEIFGPILPIITLRDIQESIGFIKSKPKPLAIYAFTKDENLKTRILSETSSGSVTXFNDVMIQYMCDALPFGGVGESGMGRYHGKYSFECISREKAIMEGSLAIDLEPGYPPWNNFKLTFIRLAFCEAYFKLVLLMLGLKR

SEQ ID NO: 1723 - protein, 132 aa, Brassica napus
AVGSMATSVGASNLWITGHSMGAAMALLAGKTLAKTGVYVKSFLFNPPFVSPPIERISNERVRSGLRIAGSLVTAGLAFSRTLKQAQQSQQQLQERNLSEDPLKALSLWLPGIHVNPGDQLCSEYIGFFEHR

SEQ ID NO: 1724 - protein, 71 aa, Brassica napus
MVVYTHLVTGGELVYHSLPYKEIANGILWEGGGKRTTEGCVEDNIGANPSAEEGGEDQGVDYCGWRACGIG

SEQ ID NO: 1725 - protein, 135 aa, Brassica napus
MSLKAIHVTEVPSLDNFPENPSLCASRFSPGGLSSFKIPRFLAVGHRGHGMNMLQSTDPRFSAFKENSILSFNAASKLPLDFIEFDVHVSFFLSHVSFGVGSLLFFFFLHVTAGHNTWGLFVDFSSIFFVMENLE

SEQ ID NO: 1726 - protein, 353 aa, Brassica napus
  misc_feature (115)..(115): Xaa can be any naturally occurring amino acid
MQAATSCDLKFRSTNLTASTARPTNGMSKRVNVLCGYRSMPSSFRNGVSVSRADWQSSCAILSSKVASVEDPGGLADKIAVVNGHKNGSVDLSLVPVETTNGKLSQVQPLTITDXLSPAPLHGSNLRVAYQGVPGAYSEAAAGKAYPNCEAIPCDQFDVAFQAVELWIADRAVLPVENSLGGSIHRNYDLLLRHRLHIVGEVQIPVHHCLLALPGVRTDCVSRVISHPQALAQTERSLDNLTPRAAREAFHDTAAAAEYIAANNLHDTAAVASARAAELYNLQILADGIQDDTGNVTRFLMLAREPIIPRTDRPFKTSIVFAAQEHKGTSVLFKVLSAFAFRNISLTKIESRP

SEQ ID NO: 1727 - protein, 401 aa, Brassica napus
MATKRSVGTLKEADLKGKSVFVRVDLNVPLDDNSNITDDTRIRAAVPTIKYLMGNGSRVVLCSHLGRPKGVTPKFSLKPLVPRLSELLGVEVVMANDSIGEEVQKLVAGLPEGGVLLLENVRFYKEEEKNDPEFAKKLAALADVYVNDAFGTAHRAHASTEGVAKYLKPSVAGFLMQKELDYLVGAVANPKKPFAAIVGGSKVSTKIGVIESLLSTVDILLLGGGMIFTFYKAQGHSVGSSLVEEDKLDLAKSLMEKAKAKGVSLLLPTDVVIADKFAPDANSKIVPATAIPDGWMGLDVGPDSIKTFSEALDTTQTIIWNGPMGVFEFEKFAAGTEAVAKQLAELSGKGVTTIIGGGDSVAAEEKVGLADKMSHISTGGGASLELLEGKPLPGVLALDDA

SEQ ID NO: 1728 - protein, 343 aa, Brassica napus
MAFCSIFCPRIPVRFRPKPISPFLSKPLFPLSYRVYSSLQPTPSTKDELGSVSIGFLGMGIMGSPMAQNLLKAGCDVTVWNRTKSKCDPLVGLGAKYKSSPEEVTATCDLTFAMLADPESAIDVACGKNGAVSGISSGKGYVDVSTVDAASSILISKQIKDTGALFLEAPVSGSKKPAEDGQLIFLTAGDKLLYEKAAPFLDIMGKSRFYLGDVGNGAAMKLVVNMIMGSMMASFAEGILLSQKVGLDPNVLVEVVSQGAINAPMYSLKGPSMIKSVYPTAFPLKHQQKDMRLALGLAESVSQSTPIAAAANELYKVAKSYGLSDEDFSAVIEALKAARSQQS

SEQ ID NO: 1729 - protein, 131 aa, Brassica napus
HVATLMACLKNSNPSSYRSNAQQWRSRLAANLKPFSWLKTNHGCHNGGSSSSSPIDSVMYWYSNLESGKFWFPAQVYNRENGHVGFMMSCYDAKVRYDNRTNTFQARYSAHGRRAAEENVTWQRLRPALVE

SEQ ID NO: 1730 - protein, 228 aa, Brassica napus
  misc_feature (95)..(95): Xaa can be any naturally occurring amino acid
VDHASGFTAKLSDFGLAKDGPEGDETHVSTRVMGTQGYAAPEYIMTGHLTAKSDVYSFGVVLLELLTGRRSVDKKRSSREQNLVDWARPMLNDPXRKLGRIMDPRLEDQYSATGARKAAALAYQCLSYRPNRRPCISTVVSVLQDIKDYGDDIPIGTFTYTVSSSPAKPSLEVKESSVQNSDKPRHVHKSDQHHNKYRSPVHTARNHRLTLRNGLNSPMRNEAGGERY

SEQ ID NO: 1731 - protein, 119 aa, Brassica napus
  misc_feature (113)..(113): Xaa can be any naturally occurring amino acid
MAFRRNCGLELLVASLTLTFALIQLVEANSDGDALYALRQSLSDPDHVLQSWDQNLVNPCTWFHVSCNQDSRVTRVDLGNSNLSGHLTPELGKLEHLQYLELYKNNIQGTIPXELGNLK

SEQ ID NO: 1732 - protein, 381 aa, Brassica napus
  misc_feature (356)..(356): Xaa can be any naturally occurring amino acid
  misc_feature (368)..(368): Xaa can be any naturally occurring amino acid
MDDHESPLLSKEPSSSSSSSVVASSFKWILKVLMSVIFVAWIVFLFVYPGKLGDGILTNWRAVSSNTLFGTTGSMFLIFSGPILVISVLASLYLIISGEEKVFAKKKISKFPRFRLWTFPVLVDGPFGVVSAAEFLVIMIFSVFFLWAIYAYTMRDLDLLDLGGDPRVRFSMLLLEITGLRFGMIGLLCMVFLFLPISRGSILLRLVDIPFEHATKYHVWLGHITMAFFSFHGLCYVVAWTVQGRLLELLFEWKAIGIAVLPGVISLVAGLLMWVTSLQYVRKHYFELFFYTHQLYIVFVVFLALHVGDYLFSIVAGGIFLFILDRFLRFCQSRRTVDVISAKSFPCGTLELVLSXPPNMRYNALSFXFLQVRELLWLQWH

SEQ ID NO: 1733 - protein, 129 aa, Brassica napus
  misc_feature (108)..(108): Xaa can be any naturally occurring amino acid
GRVGLPSPTAEQDEDPNKDSSSNNKNPVLVLPVKEPIMRRNMDNQAYYVLGHKTPNIRDLYTLSRKLGQGQFGTTYLCTEVATGVDYACKSISKRKLISKEDVEDVRXEIQIMHHLAGHKNIGYIKRAY

SEQ ID NO: 1734 - protein, 65 aa, Brassica napus
MANVPKIGKAVYQGPSIVKEIIYGIALGLAAGGLWKMHHWNNQRRTREFYDLLEKGEISVVVADE

SEQ ID NO: 1735 - protein, 132 aa, Brassica napus
  misc_feature (39)..(39): Xaa can be any naturally occurring amino acid
  misc_feature (101)..(101): Xaa can be any naturally occurring amino acid
MAVLTEIAAREEKYIEICKKHGTVPNTSILSAFFEAEDXKSRNQRCIMNILVDRVMYDDFHPILELCNEINASEVEGIDLSVRSSWSLEDQYVLSLIRSVXNQNLRLVDVHDWFGTTFWRDVFSQGLSCEVL

SEQ ID NO: 1736 - protein, 243 aa, Brassica napus
MAAATSSSSAFLLNPLTSRHRPFNYSPQLASLSLSSRKAAAFTLNSQRQRCEDVVCKAVSAKVEAGVESLNIAENAAQLIGKTPMVYLNNIVKGCVASVAAKLEIMEPCCSVKDRIGFSMITDAEEKGLITPGKSVLVESTSGNTGIGLAFIAASKGYKLILTMPASMSLERRVLLRAFGAELVLTEPAKGMTGAIQKAEEILKNTPNSYMLQQFDNPANPKIHYETTGPEIWEEQEQSGYTG

SEQ ID NO: 1737 - protein, 119 aa, Brassica napus
ICHKFFPTPVFVTGVRNPVGPKWSRFIPLPMAMAKPFYIGGYFTINMCVGSLKLFVWRKLNRPKADAYSSAVASGLICGEGIWTLPSSVLALAGVKPPICMKFLSGATNVKVDSFLNPS

SEQ ID NO: 1738 - protein, 183 aa, Brassica napus
MSSLEQEMFLQWGNKKRMRRLRASANKDNKHISQRQSNSSSHETFLFHSSRFSRGSEGAILRSGGSLPEKEKEERYSTTRGVVDPNGEDSTGKGEESMWPKLFVTLSSKEKEEDFMAMKGCKPSHRPKKRAKLIQKSLLLVSPGTWLADMCPDRYDVRVKKSSKKRRARGLKAMGNNIDSDSD

SEQ ID NO: 1739 - protein, 77 aa, Brassica napus
  misc_feature (11)..(11): Xaa can be any naturally occurring amino acid
  misc_feature (14)..(14): Xaa can be any naturally occurring amino acid
  misc_feature (32)..(32): Xaa can be any naturally occurring amino acid
  misc_feature (34)..(34): Xaa can be any naturally occurring amino acid
GRVGFLPRKFXVAXTVPTDNGVYLLTNDIGRXVXSDENGEPHGFNLYVGGGMGRTYIMESTFDRLAKPLGYVPKEYI

SEQ ID NO: 1740 - protein, 204 aa, Brassica napus
MAASSSVGISLSFFLWALLISPSVSQQTCKSQTFSGDKTYPHCLDLPQLKAFLHYSYDEPNTTLAVVFSAPPSKPGGWIAWAINPQATGMAGAQTLVAYKDPSKGVAVVKTLNISSYSTIIPSKLAFDVWDMKAEEVSGDGGGTLRIFARIKVPSDLAAKGKVNQVWQVGPGVSPEGMIAKHDFDTANINSKGPLDLSGNNNGG

SEQ ID NO: 1741 - protein, 357 aa, Brassica napus
  misc_feature (57)..(57): Xaa can be any naturally occurring amino acid
  misc_feature (97)..(97): Xaa can be any naturally occurring amino acid
  misc_feature (161)..(161): Xaa can be any naturally occurring amino acid
  misc_feature (199)..(199): Xaa can be any naturally occurring amino acid
  misc_feature (271)..(271): Xaa can be any naturally occurring amino acid
  misc_feature (333)..(333): Xaa can be any naturally occurring amino acid
GRPTLRLSVESESWVKAISGNLKKLTIDTGRSETLVVCFGEMLIDFVPTVGGVSLAXAPAFKKAPGGAPANVAVGVSRLGGSSAFVGKVGDDEFGKXLAEILKLNNVDNSGMRFDHKARTALAFVTLRADGEREFLFFRHPSADMLLTESELDKNLIQKPXIFHYGSISLIKEPCRSTHLAAMKIAKAAGSLLSYDPNXLRLPLWPSEEAARKEIMSIWELADVIKISEDEIPFLTGGDDPYSDELVLQKLFHPNLKLLVVSEGPNGCRYXTKEFKGRVGGVKVKAVDTTGAGDAFVSGLLHSLASDLTLLTDEKKLREALLFANACGAITVXTERGAIPAMPPMDAVQELLKSSGS

SEQ ID NO: 1742 - protein, 82 aa, Brassica napus
QINPVARWHICQGSINSIAFSNDGSHLATAGRDGYLRVFDFSTQKLVCGGKSYYGALLCCSWSMDGKYILTGGEVARRLFRR

SEQ ID NO: 1743 - protein, 93 aa, Brassica napus
MAAGMGTRAGASLVGGNRILPGINDRLNLNFFGVEKAAFGAGQCQMLDLTFPGVGPMPKVNFVAKTESVLIQNSKVLQDGFNRFQITKPLGIN

SEQ ID NO: 1744 - protein, 173 aa, Brassica napus
  misc_feature (146)..(146): Xaa can be any naturally occurring amino acid
  misc_feature (167)..(167): Xaa can be any naturally occurring amino acid
RPTRPQIIHRDIKSSNILLTDSMRAKVADFGFARGGPSDSNQTHILTQVKGTVGYLDPEYMRTYQLTAKSDVYSFGILLVEILTGRRPVEAKKPHDERITVRWAFDKYNEGKVLELVDPKARERVDEKILKKMFSLAFQCAAPTRXERPDMEAVGKQLWAIRSTYLXRSVEQK

SEQ ID NO: 1745 - protein, 89 aa, Brassica napus
TYDLNFKEENNNGSQKISGDALKDLYKSFVAEYPIVSIEDPFDQDDWEHYAKMTTECGDSVQIVGDDLLVTNPKRVAKAITEKSCNALL

SEQ ID NO: 1746 - protein, 128 aa, Brassica napus
MDQPKGKVCVTGASGFLASWLVKRLLLEGYEVIGTVRDPGNEKKLAHLRKLEGAKERLRLVKADLMEDGSFDNAIMGCQGVFHTASPVLKPTSNPEEEILKPAIEGTLNVLRSCGKNESLKRVVLTSS

SEQ ID NO: 1747 - protein, 114 aa, Brassica napus
MADGISSFWGPVTSTIECCEKNYAYSSYIAEFYNTISNVPGILLALIGLVNALRQRFEKRFSILHISNMILAIGSMLYHATLQHVQQQSDETPMVWEILLYMYILYSPDWHYRS

SEQ ID NO: 1748 - protein, 93 aa, Brassica napus
LVCLRSTGQERLFVHKLDLFECSLEMWSFELLVLLSGLLPNPVLETSVLSICLNTAGTVWMIPFGLSGAASTRVSNELGAGNPRVAKLAVRVV

SEQ ID NO: 1749 - protein, 146 aa, Brassica napus
  misc_feature (89)..(89): Xaa can be any naturally occurring amino acid
  misc_feature (101)..(101): Xaa can be any naturally occurring amino acid
MALRTVLVADVPSLPDSVYGLSEGLEMSKPTSFKMPGFSVIGHRGNGMNVLQSSDRRTRGFKENSILSFNSAAKFPIDFIEFDVHVTKXDDCPGIFHDDFXIYSQENGVVNESRVTDLSLSEFLLYGPQKEAEKIGKTLMRKSKKG

SEQ ID NO: 1750 - protein, 72 aa, Brassica napus
MASRNSVAGFALFTFVFAVFSSLAGAQTLAPAPAPTSDGTSIDQGIAYLLMVVALVLTYLIHPLDASSSLSF

SEQ ID NO: 1751 - protein, 232 aa, Brassica napus
MTTLVIFLQLLFIIPLALGLNHPNCDLTNTQDQGSTLRIFHIDSPCSPFKSSSPLSWEARVLKTLAQDQARLQYLTSLVAGRSVVPVASGRQMLQSTTYIVKAKIGTPAQSLLLAMDTSSDVAWLPCSGCVGCPSTTAFSPAKSTTFKNVSCSAPQCKQVPNPTCGSRACSFNLTYGSSSIAANLSQDTIRLAADPINAFTFGCVNKVAGGGTVPPPQGLLGLGRGPLSLMS

SEQ ID NO: 1752 - protein, 271 aa, Brassica napus
  misc_feature (88)..(88): Xaa can be any naturally occurring amino acid
  misc_feature (158)..(158): Xaa can be any naturally occurring amino acid
  misc_feature (165)..(165): Xaa can be any naturally occurring amino acid
  misc_feature (170)..(170): Xaa can be any naturally occurring amino acid
MAAAVNTAVFVSPSQPLSSKRNFLYSPTVSPIQRRFPRRKLELQVKAVATTLAPLEEIKEYKLSLWAMVEMGTGSMVLKTMTRRPPTXRGEKVKLFFNPAATKLTPNEDYGVAFNGGFNQPIMCGGEPRAMLKKDRGKADSPIYTMQICIPKHAVNLXIFSFTNXGVDWXDGPFRPLCLLPKRWQNKPIEFFNEGLAKELSQDGACERAIFPDSNIVATRCTMIANLTVEGGDRCNLDLVPGCMDTNSEHFNPLANVDDGSCPLELSDSDE

SEQ ID NO: 1753 - protein, 192 aa, Brassica napus
  misc_feature (170)..(170): Xaa can be any naturally occurring amino acid
NTYIVYSAGGSPIQRRFPRRKLELQVKAVATTLAPLEEIKEYKLPSWAMFEMGTAPVFWKTMNGLPPTAGEKLKLFYNPAATKLTPNEDYGVAFNGGFNQPIMCGGEPRAMLKKDRGKADSPIYTMQICIPKHAVNLIFSFTNGVDWDGPYRLQFQVPKRWQNKPIEFFXEGLAKELSQDGACERAIFPDSN

SEQ ID NO: 1754 - protein, 128 aa, Brassica napus
  misc_feature (100)..(100): Xaa can be any naturally occurring amino acid
MTDKAKRSRTHFNGSHHPVVDFWRREVGGISPRSFSDRFSASENMVLRLEIYRKLAKHKGCVNTVSFNAQGDILVSGSDDRRVLLWDWELGNVKLSFHSXHSNNVFQAKFMPFSDDRTIVTCAADGMV

SEQ ID NO: 1755 - protein, 197 aa, Brassica napus
  misc_feature (183)..(183): Xaa can be any naturally occurring amino acid
  misc_feature (185)..(185): Xaa can be any naturally occurring amino acid
VDPRVRKFLGQPDDIAELSGVVSVWVIPLHFAFALSFPLQRFLQCQLKNQVTAIASAIALVVHFLVCWLFVDGLKLGVVGTMATVSISWWVNVLITLGYSVCGGCPLTWTGFSSEAFTGLWEFLKLSASSGVMLCLENWYYRILIIMTGNLENARIAVDSLSICMSIKGWEMMIPIAFFAGTXGXRVANELRAGHGE

SEQ ID NO: 1756 - protein, 147 aa, Brassica napus
  misc_feature (111)..(111): Xaa can be any naturally occurring amino acid
MEKAKAKGVSLLLPTDVVIADKFAPDANSKIVAATAIPDGWMGLDIGPDSIKTFSEALDTTKTIIWNGPMGVFEFDKFAAGTEAVAKQLSELSGKGVTPIIGGGDSVAAVXKVGLADKMNHIFTGGGASLELLEGKPLPGVLAFDDA

SEQ ID NO: 1757 - protein, 159 aa, Brassica napus
MGKDKTLPLLDPREPPELTETKPASKVWAKEFRQESKRLWELAGPAIFTAISQYSLGALTQTFSGRIGELELAAVSVENSVISGLAFGVMLGMGSALETLCGQAYGAGQLRMLGIYMQRSWVILFTTALCLLPVYIWAPPILSFFGEAPHISKAAREFA

SEQ ID NO: 1758 - protein, 243 aa, Brassica napus
  misc_feature (88)..(88): Xaa can be any naturally occurring amino acid
  misc_feature (112)..(112): Xaa can be any naturally occurring amino acid
YMMRALEDDCKHVVGISWYLWIFVVIFLLLNVNGWLTYFWIAFIPFILLLAVGTKLEHVISQLAHEVAEKHVSIEGELVVKPSDEHFXVSKPEFALFLIHVILFQNAFEIAXFFFWIWVTYGFDSCIMGQVRYIVPRLVIGVFIQVLCSYSTLPLYAIVSQMGSNYKKAIFEENVQVGLVGWAQKVKTKRANNGNEGSSNAGTTPSPPGAGAGFAGIQLSRLTRNNAGETTQNEITPAHVNTH

SEQ ID NO: 1759 - protein, 218 aa, Brassica napus
MAFRNCRWELLAASLALTLALIHLVDANSEGDALYALRRSLSDPDHVLQSWDPTLVNPCTWFHVTCNQDNRVTRVDLGNSNLSGHLAPELGKLEHLQYLELYKNNIEGTIPSELDNLKNLISLDLYNNNLTGKIPSSLGKLKSLVFLRLNDNKLTGPIPKELTKIASLKVVDVSNNDLCGTIPTEGPFAHIPLQNFENNSRLEGPELIGLASYDTNCN

SEQ ID NO: 1760 - protein, 268 aa, Brassica napus
MAASIGIMDSAYFVGRNEILTWINDRLHLNLSRVEEAASGAVQCQMLDMTFPGVVPMHKVNFDAKNEYDMIQNYKVLQDVFNKLQITKPLEINRLVKGRPLDNLEFLQWLKRFCDSTNGGIMNENYNPVERRSKGGREKSVKGSNKMPKSLQTNNTPPNSSSVGLTKASGPKPANTAQVQALSKELTDLKLSYDHLGKERDFYFSKLRDVELLCQTPELEDLPIVVAVKKILYATDANESALEDAQEYLNQSLGVKAEDEENGEQEDY

SEQ ID NO: 1761 - protein, 221 aa, Brassica napus
MSLTIPTNLVLNPRSNKKSLTQSLPKSTARFVCSDDKSATQQQSMKAFSAAVALSSILLSAPMPAVADISGLTPCKESKQFAKREKQQIKKLQSSLKLYAPESAPALALNAQIEKTKRRFDNYGKYGLLCGADGLPHLIVNGDQRHWGEFITPGLLFLYIAGWIGWVGRSYLIAISDEKKPAMKEIIIDVPLASRLIFRGFIWPVAAYRALLNGDLIAKDV

SEQ ID NO: 1762 - protein, 148 aa, Brassica napus
MEYSIKDDVTQLIGNTPMVYLNNIVHGCVARIAAKLEMMQPCSSVKDRIAYGMIKDAEDKGLISPGKNILIEPTSGNTGIGIAMVGAARGYKVVITMPASVSIERRIVLLALGAELHLTDPSKGVIGVIVKAEEILSKTPDGFMLEQF

SEQ ID NO: 1763 - protein, 96 aa, Brassica napus
MNGDDEEIVAASVDPSLPLEWRFSQVFGERSAGEEVQEVDVISAIEFDHSGDHLATGDRGGRVVLFERSHVRNSSGGARTDLEDTDHPLRHPEFPL

SEQ ID NO: 1764 - protein, 108 aa, Brassica napus
  misc_feature (46)..(46): Xaa can be any naturally occurring amino acid
  misc_feature (102)..(102): Xaa can be any naturally occurring amino acid
VNPVYEGSKAVERNKPEIQQFRFWGQYWILGVVLTVFERVGDPFVXWVPLSSGAKLAFLIYFGFPKTRGTTYVYDFFFRPFVSKPENEIARTWVELRTRAGXLAVIYC

SEQ ID NO: 1765 - protein, 140 aa, Brassica napus
  misc_feature (113)..(113): Xaa can be any naturally occurring amino acid
RVKEGKTVITTIHQPSSRLFHRFDKLILLGRGNLLYFGKSSEALVYFSSIGCSPLITMNPAEFLLDLANGNINDISVPSELEDIVQVGNSGREPQTGNPSPAAVHDYLVDAYXTRVAQQEIKKLTDSVPLDEQAKAKVLR

SEQ ID NO: 1766 - protein, 463 aa, Brassica napus
  misc_feature (354)..(354): Xaa can be any naturally occurring amino acid
  misc_feature (361)..(361): Xaa can be any naturally occurring amino acid
  misc_feature (378)..(378): Xaa can be any naturally occurring amino acid
  misc_feature (398)..(398): Xaa can be any naturally occurring amino acid
  misc_feature (402)..(402): Xaa can be any naturally occurring amino acid
  misc_feature (404)..(404): Xaa can be any naturally occurring amino acid
  misc_feature (413)..(413): Xaa can be any naturally occurring amino acid
MASSSFAVLPLLNYNSSTTNRSSSSIRFFNLPKSKHRSTKHLLNPRSPQVLVSLSLNQPTDDESSDAALFLESNSIADYMRFKRRSDDGDNGSSELQTAIVSYKKRFPWILLNPFLQVDLVSTIHIADKEYFTALPKELEPYDSILYEMVTCKESLENRRNPIAAKRLKTSRSRGFSILGLIQRQMARVLALDFQLDCLNYEAKNWYHADLDFETFTLLQKEKGESFYSFARDMTIRSTKAMIQPALVTEGLDTWRSKLLWVSRVFPMPLVGLFLIVAFCADFENQTEDYPELEALSRLDIGAAMKVFLAKRLTSELTQGTSEIEEKSVIIGERNRAATEALKRAIEQGSKRVXILYGGGXMPDLGRRLREEFDLVPXEVRWVTAWSISNPGDMETTXFPFXRXMADALRWPXNRYQTLALLLFSSVLALDLCFWELFLDSTIDWGSQIAAELYKFVDNTKLV

SEQ ID NO: 1767 - protein, 189 aa, Brassica napus
MATQGQVITCKAAVAYEPNKPLVIEDVQVAPPQAGEVRIKILFTALCHTDAYTWSGKDPEGLFPCILGHEAAGIVESVGEGVTEVQPGDHVIPCYQAECRECKFCKSGKTNLCGKVRSATGAGVMMNDRKSRFSVNGKPIYHFMGTSTFSQYTVVHDVSVAKIDPQAPLEKVCLLGCGVPTGLGAVWNT

SEQ ID NO: 1768 - protein, 169 aa, Brassica napus
  misc_feature (152)..(152): Xaa can be any naturally occurring amino acid
MSEEHRLQEPRLCANDCGFFGNTATQNLCSKCFRDLKHEQENSSTAKNALKQTLAACVASSSVSSPPPPPPPADLTSDLKEVNTENPGKRAASEPEEEEEQKPPQDPKRCLTCRRRVGITGFRCRCGFVFCGTHRYAEQHECTFDFKRVGKXKIAKANPIVKAEKLEKI

SEQ ID NO: 1769 - protein, 147 aa, Brassica napus
SDLVKHVFTFNRLNRNTSFSTVFTENDADQYSLVFANCLQQVKVTMDVRSAMYNLEGKSGGRDYLSAGRTVLPKVYFLFSVIYFSLAATWIYVLLTKRRTVFAIHFFMLGVVVLKALNLLCEAEDKSYIKKNGFGHGWDVLFYIFSF

SEQ ID NO: 1770 - protein, 195 aa, Brassica napus
MGEAVKDGREEVIQAWYMDDSQDDQRLPHHKDPKEFISLDKLAELGLLSWRLDADNYETDEELKKIRESRGYSYMDFCEVCPEKLPNYEEKVKSFFEEHLHTDEEIRYCVAGSGYFDVRDRNEAWIRVWVKKGGMIVLPAGIYHRFTVDSDNYIKAMRLFVGEPVWTPYNRPHDHLPARKEYVDNFVKKAINASA

SEQ ID NO: 1771 - protein, 194 aa, Brassica napus
MVDAQSSAKDVLLLSVDRVQVVTWRDLRDGSFTEELKRLISFAAPMAAVVIAQFSLQIISMVMVGHLGNLALASASLASSFCNVTGFSFIIGLSCALDTLSGQAYGAKLYRKLGVQTYTAMFCLTLVCFPISIIWFNMEKLLVFLGQDHSIAHEAGWYASWLIPGLFSYAVLQPLTRYLQNQSMIRPLLVTCCF

SEQ ID NO: 1772 - protein, 131 aa, Brassica napus
MPRYEDRHGSTRLYVGHLSSRTRTRDVERLFSKYGRVRDVDMKRDFAFVDFSDPRDADDARYRLDGRDVDGSRIVVEFAKGTPRGSGSGYGSREISSSRGGPPPPGSGRCFNCGLDGHWARDCTAGDWKNN

SEQ ID NO: 1773 - protein, 238 aa, Brassica napus
  misc_feature (188)..(188): Xaa can be any naturally occurring amino acid
  misc_feature (203)..(203): Xaa can be any naturally occurring amino acid
  misc_feature (223)..(223): Xaa can be any naturally occurring amino acid
MDMLKKRRLDENGNGILNDAHITRLTPHDARKLIERFSTDQLLDILQNAVARHPDVLELVRSTADADITQRKLFIRGLAAETTTEGLRSLFSSYGDLEEAIVILDKVTAKSKGYGFVTFRHVDGALLALKDPSKKIDGRVTVTQLAAAGNQGRGGAAAAANGSDVSMRKIYVANVPVDMPADRLLNLXLAYGEIEEGPLGFDXVTGKSRGFALFVYKSPESAXAALADPTKVGDGKHL

SEQ ID NO: 1774 - protein, 161 aa, Brassica napus
VIQGKGNVENQKEAAIKSLCRLRGSAFVDSAAEQVNEILAELSFVGEDKEATFGELFQGKCKKALIIGGGLVLFQQITGQPSVLYYAPSILQTAGFSAAGDATRVSILLGLLKLIMTGVAVVVIDRLGRRPLLLGGGGGMVVSLFLLGSYHIFFSADQLLL

SEQ ID NO: 1775 - protein, 183 aa, Brassica napus
PSVLYYAGSILQTAGFSAAADATRVSVIIGVFKLLMTWVAVAKVDDLGRRPLLIGGVSGIAISLFLLSAYYKFLGGFPLVAVGALLLYVGCYQISFGPISWLMVSEIFPLRTRGRGISLAVLTNFGSNAIVTFAFSPLKEYLGAENLFLLFGAIALVSLLFVVLVVPETKGLSLEEIESKILK

SEQ ID NO: 1776 - protein, 130 aa, Brassica napus
MDSSNSWINCPSVFSSSSSASRRCQQSRSDLYIGGGYEDLEGEDDLKSEFICPFCAEVFDIVGLCCHIDEEHPVEAKNGVCPVCTKRVGLDIVGHITTQHANFFKVQRRRRLRKGGGYSSAYLTLKKELR

SEQ ID NO: 1777 - protein, 168 aa, Brassica napus
MSGAGKKVADVAFKASRTIDWEGMAKVLVTDEARREFSNLRRAFDEVNTQLQTKFSQEPEPIDWDFYRKGIGSGIVDMYKEAYDSVEIPKYVDNVTPEYKPKFDALLVELKEAEQKSLKESERLEKEIVDVQEISKKLSTMTADEYFEKHPELKKKFDDEIRNDYWGY

SEQ ID NO: 1778 - protein, 251 aa, Brassica napus
RPTRPELEDWETEFTKNRVKFKDLYSATEGFKEKDVLGSGGFGSVYKGVMPNTKKEIAVKRVSNESKQGLKEFVSEIVTIGRMSHRNLVPLLGYCRREKELLLVYDYMPNGSLDKYLHNSPEVTLDWKQRIKVIKGVASALFYLHEDWEQVVIHRDIKSSNVLLDAEYNGRLGDFGLARLCGHGTDPQTSHVAGTWGYLAPDHMRTGKTTTATDVFSFGVLLLEVACGRRPIEVHKKSGETVLLVDWVFGF

SEQ ID NO: 1779 - protein, 162 aa, Brassica napus
VFCRFSIMGSEQNDSFSPSEPKLCVNGCGFFGSPSNMNLCSKCYRDIRATEEQAASAKAAVDKSLNPNKPHTKPPQQSLETAPEPSSSASVGDSSDPPRATRCLSCNKKVGVTGFKCRCGSTFCGAHRYPESHDCEFDFKGAAREAIAKANPVVKADKVEKI

SEQ ID NO: 1780 - protein, 228 aa, Brassica napus
MTSPEKTGSSSVSKKVSEIWERMNEGVPNKRFNFVSKTSTSSPPAKKTANSNWKSYLGIDAKKRDKAVQKEDSVLDSSCSEEAKRIAAAALAAVRNATATAAAASSRGKIEITEVKDFAGQEIEVKRLVEAGSKEASSSSGVATSGVDAVLEQIKKKQKLSVLDKTKKDWGEYKEENKGVEDELDKYKKSSDKYLDKVSFLERADYRQFEKERDARLALQSKRRLDDV

SEQ ID NO: 1781 - protein, 86 aa, Brassica napus
  misc_feature (13)..(13): Xaa can be any naturally occurring amino acid
  misc_feature (31)..(31): Xaa can be any naturally occurring amino acid
  misc_feature (41)..(41): Xaa can be any naturally occurring amino acid
SFTVVGPSFDGIXRGVNEKEALLSTASMHIXVSRADPAYQXGVLVFMRYIVYEFGVPIQLYGPITSISGICKQAIECITSICISLS

SEQ ID NO: 1782 - protein, 181 aa, Brassica napus
  misc_feature (11)..(11): Xaa can be any naturally occurring amino acid
GAACVRVANEXGKGDAAAVRFSIKVILTVSTIMGMIFSVLCLAFCGQISYLFTNSKEVSKAVDDLSMILSVSILLNSIQPVLSGVAVGAGMQSIVAVVNFVSYYAVGIPLGLILTYVFHLGVKGLWSGMSAGIAIQTAILCYIIYRTDWESEVKKPSERMKAWSIQPSHEESNPIREDERK

SEQ ID NO: 1783 - protein, 199 aa, Brassica napus
  misc_feature (47)..(47): Xaa can be any naturally occurring amino acid
IFSQYIYTLEFNICLGFLGAACVRVANELGKGDAAAVRFSIKVILTXSTIMGVIFSVLCLAFCGQISYLFTNSEEVSKAVDDLSIILAVSILLNSIQPVLSGVAVGAGMQSIVAVVNFVSYYAVGIPLGLILTYVFHLGVKGLWSGMSAGIAIQTAILCYIIYRTDWELEVKKTSERMKAWSIQPSHEESNPIREDERK

SEQ ID NO: 1784 - protein, 133 aa, Brassica napus
VVIDETGPYGQDWVTWKQIFLLVDVVCCCAVLFPIVWSIKNLREAAKTDGKAAVNLVKLTLFRHYYIVVICYIYFTRVVVYALETITSYKYMWTSVVASELATLAFYLFTGYKFRPEVHNPYFCCDDDEEEAA

SEQ ID NO: 1785 - protein, 133 aa, Brassica napus
RPFTCILCESKPPPSLTSLSSSGTTVPCSSPSCSAAHSSLPSSDLCAISNCPLDLIETGECNNSSYPCPPFYYAYGDGSLVARLFSDSLSLPPLSVANFTFGCAHTTLAEPIGVAGFGRGRLSVPAQLASFAP

SEQ ID NO: 1786 - protein, 146 aa, Brassica napus
MTTLNPFDLLDDDTEDPTLLAAAKPLKVEKPAPAQPAKMPTKPTPPSQAVREARGGGRNGGGARGGGRGRGGGFNRESRNSDAPANENGYVGGGYRRSEGGDAGRRGGYRGRGGRHGDSGDLERPRRNFERHSGTAHGHELKRDGA

SEQ ID NO: 1787 - protein, 379 aa, Brassica napus
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGEGIRCIITMGA

SEQ ID NO: 1788 - protein, 87 aa, Brassica napus
  misc_feature (38)..(38): Xaa can be any naturally occurring amino acid
  misc_feature (76)..(76): Xaa can be any naturally occurring amino acid
MRPPLTGGRGGGGFSGGRAVCGFSGGRGGSSGCRGRGXGRGFRDRGGCGGCRCMSRGGGRGDRGGRRGGINGGSKXIVLPHRHAVVF

SEQ ID NO: 1789 - protein, 443 aa, Brassica napus
  misc_feature (22)..(22): Xaa can be any naturally occurring amino acid
  misc_feature (41)..(41): Xaa can be any naturally occurring amino acid
RKRTTPASRTRVGNYEMGRTLXEGSFAKVKYARNTVTVDIXSAAIKILDRDKILRHKMVEQLKREISTMKLIKHPNVVEIIEVMASKTKIYIVLELVNGGELFDKIAQQGKLKEDEARRYVHQLINAVDYCHSRGVIHSDLKPENLIPDANGILKVSDFGLSAFSLQVRGDGLLHTACGTPNYVAPEVLSDKGYDGAAADVWSYGIILFVLMAGYLPFDEPNLMTLYKRICKAEFSCPSWFSPGAKEVIKRILDPSPITRISIAELLEDEWFKQGYKPPSFGQDDEDITIDDVDAAFSNSKESLVTEKKAKPESMNAFELISSSNSLENLFEKQAQLVKKETRFTSQRPASEIMSKMEETAKPLGFNVRKDKYKIKMKGDKSGRKGQLSVATEVFEVAPSLHVVELRKTGGDTLEFHKFYKNFSSGLKDVVWNTDGAPEEHKA

SEQ ID NO: 1790 - protein, 330 aa, Brassica napus
PSSSRVRRRRFLLTGAAWIHIFWTVPDSLDEISPSTVRRAMSKARVYTDVNVIRPKEYWDYESLNVQWGEQDDYEVVRKVGRGKYSEVFEGININSNEKCVIKILKPVKKKKIRREIKILQNLCGGPNIVKLFDVVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLNRGQLELDAQLEALVGRHSMKPWSKFINADNRHLVSP

SEQ ID NO: 1791 - protein, 338 aa, Brassica napus
MGVDYYNVLQVDRNASEDDLKKAYRKLAMKWHPDKNPNNKKDAEAKFKQISEAYEVLSDPQKKAVYDQYGEEGLKGNVPPPDAGGATYFATGDGPTSFRFNPRSADDIFAEFFGFSRPFGGGGGGGTRFSSSMFGDNIFASFGEAGGGGGAMHHGGGARKAAPIENRLPCSLEDLYKGTTKKMKISREIADVSGKTMPVEEILTIDVKPGWKKGTRITFPEKGNEQPGVTPADLVFIIDEKPHPVFTREGNDLIVTQRISLAEALTGYTVNLTTLDGRRLTIPVTNVIHPEYEEVVPKEGMPLQKDQTKRGNLRIKFNIKFPTRLTSEQKAGVKKLLG

SEQ ID NO: 1792 - protein, 146 aa, Brassica napus
ISFVAVMSSHDSMGLIFKCLSKGAVDFLVKPIRKNELKILWQHVWRRCQSSSGSGSESGTHQTQKSVKSKNIIKSDNDSGHSGENENGSIGLNASDGSSDGSGAQSSWTKKAVEVDDSPRAVSLWDRVDSTCAQVVHSNPEFPNNH

SEQ ID NO: 1793 - protein, 98 aa, Brassica napus
MVCDKCEKKLSKVIVPDKWKDGARNVTEGGGRKINENKLLSKKNRWTPYGTATTKCMICKQQVHQDGKYCHTCAYSKGVCAMCGKQVLDTKMYKQSNV

SEQ ID NO: 1794 - protein, 199 aa, Brassica napus
PNPTCTVSKSCGFNMTYGGSTITASLTQDTLTLTNDAIPGYTFGCINKATGTSLPAQGLMGLGRGPLSLISQTQNLYKSTFSYCLPNSKSSSFSGTLRLGPKFQPVRIKTTPLLKNPRRSSLYYVNMVGIRVGNKIVDIPPSALAFNPATGAGTIFDSGTVYTRLVEPAYVAVRNEFRRRVKNANATSLGGLDTCYSGS

SEQ ID NO: 1795 - protein, 291 aa, Brassica napus
  misc_feature (288)..(288): Xaa can be any naturally occurring amino acid
MGKVPATEAFGLAAKDESGVLSPFRFSRRETGEKDVRLKVLFCGICHTDVCMARNEWGFTTYPLVPGHEIVGVVTEVGAKVIKFKAGDKVGVGYMLSSCRSCDICTDDQENHCPKMIMTSGGKYYDDTMTYGGYSDHLVCEEDYIIRIPENLPLDAAAPLLCAGVTVYSPLKSHGLDKPGIHIGVVGLGGLGHVAVKFAKAMGTKVTVISSSDGKRDEAINRLGADLFLVSRDPEEMKDAMGTMDGIIDTVSATHPLLPLLGLLKYKGKFIMVGAPDKPLDLPALPLXLGK

SEQ ID NO: 1796 - protein, 77 aa, Brassica napus
RVRIIFPALERNAQKHWNQAVHSLTLNVRKIFSDLDPELFKECLAKFKEDESKEGETKAKREATWRRLEEFGMRKAS

SEQ ID NO: 1797 - protein, 87 aa, Brassica napus
ATLLLSTDLLTGDELFSDFFPYRGMEIGFLGEVEGKGPTKGWVGVNMGANQFAEKGGEAKGVANSVEKVVDIVTTLRLKEQPIYDRK

SEQ ID NO: 1798 - protein, 153 aa, Brassica napus
ITKGEKKRMCKLMDCRKLSVEACMHAVQNDRLPLRVVVQVLFFEQVRASASSGSSTPDFPKGIRELRSCGTYGSSRSVPTVMEDEWDAVATEEEMRALKSEIAALKLQEESGRKSTDKAAVTAISRVKSLIMSRKMFGKKLQGKAVVGEKNYG

SEQ ID NO: 1799 - protein, 399 aa, Brassica napus
MASSSATLFKASPVKSDWLKGQSLLLRQPSSVSPFRSHVAPSALTVHAASAYADELVKTAKTIASPGRGILAMDESNATCGKRLASIGLENTEANRQAYRTLLVSAPGLGQYISGAILFEETLYQSTVDGKKMVDVLVQQNIVPGIKVDKGLVPLVGSNDESWCQGLDGLASRTAAYYQQGARFAKWRTVVSIPNGPSALAVKEAAWGLARYAAISQDSGLVPIVEPEIMLDGEHCIDRTYEVAEKVWSEVFFYLSQNNVMFEGILLKPSMVTPGAESKDRATPEQVASYTLKLLRSRVPPAVPGIMFLSGGQSELEATLNLNAMNQGPNPWHVSFSYARALQNTCLKTWGGREENVKAAQDTLLTRAKANSLAQLGKYTGEGESEDAKEGMFVKGYTY

SEQ ID NO: 1800 - protein, 154 aa, Brassica napus
  misc_feature (80)..(80): Xaa can be any naturally occurring amino acid
  misc_feature (105)..(105): Xaa can be any naturally occurring amino acid
SNKGTVMVRFSPDDRPLLTSPVANEVSHLFTVDGSLHLNFHIAPPGSSMTYTGSYSMNGNAHLTSGTSDESMARVCCAQXTGSRLRDVSLEWPRSEFPMMFAQSXRGAPPRDFNMSVLARHTPPSSVFEIVKVNTLAPRDNIEAHSWVFIAPLK

SEQ ID NO: 1801 - protein, 145 aa, Brassica napus
LGLGPSLGLVRVPGVGLVYTELASGVPHIFSHFITNLPAIHSVVVFVCVKNLPVYTVPEEERFLVKRIGPKNFHMFRCVARYGYGDLHKKDDDFEKRLFESLFLFIRLESMMEGGCSDSDDYSICGSQNHFKEKNENVATFDTFD

SEQ ID NO: 1802 - protein, 127 aa, Brassica napus
IRLDHVRERGTVGSKSEVVDRKRLNEVRDNRASHSMSQPVNGKGKAASNSVMIGKQLHDQNNNSRDSRSGSLSKTTISDGEMRLLETDSEESEVSGSEGEDTSWISWFCNLRGNEFFCEVDDDYIQD

SEQ ID NO: 1803 - protein, 123 aa, Brassica napus
  misc_feature (62)..(62): Xaa can be any naturally occurring amino acid
  misc_feature (108)..(109): Xaa can be any naturally occurring amino acid
MYRERGTVGTKSEIVDRKRVVNEVRDNRASHSMSQPVNGKGKAASNSVMIGKQLHDQNNKQXSRSGSLSKTTISDAVDISETDSEESEVSGSEGEDTSWISWFCNLRXXEFFCEVDDDYIQDD

SEQ ID NO: 1804 - protein, 73 aa, Brassica napus
  misc_feature (6)..(6): Xaa can be any naturally occurring amino acid
  misc_feature (12)..(12): Xaa can be any naturally occurring amino acid
  misc_feature (16)..(16): Xaa can be any naturally occurring amino acid
SKNPMXRQIQTXARPXRTISSMTRMVRRGSESPGAEANGNGYDFTNKLLHMAWHPTENSIACAAANSLYMYYA

SEQ ID NO: 1805 - protein, 106 aa, Brassica napus
MATKIGMMDSAYFVWRSEILAWINSTLQLNLSKVEEACSRAVHCQLMDSVHPAAVPMHKVNFDAKSEYHMIQNYNVLHDVFNILKITKHIEVGKLVKGRPLDNLEF

SEQ ID NO: 1806 - protein, 202 aa, Brassica napus
MSSQGEMEESLLRVGSDAKAQSNSIESLYLRAKVWSEVSKVWRIALPSSLFRMTSFGSIIVAQAFIGHSSELGLAAYALLQSTFIRFLYGLTGGMSSATETLCGQAYGAEQYHTMGIYLQRSWIIDMAVTTLFLPFIVFAGPILRLLGQNVDITRTVDEIYPWTIPYVYSLIFTMTMQMYLQAQMRNAIVGLLSVLSLALDL

SEQ ID NO: 1807 - protein, 122 aa, Brassica napus
MNPRREPRGGRSALFDGIEEGGIRASSYASHEINEHENERALEGLQDRVILLKRLSGDINEEVDTHNRMLDRMGNDMDSSRGILSGTMDRFKTVFETKSSRRMLTLVASFVGLFLVIYYLTR

SEQ ID NO: 1808 - protein, 140 aa, Brassica napus
  misc_feature (56)..(56): Xaa can be any naturally occurring amino acid
DSSHGEMFTEEQNELIESAAEMLYGMIHARYILTSKGLASMLDKYKNYDFGRCPRXVYCCGQPCLPVGQSDIPRASTVKIYCPKCEDVYYPRSKYQGNIDGAYFGTTFPHLFLMTHGHLKPQKASQSYVPRVFGFKLHKP

SEQ ID NO: 1809 - protein, 161 aa, Brassica napus
MDPTTPFLGNEVKEDYSPARTLSEVKRVFSMESAKLWKIAAPIGFNIICQYGVTSFTNIFVGHIGEIELSAVSISLSVIGTFSFGFLLGMGSALETLCGQAFGAGQVHMLGVYMQRSWIILSVSCIFLLPIYIFATPVLRLLGQAEEIAVAAGEFTLLTIP

SEQ ID NO: 1810 - protein, 400 aa, Brassica napus
RPTRPSLEDLFNYCSRRFNLKTVLMLADQMLNRVEYMHVRGFLHRDIKPDNFLMGLGRKANQVYIIDYGLAKKYRDLQTHRHIPYRENKNLTGTARYASVNTHLGIEQSRRDDLESLGYVLMYFLRGSLPWQGLRAGTKKQKYDKISEKKRLTPVEGLCKSFPPEFTSYFLYGRSLRVEDKPDYPYLKRLFRDLFIREGYQFDYVFDWTILKYPQFGSSSSSSSKPRSSLRPALNPPVPSAERPEKPSAGQDSRERFSGALKAYARRNGSGSGAGQADISIPRTSENALASSKDTITPQNYERVVERPISSTRHASSSRKAAIVSSVVRATSSADFTENRSSRVVPNNGRSSTAQRTQHVPDPTTRPSFFSFSRAVPSRTARDPALQNFELLPIGNGKRK

SEQ ID NO: 1811 - protein, 298 aa, Brassica napus
  misc_feature (8)..(8): Xaa can be any naturally occurring amino acid
  misc_feature (220)..(220): Xaa can be any naturally occurring amino acid
MDHEEIPXMPSTPGTTPGTPGAPLFGGFEGKRNGHNGKYTPKSILKSCKCFNVDNEWALEDGRLPPVSCALAPPNVSLYRKLGAEFVGTLILIFAGAAPAIVNQKTDGAVTLIGCAASAGLAVMIVILSTGHISGAHLNPAITIAFAALKHFPWKHVMASLCAAFALKAVFEPPMSGGVTVPTVGLSQAFALEFIISFNLMFVVTAVATDTRAVGELAGXIAVGATVMLNILIAGPNTCASMNPVRTLGPAIAANNYRSIWVYLSAPILGALIGAGTYTIVKLPEEDEAPKEKRSFRR

SEQ ID NO: 1812 - protein, 438 aa, Brassica napus
MSHGDHASHKKVIDLPHASNPQSKDNTIAIMLDTKGPEVRSGDLPQPIMLDPGQEFTFTIERGVSTPTCVSVNYDDFVNDVEAGDMLLVDGGMMSFMVKSKTKETVICEVVDGGELKSRRHLNVRGKSATLPSITEKDWEDIKFGVENKVDFYAVSFVKDAQVVHELKNYLQGCGADIHVIVKIESADSIPNLHSIITASDGAMVARGDLGAELPIEEVPILQGRIINLCRSMGKAVIVATNMLESMIVHPTPTRAEVSDIAIAVREGADAVMLSGETAHGKFPLKAAGVMHTVALRTEATITTSTEMPPNLGQAFKNHMSEMFAYHATMMSNTLGTSTVVFTRTGFMAILLSHYRPSGTIYAFTNEKKIQQRLALYQGVCPIYMEFSDDAEDTFTKALATLLKQGMVKKGEEIAIVQSGSQPIWRSQSTHNIQVRKV

SEQ ID NO: 1813 - protein, 64 aa, Brassica napus
MAGHKVAHATLKGPSVVKELVIGLALGLAAGGLWKMHHWNEQRKTRAFYDLLERGEISVVHPEE

SEQ ID NO: 1814 - protein, 328 aa, Brassica napus
MQKSSMSTEREVVCVTGASGCIGSWLVHLLLLRGYSVHATVKNLQDEKETKHLEALEGAATRLHLFEMDLLKYDTVSAAVNGCSGVFHLASPCIVDEVQDPQKQLLDPAVKGTLNVLTAAKEAGVKRVVVTSSISAITPSPNWPADKIKNEDCWADEDFCKQNGLWYPLSKTLAEKAAWEFAEEKGLDVVVVNPGTVMGPVIPPSINASMLMLQRLLEGCTETYENFFMGSVHFKDVALAHILVYENPSAKGRHLCVEAISHYGDFVAKVAELYPNYSVPKLPRETQPGLLRAKNAAKKLMELGLEFSSMEVIIKDGVESLKSKGFIS

SEQ ID NO: 1815 - protein, 202 aa, Brassica napus
MNPEYDYLFKLLLIGDSGVGKSCLLLRFADDSYLDSYISTIGVDFKIRTVEQDGKTIKLQIWDTAGQERFRTITSSYYRGAHGIIVTYDVTDQESFNNVKQWLNEIDRYASESVNKLLVGNKNDLTSQKVVSTETAKAFADELGIPFLETSAKNATNVEEAFMAMTAAIKTRMASQPSGGSKPATVQIRGQPVNQQSGCCSS

SEQ ID NO: 1816 - protein, 337 aa, Brassica napus
  misc_feature (188)..(189): Xaa can be any naturally occurring amino acid
  misc_feature (193)..(193): Xaa can be any naturally occurring amino acid
  misc_feature (196)..(198): Xaa can be any naturally occurring amino acid
  misc_feature (207)..(207): Xaa can be any naturally occurring amino acid
  misc_feature (212)..(212): Xaa can be any naturally occurring amino acid
  misc_feature (220)..(220): Xaa can be any naturally occurring amino acid
  misc_feature (222)..(222): Xaa can be any naturally occurring amino acid
  misc_feature (253)..(253): Xaa can be any naturally occurring amino acid
  misc_feature (255)..(255): Xaa can be any naturally occurring amino acid
  misc_feature (268)..(268): Xaa can be any naturally occurring amino acid
  misc_feature (273)..(273): Xaa can be any naturally occurring amino acid
  misc_feature (281)..(281): Xaa can be any naturally occurring amino acid
  misc_feature (296)..(296): Xaa can be any naturally occurring amino acid
MGATTVTHVTTINPTNTNIHGPAIDEVDGLIRVYKDGHVERFQLVPCVGPSLPLDLAVACSDVHIDELTNVWARLYVPTVTKSLSVSSSKLPLLVYFHGGGFCVGSVSWSCYHEFLARLSASSRCIIMSVNYRLAPENPLPAAYEDGVNAILWLKKTRDDNLWSKLCDFGKIFLAGDSAGGNIANHVXXRLQXVDXXXQPLKIEGTXLIQPXFGGEARTXSXRRVENNMKSSVLTLAASDAWWRLALPRGANXEXPYCKPAKSKTRTXVCVAXMDVLMDRXMEMCYEIDNEEMIKXVVYKGVGHAFQILGKSQLAHTMTLEMLCHIDDFIHQCDPSI

SEQ ID NO: 1817 - protein, 142 aa, Brassica napus
RGGPRRPEKEEKLLLVNFFFSSAVVVTARVKATMGVPLTAWKSSFAFPVTRRATTAIPSIVGTGGGVNCLQVWPPIGKKKFGTFFYFPDLTEVEWGKEVDYFFRTRWIPGVEFKLEHGFVARGHGSTPGYYDGRYWPMWKLP

SEQ ID NO: 1818 - protein, 99 aa, Brassica napus
  misc_feature (82)..(82): Xaa can be any naturally occurring amino acid
MVTNTEVVAPASNGVDGGCCKSGPGYATPLAAMSGPSEKLIYVTAVYSGTGREKPDYLATVDVDPNSPTYSTVIHRLPMPFXVGDELHHSGWNSCSSCH

SEQ ID NO: 1819 - protein, 392 aa, Brassica napus
RPTRPVRGGELFNKVAKGRLKEDVARKYFQQLISAVTFCHARGVYHRDIKPENLLLDENGNLKVSDFGLSAVSDQIRQDGLFHTFCGTPAYVAPEVLARKGYDAGKVDIWSCGVVLFVLMAGYLPFHDRNVMAMYKKIYKGEFRCPSWFSPELTRLCSRLLETNPEKRFTFPQIMENSWFKKGFKHVKFYVEDDKLCNVVDDDDELETGSVESDRSSTVSESDVEFFKPARRVGGLPRPASLNAFDIYRFSQGFDLSGLFDDDGEGSRFVSGAPVSKIISKLEEIAKVVSFTVRKKDCRVSLEGSRQGVKGPLTIAAEIFELTPSLVVVEVKKKGGDRTEYEEFCNKELKPKLQTLTADEVDDPVAVSAVVDETASGVANSPPVCFLPSDTE

SEQ ID NO: 1820 - protein, 382 aa, Brassica napus
  misc_feature (270)..(270): Xaa can be any naturally occurring amino acid
  misc_feature (276)..(276): Xaa can be any naturally occurring amino acid
MGLCFQPILASLFLILLSSLPELLAQSQQHFLGQNNTSLLGEERSCNWFRGKWVYDSSYPLYSPFSCPFINPEFNCQKTGRPDTNYQHFRWQPFSCSLPRFDGVNFMRRMRGKKIMMVGDSLSLNMFESLACLIHASLPNAKYSLSRSQPLTSLTFQDYGVTILLYRTQFLVDVVQEKAGRVLVLDSIKQANAWLGMDVLIFNSWHWWTHTDGIQPWDYMREGNTLYKDMNRLVAFYKGLNTWARWINGNINPSRTQVFFQGVSPVHYDXMTFKAXIQNTNCVQNSGRQWNEPSQSCKGQTQPFMGERYPGGLPLGWVVVNKVLSRIKKPVRLLDLTTLSEYRKDAHPSLYNGIAKGLDCSHWCLPGLPDTWNLLLYASLTS

SEQ ID NO: 1821 - protein, 184 aa, Brassica napus
  misc_feature (13)..(13): Xaa can be any naturally occurring amino acid
VDPRVRSAVAAVXAAVASGEEATAAPVQPTDIASGSGPSHRRLWVKERTTDWWDRVSSPDFPEEEFRREFRMSKSTFNLICDELDATVTKKNTMLRDAIPAPKRVGVCVWRLATGAPLRHVSERFGLGISTCHKLVIEVCRAIYDVLMPKYLRWPSDSEIRSTKEKFESVHKIPDVVGSIYTTH

SEQ ID NO: 1822 - protein, 184 aa, Brassica napus
  misc_feature (124)..(124): Xaa can be any naturally occurring amino acid
MASLNPFDLLGDDAVDPSQIVLSLPKKVEKAAPVQPAKAAKFPTKPSPPSQAVRESRDGPSGGHGGGGGRGPPRGSFNPGGNRPHDPKDGERNGGFRGYRESGGRGGHIGGFANGKTGDVEPPXRVYDRRSGTGRSNDVKREGGGRGNWGTPEDDIQPATEEPTTDVEKSPVAENERGEDATTD

SEQ ID NO: 1823 - protein, 447 aa, Brassica napus
  misc_feature (190)..(190): Xaa can be any naturally occurring amino acid
VDPRVRHRIDGGSFNFDGDLMEALFGYVGARKPGEANTVPQKPTVSTTQTYILDPRKSQNKAIVLKSLGMTKEEIIDLLTEGHDADTDTLEKLSGIAPTPEEQTEIIDFSGDPTKLADAESLLFHILRAVPSAFNRFNVMLFKINYGSEVAQQKGSLQTLESACNELRARGLFMKLLEAILQAGNRMNAXGTARGNAQAFNLTALRKLSDVKSVDGKTTLLHFVVEEVVRSEGKRAAMNKISGENTGGDIADASREEQEIEFIKLGLPIIGALSSEFTNVKKAAGVDYDSFLATTLALGTRLKETKRLLDQSKGKEDGCLTKLRSFFESAEEELRVITEEQLRIMDLVKKTTNYYQAGGALKERNLFQLFVIIRDFLGMVDTACSEIARNQRKQRPAATVAGASSSTAATTPSAAAPQRNAVRFPILPPNFMSEHSRYSSSDSDSDS

SEQ ID NO: 1824 - protein, 204 aa, Brassica napus
RKPAAKLRFLNEYLPEDRDPAHAWPVIFFVFLIALAALSFGSGNETSVPVLKKLRLHPPGASRVELPDGRYLAYQELGVSSDRARYSLIVPHSFMSSRLAGIPGVKDSLLKDYGVRLVSYDLPGFGESDPHRGRNLSSSASDMIDLASALGIVEKFWLLGYSSGSMHAWAAMRYFSDRIAGVAMIAPMINPYEASMSKEETANT

SEQ ID NO: 1825 - protein, 181 aa, Brassica napus
MAYSMLSSAAVVTSPAQATMVAPFTGLKSSSAFPVTRKANNDITSIVSNGGRVNSMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 1826 - protein, 137 aa, Brassica napus
MATAVSLQAIIGSIASQSPSNSKASLFPKEPFNLPIKFRQNRCFKIEATTASQTPVLDTLLSPSKTTTTPHKKKSNEASLILIRHGESLWNEKNLFTGCVDVPLTEKGVAEAIQAGKRISTIPVDLIFTSSLIRAQM

SEQ ID NO: 1827 - protein, 256 aa, Brassica napus
LQISRMWETPVSVLLLLTIPKTSPSEWSRFYRSANIVFCPLALLYACNSFVPLNHPISFLFPNTHLPLWLVVLFMTSSLAFLHFTIEKQPPKTEQMPVIIVAFVMSVFWISTIAGELLNCLAALGTLLELPPALLGLTVLAWGNSVGDLVADVAVAKAGRPAMAMAGCFAGPMFNMLVGLGTALVMQTANVYPNAYELGFHVGIVIAFVFLLLSLMGSLLVITWSRFRVPRFWGVCLVGLYVVFTFVSLIIATFST

SEQ ID NO: 1828 - protein, 311 aa, Brassica napus
  misc_feature (103)..(103): Xaa can be any naturally occurring amino acid
  misc_feature (197)..(197): Xaa can be any naturally occurring amino acid
  misc_feature (307)..(307): Xaa can be any naturally occurring amino acid
KNLDPSISDEKLKEIFSPVGTVTSCKVMRDPSGISKGSGFVAFSTPEEATEAMSQLSGKMVESKPLYVAIAQKKEDRRVRLQAQFSQPRPVAMPPSAGPRMPXFPPGGPGIGQQMFYGQAPPTMIPPQPGYGYQQQLVPGMRPGGGHGPNYFMPMVQPHQQRPEVGGRRPGGIQQFQQQPPMMQHQMHPRGRNIRYXPKGRGVSGGDVPPYDMGNNNMPLPIGTLASNLANASPEQQRTMLGENLYPLVEKLEAESAAKVTGMLLEMDQTEVLHLLESPEALEAKVAEAMDVLRSVAAGGATEQLAXLNLS

SEQ ID NO: 1829 - protein, 228 aa, Brassica napus
MAQVQTANGTSAAAPAQIGTTSLYVGDLDLNVTDSQLFEAFSQMGQVVSVRVCRDLATRKSLGYGYVNLANPQDAARAIQEMNFMPLYGKPIRVMYSHRDPSVRRSGAGNIFIKNLDLAIDHKALHDTFSTFGNIVSCKVAVDASGQSKGYGFVQYADEESAQKAIEKLNGMLLNDKQVYVGPFLRRQERDSSANKTKFTNVYVKNLGESTTDDDLKKAFSEYGKITS

SEQ ID NO: 1830 - protein, 307 aa, Glycine max
MPMAKKRKLRSSNPEPTKPVEPQQQNHETVELDQQQPIPEPTLEDSNTMAIDEPKHEQEEEPQNAESEQEVEEEEEEEDEQQEEQEPETREGQPGPETLEAANQAEANGSNEGNNEEEEEEDLTLEEEPVEKLLEPFTKEQLHSLVTQAVDMFPEFVDSVRRIADVDPAHRKIFVHGLGWDATAETLTSVFGKYGEIEDCKAVTDKVSGKSKGYAFILFKHRDDARKALKHPQKKIGNRTTSCQLASVGPVPDPPSSVTPVSEYTQRKIYVSNVSAETDPQKLLEFFKQLGEVEDGTLGLAKNTGKP

SEQ ID NO: 1831 - protein, 430 aa, Glycine max
EFGTRPGCRVRYDLFPFNNVSTVSRSNSPSSGKSSISIILAIVVPITVAILLFIVGVYFLRKRASKKYNTFVQDSIVDDLTDVESLQFDLATIEAATNGFSDENKIGQGGFGVVYKGVLPSGQEIAVKRLSVTSLQGAVEFRNEAALVAKLQHRNLVRLLGFCLEGQEKILIYEYIPNKSLDYFLFDPAKQKELDWSRRYKIIVGIARGIQYLHEDSQLRIIHRDVKASNVLLDENMNPKISDFGMAKIFQADQTQVNTGRIVGTYGYMSPEYAMRGQFSVKSDVFSFGVLVLEIVSGKKNTDFYQSNHADDLLSHAWKNWTLQTPLELLDPTLRGSYSRNEVNRCIHIGLLCVQENPSDRPSMATIALMLNSYSVTMSMPQQPASFLRGRGPNRLNQGMDSDQSTTDQSTTCSIPWSVNEVSITDVYPR

SEQ ID NO: 1832 - protein, 309 aa, Glycine max
MSLIAEAPNFLKLYSDGSVKRFDPEIVPASLESTKGYKSKDVIIDSSKPITGRIFLPDYPTSSKKLPLLVYFHGGGFCIGSTTWLGYHNFLGDFSVTSQSIILSVDYRLAPEHRLPIAYEDCYTSLEWLGDQVSCEPLLQQIDLTRVFLSGDSAGGNIAHHVAVKAIQNNECPLKIKGLMLIHPYFGSEKRTKNEMADESIKDVAMNDMFWRLSIPEGLNRDYFGCNFEKTDLSTSVWSKFPAIGVYVAGKDFLKERGVRYAEFLKKKGVKEVELVEAKEETHVFHVYYPESCATRLLQNQMSLFMEKY

SEQ ID NO: 1833 - protein, 253 aa, Glycine max
MASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQIVKAEDSIGQDERWRHVLHMQVGREWCFLCSGGRLTTIIGGGDSVAAVEKVGVASVMSHISTGGGASLDVIGRQRASRSPCSR

SEQ ID NO: 1834 - protein, 93 aa, Glycine max
  misc_feature (47)..(47): Xaa can be any naturally occurring amino acid
  misc_feature (58)..(58): Xaa can be any naturally occurring amino acid
  misc_feature (74)..(74): Xaa can be any naturally occurring amino acid
RDLSRDLGIGYSRGIRKTWVNDRLGTRFREVNDNDSICILKKLVAAXLSHDPSRSTSXKWFTIYIEHITLNDYXIHDGLGLELYYNYTHIWCD

SEQ ID NO: 1835 - protein, 473 aa, Glycine max
  misc_feature (203)..(203): Xaa can be any naturally occurring amino acid
  misc_feature (414)..(414): Xaa can be any naturally occurring amino acid
MAMVKRSIGVCKRLFGSSSCLSTSTATSDHDIARRLQLPPFDYKPRPYKGPLADEVFAKRKKFLGPSLFHFYQKLLNIVEGMMQHLFDENGRRYLDAFAGIVTISCGHCHPAVLNAIMEQSKLLQHTTTIYLHHAIADFAEALASKMPGNLKVVYFLNSGSEANDLAMLMARLYTGNMGMISLRNAYHGESSSTIGRTAMNTXKYPIPEGEVHHVMNPDPYRGVFGSDANRYARELQDHIDYGPSGRVAGFMAETIQGTGGAVELAPGYLKLAYDIIHKAGGVCIADEVQCGFARTGSHFWGFETQGVIPDIVTMAKGIGNGLPLAAVVTTPEIASVMAQKLQFNTFGENPVCFAGGLAVLRVLDKERRQCHCADVGSHSIQRLRSMMQVHDIIGDVRGRGLMVGIEFVTDRKXKPPAKAETTALHERFSELGILVGKGGLHGNVFRIKPPMCFTKDDAGFFVDALDCAISKL

SEQ ID NO: 1836 - protein, 336 aa, Glycine max
  misc_feature (33)..(33): Xaa can be any naturally occurring amino acid
LEANAILAVSVSLAVCNAGAAVKKIPLYKHIAXAGNKTLVLPVPSFNVINGGSHAGNKLAMQEFMILPVGASSFKEAMKMGVEVYHHLKAVIKKKYGQDATNVGDEGGFAPNIQENKEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 1837 - protein, 77 aa, Glycine max
  misc_feature (52)..(52): Xaa can be any naturally occurring amino acid
GNSRVHAAPSWAKFEIGRAAVYWKTMNGLPPSSGEKLKLFYNPAATHLVPNXGEFGFAFIGGFNYPIMFGVEPFPFA

SEQ ID NO: 1838 - protein, 485 aa, Glycine max
MASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQIVKAEDSIGPEVEKLVASLPDGGVLLLENVRFYKEEEKNDPEHAKKLASLADLYVNDAFGTAHRAHASTEGVTKYLKPSVAGFLLQKELDYLVGAVSNPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 1839 - protein, 81 aa, Glycine max
SNSYTRAVHQLSHRARGTAWLHPYTGLKSMAGLPTRKTNTDITSIASNGGRVQCMQVRPPAGSMKFETLSYLPDLDDAQLA

SEQ ID NO: 1840 - protein, 79 aa, Glycine max
  misc_feature (55)..(55): Xaa can be any naturally occurring amino acid
MISSAAVTTVNRAGADMAASFTGLNVMTGFPTRKTNDDSTFIARTGCRAQCLHVXTPVGQQKSETMAYLSDLADAQLAN

SEQ ID NO: 1841 - protein, 80 aa, Glycine max
  misc_feature (17)..(17): Xaa can be any naturally occurring amino acid
  misc_feature (31)..(31): Xaa can be any naturally occurring amino acid
  misc_feature (52)..(52): Xaa can be any naturally occurring amino acid
  misc_feature (57)..(57): Xaa can be any naturally occurring amino acid
SQTDTTVNRTDAGAIAXLTGLKSMAGLRTRXTNTDITFIASNCGRTQCMQVXSPIGXKKSETSFYLPDLDDAQLAKEVEY

SEQ ID NO: 1842 - protein, 100 aa, Glycine max
  misc_feature (13)..(13): Xaa can be any naturally occurring amino acid
  misc_feature (81)..(81): Xaa can be any naturally occurring amino acid
MASSTISDPAVTXVNHAQADIVTTFTDLKSKTALPTRNTNNDITSIGSNTGRVHFMQAYPAHNKNNTDTVSYLAHLYDAQXSKDEEYLIMNGWMNCLQFK

SEQ ID NO: 1843 - protein, 130 aa, Glycine max
  misc_feature (93)..(93): Xaa can be any naturally occurring amino acid
  misc_feature (102)..(102): Xaa can be any naturally occurring amino acid
IADADATIDYRAGALVHTSFTGLKAMAGFPTMRTNNDITSIASNRGRVQCMQDWPPFGKKMSVTLSYLPDLDDAQLAKEVQYLLMNGWILWLXEFGAEHGFXYRERNRSPGIYHGRYWTMCTLTMTGCTD

SEQ ID NO: 1844 - protein, 92 aa, Glycine max
  misc_feature (66)..(66): Xaa can be any naturally occurring amino acid
MAFRLPGIRKASLAAIQGNSKAVDVPKGYLAVYVGDKMKQFMIPVTYLNQPSFQDLLSQAEEEFGXDHPMGGLIIPCREDVFLDMTSRLNKC

SEQ ID NO: 1845 - protein, 74 aa, Glycine max
MAGPFELGSSMKVPADCVNDLRTFRADNMHSSMTIIYYSRTFLSKIGELVAGILGFTSLLRFVIYFLLMMGTSL

SEQ ID NO: 1846 - protein, 97 aa, Glycine max
  misc_feature (22)..(22): Xaa can be any naturally occurring amino acid
  misc_feature (38)..(38): Xaa can be any naturally occurring amino acid
  misc_feature (42)..(42): Xaa can be any naturally occurring amino acid
SRSSHSLKMDHDTLKRNIDCIXFLSAPLTCKSVAKCDXRHNXRCARLKPKDCWYWLAGQCMNPNCAFRHHRLDGHNAASVQSEFKQTSLRAHNTLVP

SEQ ID NO: 1847 - protein, 505 aa, Glycine max
MASLSCSANDLAPLFNDTAAANYLCAQFDSISRKLNVTTYAVDNTYLLFSAYLVFAMQLGFAMLCAGSVRAKNTMNIMLTNVLDAAAGGLSYYLFGFAFAFGGPSNGFIGRHFFGLRKFPKDSPPSGDYSFFLYHWAFAIAAAGITSGSIAERTQFVAYLIYSSFLTGFVYPIVSHWFWSSDGWASATRSHGNVLFGSGVIDFAGSGVVHMVGGIAGLWGALIEGPRIGRFDRSGRSVALRGHSASLVVLGTFLLWFGWYGFNPGSFLTIAKGYESGGYYGQWSAIGRTAVTTTLAGSTAALTTLFSKRLLAGHWNVIDVCNGLLGGFAAITSGCAVVEPWAAIVCGFVAAWVLIGLNKLAAKVEYDDPLEAAQLHGGCGAWGVFFTGLFAKKVYVEEIYGVGRPFGALMGGGGRLLAAQVIQILVVCGWVTATMAPLFYGLHKMKLLRISRDDETAGMDLTRHGGFAYAYHDDEDGSSRGVGFMLRRIEPAASTTPSPPAAPQV

SEQ ID NO: 1848 - protein, 545 aa, Glycine max
MATSLSVSPSLSLNTLFIAKALPLSRPSFLSLPLPKSLLSLSTRRRTFIVRAESQNGRDPVPAHYDFDLFTIGAGSGGVRARRFAANYGASVAICELPFSTISSETTGGVGGTCVIRGCVPKKLLVYASKFSHEFEESNGFGWRYDSEPKHDWSSFIANKNAELQRLTGIYKNILNNAGVKLIEGHGKMIDPHTVDVNGKLYSAKHILVAVGGRPFIPDIPGKELAIDSDAALDLPTKPVKIAIVGGGYIALEFAGIFNGLKSEVHVFIRQKKVLRGFDEEIRDFVEEQMSVRGIEFHTEESPQAITKSADGSFSLKTNKGTVDGFSHIMFATGRRPNTQNLGLESVGVKLAKDGAIEVDEYSQTSVYSIWAVGDVTNRINLTPVALMEGGALVKTLFQDNPTKPDYRAVPSAVFSQPPIGQVGLTEEQAVQQYGDIDIFTANFRPLKATLSGLPDRVFMKLVVCAKTNEVLGLHMCGEDAPEIVQGFAVALKARLTKADFDATVGIHPSAAEEFVTMRTPTRKIRKSESSEGKSGSQAKAAAGV

SEQ ID NO: 1849 - protein, 97 aa, Glycine max
  misc_feature (72)..(72): Xaa can be any naturally occurring amino acid
  misc_feature (86)..(86): Xaa can be any naturally occurring amino acid
MASSMISSPAVTTVIRAGAGMVARFTGLKSMAGFRSSKTINDITSIATNGGRVHCMQVWSPVGNKLFETLSXLPFLDDVQLAHELXYLLMNGWIPCL

SEQ ID NO: 1850 - protein, 85 aa, Glycine max
  misc_feature (37)..(37): Xaa can be any naturally occurring amino acid
  misc_feature (52)..(52): Xaa can be any naturally occurring amino acid
MASSMISSPAVTTVNRAGAGMAAPFTGLKSMAGFPSXKTNDDSTSIATNGGXVQCIHVWPPIGNTKFETPSDLPDLDDAQVAKEI

SEQ ID NO: 1851 - protein, 109 aa, Glycine max
  misc_feature (63)..(63): Xaa can be any naturally occurring amino acid
  misc_feature (96)..(96): Xaa can be any naturally occurring amino acid
ASSMISSPAVTTVNRAGAGMVAPFTGLKSMAGYTTIKTNNDITFIAINGGRVQCMQEWPPIGXTKYEILYYLSDLDDAQLAMEIEYLLTKGWILYXEFNWEHCFMYREH

SEQ ID NO: 1852 - protein, 118 aa, Glycine max
  misc_feature (22)..(22): Xaa can be any naturally occurring amino acid
SKHFAKRDKQSIKNLASSPKLXEAGNAPSLAIKASVDKTNMRFDSYAKQGLLCSGAWLPHLIVNGYQTHSGEFITPGILILYISGWICRVGRTHLIAIRDHKNHTMNEIIIDVPLASR

SEQ ID NO: 1853 - protein, 112 aa, Glycine max
  misc_feature (37)..(37): Xaa can be any naturally occurring amino acid
MASSMISSPAVTTVNRAGAGMVAPFTGLKSMAGFPTXKTNNDITSIASNGGRVQCMQVWPPVGKKKFETLSYLPDLDDAQLAKEVEYLLMKGWIPCLEIQLEQRFVFREPHQ

SEQ ID NO: 1854 - protein, 371 aa, Glycine max
MKYIRSNSLKRLFSFGRRGFGEENDVGLVVSPCEEHPPRPSWKCFSYEELFDATNDFSSENVIGRGGYAEVYKGTLNGGDEVAVKRLTRTSTDERKEKEFLLEIGTIGHVRHSNVLPLLGCCIDNGLDLVFELSTVGSVASLIHDENLPPLDWKTRYKIALGTARGLHYLHKGCKRRIIHRDIKASNILLTADFEPKISDFGLARWLPSQWTHHSIAPIEGTFGHLAPEYYLHGVVDEKTDVFAFGVFLLEVISGRKPVDGSHQSLHSWAKPILSKGEIENLVDPRLGGAYDVTQFNRVAFAASLCIRASATCRPIMSEVLEVMEEWEMDKGKWEMPEEEEQEEELWGFEDLEYEYDSSFSMSLPDSVGST

SEQ ID NO: 1855 - protein, 202 aa, Glycine max
  misc_feature (68)..(68): Xaa can be any naturally occurring amino acid
  misc_feature (172)..(172): Xaa can be any naturally occurring amino acid
MNRYKLPSWAKFEIGRAAVYWKTMNGLPPSSGEKLKLFYNPAATQLVPNEEFGIAFNGGFNQPIMCGXGEPRAMLRKYRGKADAPIYSIQICIPKHALNLIFSFTNGVDWDGPYRLQFQVPKALQNKPIDFFNKGLAEELSKEGACEQAIFPDTNKVITKCAMIGNLSKEGXCTDPSSHLYNPLANVDDGTCTIELDSESEE

SEQ ID NO: 1856 - protein, 500 aa, Glycine max
MFGYAAAIIAAILFFQYFFHRRRCCKHPILTEYPIIGMLPQLLFNLWRAHDYSTQVLQRHGGTGEFIGPWFTNMDYLVTCDPINVHHMLSKNFHNYVKGPEFRHIFQAFGDGIFAADSEAWKYSRDLFHSLFKQKSFEVFVAKTIHNKVHNGLLPILDHVQQQGRVVDLQDVFNRFTFDNICSIVLGNDPNCLSIDFSEVAIEKAFNEVEESIFYRHVVPRCVWKIQRWLQIGQEKKMTEACKTLDQFIHACIASKREKLSKYNENEMGEAHHVDFLTALMREETAHDDKFLRDAVFNLFVAGRDTITSALTWFFWLVATNPSVEAKILDEMKEKLGTKEKTLGVLSVEEVKRLVYLHGAICEALRLFPPIPFETKQAIKADMLPSGHRVNSGTKILFILYAMGRSEETWGKDCLEFKPERWISEKGGIIYVPSYKFIAFNAGPRTCLGKEISFIQMKMVAAAILHKYRVRVVDHVATPSPSIVLLMKDGLKVQIAKREI

SEQ ID NO: 1857 - protein, 68 aa, Glycine max
MIEVVCNDRLGKKVRVKCNTDDTIGDLKKLIAAQTGTRWNKIVLKKWYTIFKDHVSLGDYEIHDGMNL

SEQ ID NO: 1858 - protein, 59 aa, Glycine max
MVVSRVVVFLGLILATLVSLACSQSAAPAPAPTSDGTSIDQTVAYILMLVALVLTYIMH

SEQ ID NO: 1859 - protein, 47 aa, Glycine max
MAAHTIAHATLKGPNVVNEITLGITLGSSADSQSKMHHWNDQTKTRT

SEQ ID NO: 1860 - protein, 152 aa, Glycine max
MSQLLDKAKNFVSEKVNDMAKPEASVTDVDFKRVSKDNVEYLAKVSVRNPYSTSIPICEINYSFKSASREIASGKIPDPGSLKAKDTTMVDVPVKVPYSILMSLAKDIGADWDIDYQLDLGLVIDVPVIGIFTIPLSQKGEIKLPTLSTMFA

SEQ ID NO: 1861 - protein, 96 aa, Glycine max
  misc_feature (16)..(16): Xaa can be any naturally occurring amino acid
  misc_feature (27)..(27): Xaa can be any naturally occurring amino acid
  misc_feature (61)..(61): Xaa can be any naturally occurring amino acid
RASFLETDIEMDVDHXVAETAADTDAXDNATDHFICYARVDDELYDLDGKQAVPISDGTSXPRSLLRDAAKAVHSMIQRNTHSFNYYVIAKGMKFG

SEQ ID NO: 1862 - protein, 173 aa, Glycine max
SFASPVSLGDLMGVSSSGRSHSVVRRVSLSRGNCRGRKRWHCVSLSVCRYSVTTTDFVADQGNSVSLDSNSSRSKGGDDGAGFVLKPPPKPVLKSPENKSDPILGPSRTTGDVEERNKVIESLGEVLEKAEKLGSSKVNGDRNNGSVNKPVRSNANASPKADKPVNSAAPQKS

SEQ ID NO: 1863 - protein, 86 aa, Glycine max
  misc_feature (61)..(61): Xaa can be any naturally occurring amino acid
GKYERVGTTQKRARAGKVAPFTGLKYMAVVPTRKTNQELTFIDRNGGGVLCLQVWPRAGKXMRVTLFYVPDIDDAHVGDEVQYLLM

SEQ ID NO: 1864 - protein, 398 aa, Glycine max
MASASASLLKSSLVLDKSEWVKGQTLRQPSASVVRCNPTTPSGLTIRAGSYADELVKTAKTVASPGRGILAMDESNATCGKRLASIGLENTEANRQAYRTLLVTVPGLGQYISGAILFEETLYQSTTDGRKIVDVLLEQNIVPGIKVDKGLVPLAGSNDESWCQGLDGLASRSAAYYEQGARFAKWRTVVSIPNGPSALAVKEAAWGLARYAAIAQDNGLVPIVEPEILLDGEHGIDRTFEVAQKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALAFRAKSNSLAQLGKYTGEGESEEAKKELFVKSYSY

SEQ ID NO: 1865 - protein, 87 aa, Glycine max
  misc_feature (52)..(52): Xaa can be any naturally occurring amino acid
MAALMISFPAVTTVNRAGAGMDVPFTGLKYMDGFPSMMSNIDITFIVSNGGXVQCMLDRSPYGKKKFETLFHLPDLDDAQLVKEVLF

SEQ ID NO: 1866 - protein, 274 aa, Glycine max
  misc_feature (261)..(261): Xaa can be any naturally occurring amino acid
MACSTTLHASILKLLIIFLFAGWVSLWLLKPTQIWTRKWKQAEDSANDTIFGYYGLSFAVYAFPIIAIAIIGLLLLDLKAGYQRSRSARSTPSKSNFFSNPLVVNTTLGILSSIEILIAFLFIVFLAWTYYSRIYTDFKKLMPYKSLKLNTWQLKYHRIATRFGLLAEACMALLLLPILRGLAVFRILGIQFEASVRYHTWIGTAMILFATIHGASTLLVWGVSHHIEDEIWKWQKTGRIYLAGEIALVVGLVIWVTSLPXIRRRKFEIFYYTH

SEQ ID NO: 1867 - protein, 148 aa, Glycine max
  misc_feature (141)..(141): Xaa can be any naturally occurring amino acid
MATRVVAEQKPKTKIVCTLGPASRSVPMIEKLLRAGMNVARFNFSHGSHEYHQETLDNLRAAMENTGILCAVVLATKGPAIRTGFLKDSKPIQLKQGNEITISTDYDLQGDEKTICLSYKKLPVDVRPGMVILCADGTISXTVLSCDK

SEQ ID NO: 1868 - protein, 501 aa, Glycine max
MATRVVAEQKPKTKIVCTLGPASRSVPMIEKLLRAGMNVARFNFSHGSHEYHQETLDNLRAAMENTGILCAVMLDTKGPEIRTGFLKDSKPIQLIQGNEITISTDYDLKGDEKTICMSYKKLPEDVRPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDTFDWACSDEAPARHSLIFRGLVPVLSAASARASHAETTEEAIEFAMQHAKSKGLCHNGDSVVALHRVGTASIIKILTVK

SEQ ID NO: 1869 - protein, 164 aa, Glycine max
MAEEHRCQAPEGHRLCSNNCGFFGSPATMNLCSKCYRDIRLKEEEQAKTKSTIETALSGSSSATVTATAVVASSVESPSAPVESLPQPPVLISPDIAAPVQANRCGACRKRVGLTGFKCRCGTTFCGSHRYPEKHACGFDFKAVGREEIARANPVIKGEKLRRI

SEQ ID NO: 1870 - protein, 470 aa, Glycine max
MAVSAITGARLTLGIGLAIPLSSPTRSRTVAMAVSVDPKTDNKLTLTKSEEAFAAAKELMPGGVNSPVRAFKSVGGQPIVIDSVKGSRMWDIDGNEYIDYVGSWGPAIIGHADDQVLSALVETMKKGTSFGAPCLLENTLAELVINAVPSIEMVRFVNSGTEACMGALRLARAYTGREKIIKFEGCYHGHADPFLVKAGSGVATLGLPDSPGVPKAATFETLTAPYNDTAAVEKLFEANKGEIAAVFLEPVVGNAGFIVPKPDFHNFLRKITKENNTLLVFDEVMTGFRLSYGGAQEYFGITPDITTLGKIIGGGLPVGAYGGRRDIMEKVAPAGPMYQAGTLSGNPLAMTAGIQTLQRIKEPGTYEYLDKITGELVQGIIEAGKRAGHAICGGHIRGMFGFFFTEGPVYNFADAKKSDTDKFARFFWGMLAEGVYLAPSQFEAGFTSLAHTSDDIKKTIAAAEKVFREI

SEQ ID NO: 1871 - protein, 466 aa, Glycine max
MAVSAITGARLTLGMSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTAAVEKLFEANKGEIAAVFLEPVVGNAGFIVPKPDFHNFLRKITKENNTLLVFDEVMTGFRLSYGGAQEYFGITPDITTLGKIIGGGLPVGAYGGRRDIMEKVAPAGPMYQAGTLSGNPLAMTAGIQTLQRIKEPGTYEYLDKITGELVQGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 1872 - protein, 200 aa, Glycine max
MQESLLRSCSRKADSPNRSSPGELSIHDLALALAPSLFQSSSHHVTNEAKTSMHLIANLAFKKGKFIHRSRSAPSLLFTDMGLDFQEPSEPHKSSTSIVRLSFLGVFLYVAIGVTVYMTSGSFRGTTTFRPVDAVYFTMVTLCTIGYGDIVPDSTFTKIFTCGFILVGFGFLGFLLNGLVAYICDTQEAFLLGMMDENRY

SEQ ID NO: 1873 - protein, 502 aa, Glycine max
MDFTPPPIEDGFTAEKLFTQGFSYTYDDVIFLPHYIDFAADVVDLSTRLTRRLPLAVPFVASPMDTVSESAMASAMASLGGIAVVHSNVPAAVQAAILRKAKSRRVPILSEIRHQAPSAVVEHDDAFGASPFLLVTDTGTSAGKLLGYVAKSDWTNHTDKGLRVGDYMAPPPKPVPWNADLNKINEIFESEKSGAVALEKDGEVVDLVVREEVERVKGYPKLVAPATVGADGEFMVGAAVGTREDDKERLEHLVKAGLNVVVLDSSQGNSIYQLEMVKYVKRVYPELDVIGGNVVTMYQAENLIQAGVDGLRVGMGSGSICTTQEVCAVGRGQATAVYKVSSIAYKSGVPVIADGGISNSGHIVKALSLGASTVMMGSFLAGSLEAPGAYVYQNGQRVKKYRGMGSLEAMTKGSDARYLGDTAKLKIAQGVVGAVKDKGSVLNFIPYTLQAVRQGFQDIGANSLQSAHDLLRSRVLRLEVRSGAAQVEGGIHGLVSYEKKYF

SEQ ID NO: 1874 - protein, 504 aa, Glycine max
  misc_feature (205)..(205): Xaa can be any naturally occurring amino acid
MDFTPPPIEDGFTAEKLFTQGFSYTYDDVIFLPHYIDFAADVVDLSTRLTRRLPLAVPFVASPMDTVSESAMASAMASLGGIAVVHSNVPAAVQAAILRKAKSRRVPILSDPAFAAPSAVVEHDDAFGASPFLLVTDTGTSAGKLLGYVAKSDWTNHTDKGLRVGDYMAPPPKPVPWNADLNKINEIFESEKSGAVALEKDGEVXVVDLVVREEVERVRGYPKLVAPATVGADGEFMVGAAVGTREDDKERLEHLVKAGLNVVVLDSSQGNSIYQLEMVKYVKRVYPELDVIGGNVVTMYQAENLIQAGVDGLRVGMGSGSICTTQEVCAVGRGQATAVYKVSSIAYKSGVPVIADGGISNSGHIVKALSLGASTVMMGSFLAGSLEAPGAYVYQNGQRVKKYRGMGSLEAMTKGSDARYLGDTAKLKIAQGVVGAVKDKGSVLNFIPYTLQAVRQGFQDIGASSLQSAHDLLRSRELRLEVRSGAAQVEGGVHGLVSYEKKYF

SEQ ID NO: 1875 - protein, 509 aa, Glycine max
  misc_feature (157)..(157): Xaa can be any naturally occurring amino acid
MNNNVGKGKKGLAEQNHMFFDKKSLENGVVNGGVASGSSTEDDTRFNKVVEDGNNGLRGLIQIHGSLQISQQPPQEPAVCWERFLPLRSIKVLLVEDDDSTRHVVRALLQNCSYKVTAVSNGLQAWKVLEDPENGIDLVLTEVAMPILSGIGRPRVXLLCKIMSHKTLKNIPVIMMSSHDSMGIVFKCLSKGAVDFLVKPIRRNELKNLWQHVWRRCHSSSGSGSESATHTRKFAKSRSNDAYENNSDSSDENDYGSRGLSIRDGSDNGSGTQSSWTKCLAQVGSPHPVSPHKQLVDAPDSTCAQVMQTKTEKVSSRWVHATEKECHELIDPLDDVARVKDLAMGISLNMQLEHPLEELSSNPIVGKGANKMSDVDDMQIIKRKSNVCEKGQLEYNGDKTGTQENQAMNVIDVTDSNSPQAESRDLNTPNGFSGFSQSKANCCPKEHPSLELTLKRLGEVGDAKNVTGEECNVLRHSYQSAFSKYNTVSVLQTGYSSDDLYDTIVYAPV

SEQ ID NO: 1876 - protein, 511 aa, Glycine max
  misc_feature (486)..(486): Xaa can be any naturally occurring amino acid
  misc_feature (492)..(492): Xaa can be any naturally occurring amino acid
MAQPSTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKSVAELGLLYLGMGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQPVDKKKLVDDVRKALYAAKICSYAQGMNLIRAKSIEKGWDLKLGELARIWKGGCIIRAIFLDRIKQAYDRNPNLANLLVDPEFAKEIIDRQSAWRRVVCLAINSGISTPGMSASLAYFDTYRRERLPANLVQAQRDYFGAHTYERVDIEGSYHTEWFKLAKQSRXLDYCIXTNQDFPNKCNVFCSDCMLS

SEQ ID NO: 1877 - protein, 443 aa, Glycine max
MAQEQEFRTSTPLPKCDAYFETIQSRKKLPLSLQETLTDAFAKIPVSSFPAVPSGKVIEILADTPVGEAVKILSESNILAAPVKDPDASNSSDWRSRYLGIIDYSAIILWVLEGAELAQAALLAGTATAAGVGAGAAGALGALALGLTGPAAIAGLTTAAAGAALAGGVAADKVMAKDAPQAADNLGEDFYKIILEEEPFKSTTVRSIIKSYRWAPFVPVARNSAMLTVLLLLSKYRLRNVPVIEPGRPDIVNFITQSAVVQGLEGCKGRDWFDCIAEKCISDLGLPFMSTDEVISIQSNELILEAFKQMKDNRIGGLPVIEGPKKRIVGNLSIRDIRHLLLRPELFTNFRKLTVMDFMKKIVSSSLQTGKVTQPITCKPDSTLQGVIHTLASQSIHRIYVVDGHDEVVGVITLRDVISCFVTEPPYNFDDYYGFAVKEMLNQ

SEQ ID NO: 1878 - protein, 275 aa, Glycine max
  misc_feature (97)..(97): Xaa can be any naturally occurring amino acid
GRVKLPKPLNNLTGFNAFWYSHHLFVIVYALLIVHGIKLYLTKEWYKKTTWMYLAIPIIIYLSERLTRALRSSIKPVRILKVAVYPGNVLSLHMSKXPQGFRYKSGQYMFLNCAAVSPFEWHTFSITSAPGDDYLSVHIRTLGDWTRSLTVKLSECCQPPDNGKSGLLRAEYLQGDRSPSALPKVLIDGPYGAPAQDYKQYEVVLLVGLGIGATPMISILKDIVNNMKAMEEEEETNIEEGTNSGFGNKSPRGSSPHKKNSSSNFNTRRAYFYWV

SEQ ID NO: 1879 - protein, 426 aa, Glycine max
  misc_feature (28)..(28): Xaa can be any naturally occurring amino acid
SIAHCKRMRFELVGASIMHYATKWLPGXCDTATPGDEASNCSMSNSSSSGGGSWKSGLHMVVTGTKDDNTSSLQAKEQRMIIESLVSIIPPQKDSVSCSFLLRLLRMAIMLKVAPALVTELEKRVGMQFEQATLADLLIPSYNKGETMYDVDLVQRLLEHFIVQEQTESSSPSRQSFSDKQHMGMGCILNAKARVARLVDSYLTEVSRDRNLSLTKFQVLAEALPESARTCDDGLYRAIDSYLKAHPTLSEHERKRLCRVMDCQKLSIDACLHAAQNERLPLRVVVQVLFAEQVKISNALASSSVKDVESESHAMVTNRKTLLEGTPQSFQEGWTAAKKDINTLKFELESVKAKYMELQNDMASLQKQFDKMLKQKHTSAWSSGWKKLSKLGRTTHLVENQDDSPEIQDSLEQNRKTTRRWRNSIS

SEQ ID NO: 1880 - protein, 136 aa, Glycine max
NDISHTFQSLLKIVAVPGGAARFAAGFTGSVMALSALCLFYAAANFFYSAVPLHSEMTQRIVDAVSDWSTVRQVLDLGCCGRGILLNAVAARLKKEGSSGRVIGLSGPNKAKLSATLRAAKVEGVEEYVTCRTGDA

SEQ ID NO: 1881 - protein, 290 aa, Glycine max
  misc_feature (125)..(125): Xaa can be any naturally occurring amino acid
  misc_feature (272)..(272): Xaa can be any naturally occurring amino acid
MAVSSSHMRFTFECRSDPDFSPPPPSFDNLRRRNFRSSAGSGAAFHGISSLILRFPPNFQRQLSTKARRNCSNIGVAQIVAASWSNNSDNSPVAGAPAPPADTAADAATVPLPVDLAAAEDVVVXPRAAENGTVQLNSSSYSFLKSDASKTIHAAERLGRGIETDGITTPVLNTSAYFFKKTADLIDFKENRQVSYEYGRYGNPTTVVLEEKISILEGAESTVIMASGMCASVVLFMALVPAGGHLVTTTDCYRKTRIFIETFLPKMGITTXVIDPAGLGRPKIRPDCRR

SEQ ID NO: 1882 - protein, 536 aa, Glycine max
MAVSSSHMRFTFECRSDPDFSPPPPSFDNLRRRNFRSSAGSGAAFHGISSLILRFPPNFQRQLSTKARRNCSNIGVAQIVAASWSNNSDNSPAAGAPAPPAATATDAATVPLPVVVAANEDVVVSAAADENGAVQLNSSSYSSFLKSDASKTIHAAERLGRGIETDGITTPVVNTSAYFFKKTADLIDFKENRQVSYEYGRYGNPTTVVLEEKISALEGAESTVIMASGMCASVVLFMALVPAGGHLVTTTDCYRKTRIFIETFLPKMGITTTVIDPADVGALESALEQHNVSLFFTESPTNPFLRCVDIKLVSELCHKKGTLLCIDGTFATPLNQKALALGADLILHSLTKYMGGHHDVLGGCISGSIKVVSQIRTLHHVLGGTLNPNAAYLFIRGMKTLHLRVQQQNSTGMRMAKLLEAHPKVKRVYYPGLPSHPEHELAKRQMTGFGGVVSFEIDGDLHTTIKFIDSLKIPYIAASFGGCESIVDQPAILSYWDLPQSERAKYKIYDNLVRFSFGVEDFEDLKADVLQALEAI

SEQ ID NO: 1883 - protein, 132 aa, Glycine max
  misc_feature (109)..(109): Xaa can be any naturally occurring amino acid
HADSNGDVILYYRRALLHRRNHDAKTISKIQKELVVYVIYSGGEAVLTNLHSHMDSSLVPRNNLQEAILLLMILLRKISLNIIEWDPLILDHLSIALYVSGDLTAIAHXWEELLPGTIHRRERYHALYVLDY

SEQ ID NO: 1884 - protein, 509 aa, Glycine max
MALLLIIPISLVTLWLGYTLYQRLRFKLPPGPRPWPVVGNLYDIKPVRFRCFAEWAQSYGPIISVWFGSTLNVIVSNSELAKEVLKEHDQLLADRHRSRSAAKFSRDGKDLIWADYGPHYVKVRKVCTLELFSPKRLEALRPIREDEVTSMVDSVYNHCTSTENLGKGILLRKHLGVVAFNNITRLAFGKRFVNSEGVMDEQGVEFKAIVENGLKLGASLAMAEHIPWLRWMFPLEEGAFAKHGARRDRLTRAIMAEHTEARKKSGGAKQHFVDALLTLQDKYDLSEDTIIGLLWDMITAGMDTTAISVEWAMAELIRNPRVQQKVQEELDRVIGLERVMTEADFSNLPYLQCVTKEAMRLHPPTPLMLPHRANANVKVGGYDIPKGSNVHVNVWAVARDPAVWKDPLEFRPERFLEEDVDMKGHDFRLLPFGSGRRVCPGAQLGINLAASMLGHLLHHFCWTPPEGMKPEEIDMGENPGLVTYMRTPIQAVVSPRLPSHLYKRVPAEI

SEQ ID NO: 1885 - protein, 150 aa, Glycine max
  misc_feature (19)..(19): Xaa can be any naturally occurring amino acid
  misc_feature (72)..(72): Xaa can be any naturally occurring amino acid
  misc_feature (98)..(98): Xaa can be any naturally occurring amino acid
  misc_feature (110)..(110): Xaa can be any naturally occurring amino acid
MKCLKPPFENNYPLLGYNXSAEILNIAGGRLKTYYTLHQQMRFILIFSILSIYTAIFFSYWDQILYRNLLQXHYKLPCLRDTLIFPQKSEYSATLLLXVLTPNAWIQTIXNLNFSSLHKQTMLSIAANLQIIRRSIWNFFTIENEHSNNV

SEQ ID NO: 1886 - protein, 111 aa, Glycine max
  misc_feature (42)..(42): Xaa can be any naturally occurring amino acid
ASSINNKNGSVNNNPCTFIALVPWGEASFVGAHSYWNLYVYXKNKNRAGDSSFAGVKKQTQFSVFHSPNNKRYPISQWHIFQGSINKISFLTDGTYIATGGRDGYLPVVDY

SEQ ID NO: 1887 - protein, 100 aa, Glycine max
MAIRLPSVLSAEDILRRSNLFANHAATTSLDVPKGHFAVYVGEGEKRRYVIPVSYLNQPSFQELLSIAEEEFGFSHPMGGLIIPCTEENFLNITSGLHRL

SEQ ID NO: 1888 - protein, 113 aa, Glycine max
  misc_feature (27)..(27): Xaa can be any naturally occurring amino acid
  misc_feature (60)..(60): Xaa can be any naturally occurring amino acid
RDVRNCGQDFIHELTCMITVSHIPGIXTSRTDGYNKTTEGNENGPIMCCRGVNDSMDYIXAPNGEVYNYSRCGNTFNCYHAVARQFIAGCLRYRVTKMHVDGCCFEPASIMTR

SEQ ID NO: 1889 - protein, 320 aa, Glycine max
MDLAPEELQFLTIPDILRESISIPKRSPKTFYLITLSLIFPLSFAILAHSLFTHPLISQLQSPFNDPSQTSHEWTLLLLIQFLYLLFLFAFSLLSTAAAVFTVASLYTSKAVSFSSTLSAIPRVFKRLFLTFLWVTLLMILYNSLILLSLVLMILAIDTDNSLLLFLAILIVLTLFLVAHVYITALWHLASVVSVLEPVYGLAAMKKSYHLLKGRLRFAAVLVSAYLVACGVISGVFSVVVVHGGEDYGVFTRIVVGGFLVGLLVIVNLVGLLVQSVFYYVCKSYHHQGIDKSALHDHLGGYLGEYVPLKSSIQMENLDV

SEQ ID NO: 1890 - protein, 241 aa, Glycine max
TSSKAMVARGDLGAELPIEEVPLLQEDIIRRCQIMQKPVIVATNMLESMINHPTPTRAEVSDIAIAVRQGADAIMLSGETAHGKFPLKAVKVMHTVALRNESSVQSGVSYPSQLSSHESHMGEMFAFHATTMSNTLNTPIIVFTRTGSMAILLSHYRPYSTIFAFTNEARIKQRLALYHGVMSIYMQFSNDVEETFSRALKLLLSKSHLHEGQHVTLVQSGAQPIWREESTHHIQVRKVHG

SEQ ID NO: 1891 - protein, 80 aa, Glycine max
  misc_feature (53)..(53): Xaa can be any naturally occurring amino acid
  misc_feature (67)..(67): Xaa can be any naturally occurring amino acid
  misc_feature (72)..(72): Xaa can be any naturally occurring amino acid
NTTSSNRNASFTSLKSIAGYPTIKTNKHITFIASNGGRMQCMHVWPQFGKKKXENIYYLPDLEDAHXANEVXYLLTKGWI

SEQ ID NO: 1892 - protein, 71 aa, Glycine max
  misc_feature (50)..(50): Xaa can be any naturally occurring amino acid
LCGAAVTTVNRAGACMVSPFTGGKSMAGFPTMNTNTDITFIVSNWGRVAXMQAWPPVGQKMFETLAYLPDL

SEQ ID NO: 1893 - protein, 331 aa, Glycine max
SAREKFSEANKLGEGGFGEVYKGLLPSGQEVAVKRLSKISGQGGEEFKNEVEIVAKLQHRNLVRLLGFCLEGEEKILVYEFVVNKSLDYILFDPEKQKSLDWTRRYKIVEGIARGIQYLHEDSRLKIIHRDLKASNVLLDGDMNPKISDFGMARIFGVDQTQANTNRIVGTYGYMSPEYAMHGEYSAKSDVYSFGVLVLEILSGKKNSSFYETDVAEDLLSYAWKFWKDETPLELLEHSLRESYTPNEVIRSIHIGLLCVQEDPADRPTMASVVLMLSSYSVTLPVPNQPALFMHSRTESNMLKWVQIDQSITKSTTKSVNEMSLSGDIPR

SEQ ID NO: 1894 - protein, 102 aa, Glycine max
  misc_feature (80)..(80): Xaa can be any naturally occurring amino acid
SNISSTVHLQPAVLYDAGCTNLKSMAVFPTRKTNNYITSIASNCGRVQCMQVWPPIVKKNFETLSYLPDLYDAQFAYEVXYLLMKVCIPFLEFVLEHIFLFP

SEQ ID NO: 1895 - protein, 133 aa, Glycine max
GSVRSFFLLPPPSESEPPWATTNWEEVPFLDLMTDLFRGLRGFSKLARRLILMGPPGSGKGPQSPILKVGSCLCHLLPGDLLRAVVAVKTLLGVKVKEVLVKGELVFDDWVVGFLDEALKNPSCQKGLIFDGF

SEQ ID NO: 1896 - protein, 93 aa, Glycine max
RTSSQVVTTVNRAGAGLVVQLTGLKSMVGFPTRKTNIAFTSIVGTGGGVHCLQGWPPIGKKKLGTFSYLPDLDDAQLAKEVDSLLRKGWIPCL

SEQ ID NO: 1897 - protein, 524 aa, Glycine max
  misc_feature (166)..(166): Xaa can be any naturally occurring amino acid
  misc_feature (180)..(180): Xaa can be any naturally occurring amino acid
  misc_feature (499)..(499): Xaa can be any naturally occurring amino acid
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKLVSPSEVSVDTTEGVNXVVNGKHIIISTGSXVESQPCVITIDENNVVSSTGALTLTDIPKRLIVIVACNIELESGSLWGRLGSEITAVEFASEIVPTMDAEVRKQFQRSLEKQGMKFKLKTKVVGVDTSGDGVKLTLEPAAGGDQTTLEADVVLVSAGRTPFTAELGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFMANSRAKAIDNAEGLVKILAEKETDKILGVHIMAPNAGELIHEAAIALQYDASSEDIARVCHAHPTMSEAVKEAAMATYDKPXTFKRSRLLLSSLFSFLSKNFTMTWR

SEQ ID NO: 1898 - protein, 234 aa, Glycine max
  misc_feature (218)..(218): Xaa can be any naturally occurring amino acid
  misc_feature (227)..(227): Xaa can be any naturally occurring amino acid
MPKPHSEAGTAFIQTQQLHAAMADTFLEHMCRLDIDSAPITARNTGIICTIGPASRSVEMLKEMIKSGMNVARLNFSHGTHEYHAETIKNVREATESFASDPILYRPVAVALDTKGPEIRTGLIKGSGTAEVELKKGATLKITLDNAYMEKCDENILWLDYKNICKVVEVGSKIYVDDGLISLQVKEKGADFLVTEVENGGSLGSKKGVNLPGAAVDXPAVSEKDIXDLKLGWS

SEQ ID NO: 1899 - protein, 70 aa, Glycine max
  misc_feature (43)..(43): Xaa can be any naturally occurring amino acid
SITTGNRSGTSMVAPFTGTKSMADFCIRNTNDDITIIASNGAXVQCMHMWTPVSMKQIDTDSYLPDIDHA

SEQ ID NO: 1900 - protein, 197 aa, Glycine max
  misc_feature (58)..(58): Xaa can be any naturally occurring amino acid
  misc_feature (91)..(91): Xaa can be any naturally occurring amino acid
  misc_feature (163)..(163): Xaa can be any naturally occurring amino acid
MKKQCCEESETNAGSWECWFDDACIVDMDYFVKTLSSIKQKGVRADLIGSIITHYASXDLSPLPKMVSPLTSNPESDTNSWMKKSFFVETXVSVLPPEKESVPCNFLLRLLRTAIMVRVDATYRVELENRISGQLDQASLKELMIPSFSHTCGTLLDVEFGPXDGAALLKVAKLVDCYLDEAAVDANLTLSEFITLA

SEQ ID NO: 1901 - protein, 78 aa, Glycine max
  misc_feature (47)..(47): Xaa can be any naturally occurring amino acid
SLKGPCQDPGVFWPNSQWFGGKALKAVVPMGFGGSFLGPLLCTHCIXTDPEPVESARGRELRFFAYVDPIDVSRNLTR

SEQ ID NO: 1902 - protein, 469 aa, Glycine max
APPPNLRSQMDGSFVPRNNIEEAILLLMILLRKVSLNRIEWDPSILDHLSFALSVSGDLTALANQLEELLPGTIHRSERYYALALCYYGTSKDLVALDLLRKLLRSREDQHHVPGLLMASKICCENSTLAEEGVSFAWQVLQNLDGRCNQLENHANFFLGVSLSAHSKLAVSDSDRFKRQSEALQALETAGRTGNPFVLYHLSLEYAEQRKLDAALYYAKCFLKLEGGSNVKGWLLLARILSALKQFLDAESIINTALDQTGKWDQGDLLRTKAKLQIAQGQLRNAIETYTQLLAVLQIQSKGFGSGKKLYKENRDRARNLEVEIWHDIAYVYISLLQWHDAEVCLSKSKAIKPLSASRCHAIGIMYEAKGHYKEALKAFGDALDVDPGHVPSLISTAVVLKRCSNKSNPAVKSFLVDALRHDRFNASAWYNLGLLHKAEGTASSLVEAAECFQAAHFLEESAPVEPFR

SEQ ID NO: 1903 - protein, 242 aa, Glycine max
MANTNLDDVPSLDLMTELLRRFKCSSKPDKRLILIGPPGSGKGTQSPIIKDEYCLCHLATGDMLRAAVAAKTPLGVKAKEAMNKGELVSDDLVVGIIDEAMKKPSCQKGFILDGFPRTVVQAQKLDEMLQNQGVKVDKVLNFAIDDAILEERITGRWIHPSSGRTYHTKFAPPKVLGVDDVTGEPLIQRKDDTAAVLKLRLEAFHKQTEPVIDYYSKKGLVANLHAEKPPKEVTVEVEKVLS

SEQ ID NO: 1904 - protein, 240 aa, Glycine max
MESLLSVTSSSLKFLVRASWDTQQRLPYNPNAPRKLKNNIVATPTPTAPITRKREQYISDLLKRATPLPTIGHIEEVQDETYLGYEKWLPTPPKVVKPRSVFNAATLAYIGDCIYELYARRHFLFPPLSIEEYNDRVMAVVRCEAQDALLQKLLESNFLSDQERDVLRWGKNIVSSKTKTKKRAGAAVYNRASSLETLVGYLYLTNVNRLEKLMLELGFSVDSSVALNVEEIVAGELNNG

SEQ ID NO: 1905 - protein, 379 aa, Glycine max
MSTAGQVIKCRAAVAWEAGKPLSIETIEVAPPQKGEVRLKILFNSLCRTDVYWWDAKGQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPAAPLDKVAVVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 1906 - protein, 593 aa, Glycine max
  misc_feature (246)..(246): Xaa can be any naturally occurring amino acid
MPSKQTYSFCFCFRRRFRLPVSEAPPEIRTLFDRYSDQNGVMTATHLRSFLAEVQREDNATEEEAQTIIDGHKHLSIFHRRGLNLESFFNYLFSHHNNPPLSPSIGVHQDMSSPLSHYFIYTGHNSYLTGNQLSSDCSDIPIINALEKGVRVIELDIWPNESKDNVDVLHGRTLTSPVALIKCLRSIKQHAFVASEYPVVITLEDHLTPDLQAKVAEMITRTFGDILFAPTSESLKEFPSPESLKXGGLLSSTKPPKEYLEAKEVQEKEEESQQEKPADDEEAWGKEVPSLRGGTISDYKNIEDDDVLDDEEDIDEAEKSRQDAADEYRRLIAIHAGKPKGGLTECLKVDPDKVRRLSLSELQLEKAAETHGKEIVRFTQRNILRVYPKGTRITSTNYNPLIGWMHGAQMVAFNMQGYGRSLWLMQGMFKANGGCGYVKKPDFLLKVGQNNEVFDPKAHLPVKTTLKVTIYMGEGWFHDFKHTHFDKFSPPDFYARVGIAGVPNDTVMKKTEKVEDNWSPSWNQVFEFPLAVPELALLRVEVHEYDMSEKDDFGGQTCLPVWELRSGIRAVPLYSRKGDKYANVKLLMHFEFI

SEQ ID NO: 1907 - protein, 604 aa, Glycine max
  misc_feature (170)..(170): Xaa can be any naturally occurring amino acid
MTSKQTYSVCFCWRRRFKLALAEAPSEIKTLFEEYSENEFMTPSHLKRFLVEVQRQEKATEEDAQAIIDSFRHFPRRGAGLNLETFFKYLFSDDNPPLLPSHGVHHDMTLPLSHYFIYTGHNSYLTGNQLSSDCSDVPIINALKRGVRVIELDIWPNASKDNIDVLHGRXAYRTLTTPVELIRCLRSIKDHAFVASEYPVVITLEDHLTPDLQAKVAEMVTETFGDLLFTPNSESVKEFPSPESLKKRIIISTKPPKEYLEAKEKEKGDDSQHEKEKGDDSQHGKALGEDEAWGKEVPSLKGGTIEDYKDYNVDEDLNDEEEFDESDKSHHNEAPEYRRLIAIHAGKPKGGLAECLKVDPDKVRRLSLSEQQLEKAAINHGQQIVRFTQRNILRVYPKGTRIDSSNYNPLIGWMHGAQMVAFNMQGYGRSLWLMHGMFRANGGCGYVKKPNFLLETGPDDEVFNPKAKLPVKTTLKVTVYMGEGWYYDFKHTHFDQYSPPDFYTRVGIAGVPNDTIMKRTKAIEDNWLPTWNEVFEFPLTVPELALLRIEVHEYDMSEKDDFGGQACLPIWELRSGIRAIPLHSQKGDKYNTVKLLMRFEFINN

SEQ ID NO: 1908 - protein, 327 aa, Glycine max
MTGSADPLVISFGEMLIDFVPDTSGVSLAESCAFIKAPGGAPANVACAISKLGGNAAFVGKMGDDEFGRMLVDILRKNGVNTDGVCFDTEARTALAFVTLRKDGEREFMFYRNPSADMLLKESELNMGLIKQAKVFHYGSISLISEPCRSAHLAAMKVAREGGALLSYDPNVRLPLWPSEEAARSGIKSIWFDADFIKVSDDEVHFLTQGDPEKEDVVMTLWHDKLKMLLVTDGEKGCRYFTKNFRGRVTGFSAKVVDTTGAGDSFVGALLTAVARDPNIFHNEPKLREALTFANACGAMCTTQKGAIPALPTAAEAEKFISNSKAK

SEQ ID NO: 1909 - protein, 600 aa, Glycine max
MTSKQTYSVCFCWRRRFKLALAEAPSEIKTLFNEYSENELMTPSHLKRFLVDVQRQEKATEEDAQAIIDSFRHFHRRGAGLNLETFFKYLFSDDNPPLLPSHGVHHDMTLPLSHYFIYTGHNSYLTGNQLSSDCSDVPIINALKKGVRVIELDIWPNASKDSIDVLHGRTLTTPVELIRCLRSIKDHAFVASEYPVVITLEDHLTPDLQAKVAEMVTQTFGDILFTPNSESVKEFPSPESLKKRIIISTKPPKEYLEAKEKEKGDDSQHEKEKGDDSEHGKASGEDEAWGKEVPSLKGGTIEDYKDNNVDEDLNDEEEFDESDKSHHNEAPEYRHLIAIHAGKPKGGLVECLKVDPEKVRRLSLSEQQLEKAAINYGQQIVRFTQRNILRVYPKGTRIDSSNYNPLIGWMHGAQMVAFNMQGYGRSLWLMHGMFRANGGCGYVKKPNFLLETGPDDEVFNPKAKLPVKTTLKVTVYMGEGWYYDFKHTHFDQYSPPDFYTRVGIAGVPNDTIMKRTKAIEDNWLPTWNEAFEFPLTVPELALLRVEVHEYDMSEKDDFGGQTCLPIWELRSGIRAIPLHSQKGDKYNTVKLLMRFEFINN

SEQ ID NO: 1910 - protein, 501 aa, Glycine max
MGSAAKYELPFKLNNPDLLHNESFVHGKWVKSKSGKTFEVADPGTGKTWIDCPTNDASDVDEAVKSSHECFLEYKKISPRQRAQMLYKWDALIKENREDIATILVYETGKPRAEAYGEIDYSTGFTWWFAGEAERIQGSVFTPALPNRRIFTIKQPLGVAAALVPWNFPIAMILRKAGAALAAGCTMIVKPSPETPITVLALAYLADKAGFPKGALNVLTTDLDKTPELSEALCRHPLVNKVTFTGSTRVGKLVAKICSDNLKKVTLELGGNCPVLIFDDANIEQAMSQVFALKFRHAGQACITANRIYVQSGIFDKFLERWNAEAQKIVVGHGSDEKTTMGPVTTPRAVDKALSLVEDARKKGAKIHTGGNKVEKNGGYFFEPTVITGVTPDMDIAKEEVFSPISTFIKFETEDEVVKAANDTSMGLASYLFTKNVDRMWRLFENLEAGMIGLNTGNSSAAESPFGGIKQSGYGKESGKDVAVNEYMITKTGTFTLEDQS

SEQ ID NO: 1911 - protein, 365 aa, Glycine max
  misc_feature (155)..(155): Xaa can be any naturally occurring amino acid
IEAPPTSSATFVFSFQTLMGILIVLLILLIIHIHGNGHHKEARGNINPKRGCDLFQGNWVVDDSYPLYNTSECPFILKEFDCQKNGRPDKLYVKYRWQPKDCNLPRFNGEDFLRRLRGKNILFVGDSLSLNQWQSLTCMLHTAVPLAKYTSVRTXSYDVKVMFSRNAFLVDIASESIGRVLKLDSIEAGKIWKGNHILIFDSWHWWLHIGRKQPWDFIQEGNRTFKDMNRLVAYEKGLKTWAKWVEDNVDPNKTRVFFQGVSPDHLNGAKWGEPRASCEEQKVPVDGFKYPGGSHPAELVLQKVLGAMSKRVNLLNITTLSQMRKDGHPSVYGYGGHRDMDCSHWCLPGVPDTWNLLLYAALIQN

SEQ ID NO: 1912 - protein, 116 aa, Glycine max
MASSMISSPAATTDNRAGAAMGASFTGLKPMAGYPTRKTSSDITYIASNGGRVHCLLVWPPGGLKKYVTLSYLPDLDDAQLAKAVEYLITMGRIPCSAFEMERCFQHREHTREPGY

SEQ ID NO: 1913 - protein, 99 aa, Glycine max
  misc_feature (43)..(43): Xaa can be any naturally occurring amino acid
MAPSTISNPGAGFVDRAVPSMIATITGLRIMAGFPTRKTNKDXTFIDCNGGRVHCMHVWPPVGKKKCENLSYLTDLEDAQWAKEAEYLVREGMDINARN

SEQ ID NO: 1914 - protein, 332 aa, Glycine max
MDREQEEMQFLGFFGIYKEASKIILSWRRIFTQITSTLILPLSFIFLIHMEISNLLFRKILINEIVMDETKPNTPQYNKLDHMISSEMVTLVVFKIAYFTLLLIFSLLSTSAVVYTIASIYTAKDVTFKRVMSVVPKVWKRLMLTFLCAFAAFFAYNIMTALVMFLSIVTIGLSSGGLAVLVSITVLYFIGFVYLTVVWQLASVVTVLEDSWGVRAMAKSKELIRGKMVLSIFIFFTLVASFVSIRVLFKVMVVDGWRVSSLDKTAYGVLCFLLLSCLFLFGLVLQTVLYFVCKSYHHENIDKSALADHLEGYRGEYVPLTAKDVQLEQYQV

SEQ ID NO: 1915 - protein, 163 aa, Glycine max
  misc_feature (123)..(123): Xaa can be any naturally occurring amino acid
  misc_feature (145)..(145): Xaa can be any naturally occurring amino acid
MMSSPANLNTGGEEKKLEIEKVVESQVEVADTESKRIQPWKEQITVRGLVVSTVLGIIYSIIAMKLNLSAGIVPNFNVSAALLAFLFVRSWNKVLHKAGFISKPFTRQENTIIQTCVVSCYSXAVHGGFASYLLGLNRKTYELSXVWTEGNIPNTCRDPGFAW

SEQ ID NO: 1916 - protein, 496 aa, Glycine max
MGLNRTPRHNPVLPTKSPILSRSHSRSQTMKTTQIFGVSLSLILINLAAIMERADENLLPSVYKEVSETFNAGPSDLGYLTFVRNFVQGLSSPLAGILVINYDRPTILAMGTFCWALSTAAVGVCHDFLQVAFWRAINGFGLAIVIPALQSFIADSYKDGVRGTGFGLLSLVGNLGGIGGGVLATVMAGQQFWGIQGWRCAFILMATLSALIGFLVLLYVVDPRKRFPTTRDASESSDRDDTVYKGNASAASIWIDSWAATKAVIKVKTFQIIVLQGIIGSLPWTAMVFFTMWFELIGFDNNTSATLLSLFAIGCAMGSFIGGSIADQLSQVYPHSARTMCAQFSAFMGIPFSWFLLKVIPQSVSSFPIFSVTLFIMGLTISWNGAAANAPMFAEVVPVKHRTMIYAFDRAFEGSFSSIAAPLVGILSEKMFGYNSKSVDPIKGSSPEALALSKGLLSMMAVPFGLCCLCYTPLYYIFRRDRENARMLAVKEEEMM

SEQ ID NO: 1917 - protein, 510 aa, Glycine max
LARPTHVSYGDSRRKYATGSMPTSNFQITYGFTECTPDLSLQECTQCLGEAIADIPVYFNGKTGGNVLKPSCRIRFDPYSFYGSTLKLDPDAPPPATPLPSPPTNNNSSSQGKSNTSRIIIAIVVPVASVVLVLILFCIYLRVKKPRKENEIKREEDNYEDEITFAESLQFNFDTIRVATNEFADSYKLGQGGFGAVYRGQLSNGQEIAVKRLSRNSGQGDMEFKNEVLLVAKLQHRNLVRLLGFCLEGTERLLVYEFVPNKSLDYFIFDPIKKAQLNWQRRYKIIGGIARGILYLHEDSRLRIIHRDLKASNILLDEEMHPKISDFGMARLVHMDQTQGNTSRIVGTYGYMAPEYALYGQFSAKSDVFSFGVLVLEIISGQKNSGVRHGENVEDLLCFAWRNWRAGTASNIVDPTLNDGSQNEIMRCIHIGLLCVQENVVARPTMASIGLMLNSYSLTLPVPSEPALLVDSRTRSLSEHDSMETRTSESANQSTPKSINEVSITELYPR

SEQ ID NO: 1918 - protein, 262 aa, Glycine max
  misc_feature (59)..(59): Xaa can be any naturally occurring amino acid
WWRGRGGFGGGGGFRGGGRGDRGRGRGGGGRGGDRGTPFKARGGGRGGGGRGGGRGGGXVVAENEDGSKDEYRVWNPFRSKLAAAILGGVDNIWIKPGARVLYLGAASGTTVSHVSDVVGPTGVVYAVEFSHRSGRDLVNMAKKRTNVIPIIEDARHPAKYRMLVGMVDVIFSDVAQPDQARILGLNASYYLKAGGHFVISIKANCIDSTVPAEAVFESEVNKLKADQFKPFEQVTLEPFERDHACVVGGYRMPKKKKDAAE

SEQ ID NO: 1919 - protein, 333 aa, Glycine max
MDTEQEEMQFMGLYGVYRESYKIIFAWSKVFNKITLTLILPLSFIFLIHIEVSNILFGKILHNTQQMMETPQDTPQYHNLTNMLSSEWAIFILFKLLYFTFLLVFSLLSTSAAVYTVASIYTSREVTFSKVMNVVPKVWKRLMVTFLCTFVAFFAYNVMTLVVFVIWALAIGLRNGGVVVLVVLGMLYFAGFVYLTVVWQLASVVTVLEEDTCGVRAMMKTNELIKGRIGLTVLIFLKLVISFGLIQFLFKKTVVQGWKLGSVDRTIYGVVCLVLFSQLYLFQLVIQTVLYFVCKSYHHQNIDKSALSDHLEVYHGEYEPLKAKDVQMEECHV

SEQ ID NO: 1920 - protein, 431 aa, Glycine max
MVLSWSRRNVFRRAKKEKSQTQLEVEVVIPNHFHCPVSLELMTDPVTLSTGITYDRVSIEKWIEGGNRTCPVTNQVLTTFDIIPNHAIRRMIQDWCVENSSYGIDRIPTPRIPISAYEVSDTCTRILSACQRGDDKRCQELVGKIKVWSRESERNKRCIVGAGAGAVLAYAFDCFSSNSIEKHVVLLEEVLEVMTWMVPLGEEGVSKLSSGASLNSLVWFLEGKDLASRQSAALLLKEVCVQELAKVGEVVEALVKMVREPIGSTSTKACLATIFNLVSLAANREGIAQRFVELGLVSLLLEAIVDGEKGVCEKALGVLDCICDCEKGKEVVKSNALALPLVVRKLLRVSPLASGFAVSILRKICDKREEGILIEALQVGLFQKLLVLLQVGCDESPKENATGLLKLLNGYRNKAECTDSSLNFEHLKKPF

SEQ ID NO: 1921 - protein, 204 aa, Glycine max
  misc_feature (74)..(74): Xaa can be any naturally occurring amino acid
MSRFLYQRRRLGKSGRVIQGYGTSGIQLSKQHINLSHSPSPHLIQPLLISRVPKWTLGGKIKKGAGGRKGGGPXKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERAAKEPKSPSKATKSPKKA

SEQ ID NO: 1922 - protein, 386 aa, Glycine max
MSTKKNTWKSVILILSCYKVKCSLEESEKQVLKQGSFQRLCLSDVSNSSSTQAIEDISISFAGSKLYAFTLEELREATNSFSWSNMLGEGGFGPVYKGFVDDKLRSGLKAQTVAVKRLDLDGLQGHREWLAEIIFLGQLRHPHLVKLIGYCYEDEHRLLMYEYMPRGSLENQLFRKYSAAMPWSTRMKIALGAAKGLTFLHEADKPVIYRDFKASNILLDSDFTAKLSDFGLAKDGPEGEDTHVTTRIMGTQGYAAPEYIMTGHLTTKSDVYSYGVVLLELLTGRRVVDKSQSNGRKSLVEWARPLLRDQKKVYSIIDRRLEGQFPMKGAMKVAMLAFKCLSHHPNARPSMSDVVKVLEPLQDYDDVFIGPFVYVAVSENGDKHKI

SEQ ID NO: 1923 - protein, 596 aa, Glycine max
MGTVTYSYKMFKYFNRKFEFGTRAPPPDVKEAFSAFSDAAAASMSADQLLRFLHDHQRETDCSAEDSNRILDSIIQSRKQNDTNAECDHHTDNNNNGLSLDEFFRFLFLVDFNDPLKSQVHHDMNAPLSHYFIYTGHNSYLTGNQLSSDCSDVPIIKALQRGVRVIELDLWPNSTKDDIDVVHGRTLTAPVSLIQCLKSIKEYAFAKSDYPVIITLEDHLTPFLQAKVAEMIAQVFGDMLYFPQADSLTEFPTPESLKGRILISTKPPKEYLESKQFKDSDSERESTEEGSLSPCVIPELEAVDEKLNGSDLDEEGLNARDKKSDQQSAPEYKRLITIHAGKPKGHVKHHLNNVGGVKRLSLSEQELEKASATYGSDIVRFTQKNIIRVYPKGTRVTSSNYRPHIGWMYGAQMVAFNMQGHGKSLWYMQGMFRANGGCGYVKKPAFLIEKGPHNEVFDPKRALPVKKTLKVKVYMGNGWSSDFSKTHFDSFSPPDFYTKVCIVGVPADKANKKTKVIQDNWFPVWDEEFEFPLTVPELALLRIEVREYDKHEKDDFGGQTCLPISELRSGFRAVPLFDQKGEQLKSVKLLMRFQFK

SEQ ID NO: 1924 - protein, 119 aa, Glycine max
  misc_feature (82)..(82): Xaa can be any naturally occurring amino acid
  misc_feature (94)..(94): Xaa can be any naturally occurring amino acid
MDHGSRSRMLLLHGPSHSTRGDGKYLRHMLSLSLTPIDEDYPITRWYKSTGCLLQDNWPITWVSLLWIGEMLGLFAYKKAQXTRQPAYEVMGHXVCMVKGAPESLSLNMAIILLPVCRN

SEQ ID NO: 1925 - protein, 118 aa, Glycine max
  misc_feature (46)..(46): Xaa can be any naturally occurring amino acid
  misc_feature (62)..(62): Xaa can be any naturally occurring amino acid
NGYVETVMDRLGYEGQDTHCRLWDLEMYEIVVPLRRPHGGSSAASXASQSSQWGNVVSLGTXDMLQSMVDVPKISPSVAPCVHAWPLSGLIFTQIYVMGAFWYGHITIWMRAWPAERP

SEQ ID NO: 1926 - protein, 183 aa, Glycine max
  misc_feature (144)..(144): Xaa can be any naturally occurring amino acid
PRVRPRVRPRVRPRVRDSPISGLIALLTAVDALSHLHDISNLKKQLVFAVFNGEAWGYLGSRKFLQELDQGADSVNGISSLLIDQVLEIGSVGKAISQGYPLFYAHAAGNSSISMKMVDALQSASESLGSDNVKVKPAASSNPXGVPPSSLMSFLGKNSSTPGLVLEDFDSQFSNRFYHSTLD

SEQ ID NO: 1927 - protein, 79 aa, Glycine max
IKGKYRTHFLDDFKHLWYETSEWYTEPKQLSNGNAVEFDGYMRVAVDTKVFLRGKRKLETFSDLTRDCKNGVNTCPGSS

SEQ ID NO: 1928 - protein, 117 aa, Glycine max
  misc_feature (37)..(37): Xaa can be any naturally occurring amino acid
  misc_feature (80)..(80): Xaa can be any naturally occurring amino acid
MASSMIFSPADTTVNRAGAGMAGPFTGLKYMAGFPTXRKTNNDLTWIARHGGKRPCMHVWPTIGKKKFETLSYLPDLDDXPLAKEGQYPLKKGWDPLLGITLEHRFAYPEHKKAPGY

SEQ ID NO: 1929 - protein, 273 aa, Glycine max
  misc_feature (17)..(17): Xaa can be any naturally occurring amino acid
  misc_feature (25)..(25): Xaa can be any naturally occurring amino acid
RPSVRSVVDLSESMRRXRVCDPSHXSPATTSLLSMLQTLTLIADQTPPVPQSARYGNVAYRTWHEKMSNSAESLILTLLPENLHPATVELVPYFTDSFGNSSRIDYGTGHETNFAAWLYCLARLGVIGVEDYPAVVARVFVKYLDLMRKLQLQYCLEPAGSHGVWGLDDYHFLPFIFGSSQLIDHKYMKPKSIHNEDILENFSNEYLYLACIAFVKKVKKGVFAEHSPMLDDISGVPNWNKVNTGLLKMYKAEVLEKVPIMQHFLFGSIIKWE

SEQ ID NO: 1930 - protein, 211 aa, Glycine max
  misc_feature (91)..(91): Xaa can be any naturally occurring amino acid
LLSKPSIAPPPAKKPVVLKDRGAAETTSVKSKEKKSPILIDKFASKKPVVDPLIAQAVLAPPKPGKAPPPGKFKDDFRKKGAMAGGPRRRXLEGDAIHDEDASELNVSIPGAATARKGRKWSKASRRASRLQAARDAAPIKVEILEVGDKGMLVEELAYCLATSESEILGYLYSKGIKPDGVQTIDKDMGKMICKEYHVEVINADPFKGEG

SEQ ID NO: 1931 - protein, 412 aa, Glycine max
  misc_feature (340)..(340): Xaa can be any naturally occurring amino acid
MVDVDRRMTGLNPAHIAGLRRLSARAAAAPSVPVRNGVVSFASLADKVINHLRDSGIHVQHGLSDAEFARAEAEFGFVFPPDLRAVLAAGLPVGPGFPDWRSGGARLHLRASLDLPIAAISFQIARNAVWSKSWGPRPCEPEKALRVARNALKRAPLLIPIFNHCYIPSNPSLAGNPIFFVDESRIFCCGLDLSDFFDRESLFRSSEADPILLKKQRSVSEKTAGVSVSAAFSRRSLDSGERTPRWVEFWSDAATDKRRRNSSSSSSSSLSASSSPERFFEMPRSKVPGWVEEYIGKIGSVLKAGGWGESDINEMVEVSASGFFEGEMVVLDNQALLDAXLLKADKFSDSLRKAGWSSEEVSEALGFDFRPEKERKPAKKLSPQLAERIEKLAQSVSRSRHDNLGKGNWMNE

SEQ ID NO: 1932 - protein, 130 aa, Glycine max
  misc_feature (15)..(15): Xaa can be any naturally occurring amino acid
  misc_feature (72)..(72): Xaa can be any naturally occurring amino acid
WVFIQTSFVFVLGTXMVVALVNLLVDPGNTFFEVPRFLVFLIPLIFLPLPPNSSEPGSVIILVSRDKRQTAXLTFFDLYGPVTMNNVLCLSVFLALAYARGWTWNFFSKVLVIFVVGMAVGVFASWPTVF

SEQ ID NO: 1933 - protein, 511 aa, Glycine max
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATERALCKPGDAVVALHRIGAASVIKICIVK

SEQ ID NO: 1934 - protein, 187 aa, Glycine max
DGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 1935 - protein, 262 aa, Glycine max
  misc_feature (203)..(203): Xaa can be any naturally occurring amino acid
  misc_feature (218)..(218): Xaa can be any naturally occurring amino acid
MANIDIEGILKQQPDDGRVPKTKIVCTLGPASRSVEMTEKLLRAGMNVARFNFSHGTHDYHQETLNNLKTAMHNTGILCAVMLDTKGPEIRTGFLKDGKPIQLKEGQEITITTDYDIKGDQEMISMSYKKLPVHLKPGNTILCSDGTITLTVLSCDPDAGTVRCRCENTATLGERKNVNLPGVVVDLPTLTEKDKEDILQWGXVPNKIDMIALSFVRXGSDLVNVRKVLGPHAKTIQLMSKVENQERVPDFDEILRETDAFM

SEQ ID NO: 1936 - protein, 98 aa, Glycine max
  misc_feature (7)..(7): Xaa can be any naturally occurring amino acid
  misc_feature (51)..(51): Xaa can be any naturally occurring amino acid
  misc_feature (54)..(55): Xaa can be any naturally occurring amino acid
  misc_feature (57)..(57): Xaa can be any naturally occurring amino acid
  misc_feature (82)..(82): Xaa can be any naturally occurring amino acid
AADQKAXSAALALSSILLSAPLPGGADIFGLTPCKESKQFAKREKQPPSKXVLXXKXYEAGKKPPLGRGASAPKINRRGDNXAKQGALCGGEGEPTRT

SEQ ID NO: 1937 - protein, 148 aa, Glycine max
  misc_feature (62)..(62): Xaa can be any naturally occurring amino acid
  misc_feature (76)..(76): Xaa can be any naturally occurring amino acid
MACSMISYAAVTTVNRACAGMVAPFTGLKTMAGWLPRMRAFDITSIASNGGRAQCVQVWPPXWIKKFETLIYLPDXLEDAQLRKEVEYLLRKGWMPSLQFELDHGFVYREHNRSPGYYNGRYWTMVKLPMFGCTEATQVVNELQEAKT

SEQ ID NO: 1938 - protein, 380 aa, Glycine max
MSSTAGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 1939 - protein, 110 aa, Glycine max
LISCPAATTVNRAEAGMVAPFTVLKTMAGFPTRKTNNDITSIASNGGREQCMQVWPPGGKTKSETLCYLPDLDDAQLATVVEHLLRQGRIPCLEFESEHGFAHREHSRSP

SEQ ID NO: 1940 - protein, 104 aa, Glycine max
  misc_feature (61)..(61): Xaa can be any naturally occurring amino acid
EEILKVPAQKSVAFSLVKEIPEFFHGNLSKEKAPPFRIFMVVKDFFTVFDRVGKKVGIINXRTLVSSAHRFPVPVNPMVSQPLSGLVGKRPNHSSEDDGQRPSP

SEQ ID NO: 1941 - protein, 151 aa, Glycine max
  misc_feature (56)..(56): Xaa can be any naturally occurring amino acid
  misc_feature (113)..(113): Xaa can be any naturally occurring amino acid
  misc_feature (130)..(130): Xaa can be any naturally occurring amino acid
MAPSKEEERRLMEHKDDSATKLGPAEKFFKAKLEVHFAFKKVETILYIGNFDSQVXNPKKPFHTLQAACEKLPNSSMYLKLLDAVLKTGNRMNVTTNHCDGHAFKLDTLLKLXDVYSADSKTTLLHLVVXKIIRTEGARTSRAKQTPSTNL

SEQ ID NO: 1942 - protein, 294 aa, Glycine max
MGKTSSREWTRIYLIYGMDQWQTFVFLLCQAVLFSVLSILYLLYFNDISHTFQSLLSIASVPCSAARFAAGFMGSVTALSALCLFYAAANFFYSAVPLHSEMAQHIVDTVNDWPTVRQVLDLGCCGRGILLNAVAARLKKEGSSGRVIGLSGQNKTELAATLRAAKVEGVEEYVTCRTGDATTLPFLDDSFDAVVSGTFVHTVGWGHAADVAAAERGRVVAEVVRVLKEGGVGVVWDLVHVPEYVRRLQEMKMEDIRMSERVTAFMVSSHVVSFRKPTHHVHGPPEVRLDWRFC

SEQ ID NO: 1943 - protein, 72 aa, Glycine max
  misc_feature (34)..(34): Xaa can be any naturally occurring amino acid
MASSMISSPAGTTVNPAGAGMDAAWAGLNFMAAXHSKKTNSDIPSIASSGSRVHRMQVWPTTGMRKFETLYY

SEQ ID NO: 1944 - protein, 156 aa, Glycine max
  misc_feature (21)..(21): Xaa can be any naturally occurring amino acid
  misc_feature (150)..(150): Xaa can be any naturally occurring amino acid
MRENSADMLDYQDLLTGDETXSDSFLYNEIENGMLCEVDGKWVDKGAIDVDIGANPSADGGENKGVEDSSVKVGDIVDTFILQQQPDFDNKQSVTCRKRFIKNITTKLDADKHDFAKKHIDGATKDLLSKINDLQVFGGESMNDDACSDXAYYKDG

SEQ ID NO: 1945 - protein, 196 aa, Glycine max
  misc_feature (177)..(177): Xaa can be any naturally occurring amino acid
  misc_feature (179)..(179): Xaa can be any naturally occurring amino acid
MDIELPAATANESQQQKFALPVDSENKATVFRLFSLANPHMRAFHLSWVSFFACFVSSFAAPPLLPIIRDNLNLTATDIGNAGVASVSGAVLARIAMGTACDLVGPRLASASLILLTAPFVYFTSIINSSTSYLLVRFFTGFSLATFVSTQFWMSSMFSAPVVGSANGFSGGMGNLXGXATQLIMPLVFSLIRDIG

SEQ ID NO: 1946 - protein, 165 aa, Glycine max
  misc_feature (51)..(51): Xaa can be any naturally occurring amino acid
MGNCLFSSYETTTTTVKVVVHDGRMEEFSYPVKVSYLLQLYPACFICDSDXMGFDDVVTAVHEDEELRPGQLYFALPLSRLKRHLPPQEMAALAVVATSALAKCGSRRKQIVFLSSCDVNTKPGRKVAPEGTVGNNDVARKGRSKIGGRGMGKFTATLSSIPEQG

SEQ ID NO: 1947 - protein, 143 aa, Glycine max
  misc_feature (23)..(23): Xaa can be any naturally occurring amino acid
  misc_feature (25)..(25): Xaa can be any naturally occurring amino acid
ALNLALGSLPQFTICNRAGAGGXVXFTVPLFTAGLPTRKTNNDITNIVSNGGRVRCMQVWAPVGKKKHETLSYLPDLDDAQLAKEVEYLPRKGWIPCLESEREHGLVYREHIRLPGYYDGRYWTMWKLLMIGCTDASQVLKEL

SEQ ID NO: 1948 - protein, 183 aa, Glycine max
  misc_feature (31)..(31): Xaa can be any naturally occurring amino acid
  misc_feature (101)..(101): Xaa can be any naturally occurring amino acid
PYCSAKTTEGPKGIFRDVFLGRPGTLSDDQXMEKSASHQRATMGNSKDVWVAGNSGHPLTEGVSVPYTHQNLTWTQHAFNQKVGEIQSIAKDAFTRLKGRXSCLQKRTEAKLEDSPAPPGARCVLHNICKMRDEEMRPQWNFDIFDDQMLPQNNNVRSNAAEQARDQIAHYLLHHGRAGTNFF

SEQ ID NO: 1949 - protein, 60 aa, Glycine max
  misc_feature (49)..(49): Xaa can be any naturally occurring amino acid
LTRLWTRGRTRGGNPVEWDGYMRVSIDTEVLLRGKKQFETFNELTSDCXDGINTCHVAAN

SEQ ID NO: 1950 - protein, 201 aa, Glycine max
MALCRFAYSYSPASASTIFRFPKYPSKHTKFSLLPLSFSTMEAPPEGYRRNVGICLMNNHKKIFAASRLDIPNAWQMPQGGIDEGEDPRNAAIRELREETGVNSVEVIAEVPYWLTYDFPPKVREKLNIQWGSDWKGQAQKWFLFKFTGQDQEINLLGDGTEKAEFGEWSWISPEQVIELAVDFKKPVYKEVLAVFAPHFQ

SEQ ID NO: 1951 - protein, 73 aa, Glycine max
LRVRFLSGGSERLLEILGPGIDGGLLLPILEALPDAMLILVSGLSGSKEVSQSKAFVGKELLAGKTTLLLTII

SEQ ID NO: 1952 - protein, 501 aa, Glycine max
  misc_feature (275)..(275): Xaa can be any naturally occurring amino acid
MSEPVADIAVIGLAVMGQNLILNMNDHGFVVCAFNRTVQKVTEFLENEAKGSRIVGAKSMEEMIKLLKKPRRVMLLVKAGKAVQEMIDRLVPLLEEGDIVIDGGNSEYHDSNLRCRELASKGIHFVGCGVSGGEEGARFGPSLMPGGSSGAWPHLKPIFQAIAAKAPDGKPCCDWLGEAGSGHFVKMVHNGIEYGDMQLISEAFHLMHQGLQMDFEAMSKVFTEWNKEELDSFLVEITANILRFKDETGEPIVPKILDSAQQVSQRKGHKGNIRXQKGTGKWTGIAALEYGIPVTLIAEAVFARCLSALKKQRMDASKLLPKPSKKASDLVKDSKKFLNSIGSALYASKVVSYAQGFMLMAEASREFDWNLNYGAIALMWRGGCIIRSRFLDRIQNAFEKNPSLVNLLLDDFFMKAIGDAQDSWREVISTAVQLGIPMPAFSSALAFFDGYRTEALPANLIQAQRDYFGAHTYELLAQPGVAVHTNWTGRGGKVTSNAYSA

SEQ ID NO: 1953 - protein, 86 aa, Glycine max
HRSWRVQTYSRGACPRRAIQANFGGPFMTLDIGSAAESTYSVPSDTEPVVGAGGYATFDYEEPLPDELGIHPGQIWSKIRSVLNPF

SEQ ID NO: 1954 - protein, 396 aa, Glycine max
MEEDYGYRRTAKIALVAIMVLASVAVFALLVVFAYYCYILNKVSNRRKSLKKVEDANLNEKSDFANLQVVAEKGLQVFTFKQLHSATGGFSKSNVIGHGGFGLVYRGVLNDGRKVAIKFMDQAGKQGEEEFKVEVELLTRLHSPYLLALLGYCSDSNHKLLVYEFMANGGLQEHLYPVSNSIITPVKLDWETRLRIALEAAKGLEYLHEHVSPPVIHRDFKSSNILLGKKFHAKVSDFGLAKLGPDRAGGHVSTRVLGTQGYVAPEYALTGHLTTKSDVYSYGVVLLELLTGRVPVDMKRPPGEGVLVSWALPLLTDREKVVKIMDPSLEGQYSMKEVVQVAAIAAMCVQPEADYRPLMADVVQSLVPLVKTQRSPSKVGSCSSFNSPKLSPGPTF

SEQ ID NO: 1955 - protein, 272 aa, Glycine max
MESFPEIIKAVDPRASANLDGNHLDDDDRMEINSDIEPAETEALPHEFNMAPIADLFDNLQDKAHQETVIDSEDSPESVDSESSSDKEVSDQHMKITFPGKKMQTIAERFEEALGTSSVITEGTHVGAPNSLRPGIFGKLQHMMLKVKETDMEFWKKLQPEARPDGELGCIDVKIISRYRDGKLTVCHCSFGKYTENFLLQDNSKGMRFGGSECSQSTIIFSPRVCNNVDLEVGSLIRIHPPWFWFLDRKEVQAGNDNVILCTYFSEILFPV

SEQ ID NO: 1956 - protein, 941 aa, Glycine max
MNGIPRHERRWASDSVPGKATVSAGTSPGTESNSAAEEFVEVTLDLQDDDTIVLRSVEPASVINIDDSVAGSGNQTPASVSRSPTIRRSSSRGFRQFSQELKAEAVAKARQFSQELRRFSWSHGHASRALSSSSAPNGAGAGFETALAARALRKQRAQLDRTRSGAHKALRGLKFISNRSNGVDAWNEVQSNFDKLATDGFLKRTDFAQCIGMKDSKEFALELFDALSRKRRLRAEKISREELFEFWSQITDQSFDSRLQIFFDMVDKNEDGRITEVEVKEIIMLSASANRLSRLKEQAEEYAALIMEELDPEGLGYIELWQLETLLLQKDTYLNYSQALSYTSQALSQNLQGLRKKSPIRRMSRRLVYYLQENWRRLWVLTLWVCIMIGLFTWKFIQYKRKDAFQIMGYCLLAAKGAAETLKFNMALILLPVCRNTITWLRSTKLGYSVPFDDNINFHKTIAGAIVIGIILHAGDHLACDFPRLVSTSEESYEKYLKGVFGDRKPSYVDLVKGVEGVTGVLMVVLMIIAFTLATKWFRRNLIKLPKPFSRLTGFNAFWYSHHLFVIVYVLLIIHGIKLYLVHKWYLKTTWMYVAVPVLLYASERILRLFRSGLYTVRLGKVAIYPGNVLTLQMSKPPQFRYKSGQYMFVQCPAVSPFEWHPFSITSAPGDDYLSVHIRQLGDWTQELKRVFSEACEPPVSGKSGLLRADETTKKSLPKLKIDGPYGAPAQDYKKYDVLLLVGLGIGATPFISILKDLLINIIKMEEMADSISDISRGSDHSVGSTTDLPSISKIAPKRKKTLKTTNAYFYWVTREQGSFDWFKGVMNEVAELDQRGVIEMHNYLTSVYEEGDARSALITMVQALNHAKNGVDIVSGTRVRTHFARPNWKKVFSKMCSKHCNGRIGVFYCGAPVLAKELSKLCFEFNEKGPTKFEFHKEHF

SEQ ID NO: 1957 - protein, 215 aa, Glycine max
MDRAKIQLEPSRLLDILNKKSSFPGSFISIPEIQARNKILNHYGLPDEEYLVLFTPSYKDAMMLVGESYPFVKGNYYMTILDQEEDYIRELASFKESKVISAPKTWLDLRISGSQLSQNFRRRCKISSKGLFSYPVDANGTMHWISEAHRNNWHVLLDASALVVGKDRLHLLALHRPDFVICNLENTHSNPSRVTCLLVRKKSFEVSATSSQAVE

SEQ ID NO: 1958 - protein, 514 aa, Glycine max
  misc_feature (241)..(241): Xaa can be any naturally occurring amino acid
VLRKNSFRSGIPAELSSYYQLERLDISSNSFVGPFQPGLLSLPSITYLNISGNKLTGMLFENLSCNSELDVVDLSSNLLTGSLPRCLVSNSSDSTVLYARNCLDTTNQNQQPQPFCHTEALAVGILPETKKHKQVSKVVLSLGIVGGTLGGVALVLLVFFIVRRGNDRSKTKNPPTRLISENAASGYTSKLFSDARYISQTKKLGAVGLPTYRSFSLEEIESATNYFDTASLMGEDSYGKXMKKRHSTQNFVQHIELISKLRHRHLVSAIGHCFECSLDDSSVSKVFLVFEYVPNGTLRNWISDEHARKSFSWTQRIGAAIGVAKGIQFLHTGIVPGVYSNDLKIEDVLLDQNLVAKISSYHLPLLSNMGKVRRGNSSSGLKNSSNSKSVKQEDKSDIYNFGVILLELILGRQIKTVNDADAFRDLLQASLGGDEEGRRGVVDPAFRKACLDQSLKTMMEICVRCLVKEPADRPSIEDVLWNLQFASQVQDAWRGDSQSSEGSPGSESRGLPFH

SEQ ID NO: 1959 - protein, 87 aa, Glycine max
MGFRLLGVRRARQALSIKGAEVPKGYLAVYVGEEKKRFVIQIECLNQPSFQDLLSKAEEEYGYHHPMGGLTIPCREDVFLHIMSLLA

SEQ ID NO: 1960 - protein, 311 aa, Glycine max
  misc_feature (73)..(73): Xaa can be any naturally occurring amino acid
  misc_feature (168)..(168): Xaa can be any naturally occurring amino acid
  misc_feature (172)..(172): Xaa can be any naturally occurring amino acid
  misc_feature (178)..(178): Xaa can be any naturally occurring amino acid
  misc_feature (194)..(194): Xaa can be any naturally occurring amino acid
  misc_feature (212)..(212): Xaa can be any naturally occurring amino acid
  misc_feature (275)..(275): Xaa can be any naturally occurring amino acid
GFLLLDHEFNLKGRWEKPGHSPSFGYDFWYQPQHKTMISSSWGAPAAFTKGFNLQHVSDGLYGRHLHVYSWPXGELRQTLDLGESGLLPLEVRFLHDPSKDTGFVGCALSSNMVRFFKTEDESWSHEVAISVKPLKVQNWILPEMPGLITDYLISLDDRFLYFVNGLXGDIXQYTIEXPKNPVRTGQVWVGGLXQKGSPIVAITEDGNTWHXDVPDILGNKLRAGPQMIQLSLDGKRLYVTNSLFSAWDKQFYPELVEKGSHMLQIDVDTENGGXKINPNFFVDFGAEPGGSCLAHEMRYPGGDCTSDIWI

SEQ ID NO: 1961 - protein, 95 aa, Glycine max
MMAIRLPSALSARHILRRSNAAATSLDVPKGYFAVYVGEGEKKRFVIPVSLLNQPSFQELLSIAEEEFGFTHPMGGLTIPCTEDIFVNITSGLHI

SEQ ID NO: 1962 - protein, 143 aa, Glycine max
PELHLGPDFCERITSDAIKAIAHCCPKLNKLRLSRIRDLNADAINAWAKHSSKLTDIAFIDCLNVDDVALGNVLSDAFLSDARTSTMKWGVDSHLWHKLPNLIGLDVSRTDIGPSALLIMLSLSQNSRALIALNCPILEEDTS

SEQ ID NO: 1963 - protein, 130 aa, Glycine max
MAYGRSRASSVLDGFTLNPLPYPVLLILSLIFIFLGVSWYFSYEEVVETAEQQLGWLLFCTPVVLILIVRWLSSMENPYWFFSASLPGERRGRTHQGLSEGSSPWGVAALILVLLIMVQYQSNFLDSWFV

SEQ ID NO: 1964 - protein, 107 aa, Glycine max
QDWFLADLDPATAKLAIGFLGPFLSVFGFLFIVRIVMSWYPKLPVGKFPYVIAYAPTEPLLIPTRKVIAPLAGVDVTPVVWFGLISFLNEILVGPQGLLVLLSQQVN

SEQ ID NO: 1965 - protein, 110 aa, Glycine max
  misc_feature (34)..(34): Xaa can be any naturally occurring amino acid
  misc_feature (82)..(82): Xaa can be any naturally occurring amino acid
KIYCPNVSTVNHAGAGMVAPFTGLKSMADFPTRXTNNDITSIASNGGRVQCMHVWPPDGKNKVDTLPYLPDLDDAQLANEGXYLHTKGWIPSLEYELEHGNVYPEHNMSP

SEQ ID NO: 1966 - protein, 92 aa, Glycine max
  misc_feature (52)..(52): Xaa can be any naturally occurring amino acid
  misc_feature (55)..(55): Xaa can be any naturally occurring amino acid
  misc_feature (65)..(65): Xaa can be any naturally occurring amino acid
VGFPTSKTYNDITSIVSNGGRLQCMHVWPPLGKKKSETLFYLPYLYDAQSAXKYXYLLKKGWIPXWEFQLDHSLVYHDHYRLPRYYDGRYWT

SEQ ID NO: 1967 - protein, 472 aa, Glycine max
MASLPALPTLLLSFAAIFFTVLLLFLRRRQLRLPPGSYGLPLIGETLQLISAYKSDNPEPFIDERVERYGSIFTTHVFGEATVFSADPEVNRFILQNEGRLLDCSYPGSISNLLGKHSLLLMKGGLHKRMHSLTMSLANSSIIKDHLLHHIDRLVCLNLDAWSNRVFLMDQAKKITFELTVKQLMSFDPDEWTENLRKEYVLVIEGFFTLPFPLFSTTYRRAIKARTKVAEALTLVVRQRRKEYDEDKEKKNDMLGALLASGDHFSDEEIVDFLLALLVAGYETTSTIMTLAIKFLTETPLALAQLKEEHDQIRARSDPGTPLEWTDYKSMAFTQCVVNETLRVANIIGGIFRRARTDIDIKGYTIPKGWKVFASFRAVHLNPEHYKDARSFNPWRWQSNSSEATNPGNVYTPFGGGPRLCPGYKLARVVLSVFLHRIVTRFSWVPAEEDKLVFFPTTRTQKRYPIIVQRRD

SEQ ID NO: 1968 - protein, 71 aa, Glycine max
IDVVWNDRLGKKVLVNCIDDDTIGDLKNLVAAHTVTRVDGILFQKCYTVYKDHITIKDYEIHDCMGLALYY

SEQ ID NO: 1969 - protein, 306 aa, Glycine max
KFGILLIQSSAEIVVVVEEKDQNQNQKQDSHSSSTFFGGNNSLFDCIYLGKILQVLELPLGLPRRLTIPVVSEEKWSKPYAVISVTLAPVLLAILFNTQSENVGSRSGIVTYIVAALIGIVLGNMACVTTERCNPPRKSLFPWLAGGFAMSVTWTYIIAEELVSLLVSIGSIIGVSPSILGLTVLAWGNSLGDLIANGAMAMNGGPDGVQMAISGCYAGPMFNTLMGLGLPLVLSAWSEHPEPYVTPKDTSLYETLLFLMGGVLWALVILPKKNMRLDKSLGAGLLSVYMCFLVIRIAMAVGIVKF

SEQ ID NO: 1970 - protein, 175 aa, Glycine max
MLIECPYKCARRWFDDGDLNHLANMGKYVSAMVAAGALVTYSRQNDNLWFAIVLITSVVATMYQLYWDFIKDWGFLNPKSINPWLRDDLILKNKSIYYMSIVLNIVLRVTWVETIMHFKVGPVQSRLLDFLLAALEVIRRGHWNFYRLENEHLNNVGHYRAVKTVPLPFREIDSD

SEQ ID NO: 1971 - protein, 131 aa, Glycine max
  misc_feature (107)..(107): Xaa can be any naturally occurring amino acid
CFAAYERKGVQYRYPNARIKDWDEGIKVTSPCPLLNTQSAQGMDCWTTFCREENSVCPAGNIIPDLNVLVYQNRWREALARLLETYNPPEVTEGACPAPCEGPCVLXLIENTRSIKCIEGASLHNTFEEGM

SEQ ID NO: 1972 - protein, 117 aa, Glycine max
  misc_feature (45)..(45): Xaa can be any naturally occurring amino acid
PARKPRGDPRGTPAVYAHQKGERVKKKRRRGAPEATTKGSEARHXGETAKPKSAQGGGGAEKDKGSGTKGRPYTLQAVRQGQQESGATSPQAGQDQPRPREPTPEARRGATQAEGGD

SEQ ID NO: 1973 - protein, 110 aa, Glycine max
  misc_feature (27)..(27): Xaa can be any naturally occurring amino acid
MKQRLHWRYQDHFMVMATQIGTMETIXLNARKEDGASINPTCNVSGIFGIRHEPMLVACARQLIARMSVFGSSRPAVHSLGLTDHNVDTSKGIVIAAMDNAMWCENAVEP

SEQ ID NO: 1974 - protein, 548 aa, Glycine max
  misc_feature (45)..(45): Xaa can be any naturally occurring amino acid
  misc_feature (96)..(96): Xaa can be any naturally occurring amino acid
  misc_feature (269)..(269): Xaa can be any naturally occurring amino acid
MNPLRRSHNSHSSAPNSSPSSSASQSSSSSSSSSSWIHLRSVLFXVVTSSSPASCSSSDRGRLKSPWSRRKRKHALSPQQWKSVFAQDGRFRDGGXKFLKRVRSGGVDPSIRAEVWPFLLGVYDLDSTKDERDVKRTQNRKQYEKLRRQCQKLLKQSNERNKLNEVGEISYEEDGGSLSHDSGSASSDDATSARESLSCEDRSPDVEHSDNPSSALLEGDDVPNANNTDVSTLDTDFSDSDSSEGPEVIQTVPSDDVQEHNDLDKASEXTKIPSKLPTSEDFSTWQRIIRLDAVRANAEWMPYSPSQAIVPDSRAYRSAEAVGLKDYSHLDASRIFHAARLVAILEAYALYDPEIGYCQGMSDLLSPIVSVIPEDHEAFWCFVGFMKKARQNFRLDEVGISRQLDIVAKIIKFKDAHLFRHLQKLQAEDCFFVYRMVVVMFRRELTFEQTLCLWEVMWADQAAIRAGIGKSAWSRIRQRAPPTEDLLLYAISASVLQKRKLIIEKYSSMDEIIKECNSMSGHLDVWKLLDDAHNLVVTLHDKIETSLS

SEQ ID NO: 1975 - protein, 128 aa, Glycine max
MVELVSALSVHAHGKLICNSLCTIAGMLLEAPSLYKEAFVSFSVSLSIEPDYIPGIISTAELLMKLGMQSLPIARSFLMNALRLEPTNHDAWFNLGLVSKMEGSLQQAAEFFQAAYELKLSAPVQEFK

SEQ ID NO: 1976 - protein, 102 aa, Glycine max
YTRRHPGEAIRNGGTASRDLRAALTQCVQQVRRYEYHHYLSLLELPPNMRKAEHALRAMNVETARAKEVASDPRNGLMRQDWWQEAIDKMHAKKLIEQPNST

SEQ ID NO: 1977 - protein, 438 aa, Glycine max
MGEKSNVGGDAINTTLLHGKYELGRLLGHGTFAKVYHARHLKTGKSVAMKVVGKEKVVKVGMMEQIKREISAMNMVKHPNIVQLHEVMASKSKIYIAMELVRGGELFNKIARGRLREEMARLYFQQLISAVDFCHSRGVYHRDLKPENLLLDDDGNLKVTDFGLSTFSEHLRHDGLLHTTCGTPAYVAPEVIGKRGYDGAKADIWSCGVILYVLLAGFLPFQDDNLVALYKKIYRGDFKCPPWFSSEARRLITKLLDPNPNTRITISKIMDSSWFKKPVPKNLMGKKREELDLEEKIKQHEQEVSTTMNAFHIISLSEGFDLSPLFEEKKREEKELRFATTRPASSVISRLEDLAKAVKFDVKKSETKVRLQGQEKGRKGKLAIAADLYAVTPSFLVVEVKKDNGDTLEYNQFCSKELRPALKDIVWRTSPAENPTLA

SEQ ID NO: 1978 - protein, 170 aa, Glycine max
MMSAPANLETGGEEKKLEIEKEKEVESQVEVADTESKPWKEQITVRGLVVSMVLGIIYSIIAMKLNLSAGIVPNFNASAALLAFLFVRSWNKVLQKAGFISKPFTRQENTIIQTCAVSCYSIAVHGGFASYLLGLNRKTYELSGVGAEGNNPNTVRDPGYAWMTAFLFVV

SEQ ID NO: 1979 - protein, 440 aa, Glycine max
MMGEKSNSNSGDAINSTLLHGKYELGRLLGHGSFAKVYHARHLNTGKSVAMKVVGKEKVVKVGMMEQIKREISAMNMVKHPNIVQLHEVMASKSKIYIAMELVRGGELFNKIARGRLREETARLYFQQLISAVDFCHSRGVFHRDLKPENLLLDDDGNLKVTDFGLSTFSEHLRHDGLLHTTCGTPAYVAPEVIGKRGYDGAKADIWSCGVILYVLLAGFLPFQDENLVALYKKIYRGDFKCPPWFSSEARRLITKLLDPNPNTRITISKIMDSSWFKKPVPKNLVGKKREELNLEEKIKHQEQEVSTTMNAFHIISLSEGFDLSPLFEEKKREEKELRFATTRPASSVISRLEDLAKAVKFDVKKSETKVRLQGQENGRKGKLAIAADLYAVTPSFLVVEVKKDNGDTLEYNQFCSKELRPALKDIVWRTSPAENPTLA

SEQ ID NO: 1980 - protein, 191 aa, Glycine max
KNVNLPGVVVDLPILTEKDKEDILEWGVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAASGSNIVGGGSSVEHGLI

SEQ ID NO: 1981 - protein, 172 aa, Glycine max
MARENPLVIGGVIGDVLNPFTSSVSLTVSINNRAISNGLELRPSQVVNRPRVTVGGEDLRTFYTLVMVDADAPSPSNPVLREYLHWMVTDIPATTNASFGREVVFYESPNPSVGIHRIVFVLFQQLGRDTVITPEWRHNFNSRNFAEINNLAPVAAAYANCQRERGCGGRRY

SEQ ID NO: 1982 - protein, 357 aa, Glycine max
MSSKGVGEDCPGWAARDASGVLSPYKFSRRTPGNEDVLIKITHCGVCFADVVWTRNKHGDSKYPVVPGHEIAGIVTKVGSNVHRFKVGDHVGVGTYVNSCRDCEHCNDREEVHCTKGSVFTFNGVDFDGTITKGGYSSYIVVHERYCFTIPKSYALASAAPLLCAGITVYSPMVRHKMNQPGESLGVIGLGGLGHMAVKFGKAFGLSVTVFSTSISKKEEALSLLGADKFVVSSNQEEMTALAKSLDFIIDTASGDHPFDPYMSLLKTYGVFVLVGFPSQVKFSPASLNIGSKTVAGSVTGGTKDIQEMIDFCAANEIHPNIEVIPIEYANEALERLINRDVKYRFVIDIENSLKEK

SEQ ID NO: 1983 - protein, 153 aa, Glycine max
  misc_feature (117)..(117): Xaa can be any naturally occurring amino acid
IGLSMGIYNMCHRPLKERKHFGAALVVFQIRHQKLVQMLGNIQAMIVVGWRLCELYESGKMTPGHASLGKSWITLRARETAALGRELLGGNGILADFLVAKAFCDIEPIYAFEGTYXDITTLVTGREVTGFSSFKSVAQKSRLLKCKMCSCMD

SEQ ID NO: 1984 - protein, 332 aa, Glycine max
MDREQEEMQFLGFFDIYKEASKIILSWRKIFTQITSTLILPLSFIFLIHMEISNLLFRKILINEIVMDETRRNTPQYNKLDRMISSELITLVLFKIAYFTLLLIFSLLSTSAVVYTIASIYTAKEVTFKRVMSVVPKVWKRLMLTFLCAFAAFFIYNIVTMLVMFLSIVTIGISSGGVVVLVLITVLYFIGFVYLTVVWQLASVVTVLEDSWGIRAMAKSKELIKGKMVLSIFVFFTLVASFVSIRVLFKVMVVDGWRVSSVDKTAYGVLCFLLLSCLFLFGLVLQTVLYFVCKSYHHENIDKSALADHLEGYRGEYVPLTAKDVQLEQYQV

SEQ ID NO: 1985 - protein, 373 aa, Glycine max
  misc_feature (69)..(69): Xaa can be any naturally occurring amino acid
  misc_feature (118)..(118): Xaa can be any naturally occurring amino acid
  misc_feature (129)..(129): Xaa can be any naturally occurring amino acid
  misc_feature (145)..(145): Xaa can be any naturally occurring amino acid
  misc_feature (322)..(322): Xaa can be any naturally occurring amino acid
  misc_feature (335)..(335): Xaa can be any naturally occurring amino acid
MATTNPFDLLGDDAEDPSQLHRRPSNSRRRLRPRRPPRLPRRRPAQQNKPAQLPTKPPPPAQAVRDARXNEPVRGGRGGGRGGGRGFGRGRGFSRDSSNDENSFPTSRAPYNQGPFEXEMLGKSSERRXMGGPRVPYRGAWWSSXGGFSNGETGEGEDGRPRRAFDRRSGTGRGNEFKREGSGRGNWGTQTDELAQVTDEVVNETEKNLGDEKPAVEEDVADGNKDSPTNETEEKEPEDKEMTLEEYEKVLEERRKAFQALKTEERKVDTKEFESMQALSSKKDNHDIFIKLGSDKDKRKEAFEKEEKSKKSVSITEFLKPXAEGEAYYNPGRGXGPVARGSRGGGGYHGSATNNAPAPSIEDPGHFPTLSAK

SEQ ID NO: 1986 - protein, 418 aa, Glycine max
MDGRGGCCIARYVPGASHGSTVDKIMLRFRPIAPKPAAAATASDGSSSESSDAFLKNGTTKRKYVRDNNYTSKRRIRRRKNTSSPQLTSHISHPLSLKMDLAPEELQFLTIPDILRESISIPKRSPKTFYLITLSLIFPLSFAILAHSLFTHPLISQLQSPFNDPSQTSHEWTLLLLIQFLYLLFLFAFSLLSTAAAVFTVASLYTSKAVSFSSTLSAIPRVFKRLFLTFLWVTLLMILYNSLILLSLVLMILAIDTDNSLLLFLAILIVLTLFLVAHVYITALWHLASVVSVLEPVYGLAAMKKSYHLLKGRLRFAAVLVSAYLVACGVISGVFSVVVVHGGEDYGVFTRIVVGGFLVGLLVIVNLVGLLVQSVFYYVCKSYHHQGIDKSALHDHLGGYLGEYVPLKSSIQMENLDV

SEQ ID NO: 1987 - protein, 63 aa, Glycine max
MRTVSVFALPLVALFIMAISRLGQAQDLPLSPAPPPTSHGNAIDQGIAYILMLVALAITYMMH

SEQ ID NO: 1988 - protein, 142 aa, Glycine max
  misc_feature (19)..(19): Xaa can be any naturally occurring amino acid
ANLDMQIDPETKEYKAFTXLLPLILVLVLIAILLCPLNIVYRSSRMFFLTCLIHCICAPLYKVTLPDFFMADQFTSQVQALRSFEFYICYYGWGDFKQRETSCKSNRIFIAFSFIVAVIPYWSRFLQVQNFIPFSSDVEIFQ

SEQ ID NO: 1989 - protein, 278 aa, Glycine max
  misc_feature (77)..(77): Xaa can be any naturally occurring amino acid
  misc_feature (178)..(178): Xaa can be any naturally occurring amino acid
MSKEVSQEGLQRKDYVDPPPAPLFDLAEIKLWSFYRALIAEFIASLLFLYVTVATIIGHKKQTGPCDGVGLLGIAWXFGGMIFVLVYYTVGISGGHINTAVTFGLFLACKVSLIRAMFYMVAHCLGAICGFGLVKAFMKHSYNSLGGGANSVSAAYNKGSALGAEIIDTFVLVNTISXATNPKRSAPDSHVPVLAPLPIGFAVFMVHLATIPITGTGINPARSLGAAVIYNNGKVWDEHWIFWVGPLVGALAAAAYHQYILRAGAIKALGSFRSNPTN

SEQ ID NO: 1990 - protein, 350 aa, Glycine max
  misc_feature (9)..(9): Xaa can be any naturally occurring amino acid
  misc_feature (11)..(11): Xaa can be any naturally occurring amino acid
MSGIPREPXTXLRLRVEIEEKINKIKWCQTANGALFLLSTNDKTIKFWKVTSHETSLMARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRVSTGSYSNLFRVFGCVPGSTEATTLEASKNPMRRQVPTPSRPSRSLGNSITRVVRRGAESAGVDANGNSFDFTTKLLHLAWHPTENSIACAAANSLYMYYA

SEQ ID NO: 1991 - protein, 106 aa, Glycine max
  misc_feature (58)..(58): Xaa can be any naturally occurring amino acid
  misc_feature (75)..(75): Xaa can be any naturally occurring amino acid
MSGAEKKVTDVAFKAATDLGGDGMADLLVSHEARREFYNIRRAYNEDSFQLETKFSAXPDPIDWDYSRRGIVTSXEDMYIEYYDSIEVLFFDDAGSSKYKSAFEAL

SEQ ID NO: 1992 - protein, 232 aa, Glycine max
MMANPSGNHQEHTHVVSSSAPETSGAALAMKHNPGISLDWTAEEQAILEDGLSKYASESNIVRYAKIALQLQQKTVRDVALRVRWMNKKENSKRRKDDHNLTRKSKDKKERVSDPAVKSSNFVARSNVSPYAPPMIAMDNDDGISYTAIGGPTGDLLEQNAQALNQISTNLSAFQVQENINLFCQTRDNILKIMNELNDSPEVMKQMPPLPVKVNEELANSILPRTNLPPQS

SEQ ID NO: 1993 - protein, 85 aa, Glycine max
VFQVVAIYEPRIAVEGFIWGINFFDQWGVKLGKSLATQVRKQLNAFCSKGEPVQGFYFSSSTMLAKYFQASSDVPTDLPTVFPKI

SEQ ID NO: 1994 - protein, 164 aa, Glycine max
  misc_feature (27)..(27): Xaa can be any naturally occurring amino acid
  misc_feature (39)..(39): Xaa can be any naturally occurring amino acid
  misc_feature (53)..(53): Xaa can be any naturally occurring amino acid
LVPSTLARPSTHLEAPFKEDLDRFPAXYLYQHCMETNGXTITSDGSFDAFTTXGPILCGEPCSNAQHSFFQRVHQCTKRIRNDFILPYKSHNPVSDNLHHRMLGSGYYDQDEALMGGKTDDHARAKGTCDELDDHKRYRGNRPTTYILGRGAIGPAELGAQIVY

SEQ ID NO: 1995 - protein, 176 aa, Glycine max
  misc_feature (108)..(108): Xaa can be any naturally occurring amino acid
  misc_feature (138)..(138): Xaa can be any naturally occurring amino acid
KYTNGPLLSAEPCKSAQHACIQIVHRGGKITPGDVILSARSHTPVTAILPQQLRASTYLAQDEGVKVGNTYDQVREEGTPQELVPHKRFLGSRPTASILVGGAIGPAXPSALFVFWTPLTFTEGAILDLTSSVQWGVXLARVLAKYILKEHHEAGHGEGPNASTGGLIGAFNKYGI

SEQ ID NO: 1996 - protein, 158 aa, Glycine max
  misc_feature (46)..(46): Xaa can be any naturally occurring amino acid
  misc_feature (92)..(92): Xaa can be any naturally occurring amino acid
  misc_feature (108)..(108): Xaa can be any naturally occurring amino acid
FLILISKQRLPHDHFPTVTTVNRAGAGLDAPLTGLKSMAGFPTRKXTNNDITSLASNGGRLQCMRGWPPGGKNNLETLSYLPDLDDAQLPKXVEYLLRKGWIPCLEFXLEHGFESREHTRKPGYYHGRYWTMWKLPMFGCTDAPEVLKELQEANTAYP

SEQ ID NO: 1997 - protein, 150 aa, Glycine max
  misc_feature (40)..(40): Xaa can be any naturally occurring amino acid
  misc_feature (57)..(57): Xaa can be any naturally occurring amino acid
ISFGLKDIPSSSYDYSYFLYQWAFAFAAAGITSGSMVERXQGVAYLIYCSFLTGFVXEKDSHWFWAPERWAFAFNITDRLFSTGVIDFAGSGEIHMGGGIPGLWGALIESPRMGRFYHPRQAGALGGHTPPLVVLGTFLLWLGWYGSNPG

SEQ ID NO: 1998 - protein, 178 aa, Glycine max
  misc_feature (53)..(53): Xaa can be any naturally occurring amino acid
  misc_feature (101)..(101): Xaa can be any naturally occurring amino acid
  misc_feature (125)..(125): Xaa can be any naturally occurring amino acid
MASSTISSPTVTTVNRAGAGMDAPFTGLKAMAGFLTTKTNNDITSIASTGGRXHCMQVWPPPGNKNIETLSYLPHLDDAQLAKEGQHLLKKGWIPCLELQXEHSCRYREHNRSPRYYDGRYCTMXNLPMFGCTDAYHALNELRDADTAYPNGFIRIIRCNIVEQVQCINFIAYKPPDF

SEQ ID NO: 1999 - protein, 494 aa, Glycine max
MKYTGEALGRDLENVRKYYGSGKTKEASWRESQLKGLHNFLVEKEEEILRALKHDLGKHYVEAFRDEVGTLMKTLNLASKSLKNWMAGKEAKLPRIALLSSAEIVPEPLGLVLIISSWNFPFGLSLEPLIGAIAAGNSVVLKPSELSPTCSSLLATFLPTYLDNNAIKVIQGGPEVGELLLQQRWDKIFFTGSARVGRIVMSAAAVHLTPVTLELGGKCPAIIDSLSSSWDKEVAVKRILVAKFGACGGQACIAIDYVLVEKSFSSTLVTLMKEWIKKLFGENPKVSNTIARIVNKNHFMRLKNLLTEPRVKESVVYGGSMDENDLFIEPTILLDPPLDSAIMAEEIFGPVLPIITVEKIEESVEFISSRPKALAIYAFTKNQTLQRRLVSETSSGSLVFNDAILQYVADTLPFGGVGECGFGKYHGKFSFDAFSHHKAVARRSYLTDFWFRFPPWTLNKLQLLEVSYNLDYLGILLVLLGLKKSKRSLFQACN

SEQ ID NO: 2000 - protein, 112 aa, Glycine max
  misc_feature (18)..(18): Xaa can be any naturally occurring amino acid
  misc_feature (26)..(26): Xaa can be any naturally occurring amino acid
  misc_feature (86)..(86): Xaa can be any naturally occurring amino acid
TTVNRAGAGMADPLTALXSMAVCPTXNTIIDFTSFASNAGRAQYMQMWPPVGYKKFETLSYLPDLDDAHLGKDGEYLLRTGWSPRXEFELEHGFLCREHNRAPEYYDGRYWT

SEQ ID NO: 2001 - protein, 200 aa, Glycine max
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSSDSFTRAKKWVQELQKQGNPNMVMALAGNKADLEDKRKVTAEEARVYAEENGLFFMETSAKTASNVNDIFYEIAKRLPRAQPAQNPAGMVLVDRPAEGTRAASCCS

SEQ ID NO: 2002 - protein, 466 aa, Glycine max
  misc_feature (135)..(135): Xaa can be any naturally occurring amino acid
QFGLACVANPSRRRRSSERSSAYGKKTNLEHNKAWLLAESGGCGAELPNADPQSVHSSFRFSFCSQVELESLNMSSSAAATVLMVNLDNGVSESRANEMKWRRMESLEKSISPVAHTLIRFSYGEIMSATRNFSXGRVLGRGALSCVFRGRVGILRTAVAIKRLDKENKESAKAFCRELMIASSLHSSNVVPLLGFCIDPEEGLFLVYKYVSGGSLERHLHGRKKGSSPLLWPVRYKVAIGIAEAVAYLHSGTERCVVHRDIKPSNILLSSRKIPKLCDFGLATWTSAPSLPFLCKTVKGTFGYLAPEYFQHGKVSDKTDVYAFGVVLLELITGRKPIEARRSSGEENLAKPFLQKGKGAIEELLDPQLKCSLKFSNQMGRMIEAAAACVTNEESRRPGIHEIIAILKGEEEPLLSKRKKSSFLGNGCVIDCYSQLQQTNNEMKSHLALAMLGVAEFEDDEYLYGR

SEQ ID NO: 2003 - protein, 264 aa, Glycine max
LEPDFWYQPRHNTMISTSWGAPSAFTKGFNLQHLSDGLYGRHLHVYSWPGGELRQTMDLGDSGLIPLEIRFLHDPAKDTGFVGSALTSNMIRFFKTQDESWSHEVAISVKPLKVQNWILPENETTEVIKTQETTPEPVPATEAPATEQAAAEVPAQEEQQATEVPAPESTTEAPKEETTRSANNRNSRNNNYRRSQAQRSLKKLQLRPRRVVTKETEEEKPAAEEKSEEKTEEVKEEAEEPKETTETETESAPAATTEEENKPA

SEQ ID NO: 2004 - protein, 89 aa, Glycine max
  misc_feature (50)..(50): Xaa can be any naturally occurring amino acid
TTHFDGQKPGTSGVRKKVKVFVPPHYLHNSDHATFNALTVEKVRGATLVXFGDEPYFSKEAIENITQLSSTNGGRREWIRQNGLMSTPA

SEQ ID NO: 2005 - protein, 420 aa, Glycine max
IRLEKPPSGKFPIIKICVLIFIIILYAESFKFLSSGSIFNFKPCPTNSTKPKSNDNKIQEVVPNDSLWFHDGFVYDPEECDFTNGKWVFNSSIKPLYSDTTCPYISRPYSCVNNGRVDSDYRYWEWQPEDCTLPKFNPKLALKKLQGKRLLFVGDSLQKSQWESFVCMGEWIIPEKQKSMKRGTHSVFKAKEYNATIEFYWAPMLVESNTEFFTIRDPKKQIVKVDAIMDRAKNWTGVDILVFNTYVWWMSDIKVKALWGSFANGEEGYEELDAQIAYNLGLRTWANWVDSTINPNKTSVFFTTMSPTHTRSLDWGNKDGIKCFNETKPIGKKNHWGSGSNKGMMSVVEKVVKKMKVPVTFINITQISEYRIDAHSSVYTETGGKLLTEEEKANPRNADCIHWCLPGVPDTWNQIFLTML

SEQ ID NO: 2006 - protein, 122 aa, Glycine max
  misc_feature (52)..(52): Xaa can be any naturally occurring amino acid
  misc_feature (86)..(86): Xaa can be any naturally occurring amino acid
  misc_feature (108)..(108): Xaa can be any naturally occurring amino acid
GSRSFVKDAAVYIAVRFLIGLAMATFVSCQYWMSTMFNSLIIGLANGTAAEXGNMGGGATHLIMSLVFELLQGAGAPPFTDGKIAXFVPGLLRPMTRMLVLTFGQNFXKGNRGSLKEIMLFF

SEQ ID NO: 2007 - protein, 110 aa, Glycine max
  misc_feature (60)..(60): Xaa can be any naturally occurring amino acid
  misc_feature (79)..(79): Xaa can be any naturally occurring amino acid
MLLMRFELFSTLLFVPLLDGSDVLGITPCTESKQVSMLKTLLNKKLESAVNLCEAGIDHXLAQIASDDNTKRRFDSYSXLQKLCCVDGVPYLILSGDLTQCVQYIHHGIL

SEQ ID NO: 2008 - protein, 235 aa, Glycine max
  misc_feature (30)..(30): Xaa can be any naturally occurring amino acid
TNEGSLPLTSQYTPRDFVLSLQRPKSVIIXVKTGSPVDHTIATLSDHLDPGYCIIDGDNEWYENTERCMNLVADKGLLYLGIGTSGGENGACHDPSLMPGGSHHAYSNVQDILHKIAAQVEDDPCVTYIDEGGSGNWAAMVGFRGCFIGGRLCEGEGKGCGLVVPDEEEGNVRGEGEMEGHARGRWRGRRRVAGAGRGKEGCWCRKGGGRPPVPGGKGEKGGLVRGRRKGKSEKK

SEQ ID NO: 2009 - protein, 490 aa, Glycine max
  misc_feature (43)..(43): Xaa can be any naturally occurring amino acid
  misc_feature (236)..(236): Xaa can be any naturally occurring amino acid
  misc_feature (247)..(247): Xaa can be any naturally occurring amino acid
  misc_feature (288)..(288): Xaa can be any naturally occurring amino acid
MMLRIKRVPTVVSNYQKDDAADSPRPVGGCGRNCLKACCLPDXSCPLYAFKKANGKDLALHACAGEPPLTFLDSLLLGEWEDRMQRGLFRYDVTACETKVIPGEYGFVAQLNEGRHLKKRPTEFRVDKVLQPFDENKFNFTKVGQEEVLLQFEASEDGQVHFFPNAPVDVDNSPSFVVINVSPIEYGHVLLIPRIFECLPQRIDRESFLLALQMAVEADNPYFRLGYNSLGAFATXNHLHFQAYYLXALPFPIEKAPTKRIASVNGGVKISELLKYPVRGFVFEGGEXLEDLSNVVSDACICLQNNNIPFNVLISDCGKQVYLLPQCYAEKQALGEVNAELLDTQVNPAVWEISGHMVLKRRKDYDEASEGNAWRLLAEVSLSQERFQEVNDLVFEAIGCGELEDVNVQSVKKEVDAVSTSEHPYCGGGGWFTRMCGSTVTRLLYFEQIQKICSVLRIIAEMCHRLSHTIALCLSLMVVCVECICFYLPL

SEQ ID NO: 2010 - protein, 436 aa, Glycine max
MMLRIKRVPTVVSNYQKDDAADSPRPVGGCGRNCLKACCLPDAKLPLYAFKKANGKDLALHACAGEPPLTFLDSLLLGEWEDRMQRGLFRYDVTACETKVIPGEYGFVAQLNEGRHLKKRPTEFRVDKVLQPFDENKFNFTKVGQEEVLFQFEASEDGQVQFFPNAPVDVDNSPSFVAINVSPIEYGHVLLIPRIFECLPQRIDRESFLLALHMAVEADNPYFRLGYNSLGAFATINHLHFQAYYLALPFPIEKAPTKKIASLNGGVKISELLKYPVRGLVFEGGDTLEDLSNVVSDACICLQNNNIPFNVLISDCGKQVYLLPQCYAEKQALGEVDAELLDTQVNPAVWEISGHMVLKRKKDYDEASEGNAWRLLAEVSLSQERFQEVNDLIFEAIGCGELEDVNVESVKEVDAVSTSEHPTVVVAGSQECVILH

SEQ ID NO: 2011 - protein, 406 aa, Glycine max
  misc_feature (19)..(19): Xaa can be any naturally occurring amino acid
  misc_feature (62)..(62): Xaa can be any naturally occurring amino acid
  misc_feature (125)..(125): Xaa can be any naturally occurring amino acid
  misc_feature (138)..(138): Xaa can be any naturally occurring amino acid
  misc_feature (156)..(156): Xaa can be any naturally occurring amino acid
  misc_feature (235)..(235): Xaa can be any naturally occurring amino acid
  misc_feature (287)..(287): Xaa can be any naturally occurring amino acid
  misc_feature (326)..(326): Xaa can be any naturally occurring amino acid
  misc_feature (345)..(345): Xaa can be any naturally occurring amino acid
  misc_feature (356)..(356): Xaa can be any naturally occurring amino acid
MMLKIKRVPTVVSNFQKDXTLADSPRPVGGCGRNCLKACCIPDAKLPLYGFKKANIGKDLAXHACAGEPPLTFLDSLLLGEWEDRMQRGLFRYDVTVCETKVIPGEYGFVAQLNEGRHLKKRPTXESEFDKVLQPFDXTKFHLYQKVGQEEVLFQXFEASEDGQVQFFPNAPVDVDNSPSFVAINVSPIEYGHVLLIPRIFECLPQRIDRESFLLALHMAVEADNPYFRLGYNSXLGAFATINHLHFQAYYDILPFPIEKAPTKKIASLNGGVKISELMNYPDLGFXIRGGDTLEDLSNVVSDACICLQNNNIPFNVLISDCGKQXYLLPQCYAEKQALGEVDAXLLDTQVNPAVXEISGHMVLKRKKDYDEASEGNAWRLLAEVSLSQERFQEVNDLIFEAHWLW

SEQ ID NO: 2012 - protein, 444 aa, Glycine max
  misc_feature (246)..(246): Xaa can be any naturally occurring amino acid
ATAVTLCLVLPERGSIDALDGGMIEMVLDPDLNKTGDIWHICIEDLPRSNVLYGYRIDGPRDWGKGHRFDSSIVLVDPYAKLVEGRRYFGDISMKLSKFLGTYDFDSLPFDWGENYKLPNISEKDLVIYEMNVRAFTSDESSGLDSNIRGSYLGAIEKIPHLLELGINAVELLPVFEFDELEFQRRPNPRDHMINTWGYSTINFFAPMSRYASAGGGSVNASREFKQMVKSLHSAGIEVILDVVYXNHTNEADDAFPYTTSFRGIDNKVYYMLDNNGQLLNFSGCGNTLNCNHPVVMELILDSLRHWVTEYHVDGFRFDLASVLCRGIDGSPLNAPPLIRAIAKDAVLSRCKIIAEPWDCGGLYLVGSFPNWDRWAEWNGKYRDDVRKFIKGDSGVKGSFATRVAGSSDLYSVNNRRPYHGINFVIAHDGFTLRDLVSYNFKHN

SEQ ID NO: 2013 - protein, 175 aa, Glycine max
  misc_feature (112)..(112): Xaa can be any naturally occurring amino acid
  misc_feature (122)..(122): Xaa can be any naturally occurring amino acid
  misc_feature (125)..(126): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLKFELKHSFVYQEHNXSPKYYDRHYXTIXXLAMFRYTNTSQVWKELQETKTTYANNFMHIIKFYNIRQIHYINFIGYEP

SEQ ID NO: 2014 - protein, 177 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPG

SEQ ID NO: 2015 - protein, 178 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 2016 - protein, 159 aa, Glycine max
  misc_feature (141)..(141): Xaa can be any naturally occurring amino acid
  misc_feature (154)..(154): Xaa can be any naturally occurring amino acid
MLVYHDLLTGDELVSDSFRYTEIENGTLWEVEGKWIVQGALDVDIGANPYADGGEDEGVDDAAAKVADIADTIRLDEQPAFDKKQHVTFMKRPIKNLTPKLDAENLELHKKLIEGSTINLLSKTNDFQLLVGESMNDDACXVLAYYKDGAADPXYLYFA

SEQ ID NO: 2017 - protein, 346 aa, Glycine max
MAQSVEIPRVKLGTQGLEVSKLGYGCMGLTGAYNDPLPEEEGISIIKHAFSKGITFFDTSDIYGPDHANEIVVGKALKQLPREKIQIATKFGITKIDSSGMFVKGTPEYARSCCEASLKRLGVEYIDLYYQHRVDLSVPIEETIGELKKLVEEGKVRYIGLSEASPDTIRRAHAVHPITAVQMEWSLWTRDIEDEIIPLCKELGIGIVPYSPLGRGFFGGKGVLETVSTVSSLITHPRFRAENLDKNKKLYGKIESLATKQQCTPSQLALAWVLHQGNDVVPIPGTTKVKNLDQNIGAVSLKLTESDLREISEAVPIDEVAGTRHYYGSANFSWTVANTPPKDPRV

SEQ ID NO: 2018 - protein, 166 aa, Glycine max
MAFVTTAEVCDANPQLILSGELRALQPVFQIYGRRQVFSGPIVTLKVFEDNVLVREFRAGKGNGRVLVVDGGASLRCAILGGNPVVQAQNNGWAGIIVNGCIRDVDEINGCDIGVRALASHPMKANKKGMGEKQVPINIAGTRISDGEWLYADTDGILISRTELSV

SEQ ID NO: 2019 - protein, 180 aa, Glycine max
  misc_feature (163)..(163): Xaa can be any naturally occurring amino acid
VWGLGTVGLAVVMGAKKAGASKIVGIDLETAKFEKAKHFGATEFVNPKEVPAEQTLQASLMDKFDGGFDYTFECCGNVQTMRQALEAAHKGWGVSCVIGVAGAGEEIKTRPFQLVTGRTWKGSSFGGWKSRDQIPSLVKEHLDGKLDLDKFITHKFAFSDINXAFECMTKGESLRCVIEI

SEQ ID NO: 2020 - protein, 490 aa, Glycine max
SISERTKMTADIGLIGLAVMGENLVLNIESRGFTVAVFNRTTSVVDKFLEARAKGKKIIGTHSLEELVSKLKRPRKIMLMIRAGSPVDQQINALLPFLEAGDIVIDGGNSHYPDSNRRTKFLKEKGISFIGTGVSGGEEGALTGPSIMPGGDPAAWEHVKPIFQAISAKVEDGTPCCDWVGEDGAGHFVKMVHNGIEYGDMQLIAEAYHLLSGVLGLSNDELAKVFAEWNKGDLDSYLIEITSHILGKKDEETGKHVVDLILDAAGQKGTGKWTATSALDFGIPVTLIGEAVFARCLSSLKDERVQASKVIPGPKANFTGDREVFIAQVRDALFAAKVVSYAQGFLLMRSAAQEFKWNLNYGGIALMWRGGCIIRSTFLGKIKEAYNNNPSLPNLLLDPYFQAKIESVQSAWRTVVSTAFLNGIPIPALSSALAYFDGFRTERLPANLIQAQRDYFGAHTYERVDKPRGEYFHTNWTGHGGTTSSRTYNV

SEQ ID NO: 2021 - protein, 155 aa, Glycine max
PYARSQLLEKAKNYVAEKVTNMPKPEASVTDVDFKRVSRDSVEYLAKVSVQNPYSTSIPICEIKYSLKSAGREIAAGTIPDPGSLKASDTTMLDVPVKVPHSILLSLAKDIGADWDIDYQLDIGLVIDLPVIGNFTIPLSQKGEIKLPTLTDMFA

SEQ ID NO: 2022 - protein, 151 aa, Glycine max
MEDVQQEPAQTPKKSNVQESDIQFRCLDQVDSLGLILITNRSRYLINWLVNSMLKLKHPNTQGVSLVKIYGPKVKFDRGPALAFNIFDWKGERVEPALVQKLADRSNISISYAFLHHIWFADKYAQEKGRVLHTTVVGDQEVVTTTNKKKD

SEQ ID NO: 2023 - protein, 115 aa, Glycine max
MPCLNLSTNVSLEGVDTSSILAEATSSVASIIGKPEAYVMIVLKGSVPIAFGGNEQPAAYGELVSIGGLNPSVNKELSAAIASILETKLSVPKSRFFLKFYDTKGSNFGWNGSTF

SEQ ID NO: 2024 - protein, 428 aa, Glycine max
  misc_feature (161)..(161): Xaa can be any naturally occurring amino acid
  misc_feature (175)..(175): Xaa can be any naturally occurring amino acid
  misc_feature (196)..(196): Xaa can be any naturally occurring amino acid
  misc_feature (237)..(237): Xaa can be any naturally occurring amino acid
MGNSHGHRHRKHGNSVPPNTVPPPHKYNPHPSRPPTSNSTMLSLPYTHVDTTLRSLAAQAEGFGALRYRRPPRSPSPRHISRRFPTLYHHPPIPSYSISTMLSLPYAHVDTTLRSLAAQAEGFGRFAIGGLHGPLHPVTSLADDGPSLRDACRRKEPLWIXFVEVSGTIQLSSYXRGLSHKTIDGRGQRIKLSGKXRLKECEHVIICNLEFEGGTGHDVDAIQIKPNSKHIWIDRCXVSDFDDGLIDITRESTDITISRCHFSQHDKAMLIGADPTHVGDRCMRVTIHHCFFNGTRQRQPRVRFAKVHLYNNYIRNWGIYAVCASVESQIFSQHNIYEAGQKKVAFKYLTEKAADKEVGATGTIRSEGDIFLNGAQKGLMTEDVGCNMFHPSEHYPSWTVEAPTDDLKQILHHCTGWQSLAKPADQTL

SEQ ID NO: 2025 - protein, 101 aa, Glycine max
GWLSSCEENCGVSRWCNRGWGDGGNLSYFDFSMTYVEAGMMRSHLVNVSLLVGAAITWGIMWPLIKGLKGEWLPASIVESIIKSLNGYKVYISIALILDDG

SEQ ID NO: 2026 - protein, 248 aa, Glycine max
MAGIAFGSFNDSVSFASIKAYIAEFISTLLFVFAGVGSAIAYAKLTSDAALDPTGLVAVAICHGFALFVAVSVGANISGGHVNPAVTFGLALGGHITILTGFFYWIAQLLGSIVACFLLNYVTGGLPTPIHSVASGVGAVEGVVTEIIITFGLVYTVYATAADPKKGSLGTIAPIAIGFIVGANILAAGPFSGGSMNPARSFGPAVVSGDFHDNWIYWVGPLIGGGLAGLIYGNVFIRSDHAPLSSEF

SEQ ID NO: 2027 - protein, 503 aa, Glycine max
MAISIPSRQLFIDGEWKVPLLNNRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGCTAILKPSELASVTCLELAEICREVGLPPGVLNIVTGLGNEAGAPLSSHPDVDKISFTGSSATGSRIMTAAAQLTKPVSLELGGKSPIIVFEDVDLDKTAEWTIFGCFFTNGQICSATSRLIVHESIATEFVNRLVQWAKNIKISDPFEEGCRLGPIVSEGQYKKVLNCISTAKSEGATILIGGSRPEHLKKGYFVEPTIITDVTTSMQIWREEVFGPVLCVKTFSTEEEAIELANDTHYGLGSAVMSKDLERCERISKAIQAGIVWINCAQPSFIQAPWGGVKRSGFGRELGEWGLENYLSVKQVTKYISDEPWGWYQSPSKL

SEQ ID NO: 2028 - protein, 178 aa, Glycine max
ARGVRFVTNYKLTKEDIDYIKNNLSVSCEDGFLDYLRGIDCSDVEFYAIPKGSVVFLKVPLLRIEGPIAVVQLLETPFVYLINFASLVSTNAARHRFVAGKPKTLLEFGLRRAQGPDGGVGASKYSYIGGFDATSNVAAGMLFGIPLRDTHSHAFVSSFMRSNSLRGNFAETHQSELA

SEQ ID NO: 2029 - protein, 629 aa, Glycine max
  misc_feature (127)..(127): Xaa can be any naturally occurring amino acid
MAFSCKLDSFILSAYTTPKLHSPTFNSNLPPSFHLPSSLKPQKLPFRIRYGSTIRATSSSSTPSATIAEPEGIKIKSIPTKPIDGQKTGTSGLRKKVKVFMQDNYLANWIQALFNSLPPEDYKNGLXVLGGDGRYFNQEAAQIIIKIAAGNGVGKILVGQEGILSTPAVSAVIRKRKANGGFIMSASHNPGGPEYDWGIKFNYSSGQPAPESITDKIYGNTLSISVIKIADILDVDISKVGVTKFGSFSVEVIDPVSDYLELLETVFDFQLIKGLLSRPDFRFIFDAMHAVTGAYAKPILVDKLGASLDSISNGIPLEDFGHGHPDPNLTYAKDLVNILYAENGPDFGAASDGDGDRNMILGRSFFVTPSDSVAVIAANAREAIPYFKNGVKGLARSMPTSGALDRVAKKLNLPFFEVPTGWKFFGNLMDAGNLSVCGEESFGTGSDHIREKDGIWAVLAWLSIIAHRNKDKNPGEKLISVSDVVMEHWATYGRNFFSRYDYEECESEGANKMIEYLRDILSKSKPGDQYGSYVLQFADDFTYTDPVDGSVVSKQGVRFVFTDGSRIIYRLSGTGSAGATVRVYIEQFEPDVSKHDVDAQIALKPLIDLAISVSKLKDFTGREKPTVIT

SEQ ID NO: 2030 - protein, 512 aa, Glycine max
  misc_feature (31)..(31): Xaa can be any naturally occurring amino acid
  misc_feature (188)..(188): Xaa can be any naturally occurring amino acid
  misc_feature (210)..(210): Xaa can be any naturally occurring amino acid
  misc_feature (227)..(227): Xaa can be any naturally occurring amino acid
  misc_feature (327)..(327): Xaa can be any naturally occurring amino acid
EVRREKWQSPLPSRQLFTKMESGKFPLLNKXRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGXTAILKPSELASVDCLELSEICXEVGLPPRVLNIVTGLGXHEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWXKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 2031 - protein, 331 aa, Glycine max
MAAFILISKSKLQSTVLVLVLNLSFFFLFCLLLKAYYLHPPNSNSQSNGPLKTFNHERLFRDVSVEGCTDLHKYSDYESKCLYVKSHLDCRSKGYINYLQIFYCSFGKFQILGQTLLALWLVVLFYLLGDTASNYFCNSLEGLSNILRLSPTIAGVTLLSLGNGAPDFFASVVSFTGSSSNGAVGLNSILGGSFFVSCAVLGIISILVGPNQVQVDKASFIRDVLFFLFSLLILLIILYIGKITLLASICYVSIYFLYVCAVSATHLIYGGDKMINERQYQYSDDESSSSSLEASIPLLGYVDEEKTKLAEIVGGLKEKDQNQNQKQDSHS

SEQ ID NO: 2032 - protein, 305 aa, Glycine max
MAATSTSLFFSNLHSLNPQPFSSSLSFFRNVHSTLSFPSSSKPSRGVVAMAGSGKFFVGGNWKCNGTKDSISKLVSDLNSATLEPDVDVVVAPPFVYIDQVKNSITDRIEISAQNSWVGKGGAFTGEISVEQLKDLGCKWVILGHSERRHVIGENDEFIGKKTAYALSEGLGVIACIGELLQEREAGQTFDICFQQLKAFADAVPSWDNIVIAYEPVWAIGTGKVATPEQAQEVHAAVRDWLKKNVSAKVASKTRIIYGGSVNASNSAELAKQEDIDGFLVGGASLKGPEFATIINSVTSKKVAA

SEQ ID NO: 2033 - protein, 199 aa, Glycine max
MNFNSTGGRHPAQRNSRKLKAGGDAAPASPMAPYPAPYNPSYPSYAPPPYGQPGADMYAQQHVSMPGGGEYMQPMQPQNMGGFPGGPQMNQGFAIPSQVFSQPIVADLAMQYGASMVGAGRQIVDRELEKYVPVSRLKYYFAVDTKYVANKLRLLFFPFTHSDWSMKYEQGQPVQPRFEMNAPDLYIPTMAYVTYVLLA

SEQ ID NO: 2034 - protein, 281 aa, Glycine max
  misc_feature (51)..(51): Xaa can be any naturally occurring amino acid
MMEDPTTLLNSEYSRLFGEDTDLYNRIVLGALLPHSVWGPLPRFLQTWLRXNYLGGVLLYLLSGLLWCFYIYYWKRNVHVPKDAIPSQRAMLLQISVAMKAMPWYSLLPTVSEYLVETGWTKCYPRLYNVGWLAYLVYLAIYLIIVEFGIYWMHRELHDIKPLYKYLHATHHIYNKQNTLSPFAGLAFHPLDGILQALPHSLCLFFMPIHFTTHLALIFIEGVWTANIHDCIHGKLWPVMGAGYHTIHHTTYRHNYGHYTIWMDWMFGTLRDPEEDGGKAM

SEQ ID NO: 2035 - protein, 254 aa, Glycine max
  misc_feature (86)..(86): Xaa can be any naturally occurring amino acid
MSVSIYIYVSISIYILVMHKPVTFHGSFSAAGGASSTTTEEVPEYWLPSWAKFEIGRAAVFWRTMNGLPPTSGEKLILFYYPPATXLSLMKDFGFAFYWNGGFNQPIMCGGEPRAMLRKYRGKADAPIYSIQICIPKHALNLIFSFTNGVDWDGPYRLQFQVPKALQNKPIDFFNKGLAEELSKEGACEQAIFPDTNKVITKCAMIGNLSKEGGDRCDLNFVVGCTDPRPLPYSPRANVDDGTCTIELDSESEE

SEQ ID NO: 2036 - protein, 145 aa, Glycine max
MEVYGNSMVAAPSNVIYLSSILGQDSPITGHRCNWKCENEHVCGNMYRCKITGLTHICDKNCNQRILYDNHSSLCLASGQIFPLTPEEEQAVRGVRRKLDTENSPSDSCGFKRRRDAQFHPSPFERSFSAVSPICSQVGDGMDMK

SEQ ID NO: 2037 - protein, 202 aa, Glycine max
GSSSSRFGSRDVTEVAALYHSEKSHKTVEYSDYSFSDANGDKGHSSNEKIHEKNDTHSTSRSSVSEKDQLSTGGSYHWEDWHTDLLACCSEPCLCIKTCFYPCGTLSKIATVANNRPISSAETCNELMAYSLILSCCCYTCCMRRKLRKMLNIRGGFIDDFLSHLMCCCCALVQERREVEIHGVEGPENTNTRPPPSQYMES

SEQ ID NO: 2038 - protein, 184 aa, Glycine max
TLALCGRGPIPNPGSGSPQNLSTKLIEPALLPFTGQFYNLVRRKRKGVSRSSLRNAASASSKESQEDAPSTLSVYLEEETNHVIRFKMPDSKISHTVSAGLGGRPDEVIFEGMVKDSRSPLCNTRVVLQQLSSAQAQRRGKRAIEVLKKLVRRKLLYHSYSMQVHGYTSLPASGVSGSFILAHG

SEQ ID NO: 2039 - protein, 82 aa, Glycine max
  misc_feature (30)..(30): Xaa can be any naturally occurring amino acid
  misc_feature (65)..(65): Xaa can be any naturally occurring amino acid
MLQHPSTDVSDARLCIQNSNMPFSALISDXGKQVHLLPQCYAEKQAVAQANDDLLHTQVNPAAWXASGHMVLNWSRDYQEGS

SEQ ID NO: 2040 - protein, 180 aa, Glycine max
FGSRVFTDVCIGWSGSMGVDQVLEKSALFHRANSAGLNLSGVWVVGGCGYPLLDWVLVPYTQQNLTWTQHAFNEKIGEVRRVAKGAFGRLKGRWGCLQKRTEVKLQDLPFVLGACCVLHNICELKNEEMDPELLENIDDDGDYAEVMEPEVAFRSVSSLKARDAIAHNLLHHGLAGTSFV

SEQ ID NO: 2041 - protein, 323 aa, Glycine max
  misc_feature (146)..(146): Xaa can be any naturally occurring amino acid
VGLWLPQRPEDLRPVKLEEVNRGFNYQQWRIPLSGSFGNEVSTVLGGGLVPGSLTLVGGDPGIGKSTLLLQIAAMIANECSDYEGPPVVYVSGEESLQQIGIRADRLGIESNIYLYSSTDIEDILTKTHGLSPRALVVDSIQTGYXLETIIGSAGGIMQVKECTAALMRFAKTTNISVFLIGHVTKSGDIAGPRVLEHIVDVVLYMEGEKYSPYRMLRAVKNRFGSTDELAVLEMSQSGLQVVSNASEMFLTQQHSDSNVLAGLAIAVIMDGSRTFLIEIQALCLTHCPVSSSLSNGINANKANIIKCVLIKQTGLHLQDNVS

SEQ ID NO: 2042 - protein, 205 aa, Glycine max
  misc_feature (38)..(38): Xaa can be any naturally occurring amino acid
  misc_feature (60)..(60): Xaa can be any naturally occurring amino acid
  misc_feature (138)..(138): Xaa can be any naturally occurring amino acid
  misc_feature (154)..(154): Xaa can be any naturally occurring amino acid
  misc_feature (162)..(162): Xaa can be any naturally occurring amino acid
MSFQGLVLCNFHFPPGWLFLSQHFGTAIGCVVAPLTFXLFDKGFDVGNPDGNYKAPYDIXYRNMAILGVGGLSGISHHCVQLCYGFFAFAIAANLVRDLAPNIIGKCFPLPMAMAVPFLVGGFFAIDLCMGSLGVFLXPKLCRDRAGFMVPTVXFGLTCANXLWILPSLNLALFKIGPPMCVSFLSAMFQSKSSTITFKYMLSTT

SEQ ID NO: 2043 - protein, 119 aa, Glycine max
HNRHFSYIPTAIASKHGLIVKQGGGEERWVDSREGLCEAVYEMASVANAHLEKARKLTESVPPEALPVLLPAVPAQVLLDSLRKVQFDVFDSKLTRGVLGIPPLWYQLKLKWTSWRRKY

SEQ ID NO: 2044 - protein, 391 aa, Glycine max
  misc_feature (80)..(80): Xaa can be any naturally occurring amino acid
  misc_feature (84)..(84): Xaa can be any naturally occurring amino acid
MEDKLATTSEGQPIRCKAAICRKPGSPLSIEEIIVAPPMPREARIRVICTSLCHSDVTFWKMEVPPAICPRILGHEAVGXSEWXVESVGEDVTEVTKGDVVVPIFLPDCGECIDCKSSKSNLCSKFPFEVSPWMPRHATSRFTDLKGDIIHHFLFVSSFSEYTVVDIAHLTKIDPAIPPNRACLLSCGVSTGVGAAWRTAGVEPGSTVVIFGLGSIGLAVAEGARLCGATRIIGVDVNPEKYETGKKFGLTDFVHAGESENKSVSQVIIKMTGGGADYCFECVGMATLVQEAYASCRKGWGKAIVLGVEKPGSMLSLSCNEVLHSGKSLVGCLFGGLKPKSDVPILLKRYMDKELNLDEFVTHEVEFKDINKAFDLLIEGQCLRCVIWMDR

SEQ ID NO: 2045 - protein, 266 aa, Glycine max
CSPTVQLRAGSMEDILLDTRWEDVICPICLEVPHNSVLLQCSSYDKGCRSFVCDTSQLHSNCLDRFKSTHSMPSSSTYDSTSQMSDANSMANSESVVSDCQYKLSCPLCRGDVFGWIIVDKARVHLDEKKRCCEEEQCAFIGSYSELQKHAQLEHPHACPSKIDPVRQLDWKNFQQSSEIIDVLSTIHSEIPRGVVLGDYVIEYGDDDSADEFEDFPGDEGSVASVEYGEYRLDEIDDDFVSTIGHLRGGSGFRRSRRRHSRSNDN

SEQ ID NO: 2046 - protein, 426 aa, Glycine max
MEFDAAIPVSREHLPQDAMWQINLRSSETMESEPYPEHPGEPDCSYYIRTGLCRFGATCRFNHPPNRKLAIAAARMKGEFPERIGQPECQYYLKTGTCKFGATCRFHHPRDKAGIAGRVALNILGYPLRPNEPECGYYLRTGQCKFGNTCKFHHPQPNNMVLSMRSSPVYPTVHSPTTPGHQSYATGITNWSSSSYIPSPRWQGPSSYAPLILPQGMVSVSGWSAYSGQMGSDSPQQTMANGQSYGTSRQSEPANSGSQGAYSQFRSGSVPVGFYALQRENIFPERPDQPECQFYMKTGDCKFGAVCRFHHPHERMIPAPDCVLSPIGLPLRPGEPLCVFYSRYGICKFGPSCKFDHPMGVFTYNMSASPLADAPGRRMLGSSSGTSALNLSSEGLVESGSENPRRLSLSETRQIPSGDDNIDEEG

SEQ ID NO: 2047 - protein, 215 aa, Glycine max
  misc_feature (6)..(6): Xaa can be any naturally occurring amino acid
VVVRGXARLFLAGPPLLKAATGEVATDEELGGAQMHAQVAGTAEYLAQNDADGVRIAREIIAQLPWNDRLPITAARTWAEPLYPIDELLGLIPDDPKKPYDVREIVARLADGSNFLEFKAEFDTQTICGHLQIQGRPCGLIGNNGPITPKGASKAAQFIQLCDQSRTPLVFLHNTTGFMVGTEAEQQGVIKHGAKMIQAVAKGRVPKITLVGGGF

SEQ ID NO: 2048 - protein, 91 aa, Glycine max
FVETVTPRNKPKYDALLIVLKEAEETSLKESERLEKEIVGVQKLKTKFRTMTADGYFEKHPDLRKKSDDEVRNDSLGVLVFQLPSCPGDGG

SEQ ID NO: 2049 - protein, 239 aa, Glycine max
  misc_feature (50)..(50): Xaa can be any naturally occurring amino acid
GRLYSKLLEAVLKTGNRMNVGTTRGGARAFKLDALLKLADVRGADGKTTXVHFVVQEIVRPDGIGVSDSIMGKISQRSKNRSEEEKEEDYKRMGLELVSGLSTELYNVKKTATIDLDVLASSVSNLSEGMKKLQHLVEKELLKNERSMNFVQCMKSFLNYADGNLKELRGDEDIVLARVKEITEYFHGDVISKEDGNPLRIFVIVRDFLGMLDNVCKELRRSKAPRSLNPLAMLPLDRS

SEQ ID NO: 2050 - protein, 138 aa, Glycine max
HGEFKAPYALIYRNMAVGGVEGFSALPQHCLQLCYGFFAFAVVVNMVRDLPPNVFGKWMPLPMVMAIPFLVGAYFAIDMCLGSLVVYVWHKLNTKKAEAMIPATASGLICGEGLWALPASILALAKVNPPICMNFLAS

SEQ ID NO: 2051 - protein, 145 aa, Glycine max
  misc_feature (22)..(22): Xaa can be any naturally occurring amino acid
WIATIPRNRRKVFELFFYTHSXSHTLFIVFFIFHVGIFYACTILPGFYLFLVDRYLRFLQSRRRVRLVSARVLPCETVELNFSKSHDLTYNPTSIMFINVPSISKLQWHPFTITSNSNLEPKMMSIVIKGEGTWSQKLYQMLSTP

SEQ ID NO: 2052 - protein, 248 aa, Glycine max
MGGIAFGRLDDSFSLTSIKAYIAEFHSTLLFVFAGVGSAIAYGKLTSDAALDPAGLLAVAICHGFALFVAVSVGANISGGHVNPAVTFGLALGGHITILTGFFYWIAQLLGSIVACFLLNYVTGGLPTPIHSVASGVGAVEGVVTEIIITFGLVYTVYATAADPKKGSLGTIAPIAIGFIVGANILAAGPFSGGSMNPARSFGPAVVSGDFHDNWIYWVGPLIGGGLAGLIYGNVFIRSDHAPLSSEF

SEQ ID NO: 2053 - protein, 126 aa, Glycine max
  misc_feature (92)..(92): Xaa can be any naturally occurring amino acid
MSSQHADLECQIFPEPDAYEIYHFDRLPDSLLLLDLNKIGEDQALGRCCVFSSRFHSLVPEVENVVVRVDCFIIDEESLSTRRLRQMTLSLXNLIDLGVRGIWKPIQTLCQVLGPKRRFSFCVRGP

SEQ ID NO: 2054 - protein, 490 aa, Glycine max
MSKEEFLKIQKCVLKVNIHCDGCKHKVKKILQKIDGVFTTEIDAEQGKVTVSGNVDPNVLIKKLAKSGKHAELWGAPKPNNNNNNHNHNNQNHLADQLKNMQINNHPKSGGGGGNHNNKGQNQNQPKGGGGGGNSQAKGGGGGGQQQGPTPQQQLQLQLQQQQRLQQQLQQLQQVKGLQDLNLPQFKDLKLPPHNPNPNAKAVKFDIPEEDDDYTDDELDDFDDDDDDFDDEFDDDEMDDLPPSKMKPPPMMMDAPPKAANNGGGGGNNGRKGGGPVPVQVHGIPGNGGGKKGGGGGGGNNQNQLVGNKRNVGKSGGGAPEGKHGGGGNKNGNGNNNNNNGGKKVNPMGGVGVQPMNGGFQNMGGGPHVMSGPNVGPMSMPMPNIPAVQGLPAGPVNGGGFFQGAGPDAMPGNPFQQQQQQQQQQQLQQQYMAAAMMNQQRAMGNDRFQPMMYARPPPAVNYMYPPYPYPPPDPYTHFFSDENTSSCNVM

SEQ ID NO: 2055 - protein, 103 aa, Glycine max
  misc_feature (44)..(44): Xaa can be any naturally occurring amino acid
  misc_feature (56)..(56): Xaa can be any naturally occurring amino acid
  misc_feature (90)..(90): Xaa can be any naturally occurring amino acid
MCVDKYYETNEPYLNALFLLRHTAMDSTTPSIERLFHRREGLYXRGFSYTYDDVIXLPHYIDFADEAWDLCTRLTRHLHLAKPFVASPMXDTVSESAMVRPMA

SEQ ID NO: 2056 - protein, 179 aa, Glycine max
  misc_feature (141)..(142): Xaa can be any naturally occurring amino acid
HQHAVSYCTETHAKKKSYRVGIFVGLIVGILAIIVVLALTIVITCKRYFPWGVSEQHLLHKTVQDSSYAAGISSELLTNARYVSEAAKLGREDLPTCRSYSLEELKEATNNFDNSTFMGENIYGKLYRGKLESGIQVVIRXXPLSKKYSIRNFKLRLDLLAKLRHPHLVSLLGHCMDGA

SEQ ID NO: 2057 - protein, 638 aa, Glycine max
  misc_feature (223)..(223): Xaa can be any naturally occurring amino acid
MIGSLNQVSHVVTTCLVCIFPIPLMASISGICSSSPTLNHSTPKRRRTPLLPSSSFPSKPSPPRSLARETPAPQQQQQQLSAVTKPLHAGLEKKPRALWRRYVEWLYQHKELGLYLDVSRVGFSDDFVREMEPRFHAALRAMEDLEKGAIANPDEGRMVGHYWLRDSARAPTSFLKSQIDNTLVAICTFADDVVTGKIKPPSSPEGRFTQILSVGIGGSALGXPQFVAEALAPDNPPLKIRFIDNTDPAGIDHQIAQLGPELASTLVIVISKSGGTPETRNGLLEVQKAFREAGLSFPKQGVAITQENSLLDNTARIEGWLARFPMFDWVGGRTSEMSAVGLLPAALQSIDIREMLAGAALMDEANRSTVIRNNPAALLALCWYWATDGVGSKDMVILPYKDSLLLFSRYLQQLVMESLGKEFDLNGNRVNQGISVYGNKGSTDQHAYIQQLREGVHNFFVTFIEVLRDRPPGHDWELEPGVTCGDYLFGMLQGTRSALYANNRESITVTVQEVTPRSVGALVALYERAVGIYASLVNINAYHQPGVEAGKKAAGEVLALQKRVLAVLNEASCKEPVEPLTLEEVADRCHAPEDIEMIYKIIAHMAANDRALIAEGNCGSPRSIKVFLGECNLDELYA

SEQ ID NO: 2058 - protein, 269 aa, Glycine max
MYSNVGSQPGVQQPQTSLPPNPFGSAFNVAGSGLIRGGLGAYGGKILGSSSEYVQSNISRYFSDPQYYFQVNDQYVKNKLKVVLLPFLHRGHWTRITEPVGGRLSYKPPIYDINAPDLYIPLMAFGTYVILAGLSLGLHGKFSPEALNLLFIKGLLGWFMQAALLKVTLLSLGSGEAPLLDIIAYAGYTFTGICLAVLGRIILGYSYYFLMPWTCLCMGVFLVKTMKRVLFAEVRSYDSSRHHYLLLFIALVQFPLFTWLGNITINWLL

SEQ ID NO: 2059 - protein, 224 aa, Glycine max
  misc_feature (146)..(146): Xaa can be any naturally occurring amino acid
  misc_feature (215)..(215): Xaa can be any naturally occurring amino acid
MTTSFGGPATTSAPLKDTKLQIPSFHCFSSASASALSRNALSLPSSTRSFSLIRAVSTPAQSETATVKRSKVEIFKEQSNFIRYPLNEDMLTDAPNIGEAATQLIKFHGSYQQYNREERGSRSYSFMIRTKNPCGKVSNQLYLTMXDDLADQFGIGTLRLTTRQTFQLHGVLKKDLKTGMATIIRNMGSTLGACGDLNRNVLAPAAPLVRKDYLXAHQTAENIA

SEQ ID NO: 2060 - protein, 73 aa, Glycine max
  misc_feature (3)..(7): Xaa can be any naturally occurring amino acid
  misc_feature (12)..(12): Xaa can be any naturally occurring amino acid
  misc_feature (22)..(22): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (38)..(39): Xaa can be any naturally occurring amino acid
  misc_feature (43)..(43): Xaa can be any naturally occurring amino acid
  misc_feature (45)..(48): Xaa can be any naturally occurring amino acid
  misc_feature (50)..(50): Xaa can be any naturally occurring amino acid
  misc_feature (61)..(61): Xaa can be any naturally occurring amino acid
  misc_feature (63)..(63): Xaa can be any naturally occurring amino acid
MSXXXXXDFRVXPMKLMDVKDXLIMXKFGSVXPDXYGXXFCEXEXXXXVXRPWHLLWKSRXLXDITVGRSTYS

SEQ ID NO: 2061 - protein, 120 aa, Glycine max
  misc_feature (45)..(45): Xaa can be any naturally occurring amino acid
FGTNKAAQLASSMISSPAVTTVNRAGAGMVAPFTGLKSMAGFPTXKTNNDITSIASNGGRVQCMQVWPPVGKKKFETLSYLPDLDDAQLAKEVEYLLMKGWIPCLEIQLEQRFVFREPHQ

SEQ ID NO: 2062 - protein, 552 aa, Glycine max
  misc_feature (452)..(452): Xaa can be any naturally occurring amino acid
MMNNSNGMISKTSSSSNTAQSQQSQSTGLKMHFKTPEGRYKLHCDKTYPSTLLHYAHGKTVSQVTLAHLKDKPVPLTPTGQSSTFSATSGVRSAAARLWGGSNGGRSLSFVGGNGTSKNLGGNSRIGSIGASSSSNSTTNSNFDGNGTYLIFNVGDAIFISDLNSQDKDPVKSIHFSNSNPTCHAFDQDSKDGHDLIIGLNTGDVYSVSLRQQLQDVGKKLVGAQHYNKDGSVNNSRCTCIAWVPGGDAAFVVAHADGNLYVYEKNKDSAGDSSFAVVKDQTQFSVSHARNSKSNPIARWHICQGSINSISFSTDGTYIATVGRDGYLRVFDYLKEQLICGGKSYYGALLCCAWSMDGKYILTGGEDDLVQVWSMEDRKVVAWGEGHNSWVSGVAFDSYWSSPNSNDDEETIRYRFGSVGQDTQLLLWDLEMDEIVVPLRRPSGGSPTYSAXSQSSQWDSVVPLGTLQPAPSMLDVPKISPLVTHRVHTEPLSGLIFTQESVLTACREGHIKIWIRPAAAESQSSNSETLLSTGLKEKPLILSKIGNSSHRQ

SEQ ID NO: 2063 - protein, 86 aa, Glycine max
  misc_feature (5)..(6): Xaa can be any naturally occurring amino acid
  misc_feature (40)..(41): Xaa can be any naturally occurring amino acid
  misc_feature (43)..(43): Xaa can be any naturally occurring amino acid
  misc_feature (48)..(48): Xaa can be any naturally occurring amino acid
  misc_feature (64)..(64): Xaa can be any naturally occurring amino acid
  misc_feature (67)..(68): Xaa can be any naturally occurring amino acid
  misc_feature (75)..(75): Xaa can be any naturally occurring amino acid
  misc_feature (78)..(78): Xaa can be any naturally occurring amino acid
  misc_feature (82)..(82): Xaa can be any naturally occurring amino acid
LIACXXGSPLLLGVKELAENKEHGSAFEDNKFLSKDGKPXXLXLSSDXHAVVEHTKKVLVIEDXEVXXLKDGGVXIWXFEDXRELF

SEQ ID NO: 2064 - protein, 202 aa, Glycine max
  misc_feature (151)..(151): Xaa can be any naturally occurring amino acid
MSKKKLCMPLSTLLRRSLTSFPQHFTSNFSPQIKLCLHHSSPTFAPPSHNPACDYYYSLRFFGKSLCSKSAEEIQRGCWNCHTVPHSEPFLVCELCQCIQPVDSSIDYFDIFGVERKYDIEGENLEGKYKDWQKKLHPDLVHSKSQVGMMXKERDFAAEQSARVIDAYRTLSKPLSRGIYLLKLYGEAEKESCNPTKLQPIF

SEQ ID NO: 2065 - protein, 79 aa, Glycine max
  misc_feature (2)..(2): Xaa can be any naturally occurring amino acid
  misc_feature (19)..(19): Xaa can be any naturally occurring amino acid
  misc_feature (37)..(38): Xaa can be any naturally occurring amino acid
  misc_feature (41)..(41): Xaa can be any naturally occurring amino acid
  misc_feature (45)..(45): Xaa can be any naturally occurring amino acid
  misc_feature (52)..(52): Xaa can be any naturally occurring amino acid
  misc_feature (55)..(55): Xaa can be any naturally occurring amino acid
  misc_feature (61)..(61): Xaa can be any naturally occurring amino acid
  misc_feature (65)..(65): Xaa can be any naturally occurring amino acid
DXKFRLPHSSSWWKKRLYXFLHDNLKLPDNPLMVIFXXSLXAWLXIILWVIXAPXAHRWDXGPLXILATGFSFLESAKW

SEQ ID NO: 2066 - protein, 499 aa, Glycine max
IRLEISFNNFSGSIPPAFQNLRRLTWLYLQNNSISGAIPDFNLPSLKHLNLSNNNLNGSIPNSIKTFPYTSFVGNSLLCGPPLNHCSTISPSPSPATDYQPLTPPTTQNQNATHHKKNFGLATILALVIGVIAFISLIVVVICVFCLKKKKNSKSSGILKGKASCAGKTEVSKSFGSGVQGAEKNKLFFFEGSSHSFDLEDLLKASAEVLGKGSYGTAYKAVLEEGTTVVVKRLKEVVVGKKEFEQQLEIVGRVGSHPNVMPLRAYYYSKDEKLLVYNYMPGGSLFFLLHGNRGAGRTPLDWDSRVKILLGAAKGIAFIHSEGGPKFAHGNIKSTNVLINQELDGCISDVGLPPLMNTPATMSRANGYRAPEVTDSKKITHKSDVYSFGVLLLEMLTGKTPLRYPGYEDVVDLPRWVRSVVREEWTAEVFDEELLRGQYVEEEMVQMLQIALACVAKGPDQRPRMDQVVRMLEEIKHPELKNYHRQSSESESNVQTPTP

SEQ ID NO: 2067 - protein, 275 aa, Glycine max
  misc_feature (157)..(157): Xaa can be any naturally occurring amino acid
  misc_feature (162)..(162): Xaa can be any naturally occurring amino acid
  misc_feature (170)..(170): Xaa can be any naturally occurring amino acid
EDLPRSNVLYGYRIDGPGDRGKGHRFDSSIVLVDPYAKLVEGRRYFGDISLKLSKFLGTYDFDSLPFDWGENYKLPNISEKDLVIYEMNVRAFTSDESSGLDSNIRGSYLGVIEKIPHLLELGINAVELLPVFEFDELEKLTGFVICYDLICDLFDXFLLCXFILKTCPXGDSGVKGSFCTRVAGSSDLYRVNNRRPYHSINFVIAHDGFTLRDLVSYNFKHNKANGEGGKDGSNDNFSWNCGFEGETDDASIRALRSRQMKNFHLALMISQGTP

SEQ ID NO: 2068 - protein, 100 aa, Glycine max
  misc_feature (28)..(29): Xaa can be any naturally occurring amino acid
  misc_feature (68)..(68): Xaa can be any naturally occurring amino acid
GIGLFLAFIGLQSNQGIGLIGYSASTLXXLGACPTSSRASLAPVLTAANGTVSLLPGGTVSGDILCLXDRMESPTLWLGLVGFIIIAYCLAKNIKGAMIY

SEQ ID NO: 2069 - protein, 162 aa, Glycine max
MSKNRGFNLRRRLIRVSKWIFRKIRTRAPREYHCLGDSPPSPMVKLLTWGRKLTAGAKSRLKVASGSGYAQLGTDPDPSVPKGHLAVYVGQKDGELHRVLVPVIYFNHPLFGELLKQAEEEFGFHHEGGITIPCRFTEFERVKTRIASGSRRGTRPKRLAWR

SEQ ID NO: 2070 - protein, 406 aa, Glycine max
  misc_feature (27)..(27): Xaa can be any naturally occurring amino acid
VKTRKKSKKLSTGAIVAIVVGSVLGLXLLLLLLLLCLRRRRRQPAKPPKAVVEEHSVPAEAGTSSSKDDITGGSAEVERNKLVFFEGGIYSFGLEDLLRASAEVLGKGSVGTSYKAVLEEGTTVVVKRLKDVVVTKKEFETQMEVLGKIKHENVVPLRAFYFSKDEKLLVYDYMSAGSLSALLHGSRGSGRTPLDWDSRMKIALGAARGLTCLHVAGKVVHGNIKSSNILLRGPDHNAGVSDFGLNPLFGNGAPSNRVAGYRAPEVVETRKVSFKSDVYSFGVLLLELLTGKAPNQASLGEEGIDLPRWVQSVVREEWTAEVFDAELMRFHNIEEEMVQLLQIAMACVSLVPDQRPNMQDVVRMIEDINRGETDDGFRQSSDDPSKGSEGHTPPPESRTPPSSLTP

SEQ ID NO: 2071 - protein, 164 aa, Glycine max
  misc_feature (139)..(139): Xaa can be any naturally occurring amino acid
MPADTVGKTITCKAAVAWEAGKDLSIEDIEVAPPKAHEVRIEIYYTGVCHTDAYTLSGKDPEGAFPIVLGHEGAGIVESVGEGVTNVKPGDHVVALYTPECRECKFCKSGKTNLCGKIRATQGKGVMPDGASRFSARGXDLLHFMGTSTFSQYTGVADISVVAI

SEQ ID NO: 2072 - protein, 587 aa, Glycine max
MGVLQEKLSSFYKSRWLVFVAAMWLQSWAGIGYLFGSISPVIKSSLGYNQKQLAMLGVAKDLGDAVGFMTGLLCEILPIWGALLVGAALNLVGYGWVWLVVTSQVPVLPLWAMCALIFVGTNGETYFNTVSLVSCVQNFPKSRGPVVGILKGFAGLSGAILTQIYALFHAPNQASLIFMVAVGPSLVGIGLMFIVRPVGGHKQVRPSDGKCFTLIYGVCLLLAAYLLGVMVVQDLVEVSETVISIFTGVLLLILLVPIVIPITLSFGPEQRHPEVEALLPPPQNKEAGKSQLDSDEVILSELEDEKPKEVDMLPASERQKRIAHLQQRLLQAAAEGAVRVKRRRGPHRGEDFTLTQALIKADFWLLFISMIMGSGSGLTVIDNLGQMSQSLGYDNAHIFVSMISIWNFLGRVGGGYISELVVRDHAYPRPVALAVFQLIMTLGHVFLGMGWPGSMYVGTLLVGLGYGAHWAIVPATASELFGLRNFGALYNFITIANPAGTLVFSSLIASTIYDAEAEKQHRQNMMLRVLNASEPLKCEGSVCFFLTSMIMAGLCVVGAGLCMVLVLRTRIVYANLYGKASSSRLRL

SEQ ID NO: 2073 - protein, 161 aa, Glycine max
MKILEGNAGALTNFEVLDFLRAKGASKDPTRVIAKVSQSEYKVYDYLVDTAASVQTRESINEFLRSVKQHDLAKAEVLNILNIGPAAEVELYPILEESDERFGDEGVTEIVELVKKTLPLPLNMKKEEITKGDEETATLKNEKGNKIRQDQNEDGEEMDTS

SEQ ID NO: 2074 - protein, 391 aa, Glycine max
  misc_feature (89)..(89): Xaa can be any naturally occurring amino acid
MEFNKFRIRSYEGQSDRAQVEDLERRYEVVPLESVSLFTDTMADPICRIRNSPMYMLLSAELDTESVGDIQGTIKVDTVPVHPLKDLSXLGYVLGLMVSPQHRRKGIGSSLVRTLEEWFTSKDVDYAYMATEKDNHASVSLFMDKFGYTKFRTPAILVNPVNHHCFQISPNIEIARLKIDQAEYLYRRFMGSTEFFPNDIGNILRNKLSLGTWVAYFKGDIAWGDFGSDGQVPNSWAMLSVWNSGEIFKLRLGKAPFSCLVCTKSWWLIHKIFPCLKLPTIPDFFNPFGFYFMYGVHHEGPFSGKLVRALCQFVHNMGAESKDESNCRIIVTEVGGRDELNHHIPHWKLLSCPEDLWCIKALKNEGTNNKFHELTTKTPPTRALFVDPREV

SEQ ID NO: 2075 - protein, 67 aa, Glycine max
MASSVISAPAGTTVNRAGAGMVAPFTGLKSMAGCPSRRTKNDVSSIASSGGRVQCMQVWPPVGREEV

SEQ ID NO: 2076 - protein, 89 aa, Glycine max
  misc_feature (4)..(4): Xaa can be any naturally occurring amino acid
  misc_feature (14)..(14): Xaa can be any naturally occurring amino acid
  misc_feature (21)..(21): Xaa can be any naturally occurring amino acid
  misc_feature (26)..(26): Xaa can be any naturally occurring amino acid
  misc_feature (28)..(29): Xaa can be any naturally occurring amino acid
  misc_feature (33)..(33): Xaa can be any naturally occurring amino acid
  misc_feature (41)..(41): Xaa can be any naturally occurring amino acid
  misc_feature (46)..(46): Xaa can be any naturally occurring amino acid
  misc_feature (57)..(58): Xaa can be any naturally occurring amino acid
  misc_feature (63)..(63): Xaa can be any naturally occurring amino acid
  misc_feature (66)..(67): Xaa can be any naturally occurring amino acid
  misc_feature (71)..(71): Xaa can be any naturally occurring amino acid
  misc_feature (78)..(78): Xaa can be any naturally occurring amino acid
  misc_feature (80)..(80): Xaa can be any naturally occurring amino acid
ASSXISSPTVTTVXNRADAGXVATIXGXXSMAXFPTRKTNXDITSXASNGGRLQCMXXWPPVXGKXXFETXSYLPDLXDXQLAKEVEYL

SEQ ID NO: 2077 - protein, 168 aa, Glycine max
MLVYQDLLTGDELLSDSFPYKETENGMLWEVEGKWVVQGAVNVDIGANPSAEGGDEDEGVDDQAVKVVDIVDTFRLQEQPPFDKKQFITYMKRYIKLLTAKLEGEQQELFKKHIEGATKSLLSKLKDLQFFVGESMHDDGSLVFAYYKEGATDPTFIYFAYGLKEIKC

SEQ ID NO: 2078 - protein, 212 aa, Glycine max
MSSLVLLSVLFLLLQRPLSSFSANSEGNALHALRSRLSDPSNVLQSWDPNLVNACTWFHVTCDSNNHVIRLDLGNSKLSGTLGPELAQLPHLQYLELYRNNISGNIPRELSKLKNLISMDLYDNQFHGKIPKSFGNLNSLKFLRLNNNKLTGAIPRELTHLKNLKILDVSNNDLCGTIPVDGNFESFPMESFENNKLSGPELKGLVPYDFGC

SEQ ID NO: 2079 - protein, 274 aa, Glycine max
MLPYGSIPEAAAALGRNLTSAETLWFNYSASKSDYFLYCHNILFLFLVFSLVPLPLVFLELKRFSFVASHKIQPKVRLSLAETFKCYKDVMRIFFLVVGPLQLISYPSIQMIGIRTGLQLPSWREILTQFLVYFLVEDYTNYWIHRFLHNDWGYEKIHRVHHEYHAPIGFAAPYAHWAEILILGIPSFLGPAMVPGHIITFWLWIALRQIEAIDTHSGYDFPRSITKYIPFYGGAEYHDYHHYVGRHSQSNFASVFTYCDYIYGTDKVISSFWN

SEQ ID NO: 2080 - protein, 444 aa, Glycine max
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 2081 - protein, 618 aa, Glycine max
  misc_feature (40)..(40): Xaa can be any naturally occurring amino acid
MKFMKLGSKPDALQSDEKSIRYISSELVTDIIITVGSATXGPPPPKFYLHKFPLLSKSNRLQKLVSKANEENSDDIYLDDFPGGPKTFEICAKFCYGMTVTLNAYNVVAARCAAEFLEMTEDVDRGNLVSKIEVFLNSSIFRRWKDSIIVLQTSKSLLPWSEDLKIVGRCIDSIASKTSVDPAYITWSYTCNRKLTEPDKIVEDKMTFLEKIESVPKDWWVEDICELDIDLYKRVMVAVRSKGRMDGVVIGEALKTYALRWIPDSVDTLVSDANTSRTKSVVETIVCLLPYDNGISCSCSFLLKLLRVAILVGVNESSREELMKSISLKLHEACVKDLLIPARSPQTTTYDVHLVQGILNHHMNHEKGICGMEVAEEKHGGEDKYTLARRSLLNVGKLVDGYLGEIAHDPNLGLSSFVDLSQSIPDFARPDHDGLYRAIDIYLKQHLNLTKAERKKLCGLMDVRKLTAGASVHAAQNERLPLRLVVQVLFFDQVRSSISFRTPGSNSTRDPLCSPLYRDEGCVTTAGDSCQPLKNQMSHLRIKDEELGKKNRKNSKSGIQLLPSRSWRIFDKLWSMRKRHGENRSSETSGSCSSPTSIGQGDTKSYGLSLRHHRHSIS

SEQ ID NO: 2082 - protein, 212 aa, Glycine max
  misc_feature (152)..(152): Xaa can be any naturally occurring amino acid
  misc_feature (192)..(192): Xaa can be any naturally occurring amino acid
  misc_feature (210)..(210): Xaa can be any naturally occurring amino acid
MMNTANGTMISPSSSSGTAAQSPGLKTYFKTPEGRYKLQYEKTHPSGLLHYAHGKTVTQVTLAHLKDKPAPSTPTASSSSSFSASSGVRSAAARLLGGSNGSRALSFVGGNGGSKSNGGNTRISSIGASSTSSAMANPNFDGKGTYLIFNVXDAIFISDLNSQDKDPIKSIHFSNSNPVCHTFDQDAKDGHXLLIGLNSGDVYSVSLRQXLQ

SEQ ID NO: 2083 - protein, 92 aa, Glycine max
MMNTANGTMMSPSSSSVTAQSPGLKTYFKTPEGRYKLHYEKTHPSGLLHYAHGKTGTQVTLGHLKDKPAPSTPTASSSAIKVRAHRGVRSGV

SEQ ID NO: 2084 - protein, 539 aa, Glycine max
MASSLRISRLLSRSFLSASTTTPLFSRGGSGALGAGLSKFSTAAAIEEPIKPPLKVEHTQLLIDGKFVDAATGKTFPTLDPRTGDVISHVAEGDHEDVDRAVAAARKAFDRGPWPKMTAYERQRILLRAADLFEKHNDDLAALETWDNGKPYEQSAQIEIPMLVRLFRYYAGWADKIHGLTVPADGPYHVQTLHEPIGVAGQIIPWNFPLVMFAWKVGPALACGNTIVLKTAEQTPLSALYASKLLHEAGLPPGVLNVISGFGPTAGAAIASHMDIDKLAFTGSTETGKVVLELAARSNLKPVTLELGGKSPFIVCEDADVDEAVELAHFALFFNQGQCCCAGSRTFVHERVYDEFIEKAKARALKRAVGDPFKGGIEQGPQIDSEQFQKILKYIRSGVESGATLETGGDRFGNSGFYIQPTVFSNVKDDMLIAKEEIFGPVQSILKFKDLDDVIQRANNTHYGLAAGVFTKNINTANTLTRALRAGTVWVNCFDTFDAAIPFGGYKMSGQGREKGEYSLKNYLQVKAVVTSLKNPAWL

SEQ ID NO: 2085 - protein, 101 aa, Glycine max
  misc_feature (46)..(46): Xaa can be any naturally occurring amino acid
LCPPVSRRIPLLVLVGQHGAVVPPFPDPALLAPFFHIGAAVEESNXSETLNHILSEMQEKLQNWSNAFGLSFQSQNFEEAKMAIRRMTYYSRVIDEAVKKL

SEQ ID NO: 2086 - protein, 46 aa, Glycine max
  misc_feature (11)..(11): Xaa can be any naturally occurring amino acid
MSRVNIDNVTXLFNNGSFVTLFKFEISYECITALKDDLEWNLIYVG

SEQ ID NO: 2087 - protein, 92 aa, Glycine max
MGFRLPGFRKASFSSNQASSKVEDVPKGYLAVYVGEKMKRFVIPMSYLKQPSFQDLLNQAEEEFGYDHPMGGLTIPCKEDEFLSITSNLNDL

SEQ ID NO: 2088 - protein, 206 aa, Glycine max
MESLEKSISPVAHSLIRFSYGEIMSATRNFSKVAIKRLDKENKESAKAFCRELMIASSLHSSNVVPLLGFCIDPEEGRKKGSSPLLWPVRYKVAIGIAEAVAYLHSGTERCVVHRDIKPSNILLSSRKIPKLCDFGLATWTSAPSLPFLCKTVKGTFGYLAPEYFQHGKVSDKTDVYAFGVVLLELITGRKPIEARRSSGEENLVL

SEQ ID NO: 2089 - protein, 67 aa, Glycine max
MASEEESAVKEPLNLIWLSLDERIYVKLRSDRELRGKLHAYDQHLNIVLGHVEEIVTTVEIIAGKFE

SEQ ID NO: 2090 - protein, 330 aa, Glycine max
MANEIPHDEVVCVTGANGFIGSWLVRTLLEKENPRYTIHATIFPGSDASHLFNLHPSAASRLTLFPADLLDAAALSRAITACSGVFHVASPCTLEDPTDPQRDLLEPAVQGTLNVLTAARRVGVRRVVLTSSISAMVPNPGWPAGRAADEASWTDVEYCKGRGKWYPVAKTEAERAAWAFDGVEVVAVLPATCLGPLLQPDLNASSAVLRELMMGSRETQEYHWLGAVHVKDVAKAHVLLYETPTAAGRYLCTNGIYQFSSFAAMVSELYPEFPIHRFPEETQPGLTACKDAAKRLIDLGLVLTPIQDAVREAVESLIAKGFLQCTPSQS

SEQ ID NO: 2091 - protein, 134 aa, Glycine max
  misc_feature (59)..(59): Xaa can be any naturally occurring amino acid
VVQLDEAAGSDESSQKFRESMNKFMRMAEEEILKVQAQESVALSLWEGGSRSYFHGDSXREEAHPFRIFMVVRDLLTVLDRVGKKVGMINERTMVSSAHRFPVPVNPMLPQPLPGLVGKRQYNSSDDDDHSPSP

SEQ ID NO: 2092 - protein, 65 aa, Glycine max
MEVLRVQVFVMSIVALALAYVAPSINAQVLPPAPAPAPTSDGISVDQGIAYVLMLLALVLTYIIH

SEQ ID NO: 2093 - protein, 250 aa, Glycine max
  misc_feature (85)..(85): Xaa can be any naturally occurring amino acid
  misc_feature (178)..(178): Xaa can be any naturally occurring amino acid
CFDLILLQNGTTEEVKKIVTTLNEAKVPGEDVVEVVVSPPFVFLPVVKSLLRPDFHVSAQNCWVRKGGAYTGEVSAEMLVNLGIXPWVIIGHSERRQLLNESNEFVGDKVAYALQQGLKVIACIGETLEQREAGTTTAVVSEQTKAIAAKISNWDNVVLAYEPVWAIGTGKVATPAQXAQEVHADLRKWVHDNVSAEVAASVRIIYGGSVNGGNCKELAAQPDVDGFLVGGASLKPEFVDIINAATVKKN

SEQ ID NO: 2094 - protein, 191 aa, Glycine max
DSHMVTFLFGLSTGCFVSLFCVYAILAHLCGIFSSSNEPAYMETVYPVFSVFTLLSLHLFMYGCNLFMWKNTRINYNFIFEFSPSTALKHRDAFLISTTLMTTVIGAMVIHLLLRAANFSPTEIDAIPGILLLFFIALLICPFDIFYRPTRYCFIRVICNIVCSPFYKGLLVKLFMADQLTSQIPLLKHLE

SEQ ID NO: 2095 - protein, 362 aa, Glycine max
MASSQPEMEHPKKVFGWAARDSSGLLSPFNFSRRETGEKDLVFKVQYCGICHSDLHMLKNEWGNTTYPLVPGHEIAGVVTEVGSKVQKFKVGDRVGVGCMIGSCRSCESCDENLENYCPKMILTYGVKYFDGTITHGGYSDLMVADEHFVVRIPDNLPLDAAAPLLCAGITVYSPLRYYGLDKPGLNLGVVGLGGLGHMAVKFAKALGANVTVISTSPNKKKEAIENIGADSFVVSREQDQMQAVMGTMDGIIDTVSAVHPLVPLIGLLKPHGKLVMVGAPEKPLELPVFSLLMGRKMVGGSSIGGMKETQEMIDFAAKHGVKPDIEVIPIDYVNTAIERLAKADVKYRFVIDIGNTLKPSS

SEQ ID NO: 2096 - protein, 183 aa, Glycine max
MEESLVPKRPREEAQVEEEKGLNFEEDYSSSSKRHKPYNHILSLLDSEEEDSTQDLSPLMTTLQQEITCASKNTLDALLVCPTQENDQNTLTITSLEDNNATTSQVLKEDEESDKERVMKHLLQASDDELGIPNSGDGLWGFEDNEFTSGDGFSSLCDKLWELEDERANYYAFLQSELFLGGY

SEQ ID NO: 2097 - protein, 151 aa, Glycine max
VSTVGEGKVSSNGHGCCKSRPGYASPLQAISGPRESLIYVTSVYTGTGIEKPDYLATVDVDPHSPTYSKVIHRLSVPYLGDELHHTGWNSCSSCHGDPSADRRFLIVPALVCVILTFPQLNYINLKGHFIHTFIKFIRKRVYIITRVNISI

SEQ ID NO: 2098 - protein, 603 aa, Glycine max
MGNNMATYNKYKSFLFFIRKFKVTEPVSPQDLEEAFSKFTGGGSHMSADELHRFLVEHQGEEDYTLLNSEKVVEKVLKERKRCQESVKVDQNREHEITLDELFRFLLHDDSNGPLKAEVHHDMGAPLSHYFIYTGHNSYLTGNQLSSDCSEEPIIKALKRGVRVIELDLWPTYNKHDIKVDHGWTLTNPASVIKCLESIKEYGFVASQYPVIITIEDHLTTDLRAKFAEMATQIFGEMLFYPGTDCSCLTEFPSPESLKNRVIISTKPPKERFKSNRIKDNPMLNESDSSEEETWGNESPDSNKNEVETEDTNGSDRDEGNVSACECDHKPYQECSPDYKHIITIHNTKLKGCMKDKLKTDGEVRRLSWSEKTLEKASESHGTDILRFTQKNILRVYPSAMRVKSSNFKPHIGWMYGAQMVACNMQGLGKSLWLMQGMFRANGGCGYVKKPQFLMQKHQCDNEFDPTRIQSVKKKTLKVKVYMGHGWSSDFSPTHFDKCSPPDFYTKVRIVGMPADVAKKKTKVMMDDWFPVWDEEFEFSLTVPELALLLIQVKDKDPGKDDFAGQTCLPVSELKHGFRSVPLYNKKGEKFKSVKLLMRFQFE

SEQ ID NO: 2099 - protein, 139 aa, Glycine max
LILGDGLYNFVKILVSSILSVHEKIKNRKNASSADQQRDNAEELKQKEVFLRDNISMWIGTGGYIVLSVISIIVIPLMFPQLKWFYVVVAYFLPPSLAFCNAYGTGLTDMNMAYNYGKVALFVVAAMSGRDNGVVAGLV

SEQ ID NO: 2100 - protein, 224 aa, Glycine max
MSLTIPSNLSKPAALRPKLSPKLRSAATTTIVCSTTNNNNNNNVSSDLKAFSAALALSSILLSAPLPAGADISGLTPCKESKQFAKREKQSIKKLESSLKLYEAGSAPALAIKASVEKTKRRFDNYAKQGLLCGGDGLPHLIVSGDQRHWGEFITPGILFLYISGWIGWVGRSYLIAIRDEKKPTMKEIIIDVPLASRLLFRGFSWPVAAYRELINGDLIAKDV

SEQ ID NO: 2101 - protein, 82 aa, Glycine max
GSLASAIKDFSASENSCLAEQFDKTPDTGNIEEAESSLRESGILNYEEARALLGRYEYQKGNIVAALHVFEGIDIGVVTPKI

SEQ ID NO: 2102 - protein, 89 aa, Glycine max
  misc_feature (23)..(23): Xaa can be any naturally occurring amino acid
  misc_feature (44)..(44): Xaa can be any naturally occurring amino acid
  misc_feature (67)..(67): Xaa can be any naturally occurring amino acid
  misc_feature (77)..(77): Xaa can be any naturally occurring amino acid
PRPANGLTLFLNPAATMHGPNEXFGVAFNGGFNQPIMCGGERRXMTLQERGKADPPIYSIRIRVAQXAVSLIFSFSXGAEWDGPYPLKF

SEQ ID NO: 2103 - protein, 335 aa, Glycine max
MADESVVESPVKRQRDDGEENGVSVSMDAEGGKDPLSNGLSSVIPGWFSEISAMWPGEAHSLKVEKILFQGKSEYQNVMVFQSSTYGKVLVLDGVIQLTERDECAYQEMITHLPLCSIPNPKKVLVIGGGDGGVIREVARHSSVEKIDICEIDKMVVDVSKQYFPDVAVGYDDPRVTLHIGDGVAFLKEVPEGTYDAVIVDSSDPIGPAQELFEKPFFASVAKALCPGGVVCTQAESIWLHMDIIEDIVANCRQIFKGSVNYAWTTVPTYPSGMIGFMLCSTEGPPVDFKHPVNPIDENESQKSVRPLKFYNSEIHTAAFCLPSFAKRKISSKAN

SEQ ID NO: 2104 - protein, 267 aa, Glycine max
  misc_feature (179)..(179): Xaa can be any naturally occurring amino acid
RPLFKEARALLGRLEYQRGNFDAALQVFQGIDIKGLAPRMIKAIAERTKQRKPRSKADIMVPNVMSLRSVSLLLEAILLKARSSEELGQCTEAAKECRIVVDTVESALPNGMPEGIGEDCKLQEMFHEALELLPSLWIKAGLLDEAVTAYRRALVKPWNLEPQRLACVQKDLATTLLYXRLNGITTPMSGTEEAILLLLILSGKMALQEIDWDPEIMDHLTFSLSVTGMFESLADHVEKILPGVHDRAEQWYFLALCYSAAGQNEVA

SEQ ID NO: 2105 - protein, 178 aa, Glycine max
  misc_feature (91)..(91): Xaa can be any naturally occurring amino acid
  misc_feature (100)..(100): Xaa can be any naturally occurring amino acid
  misc_feature (122)..(122): Xaa can be any naturally occurring amino acid
  misc_feature (149)..(149): Xaa can be any naturally occurring amino acid
MASSMISSPAVTTVNRAGPGMVAPFTGLKSMAGFPTRKTNNDITSIASDGGRVQCMQVWPPVGKKKFETLSYLPDLDDAQLAKEVEYLLKXGWIPYLEFXLKHNFVYHKHNKSPIYYNKRYXTICKRAIFICTNTSHILNKRARTNTTXGNNCIRMITCGRHRQLQYISCISYERPSY

SEQ ID NO: 2106 - protein, 387 aa, Glycine max
  misc_feature (337)..(337): Xaa can be any naturally occurring amino acid
MSSQRADLACRIFPEPDASEIDHFDRLPDSLLLLVFNKIGDVKALGRCCVVSRRFHSLVPQVENVVVRVDCVISDDDSSSSAAASDKSRGPFWNLLRLVFGGIVKPIQTLGQFLGPKRPSSSSVTSPSSTTSSSPLAVGTDDDSDAGVTHHSPTQVLKNFNEIRLLRIELPSGELGIEDGVLLKWRADFGSTLDNCVILGASSVFHPKDNLTDPIPTTNCNAYDDNGSIPDSFYTNGGLKLRVVWTISSLIAASARHYLLQPIISEHATLDNLVLTDADGQGVLYMNREQLEELRVKPLSASSASKRTLVPALNMRLWYAPHLELPTGVVLKGATLXAIRPSGLSPNTRKRKTSDLSWVSTAFEEPYRTAATMLVKRRTYCLEMNSF

SEQ ID NO: 2107 - protein, 556 aa, Glycine max
MLVLFETPAGFALFKVLDEGKLSKVEDLWKNFSSADTARQVVKLKAFSKFENTSEALEAATLLIDGKASKGLRKFLRVHCENETLGVADSKLGNVIKEKLKIDCIHNNAVMELMRGVRNQLTELISGLAVQDMAPMSLGLSHSLSRYKLKFSAEKVDTMIVQAIGLLDDLDKELNTYAMRVREWYGWHFPELTKIIQDNILYARAVKLMGDRVNAANLDFSEILPEEVEAELKEASVISMGTEIGELDLANIRELCDQVLSLSEYRAQLYDYLKSRMNTIAPNLTAMVGELVGARLIAHGGSLLNLAKQPGSTVQILGAEKALFRALKTKHATPKYGLIYHASLIGQAAPKFKGKISRSLAAKTALAIRCDALGDSQDNTMGLENRAKLEARLRNLEGKELGRFAGSAKGKPKIEAYDKDRKKGAGGLITPAKTYNPSADSVIGQMVNSAMDEDAQEPSVADKKKEKKEKKEKKKKEKNEGDETVQADGDVGEEPEPEVVKKEKKKKRKETESAELQNGNDDNAGEKKKKRKKHAEKEESPEMPSKKKGKKKKSGD

SEQ ID NO: 2108 - protein, 566 aa, Glycine max
  misc_feature (232)..(232): Xaa can be any naturally occurring amino acid
MQSSISLSSSYAPTISGPRHSFPLSGRTLAPSNLRFCGLRRQAFTSTPLNHHFRLRRRRLPHSAAVSAALSANGTSPKSFDYDLLIIGAGVGGHGAALHAVEKGLKTAIVEGDVVGGTCVNRGCVPSKALLAVSGRMRELRSDHHLKSFGLQVSAAGYDRQGVADHANNLASKIRNNLTNSMKALGVDILTGFGTILGPQKVKVGSSDNVVTAKDIIIATGSVPFVPKGIEXVDGKTVIPRVRALKLETVPDWIAIVGSGYIGLEFSDVYTALGSEVTFIEALDQLMPGFDPEISKLAQRVLINPRNIDYHTGVFASKITPARDGKPVSIELIDAKTKEPKDTLEVDAALIATGRAPFTQGLGLENIDVVTQRGFVPVDERMRVIDANGNLVPHLYCIGDANGKMMLAHAASAQGISVVEQVTGRDHVLNHLSIPAACFTHPEISMVGLTEPQAREKAEKEGFEVSVAKTSFKANTKALAENEGEGLAKLIYRPDTGEILGVHIFGLHAADLIHEASNAIALGTRIQDIKFAVHAHPTLSEVLDELFKSAKVKAEASEPIKEAVAV

SEQ ID NO: 2109 - protein, 408 aa, Glycine max
  misc_feature (226)..(226): Xaa can be any naturally occurring amino acid
SKRIPKCATTTAPLSATPIHQVYVNDQFLNWDPEHRIKVRIVSARAYHSLFMHNMCIRPTPKELEEFGTPDFTIYNAGLFPCNRYTHYMTSSTSIDINIARKEMVILGTQYAGEMKKGLFGLMHYLMPKRYILSLHSGSNMGKDGDVALFFGLSGTGKTTLSTYQNRYLIGDDEHCWSENGVSNIEGGCYAKCVDLSKDKEPDIWNAIKFGTVLENVVFDEHTREXNTRAAYPIEYIPNAKIPCVAPHAKNVILLACDAFGVLPPVSKLNLAQTMYHFISGYTALVAGTEDGIKEPQATFSACFGAAFIMMPPTKYAAMLAEKMQKHGATGWLVNTGWSGGSHGLGNRIKLAYTRKIIDAIQSDKKTYQDTLLKLASLFKKNFDGFTTYKIGGDQKLTEEIVSAGPIF

SEQ ID NO: 2110 - protein, 559 aa, Glycine max
  misc_feature (135)..(135): Xaa can be any naturally occurring amino acid
MGNTCRGSLKGKYIQGFSQPEDHSKRSTTHSDPSSTKQQDDNDNNNNNNNNNNNNNNNNNNLPFNAKREAIMRRGLDNQAYYVLGHKTPNIRDLYTLGRKLGQGQFGTTYLCTENSTSIEYACKSISKRKLISKXDVRGPLGREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKTGQVFTDVVGSPYYVAPEVLLKHYGPEAYVWTAGVILYILLSGVPPFWAETQHGIFDAVLKGLIDFDSDPWPLISDSAKDLIRKMLCSRPSERLTAHQVLCHPWICENGVAPDRSLDPAVLSRLKQFSAMNKLKKMALRVIAESLSEEEIAGLREMFQAMDTDNSGAITFDELKAGLRRYGSTLKDIEIRDLMEAADVDKSGTIDYGEFIAATVHLNKLEREEHLIAAFQYFDKDGSGYITVDELQQACAEQNMTDAFLEDIIREVDQDNDGRIDYGEFAAMMQKGNAGIGRRTMRNSLNLSMRDAPSAQ

SEQ ID NO: 2111 - protein, 78 aa, Glycine max
LKEETCSPLGGYSVWSSLPPINISSLQRSKPILLTVASMDSASFFRDKSLGADSPISVSACASTKILSISGIDYFTGF

SEQ ID NO: 2112 - protein, 433 aa, Glycine max
MEIIMPSLERDLNDTRGYYESGKTKEASWRESQLKGLRRFLIEKQEDIMNALMHDLGKHQLEAFRDEIGTLIKTLNLALKSLKHWMSGKKAALPQLALLTSAEIVPEPLGVVLIISSWNFPFGISLEPLIGAVAAGNAAVLKPSELSPACSSLLASNLSTYLDNKAIKVIQGGPKETQQLLEQRWDKIFFTGSAHVGKIVMSAAVKHLTPVTLELGGKSCIAIDYVLVEKVYCFKLVELMKVWIKKMFGENPQQSKTIAKIVNKHHFSRLKNLLADKKPTILVDPPLEAAIMSEEIFGPLLPIITVEKIEDSIKFINSRPKPLALYVFTKNQTLQRRMISETSSGSVTINDAILQYAVDTVPFGGVGESGFGMYHGKFSFDTFSHQKAIVRRSFLTDFWYRYPPWTLNKLQLLEVSYNYDYLGLLLVLLGLKR

SEQ ID NO: 2113 - protein, 186 aa, Glycine max
DGKTTLLHFVVQEIVRTEGSHISGSNHPHASDNGHQYTLQDEVDFKKLGLQVVSGLSGELTNVKKAAAMDSDVLSSDVAKLSRGIEKVVQVVKWNKELPLKETNKKFSDAMKGFLERGEQELSTIQTQEKNALSSVKEITQYFHENSAKEKAHPFRIFIIIKNCLSILNNIYRKVNKVDKKTLVSS

SEQ ID NO: 2114 - protein, 95 aa, Glycine max
VSDEGGGIPRSGLPKIFTYLYSTARNASWDENEPSDLGTTDNISVKMAGNGYGLPICRLYARYFGGDLQVISMEGYGTDAYLHLSRLGDSQEPLP

SEQ ID NO: 2115 - protein, 229 aa, Glycine max
LPQVIRVIPYSAVQLFAYEIYKKIFKGKDGELSVLGRLAAGAFAGMTSTFITYPLDVLRLRLAVEPGYRTMSEVALSMLREEGFASFYYGLGPSLIGIAPYIAVNFCVFDLLKKSLPEKYQKRTETSLLTAVVSASLATLTCYPLDTVRRQMQLRGTPYKTVLDAISGIVARDGVIGLYRGFVPNALKNLPNSSIRLTTYDIVKRLIAASEKEFQTITEENRNKQKKPQ

SEQ ID NO: 2116 - protein, 165 aa, Glycine max
  misc_feature (56)..(56): Xaa can be any naturally occurring amino acid
  misc_feature (64)..(64): Xaa can be any naturally occurring amino acid
MAERFEEALGTSSVITEGTHVGALNSLRPGIFGKLQQMMLKEKETDMDFWKKLQAXLGQIWLCXFTYNVKIISRYRDGKLTVCHCSFSKSTENFLLQDNSKGMGCGGRKSSQSTIIFSPRVCNNVDLEVGNLIQIHPPWKEAQVGNDNIIVCTYFSEILFQFDSL

SEQ ID NO: 2117 - protein, 531 aa, Glycine max
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVFCMSFVKDAAGYIAVRFLIGVSLATFVSCQYWMSTMFNSKIIGLANGTAAGWGNMGGGATQLIMPLVYELIRRAGATPFTAWRIAFFVPGFMHVIMGILVLTLGQDLPDGNLGALQKKGNVAKDKFSKVLWYAITNYRTWVFALLYGYSMGVELTTDNVIAEYFYDRFNLKLHTAGIIAASFGMANLLARPFGGYTSDVAARLFGMRGRLWNLWILQTLGGVFCIWLGRANSLPIAVLAMILFSIGAQAACGATFGIIPFISRRSLGIISGLTGAGGNFGSGLTQLVFFSTSRFSTSTGLSLMGVMIVCCTLPVTLVHFPQWGSMFLPPSKDVNKSTEEYYYTAEWNEEEKQKGLHQNSLKFAENSRSERGKRVCSSAPTPPNATPTHV

SEQ ID NO: 2118 - protein, 85 aa, Glycine max
VNRAQARMYVICTGHKYMVGFPTRKTNNDITCIVSNGGRVQCMQVWPPFGKKKFETLSYLGDADDAQSLEELQFRFRNEGSLAWI

SEQ ID NO: 2119 - protein, 104 aa, Glycine max
  misc_feature (59)..(59): Xaa can be any naturally occurring amino acid
TVTTVNLARASMDAPFTRLKAMAGLPTNRTNGDLTCIAAGCGSVRCIPFWPPDGTNRQXTLIYLPDLADAHLAKEEQYVVRNGWIACTQDRLDLGSEDTEHDRS

SEQ ID NO: 2120 - protein, 90 aa, Glycine max
CLQLDEILEKQGNKVDKVLNFAIYDAILEERITGHWICPSTGKTYHTKFAPPKVPGVDDVTGEPLIQRKDDPATVLKSRLEAFHKQTEPV

SEQ ID NO: 2121 - protein, 341 aa, Glycine max
PRLSVPEESLLSGNCCSDAAPGLGWDATADTLTAVFGKYGEIEDCKAVTDKVSGKSKGYAFILFKHRDDARKALKHPQKKIGNRTTSCQLASAGPVPAPPPSVTPVSEYTQRKIFVSNVSAEIDPQKLLEFFKQFGEVEDGPLGLDKNTGKPKGFALFVYKSVESAKKALEEPNKNYEGHTLYCQKAVDGPKGSKGYHHQQHSHSHHHHHHHQPHYQRKEKNKYSSGGGGPSHGSGHLMAPSGSAVGGFNPGVPAQGLNPVLGQALTALINQGAGLGLGNLLGGLGGAPVNQGGPPAPYANQPAMGYGNQPAMQPGYQNPQMGQSSGVRPHPGAGAPYMGH

SEQ ID NO: 2122 - protein, 127 aa, Glycine max
ACLQAGLGVGLIGPDAANLVTITACKVVDPETGACVGGKLQSPKFWLGLVGFIITSYGLMKNVKGSMIYGILFVTLVSWFRHTEVTYFPNTPLGDANYNYFKQVIGFHNIESTAGVLRYVIISVHLD

SEQ ID NO: 2123 - protein, 83 aa, Glycine max
  misc_feature (77)..(79): Xaa can be any naturally occurring amino acid
DTHKKSNEAALILIRYGESLWNEKNLFTGCVDVPLSKRGIDEAIEAGKRIRSIPVDLIFTSALIQAQMTAMLAMTQXXXKKVT

SEQ ID NO: 2124 - protein, 217 aa, Glycine max
ERERERERESCSEDPYLAAEGVNHAQRAISNAHGPNEHLKGVALRMLGLCLGKQAKVASSDFERSHLQSKALESLVAAIRLEPNNSDLIFELAVQYAEHRNLPAALRSARHFFNKTGGSVSKSWRLLALILSAQQRFSEAEVVTDAALDQTARWEQGPLLRLKAKLMISQSRPMDAIETYRYLLALVQAQKKSFGPLQISSKVRFCHLLIIFQDSYV

SEQ ID NO: 2125 - protein, 77 aa, Glycine max
  misc_feature (15)..(16): Xaa can be any naturally occurring amino acid
  misc_feature (24)..(25): Xaa can be any naturally occurring amino acid
LQYTSLVITRQIVRXXPSSNDLGXXKMSHSGLQAVSNAIEMFLSEQLLDSEILAGLAIAVIMDGSRTFLIEIQVFSF

SEQ ID NO: 2126 - protein, 346 aa, Glycine max
  misc_feature (229)..(229): Xaa can be any naturally occurring amino acid
MATFEQFWSRKTLLGLALGQFLSLLITSTGFTSSLLAKKGINAPTSQSFLNYVFLSLVYGTILLYRRKALKAKWYYYIILGLVDVEANFLVVKAYQYTSLTSVMLLDCWSIPSVMLLTWLFLKTKYRFKKITGVVVCVAGLVLVVFSDVHSGDRAGGSNPRKGDLLVIAGATLYAISNVSEEFLVKNADRVELMAMLGLSGGIISAIQISILERNELKSIHWSAEAEIXFDYEHAVAMFMFYSLVPVLLKINGSTMLNLSLLTSDMWAVLIRIFAYHEKVDWMYFVSFGAVTIGLIIYSGGDRDDDQHPPNAAIDDHRPAVKQDEEANSGNHSKGTAAGSSKTWVA

SEQ ID NO: 2127 - protein, 471 aa, Glycine max
  misc_feature (97)..(97): Xaa can be any naturally occurring amino acid
  misc_feature (388)..(388): Xaa can be any naturally occurring amino acid
  misc_feature (394)..(394): Xaa can be any naturally occurring amino acid
MEWVKMKGYAREFMVGVAEMTVEFGKGCRDIVKQSLVNDDSYIVKNFGRDSYIGKTVTEPFANLFQKLSFFNEYLPEDKDPLHAWSVIFFVTIHASXNFECDPYAAAAPVKHVFVHPPSATRVVLPDGRYMAYKEQGVSSHKARFSVIAPHSFLSSRLAGIPGVKDSLLQEFGIRLLTYDLPGFGESDPHPNRNLESSATDMAFLANALGVDKFWVVGYSSGSMHAWAALRYIPDRLAGAAMFAPMVNPYDPIMTKEERRRTWNKWTRRRKFMYFLARRFPRLLAFFYQQSFLSGKHGQIDRWLSLSLGNRDKALMEDPIYGEFWQRDVEESIRQRNVKPFMEEAALQVANWGFSLSDLKLQKRKQSSNLLSWLKSMFTETEEYMGLXTYIAMXQGMDDKVVPPSMTDFVHRVLPGAAVHKLPYEGHFTYIYFCHECHRQIFTTLFGTPQGPLSISIEVDQANLEETNIEQ

SEQ ID NO: 2128 - protein, 125 aa, Glycine max
ACSMISSPSVTTVNRACAGMFAPFTGLNSIAGFPIMNTNTDITSIASNGGRVQCMQVWPPVCKKKCETLSYLPDLDDAQSAYEVQHHLMNGWITCLECQLEHCFVYRVHYMSPVYYDGLYWTIWN

SEQ ID NO: 2129 - protein, 163 aa, Glycine max
  misc_feature (87)..(87): Xaa can be any naturally occurring amino acid
  misc_feature (149)..(149): Xaa can be any naturally occurring amino acid
HAGAGMGAPFTGLKSMVGFLTRKTNNDITFIDSNGGRMQCMQVWTRVGMKKLDTLSYLPDLDDAQWAKEVQYLLRKGWIPCLECKLXHGFVYREHNRSPGYYDGRYWIMWKLPMIGCTDASQVTKELQDAKTAYTNGLIPIFGFDNVRXVQSIIFVVYKPPSF

SEQ ID NO: 2130 - protein, 136 aa, Glycine max
HASDHAYGCELRRRSKWLPSMISSPAVTTVNRAGAGMVAPFTGLKSMAGFPTTKTNNDITSIASNSGRVPCMQVWPPACTKNFETLSYLPYLDDAQLAKAVVYLPKKAWISCWAFELEHVYLYREHIMSPGYYYGR

SEQ ID NO: 2131 - protein, 137 aa, Glycine max
  misc_feature (71)..(71): Xaa can be any naturally occurring amino acid
  misc_feature (110)..(110): Xaa can be any naturally occurring amino acid
  misc_feature (131)..(131): Xaa can be any naturally occurring amino acid
KNKLLRTNNEKLTAGSMISCAAVTTVNRAGGDMVATFTGLMSMAGLPTTKTNDDISSIASNGGRVQCMQAXPPVGKKKFETLCYLPDLDDAQLAKEVEYLLRKGWIACWXFELDHRFWYREHNTSAEYYYXRYWTMW

SEQ ID NO: 2132 - protein, 113 aa, Glycine max
  misc_feature (28)..(28): Xaa can be any naturally occurring amino acid
MASSMIWSAAVTTVNRAGAGMVAPFTGXLKSLLGFPTGRPTIAFTSMVGTVGGVHCLQVWPPIARKKFGTLSYLPDLDDAQLAKEVEYLLRKGWIPRLEFELEHGFVYREHNR

SEQ ID NO: 2133 - protein, 115 aa, Glycine max
  misc_feature (39)..(39): Xaa can be any naturally occurring amino acid
  misc_feature (106)..(106): Xaa can be any naturally occurring amino acid
MKPMKKQAGAGMDAPFTGLKSMAGFPTRKTINDFSFIAXFGGRVLCMQVWPPVDKKKFVTLSYLPDLDDAQLAKEAEYLLRKGWIPCLEFQLEHGFLYREHIGSPXYYYGRYWSL

SEQ ID NO: 2134 - protein, 158 aa, Glycine max
  misc_feature (98)..(98): Xaa can be any naturally occurring amino acid
  misc_feature (100)..(100): Xaa can be any naturally occurring amino acid
  misc_feature (115)..(115): Xaa can be any naturally occurring amino acid
  misc_feature (130)..(130): Xaa can be any naturally occurring amino acid
MDSSLISFPAVTTVNRAGAGMVAPFTGLKYMAGFPTIKTNNDITSIASNGGRVQCMHVWPPLGKKKLETLYYLADLDDAQLLEEVEYLLRKGWIPCLXIXLEHGFLYREHNRLPXYYDGRYCTMCKLPMXCCTDASQVSEELQEATTAYSSCFMRIIA

SEQ ID NO: 2135 - protein, 179 aa, Glycine max
  misc_feature (59)..(59): Xaa can be any naturally occurring amino acid
MASSMISSPAVTTVNRAGAGMVAPFTGLKSMAGFPTRKTNNDITSIASNGGRVQCMQAXWHPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 2136 - protein, 170 aa, Glycine max
MQTKQSEIVEEGEPPDSKLKAPQCSEIEEVQQEAVQNLKKSSKVEETDIQCRCLDQVDSLGLILITNRSRYLINWLVNSMRKLKHPNTQGVHLVKIYGPKVKFDRGPALAFNIYDWKGERVEPALVQKLADRSNISISYAFLHHIWFADKYAEEKGKVLQTKVVGGQEGV

SEQ ID NO: 2137 - protein, 188 aa, Glycine max
  misc_feature (72)..(72): Xaa can be any naturally occurring amino acid
  misc_feature (112)..(112): Xaa can be any naturally occurring amino acid
  misc_feature (148)..(148): Xaa can be any naturally occurring amino acid
MLNIWILLSLPHNTELEINRYIPYEVQISANRMKKSECLIDAVIAPGADSIIAIGGIQTIHCRATAVAATYXNLDCFLILRTSDLLVDQDPGLTGNLLVERMVGAHVHLISXQEYAQIGSVTLTHGLNEKLIQGGRRPYGIPVGRSNXSLGTWGYIEAVREIEQQIQKGTGNVKFDDIVVACGRFCST

SEQ ID NO: 2138 - protein, 158 aa, Glycine max
  misc_feature (82)..(84): Xaa can be any naturally occurring amino acid
FAVTTTSSIFPNTQFTNHESLPSLHESFNEFTKVYPQYSETEQVDHVRAKHYFHLSLSNQTCLDYIGIGLFSYSQLEHHETXXXQTGSLKTLLLHGGQDSEFEAAMRKRIMCFLNISENDYFMVFTANRTSAFKLVADSYQFQTSRRLLTVYDYESEA

SEQ ID NO: 2139 - protein, 143 aa, Glycine max
  misc_feature (85)..(85): Xaa can be any naturally occurring amino acid
  misc_feature (93)..(93): Xaa can be any naturally occurring amino acid
  misc_feature (122)..(122): Xaa can be any naturally occurring amino acid
MASSMISSPAVTTVNRAGAGMVAPFTGLKSMAGFPTRKTNNDITSIASNSGRVQCMHVWPPVDKKKFETLSYLPYLDNTQLAKEXEYLLKKEXIPYLEFECKHDFIYHKHNRSPGYYNKHYXTIVKLAIYNYTNTSQILRDLQ

SEQ ID NO: 2140 - protein, 111 aa, Glycine max
  misc_feature (33)..(33): Xaa can be any naturally occurring amino acid
MASSMISSPTVTTANRPGAGLVVQLIGLNSLVXFPTLKTHHDITFIASNGGRVQCMPVWPPVGKKKFETLSYLPDLDDAQLAKEVEYLLMKGWIPCLEFELEHSFLYREHN

SEQ ID NO: 2141 - protein, 178 aa, Glycine max
  misc_feature (86)..(86): Xaa can be any naturally occurring amino acid
MAYSMISSPSVTTVNRACAGMAAPYTGLKFMAGFPTRMTNNDITCIASLCGILQCMQVWSPICKTNSETLSYLPDLDDSHSPEELXYLLRKGWIPCLQFELEHGFVYREHNRSPGYYDGRYWTMWKLPMFGCTDASQVLKELQEAKTAYPNGFIRIIGFDNVRQVQCISFIAYQLPGF

SEQ ID NO: 2142 - protein, 178 aa, Glycine max
  misc_feature (62)..(62): Xaa can be any naturally occurring amino acid
  misc_feature (75)..(75): Xaa can be any naturally occurring amino acid
  misc_feature (122)..(122): Xaa can be any naturally occurring amino acid
  misc_feature (125)..(125): Xaa can be any naturally occurring amino acid
MASSMISSPAVTTVNRAGADMVAPFTDLKSMAGFPDQKTNNDITSIASNGGRVQCMQVWPPXGKKKFETLSYLPXLNNTQLAKEVEYLLRKGWIPCLKFKLKHGFIYQEHNKSPKYYNGHYXTMXKLPMFDCTDASQVLKELQEAKTAYPNNFIHIIKFHNIHQMQYISFITYEPPSF

SEQ ID NO: 2143 - protein, 156 aa, Glycine max
  misc_feature (99)..(99): Xaa can be any naturally occurring amino acid
  misc_feature (101)..(101): Xaa can be any naturally occurring amino acid
  misc_feature (142)..(142): Xaa can be any naturally occurring amino acid
ASSMIYSPTVTTVNRAGAGMVATFTGLKSMAGFPTKNTNNDITSIASNGGRVQCMHVWPPVGKNKDETHCYLPDLDDAQLAKEVEYLFRKGWIPRLEFXVXHGFMYGEHTRSPGYYDGHYWTMWKLPMVCCTDASKVLNDLXDAKTAYPNGFIRII

SEQ ID NO: 2144 - protein, 176 aa, Glycine max
  misc_feature (115)..(115): Xaa can be any naturally occurring amino acid
  misc_feature (143)..(143): Xaa can be any naturally occurring amino acid
  misc_feature (153)..(153): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFLYHEHNRSPXYYDGRYWTMWKLPMFGCADASHVLKDLXDAKTGYPDGXVRIMGCDTFGSADRELICYNLPR

SEQ ID NO: 2145 - protein, 541 aa, Glycine max
  misc_feature (371)..(371): Xaa can be any naturally occurring amino acid
MGCAFGREASREERREEVREAKAEEEGRGEVVENENIEKEGGREERRTRARGERRRSSKPNPRLSNPPNHVHGEQVAAGWPSWLSKTAGEAINGLTPRRADTFEKIDKIGQGTYSNVYKARDTLTGKIVALKKVRFDNLEPESVKFMAREILILRRLDHPNVIKLEGLVTSRMSCSLYLVFEYMVHDLAGLATNPAIKFTESQVKCYMHQLFSGLEHCHNRHVLHRDIKGSNLLIDNDGILKIGDFGLASFFDPNHKHPMTSRVVTLWYRPPELLLGATEYSVGVDLWSAGCILAELLAGKPIMPGRTEVEQLHKIFKLCGSPSDEYWKKSKLPHATIFKPQQSYKRCIAETYKDFPPSSLPAIELTLVMXPDERLTATAALHSEFFTTKPYACEPSSLPKYPPSKEMDAKLRDEEARRLRAAGKANADGVKKSRPRERVGRGIAVPEANAELQANIDRRRLITHSNAKSKSEKFPPPHQDGALGYPLGSSHHMDPVFDPPDVPFSSTNFSQPKANIQTWSGPLVDPSGVGVPRRKKKHGK

SEQ ID NO: 2146 - protein, 354 aa, Glycine max
MCAHVRQTLADLSSQEVADATRIQYGGSVKPNNIKEYMAQSDIDGALVGGASLKVEDFVQLLEDGFANRESEHGNAVKQAHKPNFDRYYEKYPTTQIEASGLDVGLPEGQMGNSEVGHMNIGAGRIVYQSLTRINKSIEDGEFFDNTVLNNAVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDAVIFYNFRPDRAAQLSEIFTNKAFDGFTVEQVDNLFYATFTKYNDDELLYHLI

SEQ ID NO: 2147 - protein, 194 aa, Glycine max
  misc_feature (124)..(124): Xaa can be any naturally occurring amino acid
  misc_feature (162)..(162): Xaa can be any naturally occurring amino acid
  misc_feature (170)..(170): Xaa can be any naturally occurring amino acid
  misc_feature (174)..(174): Xaa can be any naturally occurring amino acid
MVSRPNLDNANMKMPSYFNFPALDVSVAFPQATPASTFPPCASDYFHFNDLLKPEEQAVRNRVRECMEKEIAPIMTEYWEKAEFPFHVIPKFAALRVAGGTIKGYGCPGLSIAGSAVAAAEVAXVDASCSTFCMVHSSLAMLTIALCGSEAQKQKYLPSLAXMKTIACWXALTXPDLWSDASALKTTATKGECG

SEQ ID NO: 2148 - protein, 86 aa, Glycine max
  misc_feature (14)..(14): Xaa can be any naturally occurring amino acid
  misc_feature (17)..(17): Xaa can be any naturally occurring amino acid
  misc_feature (19)..(19): Xaa can be any naturally occurring amino acid
  misc_feature (23)..(24): Xaa can be any naturally occurring amino acid
  misc_feature (28)..(28): Xaa can be any naturally occurring amino acid
  misc_feature (53)..(54): Xaa can be any naturally occurring amino acid
  misc_feature (57)..(57): Xaa can be any naturally occurring amino acid
  misc_feature (63)..(64): Xaa can be any naturally occurring amino acid
FLCLSGWLGWVGRXPLXAXRAGXXPPLXGFFFAVPLASRLLFRGFPWPVAASXXLFXGALLAXXVSLRAGWLPWAWCLWSSPFPFF

SEQ ID NO: 2149 - protein, 401 aa, Glycine max
MSGGGEEGATLEFTPTWVVAAFCTVIVAISLAAERLLHYGGKFLKAKDQKPLYEALQKIKEELMLLGFISLLLTVTQNGITKICVRPSLTLHMLPCNLHDAPANHESHFQTFFPGTARRLLSGEHSTPESASKIGYCSRKIRQWKHWEDSIAKQNYETDRVLKPKVTQVHQHDFIRGRFAGFGKDSAIVGWLLSFLKQFYGSVTKSDYVTLRHGFIMTHCRTNPKFNFHKYMIRALEDDFKQVVGISFCFAFDKLLLAVGTKLEHIITQLAHEVAEKHAAIEGDLVVQPSDDHFWFHRPRVVLFLIHFILFQNAFEIAFFFWIWMGTHYKRAIFNDHLQQNIVGWAQKAKKRKGLKADGNPGQGSSQESANTGIQLGSIFKKATAPGDSSSAPKADGISSV

SEQ ID NO: 2150 - protein, 400 aa, Glycine max
  misc_feature (298)..(298): Xaa can be any naturally occurring amino acid
MEGGEEVLPSATATSAATGNPTASPPPLADLVGAPDLAAASDDVVTQPEIHALISDEEHDHEHEHDDDLEHEHDQHEHDHHHEDRDDHAAVAAVSLEDLKLKIIKQAEYYFSDENLPTDKYLLGFVKRNKEGFVPVSVIASFRKIKKLTRDHAFIVAALKESSLLVVSGDGRRVKRLNPLRFNESRDHKLYTVLVENLPEDHSKKNIQQIFHEAGNIKRITIHDPHSTSESAKQHNKQEMLISNKLHALVEYETMEAAEKAVAMLNNEQDWRNGMRVKLLKGMGKYGHKKTSLERTSXEKNSSRPEQTGDEENHGSNDHHEDTHEEEDGDHLSKDKGGQRYRNQGRSRKHKYRAGNGMGHGSAPSTHAAEASKSPPGPRMPDGTRGFAVGRGRPPVPASN

SEQ ID NO: 2151 - protein, 253 aa, Glycine max
ALSKKCSIQNLKAGLDLLSKLHHPNLVSLFGHCIDGDGQDDSSGLKLHLVYEYVPNGSYRTHLSEFSSDKALKWSDRLAILIGVAKAVHFLHTGVIPGCFRNQLKTNNILLDEHHIPKLSDYGMSIIAEEIEYLEAKGEYPKSCQRAKLEDDVYNFGLILFESLVGPIASKKGEKYFLDEKTSFDSQDGRIKIVDPVVLTTCCPESLSIAISITTKCISPESSAPPSFEDVLWNLQYAAQVQATADAEQKSDS

SEQ ID NO: 2152 - protein, 99 aa, Glycine max
  misc_feature (10)..(12): Xaa can be any naturally occurring amino acid
MTYVGAGMIXXXLVNLSLLLGAVLSFGVVWPLIDLRKGDWFPTNLDESSMKALYGYKVFLTVALILELAILENGEELQVFLRDNISMWIGTGGYIVLSV

SEQ ID NO: 2153 - protein, 144 aa, Glycine max
  misc_feature (11)..(13): Xaa can be any naturally occurring amino acid
  misc_feature (87)..(89): Xaa can be any naturally occurring amino acid
  misc_feature (91)..(99): Xaa can be any naturally occurring amino acid
  misc_feature (101)..(103): Xaa can be any naturally occurring amino acid
  misc_feature (109)..(111): Xaa can be any naturally occurring amino acid
NMTYVGAGMIXXXLVNLSLLLGAVLSFGVVWPLIDLRKGDWFPTNLDESSMKALYGYKVFLTVALILGDGLYNFVKILVSSILSVHXXXKXXXXXXXXXQXXXNGEELXXXQVFLRDNISMWIGTGGYIVLSVVAIIVIPQMFP

SEQ ID NO: 2154 - protein, 176 aa, Glycine max
MSDREDNAPEEFTAEQGIQQDEEIRRIQRENKARVVREGKERRRRWAQKITPRPSKAGEKSEDVGDSEPQKESNTAAGFLPDNIVQMLAAREKQVFLSDNNEEKDEIKPTTSRKRKSRKSGLKPVILSEIGPPPCLNTALDFLKEKQMSVQRSSSVLNNSNKAFRLLSRSGVLRSK

SEQ ID NO: 2155 - protein, 89 aa, Glycine max
  misc_feature (83)..(83): Xaa can be any naturally occurring amino acid
TMIAAPAVTTVHHAGAGMAAPFTGQKSMVGFPTRKTNNGISCIGYNCLRLQCLQVWTPVVKSEVETLSYLPHLVDAQMAKEVXYLIRNG

SEQ ID NO: 2156 - protein, 102 aa, Glycine max
AVKISNWGKVVWAYKPVWALGTGKGATPAQGQEVHADLRKWVHANVRAEVPASVKIIYGGSVNGGNCKKLAAQPDVDGFLGGGASPKGGFVGLITPATVKKN

SEQ ID NO: 2157 - protein, 90 aa, Glycine max
  misc_feature (39)..(39): Xaa can be any naturally occurring amino acid
MGFRLPAVRRASFTASQAASKSVQVPKGYLAVYVGEKQXRFVVPVSYLNQPSFEDLLCQAEEEFGYDHPLGGLTIPCSEDVFQHITSHLN

SEQ ID NO: 2158 - protein, 175 aa, Glycine max
AKLLACIYVFTGMALVGLILSKAADYIVEKQEIFLVRTLFKGENFGPEELSKEVETNKAKYKFILAASVFLVLMISGTIFLHYIENLDFVDALYWVCSTVTTLGYGDKSFSTTIGRAFAVFWILSSTICLAQSFAYLAEFYTEERQKAMAKIVLTPKLSLLDLEAADLDGDHVVR

SEQ ID NO: 2159 - protein, 115 aa, Glycine max
IPLPIAVLPMILFSIGAQAACGATSGIIPFISRRSLGIISGLTGAGGNFGSGLTQLVFFSTSKFSTSTGLSLMGIMIVCCTLPVTLVHFPQWGSMFLPPSKDINMSTEEYYYTAE

SEQ ID NO: 2160 - protein, 84 aa, Glycine max
  misc_feature (40)..(40): Xaa can be any naturally occurring amino acid
  misc_feature (67)..(67): Xaa can be any naturally occurring amino acid
KKLFKREQEEALPQEEEEEEEEEEEEEESESKTDSNKNIXGMAIVKPVFVPKSQRNTIAEREPFEAXELAFEDKRKRELEEPRI

SEQ ID NO: 2161 - protein, 107 aa, Glycine max
EGQLGYPSVDTQPTPRRVSSLRSRIVAVAAANKHTAVVSDLGEDFTWGCNREGQLGYGTSNSASNYTPHVVESLKGKTLTRVSAAKYHTIVLGSDGEVTNCRLLSFC

SEQ ID NO: 2162 - protein, 122 aa, Glycine max
  misc_feature (67)..(67): Xaa can be any naturally occurring amino acid
MPAELLGPCCVHVVGGRDDFDSVPSIFSAYQLIDHKYMKPKSIHNEDILENFSNEYMYLAGIAFVKXVNTGVSAEHSPMLDDISGVPNWNKVNSGLLKMYKAEVLEKVPIMQHFLFGSIIKW

SEQ ID NO: 2163 - protein, 245 aa, Glycine max
  misc_feature (25)..(25): Xaa can be any naturally occurring amino acid
  misc_feature (93)..(93): Xaa can be any naturally occurring amino acid
MADASFFVGVIGNIISILMFLSPTXTFWKIKKQGSTEDFSSLPYICTLLNCSLWTYYGIIKAREYLVATVNGFGIVVETIYVILFLIYAPKGXKGRTAILAVILDVAILAAAVITTQLAFQGKARSGAVGVMGAGLNIVMYFSPLSAMKTVVKTKSVEYMPFLLSFFFFLNGGVWLLYAVLVRDVILGVPNGTGFLLGAMQLVLYAIYRNGKPSSNNRLEEGLQHEPLISQPNKESHQIREDRPI

SEQ ID NO: 2164 - protein, 74 aa, Glycine max
  misc_feature (21)..(21): Xaa can be any naturally occurring amino acid
  misc_feature (23)..(23): Xaa can be any naturally occurring amino acid
  misc_feature (37)..(37): Xaa can be any naturally occurring amino acid
  misc_feature (59)..(59): Xaa can be any naturally occurring amino acid
ASSMISSPAVTTVNRAGGRMXAXFTGLQSMAWLPTRXTHHDITFIASNGGRGPCLPGWXPPFGRRKFRTFSTLP

SEQ ID NO: 2165 - protein, 65 aa, Glycine max
MASEEESAVKEPLNLIWLSLDERIYVKLRSDRELRGKLHTTKRTVPFLFVRGDGVILVSPPLRTT

SEQ ID NO: 2166 - protein, 84 aa, Glycine max
KLKKMVTKNKREKRKGGLFVFPLHSRVTGAPYSYVWMSMAQEHGWRVLLDVCGLKPKEMGTLGMSLFKPDFMVCSFYKVFGENP

SEQ ID NO: 2167 - protein, 265 aa, Glycine max
SARGFTVQVFDGHGGKSAAQFVRDHLPRVIVEDADFPLELEKVVTRSFLEIDAEFARSCSTESSLSSGTTALTAIIFGRSLLVANAGDCRAVLSRGGGAIEMSKDHRPLCIKERKRIESLGGYIDDGYLNGQLGVTRALGDWHLEGMKEMNGKGGPLSAEPELKLMTLTKEDEFLIIGSDGIWDVFRSQNAVDFARRRLQEHNDVKQCCKEIIGEAIKRGATDNLTVVMICFHSEPPPPMVVERPRVRRSISAEGLQNLKCLLEG

SEQ ID NO: 2168 - protein, 188 aa, Glycine max
  misc_feature (138)..(138): Xaa can be any naturally occurring amino acid
  misc_feature (154)..(154): Xaa can be any naturally occurring amino acid
  misc_feature (175)..(175): Xaa can be any naturally occurring amino acid
AALRPKLIPKLMPAATTTIVCSTTNNNNNNNVYSDLKAFSATLALSSILLSDPLPAGADIFGLTPCKELKQFAKREKQSINNLESTLKLYDAGSAPALAINASVDNTNRMLYNYAKHGLLCGCYGSPHLIDSGHHMHXGEFITPGILFLYISGXISCVGTSYLIAITDEMKPTMXEIIIQVPLASSFL

SEQ ID NO: 2169 - protein, 119 aa, Glycine max
MPPMSMHAASLLLEAVFLKAKSFQALGRFQDAAQSCKTILDTVESALPEGWPENFVSDCKLQETVGNAVELLPKLWKLAGSSQDIMSSYRRALLYHWNLDIEATARIQKELSFFLLYSG

SEQ ID NO: 2170 - protein, 42 aa, Glycine max
GFPTTKTNCDITYIASNRGRVLCMRVWPPRGKKNFETLAYLP

SEQ ID NO: 2171 - protein, 79 aa, Glycine max
  misc_feature (30)..(30): Xaa can be any naturally occurring amino acid
  misc_feature (57)..(57): Xaa can be any naturally occurring amino acid
LKSMAGFCTMQNMNDIISIASNGGRVQCLXVWPPVGKKKFETLSYLLDLDDAQFANXVEYLLRNGWILVRYHWSTFVYV

SEQ ID NO: 2172 - protein, 168 aa, Glycine max
  misc_feature (49)..(49): Xaa can be any naturally occurring amino acid
  misc_feature (145)..(145): Xaa can be any naturally occurring amino acid
MIYSPSVTTVNRAGADMGATFTDLNSMAGFPIIKTNNDITSIDTNNGRXQCIQVWPPIGNKKFETLSYLPYLDDAQLAKEVEYLLKKGWIPCLEFKSEHGFLCREHNKTPGYYYRRYCTMWKLPIEGCTDANNVVEEDKHDKTAXPNWLISIFRNDNEMQVHCISVNY

SEQ ID NO: 2173 - protein, 224 aa, Glycine max
  misc_feature (191)..(191): Xaa can be any naturally occurring amino acid
MDTIEQENMQFLGFLGIYKESYKLIFSWRKIFTQITFTLILPLSFIFLIHIQVSDLLFGKITHDAKDLTETLPGTPQHQKLLDTFSSDWATFFLFKLLYFISLLIFSLLSTSAIVYTVASFYTGKEVTFKKVLSVVPKVWKRLMVTFLCTVVAFFVYNVMAVLVLGIWALTIGVRNGGGAILSVLAILYLXGSVYLTVVWLLASVVTVLEDSYWYEALIKSKEL

SEQ ID NO: 2174 - protein, 77 aa, Glycine max
  misc_feature (30)..(30): Xaa can be any naturally occurring amino acid
  misc_feature (52)..(52): Xaa can be any naturally occurring amino acid
TTVNRAGAGMVAPFTGLKSMAGLLTKKTNXDITCIATNRGRVQCMHVWPRVXQEELETLSYLTTMDDTQYQTEAEYL

SEQ ID NO: 2175 - protein, 356 aa, Glycine max
  misc_feature (252)..(252): Xaa can be any naturally occurring amino acid
  misc_feature (323)..(323): Xaa can be any naturally occurring amino acid
  misc_feature (327)..(327): Xaa can be any naturally occurring amino acid
APPPKKLEKNKGVVAAAAVVAENENENEEEKRKRSILEALVEAFSLSSVREASMAYNIAGGDPDRASEILRKGFSDRSEDSFSCFSYGSSSSSSSSSGLELGSKGGWRQQQQQKKMVASTGTVSTVLGKEYVRRNNNNIRNKGLSSNGVFEMEEAEQFLCSMLGDDSDINLAVVRDVLCQCGYDIETASDVLLDLAASTNDKPNTDRHPNYRVDNIDDERFFADPNDSLIDRRSECTSLSSEGYLSDNPWPXEAKGDEYHVFREDSKQQWDSVKSYYTKAATAYTKRERAYAAYLSDQGKEQTRLAQKADTKASHDIFIARNXGIEXMITIDLHGQHVKQSMRMLKLHLLFGSYVP

SEQ ID NO: 2176 - protein, 174 aa, Glycine max
  misc_feature (140)..(140): Xaa can be any naturally occurring amino acid
  misc_feature (154)..(154): Xaa can be any naturally occurring amino acid
MICSLAVTTANRAGAGMVAPFTGLNSMAGLPTTKTNTDITFIACIGGIEQCMQVWPPLGKKKLETLSYLPYLDDAQLAKEVKYLLRKGWIPCLEFNLDHSSVYREHNTSPRYYDRRYCTMSNLTMLGCTDASHVLNELHXAKTAYPNGSVRIIXFDNATQVQCITFIVYNTPAY

SEQ ID NO: 2177 - protein, 65 aa, Glycine max
MIKKLQWQKLKGLVPVILQHAQTDSVLMLGYMNEEAYQKTLKEKKVTFFSRSKQRLWTKGETSGH

SEQ ID NO: 2178 - protein, 49 aa, Glycine max
GTLQPAPSMQNVPKISPVVSHRVHTEPLSILIFTQESILTTYQKKHIKI

SEQ ID NO: 2179 - protein, 95 aa, Glycine max
  misc_feature (54)..(54): Xaa can be any naturally occurring amino acid
ASSKISFPVVTTDNRAGAGMVAPFTGLIFMAGFPTIKTNIDITSIASNGGRVQXFQVWPPAGNKKFETLTFLTDLDNAQLSNEVKYLLKKGWIPC

SEQ ID NO: 2180 - protein, 71 aa, Glycine max
  misc_feature (18)..(18): Xaa can be any naturally occurring amino acid
  misc_feature (41)..(41): Xaa can be any naturally occurring amino acid
PGAGMVVPFTGLKSMVGXPTRKTTIDFTSIVTTGEKFQCMXQVWPPFGKKNFKTFSYLPNLDDPQWAKEVE

SEQ ID NO: 2181 - protein, 184 aa, Glycine max
MEKMELAETPLPLLSLNHVSFVCKSVSESVKFYEDVLGFLLIKRPSSFKFEGAWLFNYGIGIHLLESEKVPVKKREINPKENHISFQCSDMKVIMQKLDAMKIEYVTAVVEEGGIKVDQLFFHDPDGYMIEICNCQNLPVLPISSCPLKQLGGEATFKINCFAEESMSMLMMDNFVMDMLKISI

SEQ ID NO: 2182 - protein, 275 aa, Glycine max
  misc_feature (213)..(213): Xaa can be any naturally occurring amino acid
GGSGITPFISIIRSLIFKANTEGSKTPRVLLVCAFKKSIDLTTIDLILPVSATCTAFDISRLQLQIEAYVTREKQPDMNDKKLIQTLWFKPNALDEPVSAVLGQNSWLYLSIIISSSFMLFLLLIAILTRYYIYPIDHNTDMIYPYFSRSSLSMLFICISIAFVATSAFLWNKKQNKDLGQIKNIYTSNSSTSPGSGYYNADRELGSLPLQSXLVQTAKVHYGERPNIKKILSGCNGSSIGVLVSGPRKMRHEVGSLCTSCSTDDLHFESLSFSW

SEQ ID NO: 2183 - protein, 128 aa, Glycine max
TSVRGSEKDYETDSDGVFGDHKPSDGDLIKGVEGVTGILMVILMAIAFTLATKWVRRNLVKLPKPFNRLTGFNAFWYSHHLFVIVYVLLTIHGVYLYLERRWHLQTVCSIISQLFRIRSIINHKFFFP

SEQ ID NO: 2184 - protein, 92 aa, Glycine max
  misc_feature (44)..(46): Xaa can be any naturally occurring amino acid
KGTLVLLVGGMMSMVVKSKTKDSVKCEVVDGGELKSRRHLNVRXXXATLPSITEKDWDDIKFGVDNKVDFYAVSFVKDAEVVHELKNYLKSK

SEQ ID NO: 2185 - protein, 499 aa, Glycine max
  misc_feature (476)..(476): Xaa can be any naturally occurring amino acid
KVAASEAGGITQGIGAYKVEVPVDGKKLPCVFLDTPGHEAFGAMRARGASVTDMAIIVVAADDGIRPQTNEAIAHAKAAGVPIIIAINKIDKDGANPERVMQELSSIGLMPEDWGGDIPMVPISALKGKNIDDLLETVMLVAELQELKANPDRSAKGTVVEAGLDKSKGPFASFIVQNGTLRRGDIVVCGEAFGKVRALFDDGGKRVDEATPSIPVQVIGLNNVPIAGDEFEVIESLDTARERAETRAESLRNERISAKAGDGKVTLSSLASAVSSGKLSGLDLHQLHIILKVDLHGSIEAVRKALEILPQDNVTLKFLLEATGDVSTSDVDLAVASKAIILGFNVKAPGSVKSYAENKAVEIRLYKVIYELIDDVRNAMEGLLEPVEEHVTIGSAVVRAVFSSGSGRVAGCMVTEGKILQDCGIRVKRKGKVVHVGILDSLRRVKEIVKEVNAGLECGLGLEDFDDWEEGDILEXSTQFRRGGPLKRPQHQWQLLWRE

SEQ ID NO: 2186 - protein, 143 aa, Glycine max
MPWARLSGSPRLDVAIDMGNPFLNLTVDGFLKIGAVAATRSAAEDTYHIIQKGNISSHDFEKTLKKMCKEGVYWGTIAGVYVGMEYGVERIRGTRDWKNAMIGGAVTGALVSAASNNKKDKIAIDAITGAAIATAAEFINYLT

SEQ ID NO: 2187 - protein, 196 aa, Glycine max
  misc_feature (67)..(67): Xaa can be any naturally occurring amino acid
  misc_feature (100)..(100): Xaa can be any naturally occurring amino acid
  misc_feature (129)..(129): Xaa can be any naturally occurring amino acid
  misc_feature (141)..(141): Xaa can be any naturally occurring amino acid
  misc_feature (146)..(146): Xaa can be any naturally occurring amino acid
  misc_feature (179)..(179): Xaa can be any naturally occurring amino acid
EVWNPSGKYRVVSTKPMPGTRWINLLVQNDVRLEICTDNKTILSVEHIITLIDDNYNKVIGQLTKHXRQQLFSTLIKSKCKSFINITINYNNININTTNXYNITIINTPIVLTKTTARVTASLSLTSDXKILNTDDCIKAXYIINXLPHLFIINLLQKQTISLITSNPIICPYTTIMMXKFNINLMYYDLYQSTRL

SEQ ID NO: 2188 - protein, 208 aa, Glycine max
LLGCGVSTGVGAAWRTAAAAPAPPPPIFGLGSIGLAVAEGARLCGATRIIGVDINPEKFEIGKKFGVTDFVNAGECGGKPVGQVIIEITDGGADYCFECVGMASLVHEAYASCRKGWGKTIVLGVDKPGARINLSSYEVLHDGKSLMGSLFGGLKPKSHVPILLKRYMDKELQLDKFVTHEVEFKDINKAFDLLSKGECLRCVIWMDK

SEQ ID NO: 2189 - protein, 394 aa, Glycine max
  misc_feature (68)..(68): Xaa can be any naturally occurring amino acid
MEHKVATTTEGQSIRCKAAICRKAGEPLSIEEIIVAPPMPGEARIRIICSSLCQTDISFRNMQMYLLXLKDHPAIYPRILGHEAIGVVESVGEDVTEVTKGDVVVPIFLPDCGECIDCKSSKSNLCSKFPFEVSPWMPRYATSRFTDLKGEIIHHFLSVSSFSEYTVVDIAHLIKIDPAIPPNRACLISCGISAGIGAAWRAAGVEPGSTVAIFGLGSIGLAVAEGARLCGATKIIGVDVNPERYEIGKRFGLTDFVHSGECENKSVSQVIIEMTGGGADYCFECVGMASLMHEAYASCRKGWGKTIVLGVDKPGSKLNLSCSEVLVSGKSLRGCLFGGLKPKSHVPILLKRYMDKELNLDEFVTHEMEFKDINKAFDLLIEGQCLRCVIWMDK

SEQ ID NO: 2190 - protein, 161 aa, Glycine max
  misc_feature (79)..(79): Xaa can be any naturally occurring amino acid
PRSDCLSLNDSSFSPSLLLLLLLIALSSSSLTESSFNSQAEHTGRNLLQAKKSCPVNFEFLNYTIITCKCKGAQYPPSXLCGIERVVACPYANVLNDLTNDCATIMFSFINLYGKYPPGFFASMCNEGKKGITINCLPAAAASPPSVSADDTGMKTHQMRV

SEQ ID NO: 2191 - protein, 142 aa, Glycine max
  misc_feature (32)..(32): Xaa can be any naturally occurring amino acid
  misc_feature (51)..(51): Xaa can be any naturally occurring amino acid
GYGSQHTNYDITSIASNGGRVQCMQVWPPGGXKKVETVSSLPDLDDAQLAXEVKYLLRKGWIPCLEFELKHGFVYREHNRSPGYYDGRYWTMCEAAMFGCTDASQVSQELQEPRLHTLRLDAFMRFRHVRRALCMSLIAYMP

SEQ ID NO: 2192 - protein, 128 aa, Glycine max
  misc_feature (17)..(17): Xaa can be any naturally occurring amino acid
ASSMISSPPVTTINRAXAGMAATFTGLTSMAGSPTRNTNNDITYIASNSGRVHCMHVWPPDDKKNFETISYLPDLDDAQLAKEVKYLLRKGWIPCLEFELEHGFVFREHNKSPEYYDGHYCTMWKPPI

SEQ ID NO: 2193 - protein, 178 aa, Glycine max
  misc_feature (83)..(83): Xaa can be any naturally occurring amino acid
  misc_feature (86)..(86): Xaa can be any naturally occurring amino acid
  misc_feature (98)..(98): Xaa can be any naturally occurring amino acid
  misc_feature (113)..(113): Xaa can be any naturally occurring amino acid
  misc_feature (137)..(137): Xaa can be any naturally occurring amino acid
MASSMISAPAGTTVNRAGAGMVATFTGLKFMAGFRTRKTNSVITCIASNGGRVQCMQAWPPVGTKKTETLSYLPDLDDAQLAXKYXYLLRKGWIPCLXFELEHGLVFRDHNRXPRYYDGLYWTMSNLSIYSFADAFXVLNELHDAKTAYPNSFIHIIGFYNIHQLHYISFISYIPAVF

SEQ ID NO: 2194 - protein, 66 aa, Glycine max
  misc_feature (17)..(17): Xaa can be any naturally occurring amino acid
  misc_feature (30)..(30): Xaa can be any naturally occurring amino acid
MAGPRIAHATLEGPKCXVRRLCIGMVAGLXAAGSVWRMHHWHEQRKTRAFGDLLEQDGMRVVADEE

SEQ ID NO: 2195 - protein, 206 aa, Glycine max
  misc_feature (39)..(41): Xaa can be any naturally occurring amino acid
LNWGVTKLKSKGLFVKLLEAVLKAGNRMNAGTARGNAQXXXNLASLRKLSDVKTTNGRTTLLHFVVEEVVRLEGKRVSLNRNGNSNSNGNYENNIASNELIEREYVTLGLPIVGGINSELSNVKKAAQIDYNNLVGSISALSTRLVEIRELASLCGNGGNFVKEMDHFLGNAEDELKLVRDKQTSVFQLIKKTTQYYLGGASKETA

SEQ ID NO: 2196 - protein, 98 aa, Glycine max
  misc_feature (52)..(53): Xaa can be any naturally occurring amino acid
  misc_feature (63)..(63): Xaa can be any naturally occurring amino acid
WYLDSFREIRSFPEMKNMNDEKEFTELIKSIKVRHNNVVPTMALGVQQLKNXXEDPDEIDEFXDRIYMSRIGIRMLIGQHVELHNPNPPPHCVGYFPS

SEQ ID NO: 2197 - protein, 97 aa, Glycine max
  misc_feature (57)..(57): Xaa can be any naturally occurring amino acid
YPRARPAYCLKPAGSHGVWGLDNFNFWPLILGSSQLLDPKYMNPKPFHMEDFGENFXNEYSALVGFALSKKEKRGVFADHSPMGEDISGAPKKNREN

SEQ ID NO: 2198 - protein, 151 aa, Glycine max
HILGLTPFQEFKPFPKPEKQSIKKLESSLKLFQAGNAPALAIKANVEKTKKKVHHYPKQGLLCRGDGLPHLIVSGDQKHWGEFITPGILFLYILGLIRWVGPNFLDGNQDQKKPTLEENIIHGSLASCVVFKGFNWPLAAFRELHYRDLIA

SEQ ID NO: 2199 - protein, 284 aa, Glycine max
  misc_feature (57)..(57): Xaa can be any naturally occurring amino acid
MYRERGGVGSKSEVTSVDRKRINDVLDKQLERSSPSTSRAAAMQRQGPLLLFPLSRXKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSNGMAAMLDKYKNYDFGRCPRVYCSGQPCLPVGQSDVPRSSTVKIYCPRCEDIYYPKSKYQDIDGAYFGATFPHLFLMTYGNLKPQKQSQNYVPRVFGFKVHKS

SEQ ID NO: 2200 - protein, 164 aa, Glycine max
  misc_feature (68)..(68): Xaa can be any naturally occurring amino acid
  misc_feature (109)..(109): Xaa can be any naturally occurring amino acid
  misc_feature (116)..(116): Xaa can be any naturally occurring amino acid
  misc_feature (125)..(125): Xaa can be any naturally occurring amino acid
  misc_feature (133)..(133): Xaa can be any naturally occurring amino acid
  misc_feature (135)..(135): Xaa can be any naturally occurring amino acid
VYRASVCMVGPFTGLKSMAGLPTKKTNYDITFIALNCGILQCMRVCPPDGKKKFETLCYLPHLDDAQXAKEVQYLLRKGWIPCLQFQLDHGFVYREHNRSPRYYDGRYXTMWDLPXFGCTDAYQXVKELQEAXTXYPNCFIRIIRFDHLSPSPCINFIAFKSPS

SEQ ID NO: 2201 - protein, 103 aa, Glycine max
MLEDLSNVVSDACICLQNNNIPFNVLISDCGKQVYLLPQLCGVFTKIDEQCYAEKQALGEVNAELLDTQVNPAVWEISGHMVLKRRKDYDEASEGNAWRLLAE

SEQ ID NO: 2202 - protein, 82 aa, Glycine max
MGFRLPGIRKASKAADAPKGYLAVYVGEKLKRFVIPVSYLNQPSFQDLLSQAEEEFGYDHPMGGLTIPCSEDVFQCITSCLN

SEQ ID NO: 2203 - protein, 189 aa, Glycine max
IRLEPTPTRAEVADVSEAVRQRADALMLSGESAMGQYPEKALTVLRSVSLRIEKWWREEKRYEAMLLPSVGSYFSEKISEEICNSAAKMANNLEVDALFVYTKTGHMASLLSRCRPDCPIFAFTTTSSVRRRLNLQWGLIPFRLSFTDDMESNLNRTFSLLKARNLIKSGDLVVAVSDMLQSIQVMNVP

SEQ ID NO: 2204 - protein, 144 aa, Glycine max
  misc_feature (108)..(108): Xaa can be any naturally occurring amino acid
SKNIFYIYDSTSYSFATLIWSLSCQSYWQLETLLLQKDTYLNYSQALSYTSQALSQNLQGLRARSPIRRMSLRMLYYLQENCWQTLGSSIVDFRICIGLFTWKFIEYXRKNAYHIMGNCLLAAKGAAENMKFNMGTYTPCPVWK

SEQ ID NO: 2205 - protein, 275 aa, Glycine max
MASSIGMMDSAYFVGRNQILTWINNRLHLNLSRIEEAASGAVQCQMMDMTFPGVVPMHKVNFDAKTEYDMIQNYKILQDVFNKLKIDKHVEVSRLVKGRPLDNLEFLQWLKRYCDSVNGGIMNENYNPVERRVKVGKDRNHKCSVKSSKSLQTNMINSGSGNTLSPNRTSGTKQFRSNEAAGGVNSSVEIQALSKEITDLKSAVDLLEKERDFYFAKLRDIEILCQTPEVENFSMSVAIKKVLYADDPKESALEEAQDYLNQRLNAVEDEAEIEA

SEQ ID NO: 2206 - protein, 61 aa, Glycine max
AGGCSVGHKCDWKCENEHVCGIMYWWKLSGLTHMCDKKCNQRIVYDNDRCFWGARGEIYKF

SEQ ID NO: 2207 - protein, 314 aa, Glycine max
  misc_feature (277)..(277): Xaa can be any naturally occurring amino acid
  misc_feature (311)..(311): Xaa can be any naturally occurring amino acid
SSQLRRPPPLFTGCSIALVVALIILIHARNILYSEGRTRYMDNIFPLYSLFGYIVLHMIMYSANVYLWRRYKINYPFIFGFKEGTELGYREVFLLSSGLAVLSLAAVLSNLDMEMDQRTKSFSALTELVPLGLVIVLLLITFSPFNIIYKSSRFFLIQCAFHSACAPLYKVNFPENFLADQLTSQVQAFRSLEFYVCYYFWGNFKTRSNNCLKSDVYKAFYLIVAIIPFWIRCLQCFRRLLEERNTMHGLNGLKYISTVVALVLRTTNEFHRGMVWXFLAATSSSIATIVNTYWDTVLDWGFPRKEFKKPXLNP

SEQ ID NO: 2208 - protein, 98 aa, Glycine max
  misc_feature (83)..(83): Xaa can be any naturally occurring amino acid
  misc_feature (87)..(87): Xaa can be any naturally occurring amino acid
TRAESPLFAPFTVLKTMAGLPTIKTTNYITSIANNGGRVQCMQVCPPVGKKKFDTLSYLPNLDDAQLAKEVQYLLRKGWIPCXEIRXDHGLEYREHNR

SEQ ID NO: 2209 - protein, 108 aa, Glycine max
  misc_feature (32)..(33): Xaa can be any naturally occurring amino acid
  misc_feature (47)..(55): Xaa can be any naturally occurring amino acid
  misc_feature (90)..(98): Xaa can be any naturally occurring amino acid
MCKYKARGIKLQGGMGSYLLGMSPYIASQVDXXNTPINTKTISLGWXXXXXXXXXFVGLFSIVPLRKVMILKYKLTYPSGTATALLVNSXXXXXXXXXAKKQVALLFK

SEQ ID NO: 2210 - protein, 345 aa, Glycine max
  misc_feature (22)..(22): Xaa can be any naturally occurring amino acid
  misc_feature (48)..(48): Xaa can be any naturally occurring amino acid
  misc_feature (84)..(84): Xaa can be any naturally occurring amino acid
  misc_feature (98)..(98): Xaa can be any naturally occurring amino acid
  misc_feature (108)..(108): Xaa can be any naturally occurring amino acid
ASRHYATCCYSKPISVDKLGAXCDACSIFIPMEDFGHDHPEPNLTHTXHLVNILYAENEPAFHSSCSMAFASNMDQGNCFFLTXPSDSAAVLPAIARXVLPYIYIRVXGLARSIPKCGALERAAPQLNPPSLQVPTGWKFFGNLMDAGNLSVCGEESFGTGSDHIREKDGIWAVLAWLSIIAHRNKDKNPGEKLISVSDVVMEHWATYGRNFFSRYDYEECESEGANKMIEYLRDILSKSKPGDQYRNYVLQFADDFAYTDPVDGGVVSKQGVRFVFTDGSRIIYRLSGTGSAGATVRVYIEQFEPDVSKHDVDAQIALKPLIDLAISMSKLKDFTGREKPTVIT

SEQ ID NO: 2211 - protein, 76 aa, Glycine max
FCYDVTACETTGNPGEYGFVAHLNEGRHLKKRPTEFRVDKVLLPFGENKFYFTQVGPEKGLFPFEACEDGQVHFFP

SEQ ID NO: 2212 - protein, 99 aa, Glycine max
  misc_feature (51)..(51): Xaa can be any naturally occurring amino acid
ASSMISSPAVTTVNLAGAGMVAPFTGLKSLAGLPTKKTYYDITSLAYTGGXLHCMHVWPPVGRKKFDTLFYLPDLDYAQLAYVLKYLLANGWIPCYEFE

SEQ ID NO: 2213 - protein, 502 aa, Glycine max
MEKMLGRNCGKLKTKIVCTLGPSSRSVEMLEKLLKAGMNVARFNFSHGTHSYHQETLDNLRTAMNNTGILCAVMLDTKGPEIRTGFLNEGKPIQIHRGQEITITTDYSIKGDENMISMSYKKLAHHLSPGSNILCADGTISFTVLECDKENGLVRCHCENSAVLGERKNVNLPGVVVDLPTLTEKDKEDILEWGVPNKIDIIALSFVRKGSDLVEVRNLLGKHAKSILLMSKVENQEGVANFDEILENSDAFMVARGDLGMEIPIEKIFLAQKVMIHKSNIKGKPVVTATQMLESMIKSPRPTRAEATDVANAVLDGTDCVMLSGETAAGAYPDIAVQTMARICSEAESFIDYGDLFKRVMETAPTPMSPLESMASAAVRTANCINAALILVLTRGGTTSKLVAKYRPSMPILSLVVPEITTDSFEWFCSQEAPARHSLIYRGLIPVLGTGSFGDSMTESTEETIQLALSYAKKNDLCKPGDSVVALHRLESGTVIKILDVC

SEQ ID NO: 2214 - protein, 136 aa, Glycine max
  misc_feature (121)..(121): Xaa can be any naturally occurring amino acid
ASSLISSPAATTVNRAGAGLVAPFTGLKSMAGFPTRKTNNDITSIASNGGRVRCMQVWPPIGKKKFETLSYLPYLDDAQLAKEVEYRVKKRLMPYLEFEVKHDCVYREHNRSPRCYNRLYXTMIKLAMFSCTEACQ

SEQ ID NO: 2215 - protein, 121 aa, Glycine max
MLSFSVSGFPPFPLRRAYPRRVSASFDIDTPQDPNSVNPNGSNAKFEEEEEEFRKGKERGRVIGGGGVFIGRKKKAGKEKVQWVCCNCGYSAGQWWGMCRSCSVSGTMKEAKFSDADTGGK

SEQ ID NO: 2216 - protein, 218 aa, Glycine max
  misc_feature (11)..(11): Xaa can be any naturally occurring amino acid
  misc_feature (16)..(17): Xaa can be any naturally occurring amino acid
MAAATRTSLRXLLSVXXTLTLAHLAASNSEGDALYTLKRSLSDPDNVLQSWDPTLVSPCTWFHVTCNQDNRVTRVDLGNSNLSGHLVPELGKLEHLQYLELYKNNIQGTIPPELGNLKSLVSLDLYNNNISGTIPPSLGKLKNLVFLRLNDNRLTGPIPKELAAVSSLKVVDVSNNDLCGTIPTSGPFEHIPLNNFENNPRLEGPELLGLVSYDTNCS

SEQ ID NO: 2217 - protein, 122 aa, Glycine max
MPAERFLKAVLDIPLAFKRIEAMLYRANFETEVNYLRKSFQTLEAASEELKNSRLFLKLLEAVLRTGNRMNVGTNRGGAKSFKLDTLLKLVDIKGTDGKTTLLHFVVQEIIRSEGTGGESAG

SEQ ID NO: 2218 - protein, 138 aa, Glycine max
  misc_feature (126)..(126): Xaa can be any naturally occurring amino acid
TPPLPQSARYGNVSYRTWHEKMSNSAESLIQTLLPENFHPATVELAPYFADSFGNSSRIDYGTGHETNFAAWLYWLARLGVIGEEDFPAVGARGFVKYLDLMRKLQLQYWLEPGWAHGVWGPEDYXFLPFIFGGFQVD

SEQ ID NO: 2219 - protein, 126 aa, Glycine max
MNTESSTSQFPVSQLNFSRQIKGNETEIIISRYEDHFMVIATQIGTMGTIMYARKEEGVSINPTFNVSVIFGKRDEPMLVACARQLIEHMSLSGSSRPLVLSLGLKDHSVETLKGIVSAVMDNSMW

SEQ ID NO: 2220 - protein, 386 aa, Glycine max
MEGEEGSQQPQLVLGDKLFLLRQPDVQDIDKVRYKEDVFTHINQNEMVPLYETLVADSVLDLDRALLDSMRAKIEDELTKLDEKIADAEENLGESEVREAHLAKSLFFIRIMDKEKALEHLKITETKTVAVGQKMDLVFYTLQLGFFDMDFDLISKSIDKAKNLFEEGGDWERKNRLKVYEGLYCMSTRNFEKAAKLFLDSISTFTTYELFPYDTFIFYTVLTSIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTVDFIDVELSRFIAAGKLHCKIDKVAGVLETNRPDAKNALYQATIKQGDFLLNRIQKLSRVIDL

SEQ ID NO: 2221 - protein, 333 aa, Glycine max
HASADAWVSCVFRGRVGILRTAVAIKRLDKENKESAKAFCRELMIASSLHSSNVVPLLGFCIDPEEGLFLVYKYVSGGSLERHLHGRKKGSSPLLWPVRYKVAIGIAEAVAYLHSGTERCVVHRDIKPSNILLSSRKIPKLCDFGLATWTSAPSVPFLCKTVKGTFGYLAPEYFQHGKVSDKTDVYAFGVVLLELITGRKPIEATRPSGDENLVLWAKPFLQKGKGAIEELLDPQLKCSLKFSNQMGRMIEAAAACVTNEESRRPGIREIIAILKGEEEPLLSKRKKSSFLGNGCVIDCYSQLQQTNNEMKSHLALAMLGVAEFEDDDYLYGR

SEQ ID NO: 2222 - protein, 386 aa, Glycine max
  misc_feature (20)..(20): Xaa can be any naturally occurring amino acid
MEHKLATTEGQPIRCKAAVXRKAGEPLGIEEIMVAPPMPGEARIRIICSSLCRTDISFRNMQGPPANFPTILGHEAIGVVESVGEDVTEVAKGDMVVPIFIAECGECIDCKSSKSNLCSKFPFKVSPWMPRHATSRFADLKGEIIHHFLSVSSFSEYTVVDIAHLIKIDPAIPPNRACLLSCGVSTGVGAAWRTAGVEPGSTVAIFGLGSIGLAVAEGARLCGATRIIGVDVNPERYEIGKKFGITDFVHSGECEKKSASQVIIEMTDGGADYCFECVGNASLMHEAYASCRKGWGKTIVLGSDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 2223 - protein, 138 aa, Glycine max
  misc_feature (26)..(26): Xaa can be any naturally occurring amino acid
GRHKMLGKLVRYNLKKISFNFSHGSXSYHQETLDNLRTALNNTGILCAVMLDTKGPEIRTGFLKQGKPIEIQRGQEITITTDYSIKGDENMISMSYNKLAHHLSPESNILCADGTISFTVLECDMENGLVRCRCENSA

SEQ ID NO: 2224 - protein, 175 aa, Glycine max
  misc_feature (18)..(18): Xaa can be any naturally occurring amino acid
AAAKAAKDAGVVLSYDPXNLRLPLWPSADSAREGILSIWETADIIKISEEEISFLTKGENPYDDAVVHKLFHPSLKLLLVTEGAEGCRYYTKEFSGRVKGLKVDAVDTTGAGDAFVAGILSQLAVDLSILQNEDELRDSLKFANVCGALTVTERGAIPALPTKEAVLNAMLKPVS

SEQ ID NO: 2225 - protein, 499 aa, Glycine max
MAAMQRPLKRTIAIAKLRACFSSLRPAAAADIVASPPPQLPPFDHQPHPYNGPFADEVLAKRKTFLGPSVFHYYKKPCRCVSDQAKIYGFSKLNIVEGKMQYLYDDSGRRYLDAFAGIVTVSCGHCHPEILNAITEQSKLLQHATTIYLHHTIGDFAESLAAKMPGNLKVVYFVNSGSEANELAMMMARLYTGSLGMISLRNAYHGGSSSTLGLTALNTWKYPIPEGHVHHVMNPDPYRGAFGADAASYANDVQDHIDYGTSGKVAGFIAETMQGVGGAVELAPGYLKLVYDIIHKAGGVCIADEVQTGFGRTGSHYWGFETQGVIPDIVTMAKGIGNGLPLGAVVTTPEIASVLAQKIQFNTFGGNPVCSAGGLAVLRVLDKEKRQAHCADVGSHLLERLRFLMERHDRNVRGRGLMVGIELVTDRDNKTPAKAETAVVFEKLRELGVLVGKGGLHGNVFRIKPPMCFSKDDAGMVVSRSLNLDADSRFYFGAFFQAK

SEQ ID NO: 2226 - protein, 195 aa, Glycine max
  misc_feature (105)..(105): Xaa can be any naturally occurring amino acid
RKAKIFHYGSISLITEPCQSAHIAAAKDAGVVLSYDPNLRLPLWPSADSAREGILSIWETADIIKISEDEISFLTKGEDPYDDAVVHKLFHPNLKLLLVTKGAEXGCRYYTKEFSGRVKGLKVDAVDTTGAGDAFVAGILSQLAVDLSILQKEDELRDSLKFANVCGALTVTERGAIPALPTKEAVLNAMLKPVS

SEQ ID NO: 2227 - protein, 134 aa, Glycine max
MTGTGSPCGACKFLRRKCVRGCVFAPYFCQEQGATHFAAIHKVFGASNVSKLLAHLPVSDRCEAAVTISYEAQARLQDPIYGCVSHIFALQQQVVNLQAQLAYLKEQAAQSCLNGTINENPNEKLLEKSSAALP

SEQ ID NO: 2228 - protein, 108 aa, Glycine max
GSRKGKTLTRVLAAKYHTIVLGSDGEVFTWGHRLVTPKRVVVSRNLKKSGSTPLKFHRKERLNVVSIAAGMVHSMALTDDGALFYWVYSDPDLRCQQLYAMCGRNMTI

SEQ ID NO: 2229 - protein, 54 aa, Glycine max
KAGIELYFSVDKQVTSLELSTGIPLLYIYKEGKFNSRGSPVGPTEAGVYAYTQV

SEQ ID NO: 2230 - protein, 166 aa, Glycine max
MAPHGESFSRKSNMSKPQKLSSENLQRTVSDISFELTKEEIDDLKLPTISEVENAKCECCGMCEECTPEYIDRVREKFNGKWVCGLCAEAVKEELEKNGGKKEEAVSAHMSACVRFNKYGRAFPVLFQAQAMKEMLKKNTRDKGGAKKGGIARSSSCIPAITREIN

SEQ ID NO: 2231 - protein, 183 aa, Glycine max
MAPHGESFSRKSNMSKPQKLSSENLQRTVSDISFELTKEEIDDLKLPTISEVENAKCECCGMCEECTPEYIDRVREKFNGKWVCGLCAEAVKEELEKNGGKKEEAVSAHMSACVRFNKYGRAFPVLFQAQAMKEMLKKNTLDGRRAKSISPRDKGGAKKGGIARSSSCIPAITREINDIKIAN

SEQ ID NO: 2232 - protein, 348 aa, Glycine max
MGSASESVCVTGASGFIGSWLVMRLIERGYTVRATVRDPVNMKKVKHLVELPGAKSKLSLWKADLAEEGSFDEAIKGCTGVFHVATPMDFESKDPENEVIKPTINGVLDIMKACLKAKTVRRLIFTSSAGTLNVIERQKPVFDDTCWSDVEFCRRVKMTGWMYFVSKTLAEKEAWKFAKEQGLDFITIIPPLVVGPFLMPTMPPSLITALSPITGNEDHYSIIKQGQFVHLDDLCLAHIFLFEEPEVEGRYICSACDATIHDIAKLINQKYPEYKVPTKFKNIPDQLELVRFSSKKITDLGFKFKYSLEDMYTGAIDTCRDKGLLPKPAEKGLFTKPGETPVNAIMHK

SEQ ID NO: 2233 - protein, 475 aa, Glycine max
TRPYGCEKTTEGEAINGLTPRRADTFEKIDKIGQGTYSNVYKARDTLTGKIVALKKVRFDNLEPESVKFMAREILILRHLDHPNVVKLEGLVTSRMSCSLYLVFEYMDHDLAGLATSPTIKFTESQVKCYMHQLLSGLEHCHNRHVLHRDIKGSNLLIDSEGILRIADFGLASFFDPNHKHPMTSRVVTLWYRPPELLLGATDYGVGVDLWSAGCILAELLAGKPIMPGRTEVEQLHKIFKLCGSPSDEYWKKLKLPHATIFKPRISYKRCIAETFKNFPASSLPLIEILLAIDPAERQTATDALHSEFFTSKPYACEPSSLPKYPPSKEMDTKLRDEEARRLRAAGKANAAGVKKSRPRDRGGRGISVPDSNAELQANIDRWRLVTHANAKSKSEKFPPPHEDGTLGYPLGSSHHMDPIFDPPDVPFSSTNLSYPKANFQTWSGPLVEPSVDAPRRKKNMAGNGHRQSKKDSYR

SEQ ID NO: 2234 - protein, 174 aa, Glycine max
  misc_feature (37)..(37): Xaa can be any naturally occurring amino acid
  misc_feature (86)..(86): Xaa can be any naturally occurring amino acid
  misc_feature (143)..(143): Xaa can be any naturally occurring amino acid
MVPSVISSPAETTVNRAGAGMADPLTALKSMDGCPTXNTLIDFTSFASNGGRAQNMQAWPPVDNKKYETLYYLPDLDPAQPAKDGXYLLRTGWTPRLELELEHGFWCREHNRPPEHYDGRYWTMWKLPIMTYTDAYHASKDLXEANTAYPNGFIRIIRFNTVRQVHHMNLIDYK

SEQ ID NO: 2235 - protein, 143 aa, Glycine max
MGACASSPSAKTTAASVNKGGGGGGAPASESFRRPSSIMVMDMLGRINEYKQPIPARNVLSENPHFYLCNSETVHIGTCMPRVPDEEELLPGRIYFLVPLSHSDSPLSLPLLCDLAVKAGSALPNPNNNSSNGHRKKASVTRR

SEQ ID NO: 2236 - protein, 652 aa, Glycine max
  misc_feature (47)..(47): Xaa can be any naturally occurring amino acid
  misc_feature (218)..(218): Xaa can be any naturally occurring amino acid
  misc_feature (228)..(228): Xaa can be any naturally occurring amino acid
  misc_feature (389)..(389): Xaa can be any naturally occurring amino acid
  misc_feature (597)..(597): Xaa can be any naturally occurring amino acid
LEILLTASTNKLSVTHDEAEDYASLIMKFLDKKNKGYIEISQMGSLXQGNNYLSNSKAHSPMKQVSSVGSSTHNVLHNTSGDFCEEQQEPMSRTEVLFRTYWRRAWIVLVWLLACLGLFVWKFVQYRHRSGFEVMGYCLPTAKGAAETLKLNMALVLLPVCRNTITWLRIHRPINSVVPFNDNINFLRLTAGGVVAAVVLRGGTRLASVFPASCVSAXHQYSGKLLPXFGYHRPTYTQILATTEEASGIGMVVLMGIAFALAAKWPRRRSPVLPVSLRRVTGYNTFWYSHHLFVLVYALLIIHSMFLFLTDKLMEKTTWMYIASPQYVGPPPPLFRAIRSGSYEVDILKASICPGKVLYLKMQKPEGFKFHSGMYIFIQCPQISPFEWXPQDDYLSVHIRTLGDWSYQIYDLFQEAVLSRSKGCPKLYIDGPYGSAAQDHVKYDILVLIGLGIGATPFISILKDVVKGVQTTQNDHRGLRQCSLTKGPLKAYLYWVTREPNSFDWFRDVMKEISNSTKKQVCLTTICFDHGIDIMLTAKTIFLIIFKSVVEMHNFLTSVHPEGDIRSALLSVIQALHVAKNGTDIVSRTQIHTHFAXPNWFNIFSRLARKHGGAKIGVFYCGPSKLARELKKLCTKFSTKTTTRFVFHKENY

SEQ ID NO: 2237 - protein, 367 aa, Glycine max
  misc_feature (314)..(314): Xaa can be any naturally occurring amino acid
  misc_feature (328)..(328): Xaa can be any naturally occurring amino acid
  misc_feature (334)..(334): Xaa can be any naturally occurring amino acid
MSTAGQVIKCRAAVAWEAGKPLSIETIEVAPPQKGEVRLKILFNSLCRTDVYWWDAKGQTPLFPRILGHEASGIVESVGKGVTHLKPGDHALPIFTGECGECTYCKSEESNLCELLRINTDRGVMLSDGKTRFSKNGQPIYHFVGTSTFSEYTVLHEGCVAKINPAAPLDKGAVGRCGFCTRSGATVNVAKPKPNNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKVMEXGRTLKGTFYGHYRXPRTDIXGGCWRSTFNQGAGWDKIYHLLLVPFFRSTTCNL

SEQ ID NO: 2238 - protein, 167 aa, Glycine max
GKPVSRAPLVPVMAPVAPVKPSLLDSIGRAKLPSVKGGGITQHIGASHLKPKRGMVPFLDTPGHVAFTPMGARGAKAPDMVILVVAADDGVMPQTQEAVQHAKAAGVPIVVAVNKIDKPDANPDNIKNGLAALDVIPEEWGGDAPYVHVSAKMGTGIDELLEAVLLQ

SEQ ID NO: 2239 - protein, 397 aa, Glycine max
MACPAMANGNDSLNLKPNETKGKTITCKAAVAYGPGEPFVVENILVHPPQKMEVRIKILYTSICHTDLSAWRGVNEAQRAYPRILGHEASGIVESVGEGVSEVEEGDIVVPIFNGECGECSLCKCEKTNKCEIFGVNPMKKVMEGDGTSRFSTVHGKPIFHFLNTSTFSEYTVVDSACVVKFVSTDHSLSIKNLTLLSCGVSTGVGAAWNTANVHSGSTVAVFGLGAVGLAVAEGARARGASKIIGVDINPDKFIKAMGVTNFINPKDEEKPVYERIREMTDGGVHYSFECTGNVDVLRDAFLSAHEGWGLTVVLGIHASPTLLPIHPMELFDGRNIVGSVFGGFKGRSHLPHFAKQCGQGVVKLDNFITHELPLEEIDKAFDLLITGKSLRCLLHF

SEQ ID NO: 2240 - protein, 84 aa, Glycine max
  misc_feature (10)..(10): Xaa can be any naturally occurring amino acid
SLSIEPDYIXSIISHAKLLLKLGMQSLPIARSFLMNALRLDPTHHDAWFNLGLVSKMEGSLQQAADCFQAAYELKLSAPVQKFE

SEQ ID NO: 2241 - protein, 120 aa, Glycine max
  misc_feature (37)..(37): Xaa can be any naturally occurring amino acid
  misc_feature (63)..(63): Xaa can be any naturally occurring amino acid
  misc_feature (97)..(97): Xaa can be any naturally occurring amino acid
AISMIFTPAATTVNRAGAGMVAPFTGLKSMDGFPTKXTNNDITSIASNGGRVQCVHVWPSVGXKKSETLYYLPYLDDAQLAKEVEYLLTKGWIPCLXLQWEHGYLYRDHNRSPRYYRWTL

SEQ ID NO: 2242 - protein, 77 aa, Glycine max
ISSPAVATVNRAGACMVAPFTGLKSMDGFPTINTNDDVASIAIYGVTVQCIQVWTPVGRRKFDTLSYLPDLDDAAIG

SEQ ID NO: 2243 - protein, 63 aa, Glycine max
MAVSSASLRVVAFLSLILAALMTVASSQVTAPAPAPTSDGTTIDQAVAYVLMLVALVLTYIMH

SEQ ID NO: 2244 - protein, 76 aa, Glycine max
QFYFDFSSTYVGVGMICPYLINASLLLGAVISWGILWPWIEHKKGIWYSADLPGSSLSGIQGYRVHTYPLRNLYCS

SEQ ID NO: 2245 - protein, 86 aa, Glycine max
MASSMISSPAVTTVNRAGAGMVAPFTGLKSMAGFPTRNTNSDITCVASNGGRVRWVRVWPPIGEREWESVCSLPNVPDRAVRGDVQ

SEQ ID NO: 2246 - protein, 181 aa, Glycine max
  misc_feature (59)..(66): Xaa can be any naturally occurring amino acid
KFGKEYTSQMVPEWQEAYMDYNFLKSLLKEIQRFKLRNKPSLTPSGLRRKLTLYRAFSXXXXXXXXVSHSPSHQEQDIESQPIIVNRDGSENKYETTFLMTSEEGGEYELVYFKRLDDEFNKVDKFYKSKVEEVMKEAAMLNKQMDALIAFRIKVEKPSLLLFDHSVEMTRLASDVASSSA

SEQ ID NO: 2247 - protein, 345 aa, Glycine max
ASRCLKCGEHSGGEWTCPLHNHIPQWIELVKAGNIDAAVELSHQTNTLPEITGRVCPQDRLCEGACTIRDEHGAVTIGNIERYISDQALAKGWRPDLSHVTKVDKRVAIIGAGPAGLACADVLTRNGVGVTVYDRHPEIGGLLTFGIPSFKLDKSLLARRREIFSAMGIHFELNCEVGKDVSLDSLLEQYDAVFVGVGTYRSMKAGLPNEDAPGVYDALAFLIANTKQVMGLEELPEEPFINTAGLNVVVLGGGDTAMDCVRTALRHGASNVTCAYRRDEANMPGSKKEVKNAREEGANFEFNVQPVALELNEQGHVCGIRFLRTRLGEPDAQGRRRPVPVEGSE

SEQ ID NO: 2248 - protein, 127 aa, Glycine max
IILHAGDHLACDFPRLVSTSEERYEKYLKGVFGDHKPSYVDLVKGVEGVTGILMVFLMIIAFTLATKWFRRNLIKLPKPFSRLTGFNAFWYSHHLFVIVYVLLIIQLNLSSTRSISKEFERSTPNCI

SEQ ID NO: 2249 - protein, 501 aa, Glycine max
MTSLTNGDAGSLNKVPTIKFTKLFINGDFVDSLSGKTFETIDPRTGDVIARISEGDKEDIDIAVKAARHAFDNGPWPRLPGSERARILLKWAEIIEENAEELAALDAIDAGKLYHMCRNVEVPAAANTLRYYAGAADKIHGEVLKMSREFHAYTLLEPLGVVGHITPWNFPNTMFYIKVAPSLAAGCTMVLKPAEQTPLSALFYAHLAKLAGIPDGVINVVPGFGPTAGAALSSHMDVDKVSFTGSTQTGREIMQAAAKSNLKPVSLELGGKSPLIIFDDADIDKAAELALFGIISNKGEICVASSRVFVQEGIYDEFEKKLVEKAKSWVVGDPFDPKVQQGPQVDKNQFEKILSYIEHGKREGATLLTGGKTVGNKGYYIEPTIFSNVKEDMLIAQDEIFGPVIALMKFKTIEEAIKSANNTKYGLAAGIVTKNLDTANTVSRSIRAGIVWINCYFAFGDDVPFGGYKMSGFGRDHGLEALHKYLQVKSVVTPLYNSPWL

SEQ ID NO: 2250 - protein, 687 aa, Glycine max
  misc_feature (194)..(194): Xaa can be any naturally occurring amino acid
MALIPSMMLFSFLSFLVILKSEANNDQLQFVYHYCNNEYGNITTETYSDNRNNLLSNMYYDKENDYGFYNSSYGQDPDKVYAIGFCRGDANLDKCRSCLEKSAVLLRERCPVQKEGIGWFDECMLRYTNHSIFGVMVTQPNNIMCNTKNAPKDPRSAAGFDQVVHNLLNELRNRTTTVADPESDSSRSRKFFAXESAPVQSSNVTIHALLQCAPDLSRQNCTRCLEHAMSRISYCDGKRGGRYLGPSCSVRYETYPFFEPIVHHAPPPQPAPQVTTTTGKEKSNPSRTIIAIVVPVVAVVVLLVAFTYNYLGARRRRQKPFQSEGGEGELDNDIKIDELLQFDFATIKFATNNFSDANKLGQGGFGIVYKGTLSDGQEIAIKRLSINSNQGETEFKTEILLTGKLQHRNLVRLLGFCFARRERLLIYEFVPNKSLDFFIFDPNKRGNLNWERRYNIIRGIARGLLYLHEDSRLQVVHRDLKTSNILLDGELNPKISDFGMARLFEINQTEASTTTIVGTFGYMAPEYIKHGQFSVKSDVFSFGVMILEIVCGQRNSQIRGSEENAQDLLSFAWKNWRGGTVSNIVDATLKDYSWDEIRRCIHIGLLCVQEDIADRPTMNTVLLMLNSSSFPLAKPSEPAFLMRDKSSLPTAMLSGGQHSEVTRSGYSGSQSAQESSIMAPITEPYPR

SEQ ID NO: 2251 - protein, 158 aa, Glycine max
  misc_feature (114)..(114): Xaa can be any naturally occurring amino acid
  misc_feature (145)..(145): Xaa can be any naturally occurring amino acid
ALSMIASITDTTVNLAGAGLDATSTGLKPMVGCPTMKTNNDITYIANNGGRAQCMQVWTPFGSKKYETLSYLPDLDEAQSAKEVEYLIKKGWITCLEYKLDHSFLYRELKMPPXYFEGLSWSLWKVPMFGSTDTSHVLNELQYAXTAYPDSQIRIIGF

SEQ ID NO: 2252 - protein, 369 aa, Glycine max
  misc_feature (197)..(197): Xaa can be any naturally occurring amino acid
MSVTAGVSDTVIAIRDKLRGKIGQTKVKRYWPGKVPEWADDENEEDAAPADIRPSREAALEKAFPRHEEDAAIVRKDDRRLRRLAESRIDNREEVRADHRRIRQAEIVSTIEEEARRQEWLEFEEEDENALAERRRLIKEKLLQREQEEALPQEEEEEEEEEEEEEESEYETDSDEEYTGVAMVKPVFVPKSERDTXAERERLEAEELAFEEKRKRRLEERRIETKQIVVEEIRKDEEIQKNLEMEANIADVDTDDEVNEADEYEAWKVREIGRIKRDREDREAMLKEKEEIEKKYYHKGAFFQNESDDRAATVGSDGIFARDFSAPTGEDKMDKTILPKVMQVKHFGRSGRTKWTHLVNEDTTDWNNP

SEQ ID NO: 2253 - protein, 169 aa, Glycine max
MADAAEECRTIIDIIESAWPYGVPDGTSEECKLIDIFHSALEYLPKLWMRSGCFDEAIIAYRRALAKPWNLGSQRSAKLQKELAVSLLYCGVEVTPGNNLEEAILLLLMLTRKLFLREIQWDPDLVNHLVYALSLSGHYEVLASHLEMLLPGTYTRSERWYILALCYSA

SEQ ID NO: 2254 - protein, 564 aa, Glycine max
  misc_feature (94)..(94): Xaa can be any naturally occurring amino acid
  misc_feature (116)..(116): Xaa can be any naturally occurring amino acid
  misc_feature (134)..(134): Xaa can be any naturally occurring amino acid
  misc_feature (146)..(146): Xaa can be any naturally occurring amino acid
  misc_feature (172)..(172): Xaa can be any naturally occurring amino acid
  misc_feature (394)..(394): Xaa can be any naturally occurring amino acid
  misc_feature (418)..(418): Xaa can be any naturally occurring amino acid
  misc_feature (425)..(425): Xaa can be any naturally occurring amino acid
  misc_feature (479)..(479): Xaa can be any naturally occurring amino acid
  misc_feature (493)..(493): Xaa can be any naturally occurring amino acid
  misc_feature (515)..(515): Xaa can be any naturally occurring amino acid
  misc_feature (533)..(533): Xaa can be any naturally occurring amino acid
  misc_feature (547)..(547): Xaa can be any naturally occurring amino acid
MATKISVSPSLSLNTLFFVKALPLSLPPLLSLPLPKYLLSLSSRPRTFILRAESQNGAAPTPSPQNLQMAPNPVRTHYDRPPSSPCGEGSGRGXRAARFRRQPTRASVAIWELPFXIWLRKPEGAVGGTYIIPXIVTKKLFVFETXCESNVNKIIVIADDNAEFQRLIGIYXVYFKNAELQRLTGIYKNILNNAGVKLIEGHGKIIDPHTVDVNGKLYSAKHILVAVGGRPFIPDIPGKEYAIDSDAALDLPTKPVKIAIVGGGYIALEFAGIFNGLKSEVHVFIRQKKVLRGFDEEIRDFVEEQMSVRGIEFHTEESPQAITKSADGSFSLKTNKGTVDGFSHIMFATGRRPNTQNLGLESVGVKLAKDGAIEVDEYSQTSVSSIWAVGDVTXNRINLTPVALMEGGAFAKTFFQAXPTKPVYXAIPCAVISKQPIGHFSLNEEQAVPQYADIAVFSANFSPRKATLSGLPDRVFMKXVVCAKRDEVLGLHXMCGEDAPEIVQGFAVALNARLXTKSEFEPTVGIHASAAGXVVIMSTSTSKRRKXESSEGKTGSQAKAAPGV

SEQ ID NO: 2255 - protein, 736 aa, Glycine max
  misc_feature (468)..(468): Xaa can be any naturally occurring amino acid
MKNLWLCFSYLFPAIILVLLTPSSVAQLSPSEGRILFQVQKLLEYPQALQGWNRWTNLCFLPSSPSLKIVCSNGHVTELTIIGNKTSPSLHNPKESAWTSLQTLSGRFSIDSFFTVMTKLSNLKMLSLVSLGLWGPLPAKINRFWSLEVLNISSNFIYGGIPQSLSSMRNLRSLVLVDNLFNGSVPDLQRLTSLEELNLGGNNLGAQFPSVGKNLVTIMLRNNSLRSHIPPQLVHFDKLQVFDVSSNDFFGNIPSFIISLPSLQYLNLASNHLSGNLSVNMACSSSLTFVDISHNLLVGKLPSCFGSMSSKAKVLYSGNCLSTKNRLNDQQHPFSFCKREGALAVKPPAKNLKKESNLGTKLGLMLGIIVGIVVIGGLLVLLVVCIIRKSKAERSPHKMDKSVANKYSTSVSPRPIGTRHIPQAMKQAAVGLPPYRIFTSEEIEDATNNFDPSNLIEEGSQGQLYKGXLHRLNNLPPMRLAAETMQTPQQSISRVLFNLKWHRHMVSVLGHCFITEQEHPQTTSTVFIVFEYISNVSLRDQLSDGRKREMLKWPQRMAMSIGIARGVQFLHTGVAPGIYGNNLKIENILLDDSLNAKVSRYNIPLPSKIAHIEQNATNHISSTNNTEKEDIYQLGVILLEVITGKQITSSSEIEELKEELENGSPEATSVIRSAIDPTLRGTYAYESMKTAVQITINCLSKVSSQRPSIEDVLWNLQYAMQVQESWTSSGNLSTKL

SEQ ID NO: 2256 - protein, 330 aa, Glycine max
MASTNALPPTGNGLIVSFGEMLIDFVPTVSGVSLAEAPGFLKAPGGAPANVAIAVARLGGKAAFVGKLGDDEFGHMLAGILKENDVRSDGINFEKGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFRGSVEAFHVNTVDTTGAGDSFVGALLSKIVDDQSILEDEARLREVLKFTNACGAITTTKKGAIPALPTEADALKLIKEA

SEQ ID NO: 2257 - protein, 138 aa, Glycine max
  misc_feature (122)..(122): Xaa can be any naturally occurring amino acid
ALSMISSPADTTINRAGAGLDAPFTGLKYMAGFPTRKTNNDLTSIASNGGRVQCMHVWPPVGKKKYETLSYLPDLDDAHIGKRQSNTLLRNGWIPCLEYALDHGFMYREHNMSPGYYDGRYXTMRKLPMLDCTVASKE

SEQ ID NO: 2258 - protein, 75 aa, Glycine max
  misc_feature (10)..(10): Xaa can be any naturally occurring amino acid
  misc_feature (39)..(39): Xaa can be any naturally occurring amino acid
  misc_feature (54)..(54): Xaa can be any naturally occurring amino acid
ASSMISSPAXTTVNRAGAGMVAPFTGLKSMACFPTQKTXHDITFIASNRGRMQXLQVLQPICKKNFETFSYFQTL

SEQ ID NO: 2259 - protein, 202 aa, Glycine max
MEGTVFTPALEGIKLVKSEQGEILTQPFLDACKHILPVIDKFGAAMALVKSDIGGNISRLESKYSSNPTKFNYLYSLVQVQVETKTAKSSSSCTNGLLWLTRAMDFLVALFRNLIEHEDWPMSQACTDSYNKTLKKWHGWLASSSFTVVMKLAPDRKKFMDVIGGTGNISADIEKFCTTFSPLLEENHKFLARFGLDDMKAS

SEQ ID NO: 2260 - protein, 619 aa, Glycine max
NYSADEKTLRSPRVRRLFPREASTGGAAAPARKARNTSSTSSEFLYLGTIVNSRGGGVDELSDPRAAALNPRKMDSPELQPLPPLARQASRLREESTPTVEDDEEEFYSPRGSLNNGREGSAGAGSGSRRVFNAIAGENLVGRSSRSESSTSSFSSSSSASPDRSHSISLSPPVSISPRKSLPKSPENTITHHSPPQEATAIRSSASSSILSSPSPVFGQHVPSSSISSTPERRECQSPSLSPLSLSPKKKQTPDGESVPGLGVLEKDASFGSSKSKNESGSPRLSNASSNGKSSAFSLPSPVIASRLHHELDQSPTISDVSDRYRHSPLSSLHLSPTLLSSPERELNSQPQPPPSRKHWEIPDLLTPIGEAPNFSVPQRKQWEIPVLSVPIAPSSSVLAPPPPPPPPPPPPPLAVPRQRKQWEMPSPLTPVDQPVSRPPPLTPPSRPFVLQTPNTKVSPVELPPASSQNFEEGSEETSKPKLKPLHWDKVRASSDREMVWDQLRSSSFKLNEEMIETLFVVNTPNPKPKDTTPRSVLAPQNQEDRVLDPKKSQNIAILLRALNVTIEEVCEALLEGVTDTLGTELLESLLKMAPSMEEERILKEHKDDSTTKLVPAEK

SEQ ID NO: 2261 - protein, 444 aa, Glycine max
MSKQQQSFAATAAAKRGPSPPSSDQIKKKRRETPTTILSLDPDIVTTIFAFLDMFDLVRCSLVCKLWNAIVESRSLREFCERKMHKSFAEFTKKPLRVILGEVAMEQHSLALQCGGFYVDQWKAHSTTVAQCRMKMGMLVTGVGHKVIRLWSLDSYKCIEEYSMPDMFSLVDFDFDESKIVGLIGSHLCIWRRNGKRSIFPSLEGKFVKGSCMRYFDPEAVVGCDDGAVRVFDMYSRKCSQIIRMHYAPITCLCLSEDQLIMSGSTSGSITMSDPSSVQQVATLRSSDARGIRTLCFNPSSQLLFAGSAVGYAYCWDLRTRKLLWSNRVSPNVIYSLQHMHSDTSTLAVGGIDGILRLLNQNDGSVVSSCVMGDKLLSTFQSPSGSIQRRKGSRLPENIYINIDLIPKTARPSITCLAVGMKKIVTTHNTNDIRLWKFKSKISL

SEQ ID NO: 2262 - protein, 135 aa, Glycine max
EVWVALATLLYVDVLAITGTMYTMAEIGGYVDEKGQFEGEYVAYLVDAGSTIVGSALGVSTTATFVESSAGPSLVMVGVMMMKVVKDIDWTNTKDAVPAFATMLLMPLTYSIANGIIGGVGLYIALSLYDYAASI

SEQ ID NO: 2263 - protein, 299 aa, Glycine max
  misc_feature (103)..(105): Xaa can be any naturally occurring amino acid
  misc_feature (218)..(219): Xaa can be any naturally occurring amino acid
  misc_feature (225)..(226): Xaa can be any naturally occurring amino acid
RGVLKRNKDDGFAEHVVLDPYAKIVGNSYPDGVGFVKNLGWLGKEPDFDWGGDCHLDLSMEKLVVYRLNVKRFTQHESSQLPSGLAGTFTGLAKKGPYFPSHXXXLMHIYGPSGGPVSAIASMKEMVKTMHANGIEVLVESALNCNYPIVQSLILDSLRHWVTEFHIDGFSFLNASHLLRGFHGEYLTRPPLVEAIAFDPVLSKTKIIADCWDPHGMXXNDVRNXXRGENLLSNLATRLCGSGDIFSGGRGPTNNTAILERRLKQIRNFLFILFVSLGVPVLNMGDECGQSSGGFTAYD

SEQ ID NO: 2264 - protein, 428 aa, Glycine max
  misc_feature (288)..(288): Xaa can be any naturally occurring amino acid
MKQVSSVGSSTHNVLHNTSGDFCEEQQEPMSRTEVLFRTYWRRAWIVLVWLLACLGLFVWKFVQYRHRSGFEVMGYCLPTAKGAAETLKLNMALVLLPVCRNTITWLRKHRPINSVVPFNDNINFHKLIAGGIVVGVILHGGTHLACDFPRISESAGSIFRQTIAAGFGYHRPTYTQILATTEVASGIGMVVLMGIAFALAAKWPRRRSPVLPVSLRRVTGYNTFWYSHHLFVLVYALLIIHSMFLFLTDKLMEKTTWMYIAFPVLLYAGERIFRALGSGPLEVVFMXASLYPGKVLYLKMQKPEGFKFHSGMYIFIQCPQISPFEWHPFSLTSGPQEDYLSVHIRTLGDWSYQIYDLFQEAVLSRSQGCPKLYIDGPYGSAAQAPVKVDLLVLIGLGLGASPFICILNDVVKGVQTTQNDHVSFLIG

SEQ ID NO: 2265 - protein, 445 aa, Glycine max
MATIKAVKARQIFDSRGNPTVEVDVILSDGSFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 2266 - protein, 565 aa, Glycine max
  misc_feature (396)..(396): Xaa can be any naturally occurring amino acid
MQSSISLSSSYAPTISGPRHSFPLSGRTLAPSNLRFCGLRRQAFTSTPLNHHFRLRRRRLPHSAAVSAALSANGTSPKSFDYDLLIIGAGVGGHGAALHAVEKGLKTAIVEGDVRPGTCVNRGCVPSKALLAVSGRMRELRSDHHLKSFGLQVSAAGYDRQGVADHANNLASKIRNNLTNSMKALGVDILTGFGTILGPQKVKVGSSDKIVTAKDIIIATGSVPFVPKGIEIDGKTVITSDHALKLESVPDWIAIVGSGYIGLEFSDVYTALGSEVTFIEALDQLMPGFDPEISKLAQRVLINPRNIDYHTGVFATKITPARDGKPVLIELIDAKTKEPKDTLEVDAALIATGRAPFTQGLGLENIDVVTQRGFVPVDEHMRVIDANGKLVPHLYXIGNANGKMMLAEKTTEGGISVVEQVTGRDLVLGHLSIPAAGLTHPEISMVGLTEPQAREKGEKEGFEVSVAKTSFKANTKALAENEGEGLAKLIYRPDNGEILGVHIFGLHAADLIHEASNAIALGTRIQDIKFAVHAHPTLSEVLDELFKSAKVKAQASSPVSEPVAV

SEQ ID NO: 2267 - protein, 384 aa, Glycine max
  misc_feature (75)..(75): Xaa can be any naturally occurring amino acid
  misc_feature (168)..(168): Xaa can be any naturally occurring amino acid
  misc_feature (183)..(183): Xaa can be any naturally occurring amino acid
  misc_feature (190)..(190): Xaa can be any naturally occurring amino acid
  misc_feature (261)..(261): Xaa can be any naturally occurring amino acid
  misc_feature (333)..(333): Xaa can be any naturally occurring amino acid
MASAAAPTTFSLLHSTTPASSSSATSASPSRVQLSSSLRSRPLARRLGFAAADPLLAANVAARVAAVRGGKGARXVVSMAKKSVGELSAADLKGKKVFVRADLNVPLDDNQNITDDTRIRAAIPTIKHLIQNGAKVILSSHLGRPKGVTPKYSLAPLVPRLSELIGIXVVKAEDSIGPEVEKXLVASLPXGGVLLLEMGRFYKEEERNDPEHAKKLASLADLFVNDAFGTAHRAHASTEGVTKYLKPSVAGFLLQKVVPAXSAIPDGWMGLDIGPDSVKSFSEALDTTQTIIWNGPMGVFEFTQVCWFGTEAIAKKLADLSGKGVTPIIGGGXDSVAPVEKVGVASVMSHISTGGGASLEIIGRRKKLPGGPWLSSETSPRFPL

SEQ ID NO: 2268 - protein, 110 aa, Glycine max
VRRKTLGLELGNKVVCVPKKIQVVFNDSFGKKVGVKFNDDYPIGDLKKLVAGQTGPKTDKIRIQKWFPIIKDSIPFKDFEIPGGMGFELFFNLTQGVFYALYNSMIWEWD

SEQ ID NO: 2269 - protein, 121 aa, Glycine max
VKSLGAKAGVVLNPATPLSAIEYVLDVVDLVLIMSVNPGFGGQSFIESQVKKISDLRRVCAEKGVNPWIEVDGGVGPANAYKVIEAGANALVAGSAVFGAKDYAEAIRGIKTSKRPEAVAV

SEQ ID NO: 2270 - protein, 370 aa, Glycine max
  misc_feature (37)..(37): Xaa can be any naturally occurring amino acid
  misc_feature (47)..(47): Xaa can be any naturally occurring amino acid
MAANKACETFSKSLIEEVHRWGCLKQTGVSLRYMMEXGSKPTDKNLXLISAQFLHKEHAIRIARRAIELENLPYGLSQKPAVLKVRDWYVDSFRDLRAFPNIKNVNDEQDFTEMIKAIKVRHNNVVPTMALGVQQLKKRMDPKIVYEDLVEIHQFLDRFYMSRIGIRMLIGQHVELHNPNPPPHVVGYIHTKMSPVEVARNASEDARAICCREYGSAPDVHIYGDPDFTFPYVPAHLHLMVFELVKNSLRAVQERFMDSDKVAPPIRIIVADGIEDVTIKVSDEGGGIARSGLPKIFTYLYSTARNPLDEHSDLGIGDNVTMAGYGYGLPISRLYARYFGGDLQIISMEGYGTDAYLHLSRLGDSQEPLP

SEQ ID NO: 2271 - protein, 105 aa, Glycine max
  misc_feature (50)..(51): Xaa can be any naturally occurring amino acid
DGGVSILKFENDMGEHGASLSRAFSVRRALSVLEMEEIHEQPESLTTTMXXRLIHRGSNKSKSVLLGGLKDHLKTIRRSRRILFIGCGTSYNAALAARPILEELS

SEQ ID NO: 2272 - protein, 129 aa, Glycine max
  misc_feature (39)..(46): Xaa can be any naturally occurring amino acid
  misc_feature (65)..(66): Xaa can be any naturally occurring amino acid
DGGVSILKFENDMGEHGASLSRAFSVRRALSVLEMEVEXXXXXXXXHYMQKEIHEQPESLTTTMXXRLIHRGSNKSKSVLLGGLKDHLKTIRRSRRILFIGCGTSYNAALAARPILEELSGQCCILYDK

SEQ ID NO: 2273 - protein, 149 aa, Glycine max
  misc_feature (72)..(73): Xaa can be any naturally occurring amino acid
  misc_feature (88)..(90): Xaa can be any naturally occurring amino acid
AANDCRRILDAVEKIFYLDNPDIQVDNRLQGIVSHAVELLPELWKQAGCYDEAISAYRRALLVQIDGSYVPXXNLEEAILLLMNFLKXXXLGKMKWDPSVMEHLTFALSICGGTSILAKQLEELRPGVYHRIDCWNTLALCYSGAGQND

SEQ ID NO: 2274 - protein, 214 aa, Glycine max
  misc_feature (80)..(87): Xaa can be any naturally occurring amino acid
  misc_feature (108)..(109): Xaa can be any naturally occurring amino acid
  misc_feature (124)..(126): Xaa can be any naturally occurring amino acid
AEAANDCRRILDAVEKIFYLDNPDIQVDNRLQGIVSHAVELLPELWKQAGCYDEAISAYRRALLGQWNLHNDFCARIQKXXXXXXXXSGVEASPPSLAVQIDGSYVPXXNLEEAILLLMNFLKXXXLGKMKWDPSVMEHLTFALSICGGTSILAKQLEELRPGVYHRIDCWNTLALCYSGAGQNDSALNLLRKSLHKHERPNDLTSLLLAAKIC

SEQ ID NO: 2275 - protein, 61 aa, Glycine max
  misc_feature (33)..(35): Xaa can be any naturally occurring amino acid
SSIKLVFFDLNKVPIIIHNESERATAWTQVYSXXXTKQSIPVITAWQLNERMYGELQGLNK

SEQ ID NO: 2276 - protein, 105 aa, Glycine max
  misc_feature (46)..(48): Xaa can be any naturally occurring amino acid
KFCLALAVVIDCIAIGTVTVHLVEDLNWDDSIYLSITSVTTVGYGXXXLRTVTGRCFAIIWLLVSTPAVARASIYLTEYSIQKRNCKMAQWVLQKKITLSDLAAA

SEQ ID NO: 2277 - protein, 77 aa, Glycine max
MASLMLSSPAVTTDNRAGAGMVAPFTGLKSMAGFPTRKTINDITSIASTGGRVLCMQVRPPLGKKTFETLSYLPDLD

SEQ ID NO: 2278 - protein, 506 aa, Glycine max
MLSETLAIPAVLLVILILILSSVLFHLQDERTNPPGPKPLPIIGNLHMLGKLPHRSLQALAKNYGPIMFIKLGQVPTVVVSSPETAELFLKTHDTIFASRPKTLASEYMSYGTKGLAFSEYGPYWRNVKKLCTTQLLSASKVEMFAPLRREELGVFVKSLEKAASSRDVVNLSEQVGELISNIVCKMILGRSKDDRFDLKGLTHEVLRLTGVFNIADYVPWTGFLDLQGLKGKMKKMSKAFDEVFEQIIKDHEDPSASNKNSVHSEDFVDILLSHMHQAVNQQEQKYVIGRTNIKAIILDMIAGSFDTSAVAVEWAMSELLRNPSDMKKLQEELNNVVGENKLVEESDLSKLPYLNMVVKETLRLYPAGPLLVPRESLEDITINGYHIKKKTRILVNAWAIGRDPKVWSDNADMFCPERFVNSNVDIRGHDFQLLPFGSGRRGCPGIQLGLTTFGLVLAQLVHCFNWELPFGVSPDDLDMSEIFGLSLPRSKPLLAIPTYRLFIKA

SEQ ID NO: 2279 - protein, 108 aa, Glycine max
  misc_feature (85)..(85): Xaa can be any naturally occurring amino acid
AASMISSPAVTTVNRAGAGMVAPFAGLKSMGGFPTIKTNSDVAFIASYGGRVQFKLVWPPVGNKMFYTLFFLPYLYDAQLAKEVXFLHRKGWITWLEFEWEHGFLCRE

SEQ ID NO: 2280 - protein, 172 aa, Glycine max
MAVNVHSTSVTSDNLSRHDMLAWINESLQLNLTKIEQLCSSSMYCQFMDMLFPGAVVLKKVKFQAKLEHEYIHNFKVLQASFKKMGVDKIIPVDKLVKGKFQDNFEFVQWFKKFFDANYDGKDYDPVAARQGQETAPAPVLSAPVLNKPKKPLGSGNTAPQRTVPVQRTAVS

SEQ ID NO: 2281 - protein, 124 aa, Glycine max
  misc_feature (24)..(24): Xaa can be any naturally occurring amino acid
GIATIVNTYWDIVIDWGLLRRNSXNPWLREKLSVPNKSVYFVAMVLNVILRLAWMQSVLGIRETPILHRTALTALVTCLEILRRGIWNFFRLENEHLNNVGNYRAFKSVPLPFNYEDEEENTVI

SEQ ID NO: 2282 - protein, 200 aa, Glycine max
MASLSCQVHSTNLLNSKNANSRRKRFISCSAQPTQNNIKVVINGATKEIGKAAVVAVTKARGMEVAGAVDTCHIGEDIGKICGMEELLEIPIINDLTMILGSISQSKAAGVVVDFTDPSSVYDNVKQATAFGMKSIVYVPRIKLDTVAALSAFCEKASMGVLVAPTLSIGSILLQQAAISASFHYSNVEIVESRANANDL

SEQ ID NO: 2283 - protein, 142 aa, Glycine max
  misc_feature (27)..(27): Xaa can be any naturally occurring amino acid
VLLWDSFFLSSSLPLVSPLLYWLKKAXWDYYILLGLVDVEANFLVVKAYQYTSLTSVMLLDCWSIPCVMLFTWIFLKTKYGFKKVTGVVVCIAGLVLVVFSDVHAGDRAGGSNPSIGDILVIAGATLYAVSNVSEEFLVKML

SEQ ID NO: 2284 - protein, 123 aa, Glycine max
  misc_feature (84)..(85): Xaa can be any naturally occurring amino acid
  misc_feature (98)..(100): Xaa can be any naturally occurring amino acid
  misc_feature (107)..(108): Xaa can be any naturally occurring amino acid
LVLSSSHHIFKQIWKWQKTGRIYLAGEIALVVGLVIWVTSLPQIRRRKFEIFYYTHHLYAVFLVLFLFHVGDRHFYTVFPGIFXXSLDKLIRIIQSSXXXCMVSARXXPGRALELILPKDPGI

SEQ ID NO: 2285 - protein, 203 aa, Glycine max
  misc_feature (41)..(41): Xaa can be any naturally occurring amino acid
  misc_feature (76)..(76): Xaa can be any naturally occurring amino acid
  misc_feature (186)..(186): Xaa can be any naturally occurring amino acid
  misc_feature (190)..(190): Xaa can be any naturally occurring amino acid
SYVGPPPRAATEKTIYDFTVKDIDRKDVSLSKFKGKVLLIXNVASRWYELCTFQGRYVAQYVSWSPIFFFEFPNFXIGLTSSNYSELSRLYEKYKNQGLEILAFPCNQFGMQEPGSNEDIKQFACTRYKAEFPIFDKVDVNGPFTTPVYQFLKSSAGGFLGDLIKWNFEKFLVDKNGKVIERYPPXTTSXFQIEKDIQKLLAA

SEQ ID NO: 2286 - protein, 295 aa, Glycine max
LDPRIDDYLPILSPFFSKQRKKALEVRREQVEFLVPIIEQRRRAIQNPGSDHTATTFSYLDTLFDLKVEGKKSAPSDAELVSLCSEFLNGGTDTTATAVEWGIAQLIANPHVQKKLYEEIKRTVGEKKVDEKDVEKMPYLHAVVKELLRKHPPTHFVLTHVVTEPTTLGGYDIPIDASVEVYTPAIAGDPKNWSNPEKFDPERFISGGEEADITGVTGVKMMPFGVGRRICPGLAMATVHIHLMMARMVQEFEWDAYPPEKKLDFTGKWEFTVVMKESLRATIKPRGGGGEKVHL

SEQ ID NO: 2287 - protein, 70 aa, Glycine max
  misc_feature (26)..(27): Xaa can be any naturally occurring amino acid
DGFLDYLRRIDCFDVEVYAIPEGSVXXPMVPILRIEGPIAVVQLLETPFVNLINFALLVSTNDARHHYVV

SEQ ID NO: 2288 - protein, 97 aa, Glycine max
MVTQQQPQPQLQVQPQQSTPPSSQDEALKRNTDCVYFLASPLTCKKGNECEYRHSEYARVNPRDCRYWLSGNCLNPKCPFRHPPLDGLLGTQAAVTG

SEQ ID NO: 2289 - protein, 122 aa, Glycine max
  misc_feature (96)..(96): Xaa can be any naturally occurring amino acid
APSLISTAAVTTVNRAGARMDAPFTGLKSMAGYPTRKTNHDITSIASNRGRVQCMQVWPPLGKKKMETLSYLPHLDDAQLATDVEYLLRNGGIPCXEFQLQHGIEYREHNRSPAYYNGRYWT

SEQ ID NO: 2290 - protein, 162 aa, Glycine max
  misc_feature (58)..(58): Xaa can be any naturally occurring amino acid
  misc_feature (85)..(85): Xaa can be any naturally occurring amino acid
  misc_feature (92)..(92): Xaa can be any naturally occurring amino acid
  misc_feature (97)..(97): Xaa can be any naturally occurring amino acid
  misc_feature (121)..(121): Xaa can be any naturally occurring amino acid
  misc_feature (140)..(140): Xaa can be any naturally occurring amino acid
ASSMISSPAITTINHTNTNIITPFTNLKSITNFPTKKTNNNITSITSNNKRIQYIPIXPPINKKKFKTLSYLPDLDNTQLAEKIXYLLRKEXNSLLXFHLNHNFIYHNHNRSPKYYNERYXTIYKLPIFGYTNTSQVLKXLEQAKTTYPNNCIHIMIFNNTQ

SEQ ID NO: 2291 - protein, 314 aa, Glycine max
LFSDDESSQLQSEEKRRDEVFLKDRIPTWFAASGYVGLAAISIATIPIIFPPLKWYLVLCSYILAPALAFCNSYGTGLTDWSLASTYGKIGLFIIAAAVGQNGGVIAGVASCAVMMSIVATAADLMQDFKTGYLTLSSAKSMFVSQLIGTAMGCVIAPLTFWMFWTAFDIGSPDGPYKAPYAVIFREMAILGVQGFSELPKYCLEMCGGFFLAALVINLLRDVTPKKFSQYIPIPMAMAVPFYIGAYFAVDMFVGTVILFVWERLNRKDAEDYAGAVASGLICGDGIWTIPSAILSILRIDPPICMYFGPSTSS

SEQ ID NO: 2292 - protein, 135 aa, Glycine max
  misc_feature (46)..(46): Xaa can be any naturally occurring amino acid
FTPLLVSIPAWAVGPPLILVGVLIMRSVVEIDWEDMREAIPAFVTXILMPLTYPQAYGLIGGIGTYLVLNPRDWGWEGLGHFGLVKKMKKTAPTTTTAMANSDEDSHHHHNGGNGVLQNQHSPQNPTGKALQLEP

SEQ ID NO: 2293 - protein, 151 aa, Glycine max
  misc_feature (16)..(16): Xaa can be any naturally occurring amino acid
  misc_feature (84)..(84): Xaa can be any naturally occurring amino acid
TASGGALVAKGDLGAXLPFEEGPLLQEEIINLCRNMGKGVIGATNILKSIIVHPTSTRAKVLDFAIAVPEGSDGIMLSGETAYXKFPLKAVKVMHTVTLPTETSIPSGQMPPYIGPMLKNHISEMFAYHATIMSNTFGTLTVVFTKTGFMA

SEQ ID NO: 2294 - protein, 346 aa, Glycine max
MTQAQIQPVKLGTQGFEVSKLGFGCMGLTGAYNDPLQEQDGISVIKYAFSKGITFFDTADVYGANANELLVGKALKQLPREKIQIATKFGIASRGFPDMKIKGSPEYVRSCCEASLKRLDVEYIDLYYQHRVDTSVPIEETVGELKKLVEEGKVKYIGLSEASPDTIRRAHAIHPITAVQIEWSLWTRDIEEEIVPLCRELGIGIVPYSPLGRGFFGGKGVVENVPTNSSLKAHPRFQAENLDKNKNIYERIEGLAKKHQATPAQLALAWVLQQGEDVVPIPGTTKIKNLDQNIGALAVKLSEKDLREISEAVPIGDVAGGRYYNGLDHFSWKYANTPPKDSKIST

SEQ ID NO: 2295 - protein, 388 aa, Glycine max
PWNTKVATTTEGQSIRCKAAICRKAGEPLCIEEIIVAPPMPGEARIRIICSSLCQTDISFRNMQDHPAIYPTILGHEAIGVVESVGEDVTEVAKGDMVVPIFIAECGECIDCKSSKSNLCSKFPFKLSPWMPRHATSRFVDLKGEIIHHFLSVSSFSEYTVVDIAHLTKIDPEVPPSKACLLSCGVSTGVGAAWRTAGVEPGSTVAIFGLGSIGLAVAEGARLCGATRIIGVDINSEKYEIGKKFGITDFVHSGECENKSASQVIIEMTDGGADYCFECVGNASLMHEAYASCRKGWGKTIVLGSDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 2296 - protein, 205 aa, Glycine max
MHNTMPSTTPTGSSSTSLFELLTEMKKQSYPESLTFQAKSPSQFSSECWFDDACILDMDYFVKTLSGIKAKGVRADLIGSIITHYASKWLPDLSAGDMAERGLTQFEESPESVTASWMKKRFFVETLVGVLPPEKDAIPCNFLLRLLRTANMVGVEGTYRQELEKRISWQLDQASLKELVIPSFSHTCGTLLDVELVIKLVKRYV

SEQ ID NO: 2297 - protein, 73 aa, Glycine max
AFSMIFSPAVITVNLAGADMVAPFTVLMSMAGFPTRKTNNDITSIASNGGRVQCMQVRPPICKNKSETLSYLA

SEQ ID NO: 2298 - protein, 221 aa, Glycine max
  misc_feature (89)..(89): Xaa can be any naturally occurring amino acid
  misc_feature (108)..(108): Xaa can be any naturally occurring amino acid
  misc_feature (138)..(138): Xaa can be any naturally occurring amino acid
  misc_feature (160)..(160): Xaa can be any naturally occurring amino acid
  misc_feature (172)..(172): Xaa can be any naturally occurring amino acid
MPQDLALDLEELRHLHSIVKRPRTLSLLSSEIRILEKLSSSEEPSAQASQIPAPITTGTKVAPSVALNYAALASFSWDQDSDKVKIYCXMEGIDEDKVESEFKSMSFXLSSIDVQGKNTRCAISKLHKEIVPEKVRVXVKPKRAIITVGEGLPKGNWLRXLHFKEDKLKPNXDKEKDPMAGIMDMMRNMYEDGDEEMKKTIAKAWTDARFGKTADPLSSYR

SEQ ID NO: 2299 - protein, 151 aa, Glycine max
  misc_feature (95)..(95): Xaa can be any naturally occurring amino acid
LKSMAGFPTTKTNNDITCIVSNRGKLQCMHVWPPLGKKKAETLCYLTDLDDAQLANEVQYLLRKGWIPCWELESEHGCMYREHNMSPGYYYGLYXTMWKLTMLGCTDAYHVLNELQEANTAYPSGYIRIIGFDSVRQLLCISYIIYKRSRF

SEQ ID NO: 2300 - protein, 482 aa, Glycine max
  misc_feature (45)..(45): Xaa can be any naturally occurring amino acid
  misc_feature (52)..(52): Xaa can be any naturally occurring amino acid
  misc_feature (68)..(68): Xaa can be any naturally occurring amino acid
  misc_feature (291)..(291): Xaa can be any naturally occurring amino acid
  misc_feature (346)..(346): Xaa can be any naturally occurring amino acid
  misc_feature (372)..(372): Xaa can be any naturally occurring amino acid
  misc_feature (393)..(393): Xaa can be any naturally occurring amino acid
  misc_feature (409)..(409): Xaa can be any naturally occurring amino acid
  misc_feature (477)..(477): Xaa can be any naturally occurring amino acid
IPVDAPLGTAALAQVPSEHVKSTSTVGLPRTVEDLATIVSIKARXQIFDSRXGNPTVEVDLTCSDGTXARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAAFXNSTRRDKTYDLNFKEDNNDGSQKISGDALKDLYKSFVTEYPIVSIEDPFDQDDWXHYAKLTAEVGTNVQIVGDDLLVTNPXRVQKAIDTKACNALLLKVNQXIGSVTESIEAVRMSKXAGWGVMASHRSGETEDTFIADLSVGLATGQIKTGAPCRSERLAKYNQLLRIEEELGAEAVYAGANFRXPVEPY

SEQ ID NO: 2301 - protein, 110 aa, Glycine max
MASSSWEYFGEIANVAQLTGIDAVKLIGMIVKAANTARMHKKNCRQFAQHLKLIGNLLDQLKISELKKYPETREPLEQLEDALRRKAQSEIDRYLHLVPLISLVDNNRLR

SEQ ID NO: 2302 - protein, 416 aa, Glycine max
MASWDQMGELANVAQLTGVDAVRLIGMIVRAASTARMHKKNCRQFAQHLKLIGNLLEQLKISELKKYPETREPLEQLEDALRRSYILVNSCQDRSYLYLLAMGWNIVYQFRKAQNEIDRYLRLVPLITLVDNSRVRERLEVIEMDQREYTLDDEDQKAQTVIFKPEPDKDDTAVLKKTLSCSYPNCSFTEALKKENEKLKLELQRSQANLDMNQCEVIQRLLDVTEVAAYSVPAKCSPEKSHKKEEYNYSDVNSDQDHSSDEKYHAKIDKHSPSRYSVAQKDLASTGGSYQQEDWHTDLLACCSEPSLCMKTFFYPCGTFSKIASVARNRPISSGEACNDLMAYSLILSCCCYTCCVRRKLRKMLNITGGFIDDFLSHLMCCCCALVQEWREVEIRGLTGSEKTKTSPPPSQYMES

SEQ ID NO: 2303 - protein, 237 aa, Glycine max
MARVISSSCARLAMRLFSTTTTATAFAVTLPKPSSLSLSSRRFLFPLSHAIVPPSTRVAGIRCRVNRAGDSAYSPLNSGSSSSSFSDRPPTEMAPLFPGCDYNHWLIVMENPGGEGANKQQMIDCYIQTLAKVLGSEEEAKKKIYNVSCERYFGFGCEIDEETSNKLEGLPGVLFVLPDSYVDPENKDYGAELFVNGEIVQRSPERQRRVEPQPQRHQDRPRYNDRTRYVRRRENMQ

SEQ ID NO: 2304 - protein, 80 aa, Glycine max
VDVMDGRFVPNITIEPLVIDTLHPLTNLPLHIHLIIINPKQIIPYFIKAKSNIVNIHYEQSSTIHLHHTINQLKTLITKA

SEQ ID NO: 2305 - protein, 293 aa, Glycine max
  misc_feature (73)..(74): Xaa can be any naturally occurring amino acid
SPYGPASTNYLRYDTIVMVSGGSGITPFISIIRELLYLNTTFRYRTPKVILICAFKNSYYLSMLDLILPNSGXXYDMSNMQLQIKAYITRKEEHRLENQIHLQQIWFKPKATDAPISAILGPNNWLWLCAIISSSFIIFLILIGIITRFIIFPIDHNSNKIFSQPLRSFLNIFAICVSISMAASAAVLWNKKYNDREAKQIQNLEGSSSAESPKLNTDEGDKELESLPQQSLVQATKVHYGARPDLRRLLLELEGSRVGVFVSGPKKMRQEVAAICSSDLGENLHFESFSFNW

SEQ ID NO: 2306 - protein, 528 aa, Glycine max
MEPLRCSTTISARERERITKWKREGSGKTTAVAAGAGRRISARTVFPVMVVLGIVLPFLFVRIAILMLESAAACSSLECAGWRFFWCVMSLLELRDELTRALIEANDGNVNEGAGSFNELVKEMTSKQDLKAFAFKTKAMLSQLERKVQLARQQESVYWHLASHGIPKSLHCLCLKLAEEYSVNAMARSRLPPPEFVSRLVDPTFHHLVLLTDNVLAASVVVTSTIESSINPEKLVFHIVTDKKTYAPMHAWFATNSIKSVVEVRGLHQYDWSEEVNAGVKEMLETNHLIWKQYYNKEKDLDYTQEHSRYLEALRPSSLSLMNQLRIYLPELFPDLKKIVFLDDDVVVQHDISSLWELDLNGKVIGSVLKSWCGDGCCPGSKYTNYLNFSHPPISSKFDGDQCAWLYGMNIIDLETWRRTNITETYHQWLKLNLKSGMTMWNPGVLPPALMTFEGQVHPISSSMLVTDLGYRHQSAEISKEKLEAAAVIHFSGPAKPWLEIGFPEVRSLWSRYVNISNKFIGRCRITG

SEQ ID NO: 2307 - protein, 157 aa, Glycine max
MCPKIIFTTNTNRNQYFRFILQAGNDELRRSPGTPVFTAPECRVGLTYHGKASDTWAVGVTLHCMTVGEYPFLGDTLQDTYDKIVNDPLVLPEDINPQLKNLIEGFLCKDPELRMTLGDVAEHIWVIGDDGPIPGYLCWCKRKSMVTEDSDGSDILD

SEQ ID NO: 2308 - protein, 131 aa, Glycine max
  misc_feature (102)..(102): Xaa can be any naturally occurring amino acid
  misc_feature (125)..(125): Xaa can be any naturally occurring amino acid
MAPLMISSPAATTGNRALAYVGAPFTDLKYMAGLRTRNTNTDITSIASNGGRVQCMQAWPPIGKKKFETLSYLPDLDDAQLTKEVAYLLRNGWIPCLAFELXTGSLYREHITSPGYYDRRYWTCXKLSMFG

SEQ ID NO: 2309 - protein, 245 aa, Glycine max
MAEASFFVGVIGNIISILMFLSPVPTFWKIKKHGSTEDFSSLPYICTLLNCSLWTYYGIIKAGEYLVATVNGFGILMETIYIILFLIYAPKGIRGRTAILALILDVVILTAIIIITQLALEGETRSGAVGVMGAGLNIVMYSSPLSVMKTVVTTKSVEYMPFLLSFFFFFNGGVWLLYAVLVRDVILGVPNGTGFLLGAMQLVLYAIYRNGKPSSNNRLEEGLQHEPLISQPNKESHQIREDRPI

SEQ ID NO: 2310 - protein, 177 aa, Glycine max
  misc_feature (145)..(145): Xaa can be any naturally occurring amino acid
ALSMISSSAVTTVYRACAGMVAPFTVLKSMAGFPTRKTNNDITSIANNGGRVHCMHVWPPSVKKKFDTLFFLPHLADAQLANGSEYLPMMGWISCLQFKLEHGSVYREHNRSPGYYYGLYCTMSKLPIFACTDASHASKDLLEAXTVFPDGFLRIIRFHNVRQEHCIIFISYNRSCF

SEQ ID NO: 2311 - protein, 213 aa, Glycine max
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSSDSFTRAKKWVQELQKQGNPNMVMALAGNKADLEDKRKVTAEEARVYAEENGLFFMETSAKTASNVNDIFYEIAKRLPRAQPAQNPAGMVLVDRPAEGTRAASCLFISIRTVFALPNPF

SEQ ID NO: 2312 - protein, 148 aa, Glycine max
  misc_feature (120)..(120): Xaa can be any naturally occurring amino acid
GKGGDRPQNHWSCTPLSPSRFFFHQDCLIVAVKPKPPVKDGYDNDDEDEDLKFRLPQSSSWWKKRLYTFLHDNLKLPDILLMVIFTLSLKAWLLIILWFILAPVAHRWDLGPLYILATGXCLILFNLGKRQAGDISAYSIFNEDFREL

SEQ ID NO: 2313 - protein, 120 aa, Glycine max
  misc_feature (58)..(58): Xaa can be any naturally occurring amino acid
  misc_feature (88)..(88): Xaa can be any naturally occurring amino acid
  misc_feature (92)..(92): Xaa can be any naturally occurring amino acid
AASMISSPAVTTVNRAGAGMVAPFTGLKSMAGFPTKKTNNNITSITSNSGRVQFIQVXPPIGKNKFKTLSYLPDRNNTQLSKKVQYLXKKDXIPYYKFELKHDFLYPEHNRSPRYYNKRY

SEQ ID NO: 2314 - protein, 201 aa, Glycine max
  misc_feature (108)..(108): Xaa can be any naturally occurring amino acid
  misc_feature (149)..(149): Xaa can be any naturally occurring amino acid
MPRYDDKYGNTRLYVGRLSSRTRSRDLERVFSRYGRVRGVDMKNDFAFVDFSDPRDADDARYNLDGREVEGRHVTVEFAKGGPRGSWESSGQGQGPPTGPGRCFDCGXDGHWARDCKTGDGKNKCFLSGERGHIEKNCKNSPKKLRHGXSFRSHSAHHGRRRDRSYSRDRSYSRSISPVGRERSPVSEDRSESSTLLDKKA

SEQ ID NO: 2315 - protein, 218 aa, Glycine max
  misc_feature (48)..(48): Xaa can be any naturally occurring amino acid
MPRYDDKYGNTRLYVGRLSSRTRSRDLERVFSRYGRFLRFSLNLEVFXLGGWPWWNLWKFLSSIDFGDSFCNLSNDGLIVSGNHFRRVRGVDMKNDFAFVEFSDPRDADDARYNLDGRDVEGSRIIVEFAKGGPRGSRDREYMGRGPPPGSGRCFNCGIDGHWARDCKAGDWKNKCYRCGERGHIEKNCKNSPKKLSQRGRSLSRSPVRSRSPRRGRS

SEQ ID NO: 2316 - protein, 156 aa, Glycine max
  misc_feature (52)..(52): Xaa can be any naturally occurring amino acid
  misc_feature (142)..(142): Xaa can be any naturally occurring amino acid
ANLKISCSAVTAVHRANASMIAPFTGLKSMAGCPLAKTANHITSIASNGGRXHCMHVWPPLVKMKFETISYLPDHDDAQLAKEIEYLLTIGWIPYFEFELEHGIAYREHDMSPRYYQRRYWYTLTCQFLTALIATTVSYELXQARTEYSIGYIRII

SEQ ID NO: 2317 - protein, 592 aa, Glycine max
MPSKQIYSFCLNSARGFRIPVSEAPPEIRTLFDGYSDENGVMTATHLRSFLAEVQREDNATEEEAQAIIDGHKHLSIFHRSGLNLESFFNYLFSHHNNPPLLPSLGVHQDMSSPLSHYFIYTGHNSYLTGNQLSSDCSDVPIINALEKGVRVIELDIWPNESKDNVDVLHGRTLTSPVALIKCLRSIKQHAFVASEYPVVITLEDHLTPDLQAKVAEMITQTFGDILFAPTSESLKEFPSPESLKGRIIISTKPPKEYLEAKEVQEKEEESQQEKPADDEEAWGKEVPSLRGGTISDYKNIEDDDVLDDEEDIDEAEKSRQDAADEYRRLIAIHAGKPKGGLTECLKVDPDKVRRLSLSELQLEKAAETHGKEIVRFTQRNILRVYPKGTRITSTNYNPLIGWMHGAQMVAFNMQGYGRSLWLMQGMFKANGGCGYVKKPDLLLKVGPNNEVFDPRSHLPVKTTLKVTIYMGEGWFLDFKHTHFDKFSPPDFYARVGIAGVPNDTVMKKTEKVEDNWSPSWNQVFKFPLAVPELALLRVEVHEYDMSEKDDFGGQTCLPVWELRSGIRAVPLYSRKGDKYANVKLLMHFEFI

SEQ ID NO: 2318 - protein, 183 aa, Glycine max
IVYGIGILFGTILGVIAFFTTKMSGPPNKCLFPWLAGGFVMSVTWSYIIAQELVGLLVSIGYICGISPSMLGLTVLAWGNSIGDLMTNLTMALNGGQDGAQVAMSGCYAGPIFNTLIGLGLSLVTCTWSEYPQAVVIPRDPYLWETMVFLVAGLVWALVVLIKRDMKLDGLLGGGLLSVTSFL

SEQ ID NO: 2319 - protein, 179 aa, Glycine max
  misc_feature (122)..(122): Xaa can be any naturally occurring amino acid
  misc_feature (125)..(125): Xaa can be any naturally occurring amino acid
  misc_feature (162)..(162): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELKHSFIYHKHNKSPEYYDRHYXPYXKLPIFNYTNTSQVLKELQEAKTTYPNHFIHIIKFNNXVRQVQYIIFITYKPPSF

SEQ ID NO: 2320 - protein, 137 aa, Glycine max
  misc_feature (77)..(77): Xaa can be any naturally occurring amino acid
  misc_feature (96)..(96): Xaa can be any naturally occurring amino acid
ARSMISFPAVTTVNRAGAGMVVPFTGLKPMAGSPTINTNNDITFIASRGGRVQCLHVCPPADKNNLETLSYLPDLDXAQSSKREEYLLTTGWLRCXGIRIKHGFVIREHTTLPGFYNGLLGTMWILPIDSCSHASNV

SEQ ID NO: 2321 - protein, 523 aa, Glycine max
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVALPAMMGQKDKAVSNLTQGIDGLFQKNKVTYVKGYGKLVSPSEISVDTTEGENTVVKGKHIIIATGSDVKSLPGVTIDEKKIVSSTGALALSEIPKKLVVIGAGYIGLEMGSVWGRIGSEVTVVEFASEIVPTMDADIRKQFQRSLEKQGMKFKLKTKVVGVDTSGDGVKLTVEPSAGGEQTIIEADVVLVSAGRTPFTSGLNLDKIGVETDKLGRILVNERFSTNVSGVYAIGDVIPGPMLAHKAEEDGVACVEYLTGKVGHVDYDKVPGVVYTNPEVASVGKTEEQVKETGVEYRVGKFPFLANSRAKAIDNAEGLVKIIAEKETDKILGVHIMAPNAGELIHEAAIALQYDASSEDIARVCHAHPTMSEAVKEAAMATYDKPHSHLKSWLLLSSLVFIFVQEFTMTWR

SEQ ID NO: 2322 - protein, 320 aa, Glycine max
  misc_feature (14)..(14): Xaa can be any naturally occurring amino acid
  misc_feature (39)..(41): Xaa can be any naturally occurring amino acid
  misc_feature (48)..(48): Xaa can be any naturally occurring amino acid
  misc_feature (67)..(69): Xaa can be any naturally occurring amino acid
  misc_feature (177)..(184): Xaa can be any naturally occurring amino acid
  misc_feature (212)..(212): Xaa can be any naturally occurring amino acid
FDPVLSKTKIIADXWDPHGMVAKEIRFPHWMRWAEMNTXXXNDVRNFXRGQNLLSDLATRLCGSGDXXXGGRGPGFSFNYIARNFGVSLVDLVSFSSVDELSWNCGAEGPTNNTAVLERRLKQIRNFLFILFVSLGVPVLNMGDECGQSSGGFTAYDGIKPFSWSALKTGFGKQTSXXXXXXXXLRKRRSYLLQRRSFLKEENIEWYGSDGXPPRWEDPSCKFLAMILKAEVTEFLESSVSSDISGDLFIAFNATDHPETAVLPLPPEGMSWYRLVDTALPFPGFFSTSGEVVPEQTEGLFTYQVKSYSCTLFEANNRTI

SEQ ID NO: 2323 - protein, 180 aa, Glycine max
MEETLVPKRPREEAQVERGLDFEEDYSTSKRHKPYNHILSLLDSEEEDSTQDLSPLMTTLQQEITCASKNTQDALLVCPTQENDQNTLTISSLEDNNATTSQVLKEEEENDKERVMRHLLQASDDELGIPNSGDGLWGFEDNEFTSGDGFSSLCDKMWELEDERANYYDFLQSELFLGGY

SEQ ID NO: 2324 - protein, 381 aa, Glycine max
  misc_feature (122)..(122): Xaa can be any naturally occurring amino acid
MSSTVGQTIKCKAAIAWEAGKPLVIEEVEVAPPQAGEVRLKILYTSLCHTDVYFWDAKGQTPLFPRIFGHEASGIVESVGEGVTHLKPGDHALPVFTGECGDCAHCKSEESNMCELLRINTXDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 2325 - protein, 381 aa, Glycine max
MAVSVDPKTDNKLTLTKSEEAFAAAKELMPGGVNSPVRAFKSVGGQPIVIDSVKGSRMWDIDGNEYIDYVGTEACMGALRLARAYTGREKIIKFEGCYHGHADPFLVKAGSGVATLGLPDSPGVPKAATFETLTAPYNDTAAVEKLFEANKGEIAAVFLEPVVGNAGFIVPKPDFHNFLRKITKENNTLLVFDEVMTGFRLSYGGAQEYFGITPDITTLGKIIGGGLPVGAYGGRRDIMEKVAPAGPMYQAGTLSGNPLAMTAGIQTLQRIKEPGTYEYLDKITGELVQGIIEAGKRAGHAICGGHIRGMFGFFFTEGPVYNFADAKKSDTDKFARFFWGMLAEGVYLAPSQFEAGFTSLAHTSDDIKKTIAAAEKVFREI

SEQ ID NO: 2326 - protein, 331 aa, Glycine max
  misc_feature (119)..(119): Xaa can be any naturally occurring amino acid
  misc_feature (147)..(147): Xaa can be any naturally occurring amino acid
MAHPTSSGQSHDLKKEDCKETRSLVVCFGEMLIDFVPTVGGVSLAEAPAFKKAPGGAPANVAVGISRLGGSSAFVGKVGADEFGYMLGDILKQNNVETSGMRFDPNARTALAFVTLRDXGEREFLFFRNPSADMLLQESELDENLIXSLIDEPCKSAHLAAMRFAKESGCILSYDPNLRLALWPSAEAARDGIMSIWDQADIIKISEEEITFLTGGDDPYDDNVVLNKLFHPNLKLLIVTEGSEGCRYYTKEFKGRVAGVEVKPVDTTGAGDAFVSGIIYSLASDQSLFQNEEHLRKALHFANVCGAITVTERGAILALPTKEAVLQFAAT

SEQ ID NO: 2327 - protein, 84 aa, Glycine max
  misc_feature (11)..(11): Xaa can be any naturally occurring amino acid
  misc_feature (71)..(71): Xaa can be any naturally occurring amino acid
KLHKEIGPYKXTDGVKPKKAIITLAKASNRNWLNLHFKENKLKPNLYLEKDPMAGIMDIMRNMYEDGDQEXKKTIAKAWTDARS

SEQ ID NO: 2328 - protein, 177 aa, Glycine max
MAITTNPLVVGRVIGDVLEPFASSIPLRVVYNNNKEVINSGELKPSQIINPPRVEVGGDDLRTLYTLVMVDPDAPSPSDPNMREYLHWLVTNIPATTSASFGQEVVSYESPRPTSGIHRFIFVLFRQPRRMSIPAPGWRQNFITRDFAEYYNLGLPVAAVYFNCQRQGGSGGRRLML

SEQ ID NO: 2329 - protein, 92 aa, Glycine max
MGFRLPGIRKTSIAANQASSKSVEVPKGYLVVYVGDKMRRFLIPVSYLNQPSFQDLLNQAEEEFGYDHPMGGLTIPCKEDEFLTVTSHLNDL

SEQ ID NO: 2330 - protein, 112 aa, Glycine max
PFPQWGALAPKFKGQKWRKIVPFKGFPPSFPPPKLAFGDIDVRKNLDGPLNRNVDSAKNVFQKLRTPIPPQIFFFSRLVCGTYVGPKMLFLPGVNGSPPLFPRSFVDKNGFS

SEQ ID NO: 2331 - protein, 476 aa, Glycine max
  misc_feature (312)..(312): Xaa can be any naturally occurring amino acid
SSRIGSRDDANTVSTPYTAAILEYRVVIHDPTVTSSYDNHINVANGNAVFDIHHPCRANVAIQRELHKPESDRSCIHLEFDISGTGITYETGDHVGVYADNCNETVEEAGKLLGQNLDLLFSLHTDKEDGTSLGGSLLPPFPGPCTLRTALARYADLLNPPRKAALVALAAHASELSEAERLKFLSSPQGKDEYSKWVVGSQRSLLEVMAEFPSAKPPLGVFFAAVAPRLQPRYYSISSSPRFAPQRVHVTCALVYGPTPTGRIHKGVCSTWMKNAIPLEKSPDCCWAPIFIRPSNFKLPVDHSIPIIMVGXPGTGLAPFRGFLQERFALKEDGVQLGPAILFFGCRNRRMDFIYEDELKNFVEQGSLSELIVAFSREGAEKEYVQHKMMDQAAFSREGAEKEYVQHKMMDQAAQLWSLISQGGYLYVCGDAKGMARDVHRTLHTIVQQQENVDSTKAEAIVKKLQMDGRYLRDVW

SEQ ID NO: 2332 - protein, 133 aa, Glycine max
  misc_feature (74)..(76): Xaa can be any naturally occurring amino acid
  misc_feature (80)..(81): Xaa can be any naturally occurring amino acid
  misc_feature (97)..(98): Xaa can be any naturally occurring amino acid
LVNLSLLLGAILSFGVIWPLIDRRKGDWFPTNLDESNMKALYGYKVFLTVALILGDGLYNFVKILVSSILSVHXXXKNRXXGMTYIQQRDNAEELKXXEVFLRDNISMWIGTGGYIVLSVISIIVIPLMFPQG

SEQ ID NO: 2333 - protein, 213 aa, Glycine max
  misc_feature (87)..(87): Xaa can be any naturally occurring amino acid
AQVADVANERSTPVNEEQRREAVKTVVGEFSEVKHVRGILSMGRYDDPDSASSSFSILLGDAPHLDGKYAIFGKVTKGDEMLTKLEXLPTRKEGIFVMPMECITILSSYYYDTETENCEQDRSILKLRPAASAVEVERQVINVIRFKTIMFVPLVNIAFMRHFAEDEMLPLIKAILILIWNEHYTAAFSFYIMNKQCIQILLLSCMRNCSKYA

SEQ ID NO: 2334 - protein, 395 aa, Glycine max
  misc_feature (227)..(227): Xaa can be any naturally occurring amino acid
  misc_feature (279)..(279): Xaa can be any naturally occurring amino acid
  misc_feature (294)..(294): Xaa can be any naturally occurring amino acid
MYVVESKVGAIGCMLVSLFFLGTWPAVMTLLERRGRLPQHTYLDYTLTNLMAAVIIAFTFGQIGNAQPNFLSQLSQDNWPSVLFAMGGGVVLSVGNLSTQYAWAFVGLSVVEVITSSITVVIGTTLNYFLDDKINKAEILFPGVGCFLIAVCLGSAVHSSNTVDNKAKLSDYKDAAKSTSVTTFKETSEVESKDLEPAKPGTGKPFLFRALKKKRSIKVLGKSTFIXGLAITFFAGVCFSPFSPGFNLATNDQWPTLKKGVHHLSVYTAFFYFSVSCFXVIAIILNITFLYHPXLNLPKSSLKAYLSDWDGRGWAFLAGLLCGFGNGLQFMGGQAAGYAAADAVQALPLVSTFWGIVLFGEYRKSSRRTYVLLGSMLLMFVAAVAVLMASSGHRK

SEQ ID NO: 2335 - protein, 113 aa, Glycine max
PSSRGRYRFRHCPCLSPFGCPSAGLSPGFSAWLRPPPRRIYGVFPTIVVGGLLVGLLVILTLRGLLVHSVFSYVAKSFPPQGIDNSPLHVHLGGHLGGYVPLKSSIQMQNLDV

SEQ ID NO: 2336 - protein, 581 aa, Glycine max
MGNTCVGPSISKNGFVQSVSAAIWRSQLPEGSVSNRESVKEEATSVPESPLPVQNKPPEQITMPKQEAKQEGKSEIEPEKEQDKKKQKKRGSVKRVSSAGLRVDSVLQRETDNFKEFFTLGRKLGQGQFGTTFLCVEKATGLECACKSIAKRKLVTDDDVEDVRREIQIMHHLAGHPNVISIKGAYEDAVAVHVVMELCAGGELFDRIIQRGHYTERQAAKLTKTIVGVVEACHSLGVMHRDLKPENFLFVNQHEDSLLKTIDFGLSVFFKPGDIFNDVVGSPYYVAPDVLRKRYGPEADVWSAGVILYILLSGVPPFWAENEQGIFEQVLRGDLDFSSDPWPSISESAKDLVRKMLVRDPRRRLTAHQVLCHPWIQVDGVAPDKPLDSAVLSRLKQFSAMNKLKKMALIIIAESLSEEEIAGLKEMFKMIDADNSGQITFEELKAGLKRVGANLKESEIYDLMQAADVDNSGTIDYGEFLAATLHRNKIEREDNLFAAFSYFDKDGSGYITQEELQQACDEFGIKDVRLEEIIKEIDEDNDGRIDYNEFVAMMQKGNLPAVGKKGLENSFSVKFREALKL

SEQ ID NO: 2337 - protein, 483 aa, Glycine max
  misc_feature (200)..(200): Xaa can be any naturally occurring amino acid
MSYHIGVSVCCGSREDDIRDSQLSSVDQMRGMNMPNFAAMEQTRMLANTLAQNGDPKFQNSKFLQFVSKMSRGELIIDDNQVKENALPASGDWATEYNQQYNHGHAWAGEFLNDKVYHGPDQWANEFTSEGRQHDAVDDQWVNEFSKLKVNDWADEFGQQFGEGALGDSTSDSWAQAYDEFLNEQVAAKQQLDRFEGCVXVFPDLNPYVGHPNPLKEGQDLFRKGLLSEAVLALEAEVLKNPENAEGWRLLGIAHAENDDDQQAIAAMMRAQEANPTNLEVLLALGVSHTNELEQTAALKYLYGWLRHHPKYGTLAPPEMADSLYYADVARKFNEATELSPDDADVHIVLGVMYNLSREYDKAIASFERALKLKPQDYSLWNKLGATQANSVQSADAIMAYQQALDLKPNYVRAWANMGISYANQGMYDESIRYYVRALAMNPKAENAWQYLRISLSCASRNDMLEACDSRNLDLLQKEFPLQ

SEQ ID NO: 2338 - protein, 173 aa, Glycine max
  misc_feature (89)..(89): Xaa can be any naturally occurring amino acid
NPRVRPRVRPRVRPRVRGRVGLLEKAKNYVAEKVTNMPKPEASVTDVDFKRVSRDSVEYLAKVSVQNPYSTSIPICEIKYSLKSAGSGXREIAAGTIPDPGSLKASDTTMLDVPVKVPHSILLSLAKDIGADWDIDYQLDIGLVIDLPVIGNFTIPLSQKGEIKLPTLTDMFA

SEQ ID NO: 2339 - protein, 198 aa, Glycine max
MPSSHLLLEEPIRMVSILEPSKPSFFSAMTKIVGTLGPKSRSVETISGCLKAGMSVARFDFSWHDPEYHQETLENLKAAIKSTKKLCAVMLDTVGAEMQVVNKSEKAISLEANGQVVLTPDQGQEASSEILPINFDGLAKAVKKGDTIFIGQYLFTGSETTSVWLEVSEVKGQDVVCIIKNTATLAGSLFTLHASQIH

SEQ ID NO: 2340 - protein, 131 aa, Glycine max
  misc_feature (16)..(16): Xaa can be any naturally occurring amino acid
  misc_feature (23)..(23): Xaa can be any naturally occurring amino acid
LERLAKMKKEAILINXSRGPVIXQAALVEHLKHNPMFRVGLDVFEEEPYMKPGLAELKNAIVVPHIASASKWTREGMATLAALNVLGKVKGYPVWFDANRVEPFLNENARPPAASPSIVNAKALGLPTSKL

SEQ ID NO: 2341 - protein, 313 aa, Glycine max
  misc_feature (64)..(64): Xaa can be any naturally occurring amino acid
MWLFGRKGASGFSSSSTAEQVTEGIDGTGFTAIVTGASSGIGTETTRVLALRGVHVIMGVRNMXAAKDVKETILKEIPSAKVDAMELDLSSMKSVRKFASEFKSSGLPLNILINNAGIMACPFSLSKDKIELQFATNHIGHFLLTNLLLDTIKKTSRESKKEGRIVNVSSEAHRFAYSEGICFDKINDESSYNNWRAYGQSKLANILHANELTRRLKEDGVDISANSLHPGTITTNLFRHNSAVNGLINVIGRLVLKNVQQGAATTCYVALHPQVKGISGKYFSDSNLAKTTAQGTDSDLAKKLWDFSMDLTK

SEQ ID NO: 2342 - protein, 338 aa, Glycine max
  misc_feature (222)..(222): Xaa can be any naturally occurring amino acid
NFCVPVGLLPGYPGPLGLFCSPDGSVNFAIFSRRAESVVLCLYDENDMEKPALELDLDPYVNRTGDIWHVSFESAKGFMSYGYSCRGGVLKRNKDDGFAEHVVLDPYAKIVGNSYPDGVGFVKNLGWLGKEPDFDWGGDCHLDLSMEKLVVYRLNVKRFTQHESSQLPSGLAGTFTGLAKKVQHFKDLGVNAILLEPVFTFDEKKGPYFPSHFFSLMHIYGXSGGPVSAIASMKEMVKTMHANGIEVLVEVVFSNTAEIGAIQGIDDSSYYYANGVGGLKVQSALNCNYPIVQNLILDSLRHWVTEFHIDGFSFINASHLLRGFHGEYLSRPPLFEAI

SEQ ID NO: 2343 - protein, 388 aa, Glycine max
  misc_feature (73)..(73): Xaa can be any naturally occurring amino acid
GIPWERLNYSRDKYRETRLKQYKNYQNFSRSPHHLRKECFQVQKGQTFYDFFFNTRLVKSTIVHFQLQLGRTXIMLRNLLWATSKHDVYLMQNYSVMHWSALLRRGKEVLNVAKPIIPTLKRPGFLAQPVSRVQISTMTVKENLMVAGGFQGELICKNLKHPGVLFCGKITTDDNAITNAVDVYSNPAGSLRVITANNDFQVRVFDAENFASLGCFKYDWSVNNTSVSPDGKLLAVLGDSTECLIADANTGKITGSLKGHLDYSFSSAWHPDGQILATGNQDKTCRLWDIRNLSQSMAVLKGRMGAIRALRFTSDGRFLAMAEPADFVHIFDSHSGYEQGQEIDLFGEIAGISFSPDTEALFVGIADRTYGSLLEFNRKRHYNYLDSF

SEQ ID NO: 2344 - protein, 188 aa, Glycine max
GENRRGRFLKVSEASVSRNRSTIIVPAGSSRDEGWAAFRNVLAEINEASRLFILPNQQNSESSERLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMTVANVRTVDPPQR

SEQ ID NO: 2345 - protein, 491 aa, Glycine max
MGIQCSRLIPCCVDSQVKASVIETPDAEIEDSSEVSNWPTFREYTLEQLKNATSGFAVENIVSEHGEKAPNVVYKGKLENQMRIAVKRFNRNAWPDARQFLEEARSVGQLRNQRLANLLGCCCEGEERLLVAEYMPNETLAKHLFHWETQPMKWAMRLRVVLHLAQALEYCTSKGRALYHDLNAYRVLFDEDGNPRLSSFGLMKNSRDGKSYSTNLAFTPPEYLRTGRVTPESVIYSFGTLLLDLLSGKHIPPSHALDVIRGRNLQMLTDSCLEGQFSDDDGTELVRLASRCLQYEPRERPNPKSLVVALAPLQKETEVPSHVLMGIQHSTTFASLSPLGEACSRKDLTAIQEVLESIGYKDDEGVANELSFHMWTDQMQDTLNCKKKGDVAFRQKDFRLAIECYSQFIDAGTMVSPTVYARRSLCYLISDMPQESLNDAIQAQIVSPVWHIASYLQSVALTGLGMENEAQAALKEGTTMESKRNATPKQK

SEQ ID NO: 2346 - protein, 384 aa, Glycine max
  misc_feature (259)..(259): Xaa can be any naturally occurring amino acid
  misc_feature (308)..(308): Xaa can be any naturally occurring amino acid
  misc_feature (338)..(338): Xaa can be any naturally occurring amino acid
PRVRLSPEIIETCLMWYARVDPPAVSRSNRKPLPSSSSSSSVATEAEQKEILETLVSNLPLEKSSKAATATRFLFGLLRTTNILNASEACRDALEKKIGLQLEEATLDDLLVPSYSYLNETLYDVDCVERILSQFLEGLEARTAAETTEDAAATRSPALMLVGKLIDGYLSEIASDANLKPEKFYNFAISLPDEARLFDDGLYRAVDVYLKAHPWVLEEEREKICGLLDCQKLTLEACTHAAQNERLPLRSVDQELFFXQLQLPQAIAGNFDGGGSRRETGKAINGAGAESGGQKKIKIRDRARAGTXGTWRVAMKDNQVLRLDMDSMKTHVHQLKRXCSSMKRVIFKINKFATYLGGWKATHDLKYPCKFKTQVCESQQSTDR

SEQ ID NO: 2347 - protein, 222 aa, Glycine max
HYYNTIIYNHCLQVYKLPSWAKFEIGRAAVYWKTMNGLPPSSGEKLKLFYNPAATQLVPNEEFGIAFNGGFNQPIMCGGEPRAMLRKYRGKADAPIYSIQICIPKHALNLIFSFTNGVDWDGPYRLQFQVPKALQNKPIDFFNKGLAEELSKEGACEQAIFPDTNKVITKCAMIGNLSKEGGDRCDLNFVVGCTDPSSHLYNPLANVDDGTCTIELDSESEE

SEQ ID NO: 2348 - protein, 198 aa, Glycine max
LLGLGEYLAFSPFLKLVHSSYFFWGHLNTSIIYFYSIFVPNEEFGIAFNGGFFLLAMCGGDPRAMLRKDRGKADAPIYSIQICIPKHALNLIFSFTNGVDWDGPYRLQFQVPKALQNKPIDFFNKGLAEELSKEGACEQAIFPDTNKIITKCAMIGNLSKEGGDRCDLNFVLGCTDPSSHLYNPLANVDDGTCTIELD

SEQ ID NO: 2349 - protein, 747 aa, Glycine max
MSVDGDSKELKELNQRLRDGKKIAGGEHGLCEEVKCNGIAEEVKVEQGGTVESSSVQQHIPQPQGAIICWERFLHIRSLKVLLVEIDDSTRHVVTALLRNCSYEVIEAANGLQAWKILEDLTNHIDLVLTEVAMPGLSGIGLLYKIMGHKTRKNIPVVMMSSHDSMGLVFKCLSKGAVDFLVKPIRKNELKNLWQHVWRRCHSSSGSGSESGTQTQKSIKSKSLEKSDNNSGSNDEDDNESIGLNNVDGSDNGSGTQSSWTKRAVEVDSHKPVSQWDQIAECPDSTCAQVVHSNAEMGGNKVVPLAAKDCAEQNEQLVKTAGSQHSNAPDVGPSKFSEQINRGQLDLNCENQSSKLRCKGLSLSDAITSTCDSQMHSGEFEALNKKPKSSDIENKGTNNDEELPSLELSLKRLRGVEDADITIQDDRNVLRRSDQSAFSRYNAASNTKKSPTGCVGSNSPYNNSLEVTKKDSSRDIQSHSCGNPPNQNSNGASNNIDMGSTTNNAYAKSAVMSEPAGASTTKCLYQTSAFQPVKNSLVCTSQQVVLNNTEDMSATILAPPKLDRHKDSAALDFHLHCENHNCIADNMKHQLPPDHDAESIKKMATAAPHCGSSNVEEVLVEGNVGNHSINRSVSGSNNGSNGQNGSSTAVNAGGTNTESNNGLTGNSGSGDASGSGSANRVDQNKTSQREVALTKFRQKRKERRERCFHKKVRYQSRKRLAEQRPRFRGQFVRQTSNENASEATTDS

SEQ ID NO: 2350 - protein, 389 aa, Glycine max
  misc_feature (3)..(3): Xaa can be any naturally occurring amino acid
  misc_feature (10)..(10): Xaa can be any naturally occurring amino acid
  misc_feature (15)..(15): Xaa can be any naturally occurring amino acid
  misc_feature (39)..(39): Xaa can be any naturally occurring amino acid
  misc_feature (105)..(105): Xaa can be any naturally occurring amino acid
  misc_feature (202)..(203): Xaa can be any naturally occurring amino acid
  misc_feature (213)..(213): Xaa can be any naturally occurring amino acid
VAXGEEGATXEFTPXTWVVAAFCTVIVAISLAAERLRHXLEGKFLKAKDQKSLYEALQKIKEELMLLGFISLLLTVTQNGITKICVRPSLTRHMLPCNLDAGETXRLSPSPPLKLVTCVRKNKVPLLSLEALHHLHIFIFVLAVVHVSFSLLNRCLSEGAKNTFIVETTWERFILLKTELTKTWPKFSNQRSLQVHQHDFFXXRFAGFDKDSXIVGWLLSFLKQFYGSVTKSDYVTLRHGFIMTHCRTNPKFNFHKYMIRALEDDFKQVVGISWYLWLFVVIFLLLNINAFTFPVVLLLAVGTKLGHVITQLAQEVAEKHAAIEGDLVVQPSDEHFWFHRPHVVLFLIHFILFQNAFEIAFFFWIWVTYGFDSCIMGQVRYIVPRLVIG

SEQ ID NO: 2351 - protein, 246 aa, Glycine max
  misc_feature (31)..(31): Xaa can be any naturally occurring amino acid
  misc_feature (40)..(40): Xaa can be any naturally occurring amino acid
  misc_feature (60)..(60): Xaa can be any naturally occurring amino acid
  misc_feature (154)..(154): Xaa can be any naturally occurring amino acid
KDNGALFLLSTNDKTIIFWKGQEKKDKKVSXLNVDPKLMXIGSIACTSNSRSYTSYSCKXYYLTDGPYNYLNNDFSFPPGGVPSLTLPLVVTSHETSLMARCRRVYAHAHDYHINSISNNSDGETFISADDLRINLWNLEISNQSFNIVEVEPXTLYMEDLTEVITSAEFHPTHCNTLAYSSSKGSIRLVDLRQSALCDSHAKLFEEQEAPGSRSFFTEIIASISDIKFGKDGRYILSRDYMTLKV

SEQ ID NO: 2352 - protein, 200 aa, Glycine max
MVSSDKDPREDVLQAWYMDDSDEDQRLPHHKEPKEFVSLDQLAELGVLSWKLDADNHENDPELKKIREERGYTYMDVCEVCPEKLPNYEQKIKSFFEEHLHTDEEIRFCAAGSGYFDVRDCNDAWIRVWVKKGGMIILPAGIYHRFTLDESNYIKALRFFVGEPVWTPHNRPNDHLPARQQYVKDFVEKDVGNHAVDAAA

SEQ ID NO: 2353 - protein, 212 aa, Glycine max
MAPFVSLSLLLLFLNHPLLSLSTNPEGNALHALRSRLSDPNNMLQSWDPTLVNPCTWFHVTCDSNNHVIRLDLGNSNVSGTLGPELGQLQHLQYLELYRNELTGKIPKELGNLKSLISMDLYDNKLEGKIPKSFGKLKSLKFLRLNNNKLTGSIPRELTRLTDLKIFDVSNNDLCGTIPVEGNFESFPMESFENNRFSGPELKGLVPYDFGC

SEQ ID NO: 2354 - protein, 304 aa, Glycine max
  misc_feature (201)..(201): Xaa can be any naturally occurring amino acid
MLGSGGVSDGYEVGSKRQRMMESNPYFAVSSGTGNLPYGYAGGFQPPPFPVVRLRGLPFNCTDIDILKFFAGLTIVDVLLVNKSGRFSGEAFVVFAGAMQVEFALQRDRQNMGRRYVEVFRCKKQDYYNAVAGEINYEGIYDNDYHGSSPPPSRLKRFNDKDQMEYTEILKMRGLPFQVTKSQIVEFFKDFKLIEDRVHIXCRPDGKATGEAYVEFVSAEEAKRAMSKDKMTIGSRYVELFPSTPDEARRAESRSRQESEVFYLVLGRLPWSFWGYYNVLNFRLCTLFLLVRLAVIFACLNWMH

SEQ ID NO: 2355 - protein, 145 aa, Glycine max
  misc_feature (105)..(105): Xaa can be any naturally occurring amino acid
  misc_feature (116)..(116): Xaa can be any naturally occurring amino acid
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDDELGKXLLGRVTIAHGXNPVLLPKKTERAAKEPKSPSKATKSPKKA

SEQ ID NO: 2356 - protein, 288 aa, Glycine max
LTLGQDLPDGNLGALQKKGNVAKDKFSKVLWYAITNYRTWVFALLYGYSMGVELTTDNVIAEYFYDRFNLKLHTAGIIAASFGMANLLARPFGGYTSDVAARLFGMRGRLWNLWILQTLGGVFCIWLGRANSLPIAVLAMILFFIGAQAACGATFGIIPFISRRSLGIISGLTGAGGNFGSGLTQLIFFSTSRFSTSTGLSLMGVMIVCCTLPVTLVHFPQWGSMFLPPSKDVNKSTEEYYYTAEWNEEEKQKGLHQNSLKFAENSRSERGKRVASAPTPPNTTPTHA

SEQ ID NO: 2357 - protein, 158 aa, Glycine max
MSAAEEAKVPAVEKPVEEVKAPKLAKEKKPKAPKEKKPKQAKTASHPPYLQMIKDALIALNEKGGSSPYAIAKYMEEKHKAVLPANFKKILGLQLKNQAARGKLVKIKASYKLAEAAKKVKESTAKATKKTKKVSTPAKPKQPRSIRSPTKRARKAAV

SEQ ID NO: 2358 - protein, 82 aa, Glycine max
MGFRLLGLQRRSNVPKGYLAVYVGKNEKKRFMIPISYLNQPSIQDLLSQAEQEFGFAHPMGGLTIPCREDVFLDITSRLQRS

SEQ ID NO: 2359 - protein, 291 aa, Glycine max
  misc_feature (202)..(202): Xaa can be any naturally occurring amino acid
MAATFKHHPTGLHGWGAPRSSRNLPSFFSMRFPCSTRHHHIRASVSHHSSTEAESALILIRHGESLWNEKNLFTGCCDVPLTNRGVEEAIEAGQRISYIPIDMIFTSALIRAQMTAMLAMTQHSQKKVPIIIHDESEQATTWTQVYSEKTTKQSIPVITAWQLNERMYGELQGLNKQETAERYGKEKVHEWRRSFDIPPPKXEPQLKSGKHVMVAAHGNSLRSIIMYLDGLTSQEVTSLEISTGIPLLYIYKEGKFNSRGSPVGPTEAGVYAYTQSLAVYRQQLDDMSSCY

SEQ ID NO: 2360 - protein, 118 aa, Glycine max
  misc_feature (85)..(85): Xaa can be any naturally occurring amino acid
MAATFKHHPTGLHGWGAPRSSRNLPSFFSMRFPCSTRHHHIRASVSHHSSTEAESALILIRHGESLWNEKNLFTGCCDVPLTNRXVEEAIEAGQRISYIPIDMIFTSALIRAQMTAML

SEQ ID NO: 2361 - protein, 125 aa, Glycine max
  misc_feature (99)..(99): Xaa can be any naturally occurring amino acid
AWSHTPFNYTFLSFTNIRTRYHDLCLSDANQITNSRFILCQLYNREDPSPDCMTTVQVLGDGIRRHSMVLSGIQSSTTGHFSGPGEVYSIKHDITDVKXLMPGWLFVIRKVVCHKYLVYGSEKFI

SEQ ID NO: 2362 - protein, 352 aa, Glycine max
MAEAESVQIPQVKLGTQGLVVSKLGLGCMTLSGRYNDPLPEEEGISVIKHAFSQGITFFDTSDVYGLDHANEFLLGKALKQLPREKIQVATKFGVAVAKFPNFQIKGTPEYVRSCCEASLKRLDVEYIDLYYQHRIDQTVPIEETVGELKKLVEEGKVKYIGLSEASPDTIRRAHAVHPITALQIEWSLWTRDIEEEIIPLCRSLGIGIVPYSPLGRGFFGGKGVLENMPASTVLTLHHPRFQAENINKNKRIYEQIESLAKKYQSTPAQLALAWVLHQGNDVAPIPGTTKIKNLDQNIGALSLKFTESDLREISEAVPIHDVARSQYFFGNDKDFLEKLPTHLSKDPRVFT

SEQ ID NO: 2363 - protein, 193 aa, Glycine max
  misc_feature (120)..(120): Xaa can be any naturally occurring amino acid
  misc_feature (138)..(138): Xaa can be any naturally occurring amino acid
MEGQFQVGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRYCLEGSGYFDVRXQDDQWIRVAVKKGGMIVXPAGMFTYVGSALIKQCVFASLAHKSPMTFREGEITEGNHFVPLPLVPPDNSSPAF

SEQ ID NO: 2364 - protein, 128 aa, Glycine max
  misc_feature (20)..(20): Xaa can be any naturally occurring amino acid
  misc_feature (34)..(34): Xaa can be any naturally occurring amino acid
MAHDLALDLEELCRIQRIAXRPLALSLLCSEMSXTSEKLSPEEASAQIPVPISTGTKEAPSPALKYAALTSIRWDHDSDKGTIYALMEGISENNDESECKSMSFDANVHDAQWKNYRCALSQLDIEIV

SEQ ID NO: 2365 - protein, 131 aa, Glycine max
  misc_feature (71)..(71): Xaa can be any naturally occurring amino acid
  misc_feature (109)..(109): Xaa can be any naturally occurring amino acid
KKFIKYPKDLLIAEAWDAGGLYQVGIFPHWGIWSEWNGKYRDTVRQFIKGTDGFAGAFAECLCGSPNLYQXGGGRKPWHSINFICAHDGFTLADLVTYNNKNNLSNGEXNNDGENHNNSWNCGQEGEFVST

SEQ ID NO: 2366 - protein, 482 aa, Glycine max
  misc_feature (121)..(121): Xaa can be any naturally occurring amino acid
  misc_feature (132)..(132): Xaa can be any naturally occurring amino acid
  misc_feature (181)..(181): Xaa can be any naturally occurring amino acid
AGIRNCGQDGINEIKFLIKEAHKRGIEVIMDVVFNHTAEGNENGPIISFRGVDNSMYYMLAPKGEFYHYSGCGNTFNCNHTVVRQFIVDCLRYWVTDMARGWVFAYDLVSIMTILNLKGHXLNRIYSAPRCXYIFSCSWTYNQYPLMRRCQYNSQISISKELLISVASFSFITIVQSRLLXLYVQWNGKYRDTVRLFIKGTDGFAGAFAECLCGSPNLYQGGGRKPWHSINFVCAHDGFTLADLVTYNNKNNLSNGEDNNDGENHNNSWNCGQEGEFVSTSVKKLRKRQMRNFFLSLMVSQGVPMIYMGDEYGHTKGGNNNTYCHDNYHNYFQWDKKEESSSDFFRFCRLMTKFRQECESLGLADFPTSERLQWHGHFPGKPDWSETSRFVACTMVDSVKGEIYIAFNMSHLPFTVTLPERPGYKWEPLVDTSKPTPYDFLTPDLPGRDIAIQQYAQFLDANMYPMLSYSSIILLRIPDENL

SEQ ID NO: 2367 - protein, 157 aa, Glycine max
MGILRKKKHERKPSFKSVLTSILATQAVTFLLLISGVSLAGTAAAFIATMPLFVVFSPILVPAGITTGLLTTGLAAAGGAGATAVTIILWLYKQATGKEPPAVLSKVLKKIIPGAAAAPAAAPAAAPAAAPAAAPAAAPAPKPAAAPAPKPAAPPAL

SEQ ID NO: 2368 - protein, 480 aa, Glycine max
  misc_feature (87)..(87): Xaa can be any naturally occurring amino acid
MSSVLEHGVVGCCKSGPGYATPLEAMSGPRESLIYVTAVYTGTGIEKPDYLATVDIDPNSPTYSKVIHRLRVPYLGDELHHTGWNSXSSCHGDPSADRRFLIAPALVSGRIYVVDVKTNPRAPSLHKVVEPADIIQKTGLAYPHTSHCLASGDIMISCLGDKDGNAAGNGFLLLDSEFNVKGRWEKPGHSPLFGYDFWYQPRHNTMISTSWGAPSAFTKGFNLQHLSDGLYGRHLHVYSWPGGELRQTLDLGDSGLLPLEIRFLHDPAKDTGFVGSALTSNMIRFFKTQDESWSHEVAISVKPLKVQNWILPEMPGLITDFLISLDDRFLYFVNWLHGDIRQYNIENLKNPKLTGQVWVGGLIQKGSPVVAITDDGETWQAEVPEIQGNKLRGGPQMIQLSLDGKRLYATNSLFSTWDKQFYPELVQKGSHIIQIDVDTEKGGLKINPNFFVDFGAEPDGPSLAHEMRYPGGDCTSDIWI

SEQ ID NO: 2369 - protein, 248 aa, Glycine max
  misc_feature (189)..(189): Xaa can be any naturally occurring amino acid
VLIMKMVEHPNIVNLIEVIDDPESDDFYMVLEYVESKWVCEGTGHPCALGEETARKYLRDIVSGLTYLHAHNIVHGDIKPDNLLITRHGTVKIGDFSVSQAFEDGNDELRRSPGTPVFTAPECCLGLTYHGKASDTWAVGVTLYCMILGEYPFLGDTLQDTYDKIVNDPLVLPEDINPQLKFHRALTTXLKNLIEGLLCKDPELRMTLGDVAEHIWVIGDDGPIPGYLCWCKRKSMVTEDSDGSDILD

SEQ ID NO: 2370 - protein, 412 aa, Glycine max
  misc_feature (119)..(119): Xaa can be any naturally occurring amino acid
  misc_feature (129)..(129): Xaa can be any naturally occurring amino acid
MLNKTLSFAMGCCSCFGFIRTPNRQSQRSKPTTNNNLCQEPLLDDDIEDEEGEPLYNDEVTNNSGDEGAEETRPKRSEEILNFRVENGMICRQFPVKETRKLVRSEDENGNKMINEYKXVRECKIGSGXQYGKVALYRSSVDGKHYAIKAFHKSHLLKLRVAPSETAMTDVLREVLIMKMLEHPNIVNLIEVIDDPESDDFYMVLEYVESKWVCEGTGHPCALGEETARKYLRDIVSGLTYLHAHNIVHGDIKPDNLLITRHGTVKIGDFSVSQAFEDGNDELRRSPGTPVFTAPECCLGLTYHGKASDTWAVGVTLYCMILGEYPFLGDTLQDTYDKIVNDPLVLPEDINPQLKNLIEGLLCKDPELRMTLGDVAEHIWVIGDDGPIPGYLCWCKRKSMVTEDSDGSDILD

SEQ ID NO: 2371 - protein, 374 aa, Glycine max
APPPRLMPDLSTLTRIPWNKQDEMVLADMCVKPGEAWEYCPRDALRRASKILKDEFDLEMNAGFENEFILLKSITREGKEEWIPFDSSPYCSSSAFDAASPILHEVAASLHSLGISVEQLHAEAGKGQFELVLKYTVCTKAADNLTFTREVVRAIARKHGLLATFIPKYALDDLGSGSHVHLSLSRNGQNVYMASDRSSKHGISTLGKEFMAGILHHLPSILAFIAPLPNSYDRLQPNTWSGAYLFWGNENKEAPLRATSPPGTPDGLVSNFEMKSFDGSANPYLGLAAILAAGIDGLRRKLSLPEPVDTNPNPETLQRLPASLSESLDALNKDDFLKEFMSDKLLTTIKAIRKAEIDHYTKHKDAYKQLIHRY

SEQ ID NO: 2372 - protein, 323 aa, Glycine max
  misc_feature (314)..(314): Xaa can be any naturally occurring amino acid
ERESVCVCRRCGPFSRKGASGFSSSSTAEQVTEGIDGTGLTAIVTGASSGIGTETTRVLSLRGVHVIMGVRNMLAAKDVKETLLKEIPSAKVDAMELDLSSLESVKKFASEFKSSGLPLNMLINNAGIMACPFKLSKDKIELQFATNHLGHFLLTNLLLDTMKKTSRETKKEGRIVNVSSEAHRFTYSEGIRFDKINDESSYSNWRAYGQSKLANILHANELTRRLKEDGVDISANSLHPGVIATNLSRHISPVNGLTKAIARLVLKNVQQGAATTCYVALHPQVKGTSGKYFSASNVAKTTSQGTDADLAKKXWDFSMDLTK

SEQ ID NO: 2373 - protein, 72 aa, Glycine max
  misc_feature (8)..(8): Xaa can be any naturally occurring amino acid
  misc_feature (10)..(14): Xaa can be any naturally occurring amino acid
  misc_feature (17)..(17): Xaa can be any naturally occurring amino acid
  misc_feature (24)..(25): Xaa can be any naturally occurring amino acid
  misc_feature (45)..(45): Xaa can be any naturally occurring amino acid
PWYETTVXGXXXXXPFXGLKSMAXXPTRKTNNDITSIASNGGKSXNAWQVWPPVGQEEIEILSYLPDLMMHG

SEQ ID NO: 2374 - protein, 151 aa, Glycine max
  misc_feature (30)..(31): Xaa can be any naturally occurring amino acid
  misc_feature (59)..(59): Xaa can be any naturally occurring amino acid
MELRTLGGTGLRVSPVGFGASPLGNVFGDXXRDVARATVRRALDLGINFFDTSPYYGGXVSESVLGDCLRFSGVPRDSFVVATKCGRYKEGFDFSATRVTRSIDESLARLGLDYVDILHCHDIEFTSLDQIVNETIPALQKIKESGKARFI

SEQ ID NO: 2375 - protein, 254 aa, Glycine max
  misc_feature (165)..(165): Xaa can be any naturally occurring amino acid
MGVLQSTLLYLILVHSCKIVAYKDQEWKKATATYANDTEGSLITEGACGYGDLHRASYGKHSAGLSTILFNRGSTCGACYEIRCVDHILWCVMGSPSVVVTVTDFCAPNYGLSVDYGGWCNFPREHFEMSRAAFAEIAKNKADIVPVQYRRVKCARSGGMRFTMXGSSHFYQVLISNVGLDGEVFAVKVKGSRTGWIPMARNWGQNWHCNFNFQNQPLSFEVTSSSGKTLTSYNVAPTNWMFGQTFEGKQFEHE

SEQ ID NO: 2376 - protein, 327 aa, Glycine max
  misc_feature (223)..(223): Xaa can be any naturally occurring amino acid
MQDSGSMKISPLDLMSAIIKGKLDPSNVSSSTNAAAAAAFLLENRDFLMLLTTSVAVLIGCFVVFIWRRSSSPKAKPLEPPKRVVEKLPEIEVDDGTKKVTIFFGTQTGTAEGFAKAIAEEAKARYDKATFRVVDMDDYAADDDEYEERFKKETHALFFLATYGDGEPTDYAARFYKWFTEGGEKGEGWLQNLHYGVFGPGNRQYEHFNKVAKVVDDMLVEQXGYRLVPVGLGDDDQCIEDDFTAWKEELWPALDELLRDEDDATVSTPYTAAVLEYRVVIHDPLEASVDEKKWHNVNGHAIVDAQHPVRANVAVRKELHTSASDRS

SEQ ID NO: 2377 - protein, 181 aa, Glycine max
FTHSGGSARRRQKGGPTINAQLLHPHARPSKIDPARLLDWENFQQSSEIIDVLSTIHSEIPRGVVLGDYVIEYGDDDSADEFEDFPGDEGNWWTSCILYHAFNNFRSSRNRRRTRVGDQSRVNRHLSSDTSNSDEGSVASVEYGEYRLDEIDDDFVSTIGHLRGGSGFRRSRRRHSRSNDN

SEQ ID NO: 2378 - protein, 116 aa, Glycine max
  misc_feature (96)..(96): Xaa can be any naturally occurring amino acid
  misc_feature (98)..(98): Xaa can be any naturally occurring amino acid
  misc_feature (100)..(101): Xaa can be any naturally occurring amino acid
  misc_feature (106)..(107): Xaa can be any naturally occurring amino acid
  misc_feature (113)..(113): Xaa can be any naturally occurring amino acid
  misc_feature (115)..(115): Xaa can be any naturally occurring amino acid
FFLKSYTKQAHSALFPRSIKVLAKIESLESLHKLEEIVQASDGIMVARGDLGVEIPLEQIPTVQEDIIYVCRQLNKPVIVASQLLESMVEYPTPTXAXVXXVSEPXXQYADAXMXS

SEQ ID NO: 2379 - protein, 327 aa, Glycine max
MEWNVTISAINWAHGEACVSCHCTINKGLDHHHWRIPLSGPFGDEVSRVFGGGLVPGSLTLIGGDPGVGKSTLLLQIAAIIAKGDSDGEACPVVYVSGEESVEQIGNRADRLRIESDIYLYSSNDVEDILKKVQYLSPGALIVDSIQTVYLKGIMGSPGGIMQVKECTSALLRFAKKTNIPVLLIGHVTKSGDIAGPRVLEHIVDVVLYMEGEKYSPHRMLRAVKNRFGSTDELAVLEMSQSGLQVVSNASEMFLTQQHSDSNVLAGLAIAVIMDGSRTFLIEIQALCLTHCPVSSSLSNGINANKANIIKCVLIKQTGLHLQDNVS

SEQ ID NO: 2380 - protein, 189 aa, Glycine max
  misc_feature (104)..(104): Xaa can be any naturally occurring amino acid
KFSIVFFFFRFSIFYSMGIGGSALGPHFVAEALAPDNPPLKIRFVDNTDPAGVDHQIAQLGLELASTLVIVISKSGGTPETRNGLWEVQKAFREAGLDLPKQVXSQGVAITQENSLLDNTARIEGWLARLPMFDWVGGRTSEMSAVGLLPAALQGIDIIEMLAGASLMDEANRSTADMAILSIQGQPVI

SEQ ID NO: 2381 - protein, 499 aa, Glycine max
  misc_feature (175)..(175): Xaa can be any naturally occurring amino acid
  misc_feature (299)..(299): Xaa can be any naturally occurring amino acid
MNSNGYPASSFKIPTVKFTKLFINGHFVDSLSGGEFETIDPRTGEVIARIAEGTKEDIDLAVKASRLAFDHGPWPRMPAVERARIMMKWADLIDQHVEEIAALDAIDAGKLYHMCKAIEIPATANTIRYYAGAADKIHGEVLKTSREFHAYTLLEPLGVVGHIIPWNFPSIMFVXKVSPCLAAGCTMVLKPAEQTPLSALFYAHLAKLAGIPDGVLNVVPGFGATAGAAISSHMDIDKVSFTGSTEVGREVMRAAANSNLKPVSLELGGKSPFIIFDDADLDKAVELALMAVVYNQGRXCAAGSRVFVQEGIYDEFEKRLVEKAKAWVVGDPFDPNVQQGPQVDKKQFEKILSYIEHGKREGATLLTGGKRVGNKGYYIEPTIFSNVKEEMLIAQDEIFDPVIALMRFKTIEEAIKSANKSRYGLVAGVVTKSLDTANTMSRSIRPGVVWINCYFAFENDIPYGGCKMSGFGKDSGLEALHKYLHVKSVVTPIYNSPWL

SEQ ID NO: 2382 - protein, 781 aa, Glycine max
MAYKHHPSVFLVFVTVLLSIHCSEQLQSSHSQTLLRIQQLLNFPVSLSNWNNNTDFCNTDSNSSLNVVCYEDTITQLHIIGERRDTPLPRNFSIDSFVTTLVRLPSLKVLTLVSLGIWGPLPSKIARLSSLEIVNMSSNFLYGSIPQELSSLSSLQTLIFDNNMLADTFPHWLDSLQALTVLSLKNNKFNGSLPKSLGNVENLRTLSLSHNHFYGAVPDLSRLTNLQVLELDDNAFGPQFPQLGNKLVILVLRKNSFRSGIPAELSSYYQLERLDISSNSFVGPFQPGLLSLPSITYLNISGNKLTGMLFENLSCNSELDVVDLSSNLLTGSLPRCLVSNSSDSTVLYARNCLDTTNQNQQPQPFCHTEALAVGILPETKKHKQVSKVVLSLGIVGGTLGGVALVLLVFFIVRRGNDRSKTKNPPTRLISENAASGYTSKLFSDARYISQTKKLGAVGLPTYRSFSLEEIESATNYFDTASLMGEDSYGKMYRGQLKNGSLVAIRCVEMKKRHSTQNFVQHIELISKLRHRHLVSAIGHCFECSLDDSSVSKVFLVFEYVPNGTLRNWISDEHARKSFSWTQRIGAAIGVAKGIQFLHTGIVPGVYSNDLKIEDVLLDQNLVAKISSYHLPLLSNMGKVRRGNSSSGLKNSSNSKSVKQEDKSDIYNFGVILLELILGRQIKTVNDADAFRDLLQASLGGDEEGRRGVVDPAFRKACLDQSLKTMMEICVRCLVKEPADRPSIEDVLWNLQFASQVQDAWRGDSQSSEGSPGSESRGLPFH

SEQ ID NO: 2383 - protein, 140 aa, Glycine max
  misc_feature (45)..(45): Xaa can be any naturally occurring amino acid
  misc_feature (78)..(78): Xaa can be any naturally occurring amino acid
  misc_feature (106)..(106): Xaa can be any naturally occurring amino acid
  misc_feature (132)..(132): Xaa can be any naturally occurring amino acid
LSTATRAGMVAPFTGLKTMAGFPTSKTNNDITPRASNGGRVSFFXERTPDGKNEVDTLRHLPDDDDAQLAKEPATVLXKGWIPWLEFEKEDGFVYREHKRAPGYYXGRYWTMSDTETFGRTDRSPVLKRLSXGNTGYPQA

SEQ ID NO: 2384 - protein, 262 aa, Glycine max
LCSGFDFLSNCRTTRSRAAAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCLPVGQSDVPRSSTVKIYCPRCEDIYYPKSKYQDIDGAYFGATFPHLFLMTYGNLKPQKQSQNYVPRVFGFKVHKS

SEQ ID NO: 2385 - protein, 160 aa, Glycine max
MAEEHRCQAPRFCANNCGFFGSPATQNMCSKCYRDFQLKEQQSSNAKMVLNQSLVPSPPPAVISQPSSSSSAAVDPSSAVVDDAPREAEEVKAPQQNRCMTCRRRRRVGLTGFKCRCGMMLCGTHRYPEQHACEFDFKGMGREQIAKANPVVKGEKLDKI

SEQ ID NO: 2386 - protein, 248 aa, Glycine max
MTNKEFKVPPVAFPSAGNPASAGPNLQQRRMPTPPFQPNSGIPFMSFDIGSAAASTSSGPIYTGPAVGAGGSANFDDEEPLLDELGIHPDQIWSKIRSVLNPFRVNHTVHKDSDLSGPILLYMSFCLFQLLAGKIQFGVILGWIVVSSIFLYVVFNMLAGRTGNLDLHTCTSVVGYCLLPVVIFSALSLFLPVDGVIRLSVAAVFVLWATRASAGLVVSLADGGDEHRGLIAYASFLIYTLFSLLVIF

SEQ ID NO: 2387 - protein, 471 aa, Glycine max
TLLPLIHHPHPKRPELHHLLLLPFPHSSTPHKPPSFQRSKTLLRASTVESPTPKRRGRKKKPETQTPSNNTPPPQNADNKTEEDELHDYDDGVDFPYSDPPLICCFGLARKEFVPAVRVQDYPMHPDIYSEWKMLQWKPPEFARAPGGPPSNVAVAHARLGGRAAFLGKVGDDEFGEEMVLMMNEERVQTRGVKIDSKCRTGCSYMKVKFEEEGRMKMETVREAAEDSLLANELNLAVLKEARIFHFNSEVLTCPSMESTLFRAIKWTKKFDGLVFFDLNLPLPLWRSHDETREIIKKAWNEADIIEVSRSELEFLLDEEYYERKRNYRPQYFAENYEQTKNRQEYYHYTAEEVSPLWHDRLKFLFVTDGTLGIHYYTPSFDGSVMGTEDVLITPYTCDRTGSGDAVVAAILRKLTTCPEMFENQDVLERQLRFAVAAGIISQWTIGAVRGFPTESATQNLKEQVYVPSLW

SEQ ID NO: 2388 - protein, 202 aa, Glycine max
VLLELFPQPPPTRAPSNPWPQWPRIFRVDYGHQEAAAKFGKDPRSYEVLTKRFIGDENGVVKGLEVIRDCWEKDETGKFQFKEIEGSEEIIEADLVLLAMGFLGPESTIAEKLGVERDNRSNFKADYGRFSTNVKGVFAAGDCRRGQSLVVWAISEGRQAAAQVENYLIKEDQDHRNQDGLVKRQQGLNMKQQGSNKHTVMT

SEQ ID NO: 2389 - protein, 387 aa, Glycine max
  misc_feature (13)..(13): Xaa can be any naturally occurring amino acid
  misc_feature (71)..(71): Xaa can be any naturally occurring amino acid
  misc_feature (107)..(107): Xaa can be any naturally occurring amino acid
AWWKEIKRQALMXLVDFIQSGSGKISENCQEEMIILISPYIFKHWRKTSNENTGKEPTDPEEEEPSLEPSXPDAELVDERLIRFVVSSDSDTKIARRYIDHFFVLWXLDLFHSEDPREREYLKTILHRIYGKFMVHRPFIRKAINNIFYRFIYETERHSGIGELLEILGSIINGFALPMKEEHKLFLARALLPLHKPKPVGVYHQQLSYCIAQFVEKDFKLADTVIRGLLKYWPVTNCQKEVLFLGELEEVLEATQTAEFQRCMVPLFRQVARCLNSSHFQVAERALFLWNNEHIVSLIAQNRTVVLPIIFEALEKNIKSHWNQAVHGLTVNVRKMFIEMDAELFEECQRQYEEREAKAKELEEQRELNWKRLADAAAQNGVDMVTA

SEQ ID NO: 2390 - protein, 330 aa, Glycine max
  misc_feature (127)..(127): Xaa can be any naturally occurring amino acid
VSKLGFGCMGLTGAYNDPLQEQDGISVIKYAFSKGITFFDTADVYGANANELLVGKALKQLPREKIQIATKFGIASRGFPDMKIKGSPEYVRSCCEASLKRLDVEYIDLYYQHRVDTSVPIEETYYXVGELKKLVEEGKVKYIGLSEASPDTIRRAHAIHPITAVQIEWSLWTRDIEEEIVPLCRELGIGIVPYSPLGRGFFGGKGVLETVSTVSSLITHPRFRAENLDKNKKLYGKIESLATKQQCTPSQLALAWVLHQGNDVVPIPGTTKVKNLDQNIGAVSLKLTESDLREISEAVPIDEVAGTRHYYGSANFSWTVANTPPKDPRV

SEQ ID NO: 2391 - protein, 99 aa, Glycine max
NFLYQWAFAIAAAGITSGSIAERTQFVAYLIYSSFLTGFVYPVVSHWFWSADGWASAISPGDRLFSTGVIDFAGSGVVHMVGGVAGFWGALIEGPRIGR

SEQ ID NO: 2392 - protein, 153 aa, Glycine max
  misc_feature (112)..(112): Xaa can be any naturally occurring amino acid
  misc_feature (115)..(115): Xaa can be any naturally occurring amino acid
NFLYQWAFAIAAAGITSGSIAERTQFVAYLIYSSFLTGFVYPVVSHWFWSADGWASAISSADHVFSPGDRLLSTGVIDFAGSGVVHMVGGVAGFWGALIEGPRIGRFDHGGXRAXALRGHSASLVVLGTFMLWFGWYGFNPGSINKILVSYGN

SEQ ID NO: 2393 - protein, 147 aa, Glycine max
MNALPILLFFLFVSALVYAKKTGDVTELQIGVKHKPASCEVLAHKGDRVKVHYRGKLTDGTVFDSSFERNNPIEFELGTGQVIKGWDQGLLGMCLGEKRKLKIPAKLGYGDQGSPPTIPGGATLIFDTELVGVNDKSLGEEKENSEL

SEQ ID NO: 2394 - protein, 169 aa, Glycine max
  misc_feature (55)..(55): Xaa can be any naturally occurring amino acid
PPQERATQRFDSGRREWRRRRPSPPPTSPASPLPHRPRSTTTRTTSSASAAPAAXAQRLVAMAGSGKFFVGGNWKCNGTKESISKLVSDLNAATLESDVDVVVAPPFIYIDQVKSSLTGRIEVSAQNTWIGKGGAFTGEISAEQLVDIGCQWVILGHSERRHVIGEDDE

SEQ ID NO: 2395 - protein, 148 aa, Glycine max
NHSFSISVSVLRFKVCVFRRFSVMGSEQNDSFSPSEPKLCVNGCGFFGSPSNMNLCSKCYRDIRATEEQAASAKAAVDKSLNPNKPHTKPPQQSLETAPEPSSSASVGDSSDPPRATRCLSCNKKVGVTGFKCRCGSTFCGAHRYPES

SEQ ID NO: 2396 - protein, 72 aa, Glycine max
MASFRFSFGFGVVAAVVLSLIFTLYMPVAVHAQSLAPAPAPTSDGTSIDQGIAYVLMMLALALTYLIHSSTF

SEQ ID NO: 2397 - protein, 186 aa, Glycine max
MGSGLSHNHRSSVAPQQQPSSARVIAADGSLTEFATSSPVSVSDVLGGNADGPFFLCSSDALYFDEDVPALGGGEQLRPGQIYFVLPVAMLGRPLSSADMAAMAVRASEALATRARPRGRGAGIRKVRVTPVHPESGRGDVDAQVNAKLNERRLGEYSVKAGNPAKISKAVAACPPAPLPLSIKDE

SEQ ID NO: 2398 - protein, 348 aa, Glycine max
MGSASESVCVTGASGFIGSWLVMRLIERGYTVRATVRDPVNMKKVKHLVELPGAKSKLSLWKADLAEEGSFDEAIKGCTGVFHVATPMDFESKDPENEVIKPTINGVLDIMKACLKAKTVRRLIFTSSAGTLNVIERQKPVFDDTCWSDVEFCRRVKMTGWMYFVSKTLAEKEAWKFAKEQGLDFITIIPPLVVGPFLMPTMPPSLITALSPITGNEDHYSIIKQGQFVHLDDLCLAHIFLFEEPEVEGRYICSACDATIHDIAKLINQKYPEYKVPTKFKNIPDQLELVRFSSKKITDLGFKFKYSLEDMYTGAIDTCRDKGLLPKPAEKGLFTKPAETPVNAIMHK

SEQ ID NO: 2399 - protein, 301 aa, Glycine max
MASRDNKKASSSRAGRIRTLSDLNRPSADSDSDSDGPQEYYTGGEKSGMLVQDPSKGNDVDEIFNQARQLGAVERPLDQLQEPPRSTSFTGTGRLLSGETTRSTNNQQPEAVVHNIVFWSNGFTVNDGPLRSLDDPENASFLESIKKSECPKELEPEDRRSSVNVNLIRRNENYREPEKQHVAFQGVGRTLGSSSTSMAPDPPAASTPSNAAPTPSAGLVVDQSLPSTSIQLRLADGTRLISHFNYHHTISDIRAFIDASRPGGRQNYQLQLMGFPPKILADETQTIEQAGLANSVVIQKF

SEQ ID NO: 2400 - protein, 172 aa, Glycine max
KDKGLGKPPPLGGGPFEGSAGIREGGRTGITALTVAAYFFLAFFFTPLLASIPAWAVGPPLILVGVLMMRSVVEIDWEDMREAIPAFVTLILMPLTYSIAYGLIGGIGTYIVLNLWDWGWEGLGRFGLGKKTTTAAAMASDEDSHHHHGVNGILQNQHSPQNPTAKALQLEP

SEQ ID NO: 2401 - protein, 616 aa, Glycine max
  misc_feature (530)..(530): Xaa can be any naturally occurring amino acid
MASLSGICSSSPTLKKFPNQSPSLTDPLRKDHVSFPARLADRTLSLAPLRAVAREVSDGALAAAVKKGLEKDPRALWRRYVGWLYQHKELGIYLDVSRVGFSDEFVKEMEPRFQAAFRAMEELEKGAIANPDESRMVGHYWLRDPKRAPNSFLKTQIENTLDAVCKFANDVVSGKIKPPSSPEGRFTQILSVGIGGSALGPQFVAEALAPDNPPLKIRFVDNTDPAGIDHQIAQLGPELASTLVIVISKSGGTPETRNGLLEVQKAFREAGLDFPKQGVAITQENSLLDNTARIEGWLARFPMFDWVGGRTSEMSAVGLLPAALQGIDIREMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKXAAGEVLALQKRVLAVLNEASCKEPVEPLTLEEVADRCHAPEDIEMIYKIIAHMAANDRALIVEGSCGSPRSIKVFLGECNIDGLYA

SEQ ID NO: 2402 - protein, 338 aa, Glycine max
MPSSESSTGFSETICVTGAGGFIASWMVKLLLEKGYTVRGTLRNPDDPKNGHLKEFEGASQRLTLHKVDLLHLDSVRSVINGCHGVFHTASPVTDNPEEMVEPAVNGAKNVIIAAAEAKVRRVVFTSSIGAVYMDPKRSIDLVVDESCWSDLEFCKNTKNWYCYGKAVAEEAAWDTAKEKGVDMVVVNPVLVLGPLLQPSINASTIHILKYLTGSAKTYANATQAYVHVRDVALAHILVYEKPSASGRYICAESSLHRGELVEILAKYFPDYPVPTKCSDEKNPRAKPYTFSNQKLKDLGLEFTPVSQCLYEAVKNLQEKGHLPVPARQQEDSTTVKP

SEQ ID NO: 2403 - protein, 113 aa, Glycine max
  misc_feature (100)..(100): Xaa can be any naturally occurring amino acid
LLSSKPLPPCSYIQQLREGVHNFFVTFIEVLRDRPPGHDWELEPGVTCGDYLFGMLQGTRSALYANNRESITVTVQEVTPRTVGALIALYERAVGIYASXLVNINAYHQPGKI

SEQ ID NO: 2404 - protein, 505 aa, Glycine max
  misc_feature (89)..(89): Xaa can be any naturally occurring amino acid
  misc_feature (135)..(135): Xaa can be any naturally occurring amino acid
  misc_feature (207)..(207): Xaa can be any naturally occurring amino acid
  misc_feature (383)..(383): Xaa can be any naturally occurring amino acid
MGLNRTPRHNPVLPTKSPILSRSHSRSQTMKTTQIFGVSLSLILINLAAIMERADENLLPSVYKEVSETFNAGPSDLGYLTFVRNFVQXLSSTLACILVINYDRPTILAMGTFCWALSTAVLCVGHDILQVSFWXAINGFGLAIVIPALQSFIADSYKDGVRGTGFGLLSLVGNLGGIGGGVLATVMAGQQFWGIQGWRCAFILMAXLECINGIPVLLYVVDPRKRFPTTRDASESSDRDDTVYKGNASAASIWIDSWAATKAVIKVKTFQIIVLQGIIGSLPWTAMVFFTMWFELIGFDNNTSATLLSLFAIGCAMGSFIGGSIADQLSQVYPHSARTMCAQFSAFMGIPFSWFLLKVIPQSVSSFPIFSVTLFIMGLTRAXSRSSRSSRSSRAAANAPMFAEVVPVKHRTMIYAFDRAFEGSFSSIAAPLVGILSEKMFGYNSKSVDPIKGSSPEALALSKGLLSMMAVPFGLCCLCYTPLYYIFRRDRENARMLAVKEEEMM

SEQ ID NO: 2405 - protein, 115 aa, Glycine max
MSAINITNVTALDNPAPFVSPFQFEISYECLTSLKDDLEWKLIYVGSAEDETYDQTLESVLVGPVNVGNYRFVLQADPPDPSKIREEDIIGVTVLLLTCSYMGQEFLRVGYYVNN

SEQ ID NO: 2406 - protein, 154 aa, Glycine max
KVRNWMLPEMPGLITDFVISLDDRYLYLVNWLHGDIRQYNIEDPAKPVLAGQVFVGGLLQKGSDVVYVTDDDKEEQYAVPQVKGHRLRGGPQMIQLSLDGKRVYVTNSLFSRWDEQFYGPDLLKKGSHMLQIDVDTEEGGLTVNPDFFVDFGTE

SEQ ID NO: 2407 - protein, 204 aa, Glycine max
  misc_feature (35)..(35): Xaa can be any naturally occurring amino acid
  misc_feature (189)..(190): Xaa can be any naturally occurring amino acid
MEREIEHCDKVMSQSSMDACPKSGPGYASPLAAIXGPRETLLYVTAIYSGTGRDKPDFLATVDVDPSSPTYSKVIHRLPVPYLGDELHHFGWNSCSSCYGDPTAVRRYLILPSLVSGRIYVVDTKANPRSPSVHKVVEPEDIISKTGLAYAHTSHCLASGDVLISFLGDEDGNAEGSRCLLLDHVLNLXXMWQKPAHSASCGYD

SEQ ID NO: 2408 - protein, 484 aa, Glycine max
MERCDKVMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLVSGRIYVVDTRSNPRSPSLHKVVEPEDIISKTGLAYAHTSHCLASGDVMISFLGDKDGNAAGSGFLLLDHEFNLKGRWEKPGHSPSFGYDFWYQPQHKTMISSSWGAPAASTKGFNLQHVSDGLYGRHLTCIQLAWGELRQTLDLGESGVLPLEVRFLHDPSKDTGFVGCALSSNMVRFLRPRDESWSHEVAISVKPLKVQNWILPEMPGLITDFLISLDDRFLYFVNWLHGDIRQYNIEDPKNPVLTGQVWVGDYFQKGSPIVAITEDGNTWQSDVPDIQGNKLSAGPQMIQLSLDGKRVYVTNSLFSAWDKQFYPELVEKGSHMLQIDVDTENGGLKINPNFFVDFGAEPGGPALAHEMRYPGGDCTSDIWI

SEQ ID NO: 2409 - protein, 485 aa, Glycine max
  misc_feature (239)..(239): Xaa can be any naturally occurring amino acid
  misc_feature (248)..(248): Xaa can be any naturally occurring amino acid
MERCDKVMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLVSGRIYVVDTRSNPRSPSLHKVVEPEDIISKTGLAYAHTSHCLASGDVMISFLGDKDGNAAGSGFLLLDHEFNLKGRWEKPGHSPSFGYDFWYQPQHKTMISSSWGAPAAFTKGFNLQHVSDGLYGRHXTCIQLAWGXELRQTLDLGESGVLPLEVRFLHDPSKDTGFVGCALSSNMVRFFKTEDESWSHEVAISVKPLKVQNWILPEMPGLITDFLISLDDRFLYFVNWLHGDIRQYNIEDPKNPVLTGQVWVGGLLQKGSPIVAITEDGNTWQSDVPDIQGNKLRAGPQMIQLSLDGKRVYVTNSLFSAWDKQFYPELVEKGSHMLQIDVDTENGGLKINPNFFVDFGAEPGGPCLAHEMRYPGGDCTSDIWI

SEQ ID NO: 2410 - protein, 179 aa, Glycine max
  misc_feature (62)..(62): Xaa can be any naturally occurring amino acid
  misc_feature (88)..(88): Xaa can be any naturally occurring amino acid
QIHLRNNPAALLALCWYWATDGVGSKDMVILPYKDSLLLFSRYLQQLVMESLGKVFDLDGNXYIQQLREGVHNFFVTFIEVLRDRPPXHDWELEPGVTCGDYLFGMLQGTRSALYANNRESITVTVQEVTPRTVGALIGLYERAVGIYASLVNINAYHQPGLGNMACGRGMLNCIQMKT

SEQ ID NO: 2411 - protein, 273 aa, Glycine max
  misc_feature (268)..(268): Xaa can be any naturally occurring amino acid
MYTNIGMPPGVPQHHPQPPTSSQPNLFGNAFNSAGSGLIRGGLGAYGEKILGSSSEYVQSNISRYFSDPQYYFQVNDHYVKNKLKVVLFPFLHRGHWTRITEPVGGRLSYKPPIYDINAPDLYIPLMAFGTYVVLAGISLGLRGMFSPEALNWLFIKGLVGWFMQTALLKVTLLSLGSGEAPLLDIIANAGYTFAGLCLAVCGRMIWSYSYYFLMLWTCICMAVFLVKTMKRVLFAEVRSYDSSKHHYLLLFIALAQFPLFTWLGNIXVNWLI

SEQ ID NO: 2412 - protein, 345 aa, Glycine max
  misc_feature (105)..(105): Xaa can be any naturally occurring amino acid
  misc_feature (249)..(249): Xaa can be any naturally occurring amino acid
LLFLLLTRWANSICPIGISISVFPSYFHRFQLLINFACRVVLAPLTRQRSYDNVPQPHAILYYSQRTSNGGLLITEATGVSDTAQGYPQTPGIWTKDHVQAWKPXASAHASGNFPHLLLLPNTNVSNTLPNTTIISMAVQIVGFDGVEIHGAHGYLLEQFMKDKVNDRTDEYGGSLENRCRFALEVVEAVVNEIGADRVGIRLSPFAEYSESGDSNPKELGLYMMNALNKYGILYCHMVEPRMKTVGEXTECPHSLVPMRKAFNGTFIAAGGYDRQDGINAVAENRADLVAYGRWFLANPDLPKRFALNAPLNKYHRETFYTSDPVLGYTDYPFLDDEESNAVAS

SEQ ID NO: 2413 - protein, 399 aa, Glycine max
  misc_feature (187)..(187): Xaa can be any naturally occurring amino acid
MASASASLLKSSLVLDKSEWVKGQTLRQPSASVVRCNPTTPSGLTIRAGSYADELVKTAKTVASPGRGILAMDESNATCGKRLASIGLENTEANRQAYRTLLVTVPGLGQYISGAILFEETLYQSTTDGRKIVDVLLEQNIVPGIKVDKGLVPLAGSNDESWCQGLDGLASRSAAYYEQGARFAKWXRTVVSIPNGPSALAVKEAAWGLARYAAIAQDNGLVPIVEPEILLDGDHGIDRTFEVAQKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALAFRAKSNSLAQLGKYTGEGESEEAKKELFVKSYSY

SEQ ID NO: 2414 - protein, 176 aa, Glycine max
  misc_feature (135)..(135): Xaa can be any naturally occurring amino acid
  misc_feature (144)..(144): Xaa can be any naturally occurring amino acid
ENREMELRELGRTVGFGGSPLGNVFGDVSEEEPKASVRLAFQSGINFFDTSPYYGGTLSEKVLEKALKALGAPRNSYVVATKCGRYKEGFDFSAERVTRSIEESLQRLQLDYVDILQCHDIEFGSLDQVLNETGXIFSYVLDRXVLSYCHYCVNDTSLGDLKAKGVGIINASPLSM

SEQ ID NO: 2415 - protein, 596 aa, Glycine max
DFENLVPKFIKVFPKEYKRVLASTKSKEASKDAVESASNHGEEQDEIELVEEDAFEKLKKLATASINGKPSEAESSKRPSQVIDPVKHRGFVAYERESVQYRDPNARINDWNEVMKETKPGPLLKTQSARCMDCGTPFCHQENSGCPLGNKIPEFNELVYQNRWREALDRLLETNNFPEFTGRVCPAPCEGSCVLGIIENPVSIKSIECAIIDKAFEEGWMVPRPPARRTGKRVAVVGSGPSGLAAADQLNKMGHTVTVYERADRIGGLMMYGVPNMKTDKVDIVQRRVNLMAEEGINFVVNANIGHDPLYSLDRLREENDAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVLWEKDETGRFQFKEIEGSEEILEADLVLLAMGFLGPEPTIAEKLGIERDNRSNFKAEYGRFSTSLKGVFAAGDCRRGQSLVVWAISEGRQAAAQVDSFLTNEDIEHNVAGSPDDKLQHKFAVPNKQ

SEQ ID NO: 2416 - protein, 170 aa, Glycine max
  misc_feature (73)..(73): Xaa can be any naturally occurring amino acid
GGHPDPKLTYGKEVGARMGLGKTEHQEEPTERGADTDGDAERNMVLGKRDIVTPTDSEAMIDVNADEAITYLXAGIKGVARSMPTSAALDDVSKHLKLKLFEGPTGRKCIGNLMDAGIWTDWGEEKVGTGTEQISEKDGIWAIYGWVYINAYKNRDKLEDKIGTVEDRTR

SEQ ID NO: 2417 - protein, 176 aa, Glycine max
SARAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 2418 - protein, 594 aa, Glycine max
  misc_feature (66)..(66): Xaa can be any naturally occurring amino acid
  misc_feature (241)..(241): Xaa can be any naturally occurring amino acid
GTAFPTRPIRPRTSFPSLSLRHAPPCQSHTPSSSASSPLPPPPFPPTTTSLPPPSSSRAPPTAASXSLRASFSPETLVSDNNGAPSPPPPSDPSSIEVDSVTEAELKENGFRSTRRTKLVCTVGPATCGFEQLEALAVGGMNVARINMCHGTREWHKEVIDRVRRLNHEKGFAVAIMMDTEGSEIHMGDLGGASSAKADDGEIWTFSVRAFDSALPQRTINGNYEGLAEGVKCTFCVHKDXGTWHLYCHAAVLTDVKCRCTDPGLLLPRANLTFWRNGSLVRERNAMLPTISSKDWLDIDFGISEGVDFIAISFVKSAEVITHLKSYIAARSRDSDISVIAKIESIDSLKNLEEIVLAADGAMVARGDLGAQIPLEQVPSAQQRIVQVCRQLNKPVIVASQLLESMIEYPTPTRAEVADVSEAVRQRADALMLSGESAMGQYPDKALTVLRSVSLRIERWWREEKRYEAMLLPSVGSYFSEKISEEICNSAAKMANNLEVDALFVYTKTGHMASLLSRCRPDCPIFAFTTTSSVRRRLNLQWGLIPFRLSFTDDMESNLNRTFSLLKARNLIKSGDLVIAVSDMLQSIQVMNVP

SEQ ID NO: 2419 - protein, 214 aa, Glycine max
MTVAAARCLILTPTISSSSAALRLPRIARRRPLSCSASPLAVFATMDSPPEGYRTNVGICLADPSLTKIFSASRIDIPTAWQMPQGGIDPGEEPRAAAVRELREETGVRSAEIVAEAPNWLTYDFPADVKDKLNARWGTNWKGQAQKWFLFRLTGGDEEINLMGDGSEKPEFSEWAWMTPQQVIEKAVDFKKPVYEETLKHFAPYLQSDPTASS

SEQ ID NO: 2420 - protein, 182 aa, Glycine max
  misc_feature (74)..(74): Xaa can be any naturally occurring amino acid
  misc_feature (82)..(82): Xaa can be any naturally occurring amino acid
  misc_feature (127)..(127): Xaa can be any naturally occurring amino acid
  misc_feature (131)..(131): Xaa can be any naturally occurring amino acid
  misc_feature (138)..(138): Xaa can be any naturally occurring amino acid
MNRRVRRKVARKNKGNVVQSSFPEDQDEVLDLEPQRQGFVDWKCLPDDTVIQLLSCLSYQDRASLSSTCKTWEXLGSFLCLXSSLDLRSHSFDAGMAPSVAPRCVHPQKLRVRRAESADAIINLRAXELAXLSGDYCXKITDATLSVIVARHELLESLQLGPDFCERISSDAIKAIAHCCPK

SEQ ID NO: 2421 - protein, 449 aa, Glycine max
  misc_feature (128)..(128): Xaa can be any naturally occurring amino acid
MEHFNNDDLEYVVDEYYDVPDFAVEDTSSDIVPELTSDVDSDFEDEFPTSNAKTDTTASEARNGKDIQGIPWERLNYSRDKYRETRLKQYKNYQNFSRSRHDLRKECLEVQKGETFYDFFFNTRLVRXTLAGPNIMLRNLLWATSKHDVYFMQNYSVMHWSALLRRGKEVLNVAKPIIPTLKRPGFLAQPVSRVQISTMTVKENLMVAGGFQGELICKNLKHPGVLFCGKITTDDNAITNAVDVYSNPAGSLRVITANNDFQVRVFDAENFASLGCFKYDWSVNNTSVSPDGKLLAVLGDSTECLIADANTGKITGSLKGHLDYSFSSAWHPDGQILATGNQDKTCRLWDIRNLSQSMAVLKGRMGAIRALRFTSDGRFLAMAEPADFVHIFDSHSGYEQGQEIDLFGEIAGISFSPDTEALFVGIADRTYGSLLEFNRKRHYNYLDSF

SEQ ID NO: 2422 - protein, 139 aa, Glycine max
GLSKFVPYEVMHERTVMAGGTYGYLAPEFVYRNELTTKSDVYSFGVLLLEIVSGRRPAQAVDSVGWQSIFEWATPLVQAHRYHELLDLHITSSSIIPEASTIQKVVDLVYSCTQHVPSMRPRMSHVVHQLQQIAQPPAK

SEQ ID NO: 2423 - protein, 209 aa, Glycine max
  misc_feature (147)..(147): Xaa can be any naturally occurring amino acid
MAANAGAGAGGSKIRNAKLVLLGDVGTGKSSLVLRFVKGQFVEFQESTIGAAFFSQTLAVNDETVKFEIWDTAGQERYHSLAPMYYRGAAAAIVVYDITNAASFTRAKKWVQELQAQGNPNTVMALAGNKADMLEARQVPVEEATTXAQENGLFFIETSAKTAINVNDVFYELAKRLLAGQQAQNPQAGMVLSQRPAERMVSSTSCCSS

SEQ ID NO: 2424 - protein, 680 aa, Glycine max
PRVRTAFRVECFTVELTRRVDEGGVKDVLIDGAHVKGSLIERKAEARGQLYGDHHDVKKKLEKPGLTVVDHIGPGRVPKAIEGEQVAAGWPAWLSSVAGEAIKGWIPRSANTFERFHKIGQGTYSTVYKARDVINQKFVALKKVRFDNLDPESVKFMAREIHVLRRLDHPNIIKLEGLITSRMSRSLYLVFEYMEHDLTGLASNPDIKFSEPQLKCYMQQLLSGLDHCHSRGVLHRDIKGSNLLIDNNGILKIADFGLANFIDPHHKVPLTSRVVTLWYRPPELLLGASNYGVAVDLWSTGCILGELYRSRPILPGKTEVEQLHRIFKLCGSPSEDYWCKLRTPHSTVFRPPHHYRRCVAETFKEYPSAATRLIETLLSLDPTLRGTAAAALKSEFFSSEPLPCDPSSLPKYPPSKEIDTKLWEEATRHGADREKEQKFRPGGRQEKEPQTFILSKDSADSCISMQQGQRLPNSRSRNEFFNPHREPVSGHLVFPQKQSEDHKETLNYFSGPLYQRPLHSGPLVPGYGCEMVGREAGERRPHVSNKVNLPKLSGLVASRTSSLSGDQKENPVPSRPRETIEVQISLESTNGSESRRRHDTKHHSQRIDPRKIENGKVSTETLIQDGHGSMGNNIYHLSGPLLVSSNNIDQMLKERDRKIQEYSRRARMYKSGEIAHAKQN

SEQ ID NO: 2425 - protein, 97 aa, Glycine max
MASEEDVAVKEPLDLIRLSLDERIYVKLRSDRELRGKLHAYDQHLNMILGDVEEIVTSIEIDDETYEEIVRTSKRTIPYLFVRGDGVILVSPPLRTV

SEQ ID NO: 2426 - protein, 368 aa, Glycine max
MSKTSEIITCKGKPVTVEEIQVDPPKATEVRVKMLCASICSTDISSTKGFPHTNFPIALGHEGVGIIESVGDQVTNLKEGDVVIPTYIGECQECENCVSEKTNLCMTYPVRWTGLMPDNTSRMSIRGERIYHIFSCATWSEYMVSDANYVLKVDPTIDRAHASFISCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGSVFGGLRAISDLSILADKGHKKEFPLQELFTHEVTLADINKAFELLKQPNCVKVVINMP

SEQ ID NO: 2427 - protein, 202 aa, Glycine max
MNPEYDYLFKLLLIGDSGVGKSCLLLRFADDSYLDSYISTIGVDFKIRTVEQDGKTIKLQIWDTAGQERFRTITSSYYRGAHGIIVTYDVTDQESFNNVKQWLNEIDRYASENVNKLLVGNKNDLTSQKVVSTETAQAFADELGIPFLETSAKNATNVEEAFMAMTAAIKTRMASQPAGGAKPPTVNIRGQPVNQQSGCCSS

SEQ ID NO: 2428 - protein, 588 aa, Glycine max
LNISSNFIYGGIPQSLSSMRNLRSLVLVDNLFNGSVPDLQRLTSLEELNLGGNNLGAQFPSVGKNLVTIMLRNNSLRSHIPPQLVHFDKLQVFDVSSNNFFGNIPSFLISLPSLQYLNLASNHLSGNLSVNMACSSSLTFVDISHNLLVGKLPSCFGSVSSKAKVLYSGNCLSTEKRLNDQQHPFSFCKREGALAVKPPAKNLKKESGSGAKLGLMLGIIVGIVLIGGLLVLLVVCIFRKSKAERSHPKMDKSVANKYSISVSPRPIGTRHIPQAMKQAAVGLPPYRIFTSEEIEDATNNFDPSNLIEEGSLGQLYKGWLRDGSVVLVNCVKIKQKGLPHSIMQQVEVLHNLRHRHMVSVLGHCIITEQEHPQTTSTVFIVFEYISNVSLRDQLSDGRKREMLKWPQRMAMSIGIARGVQFLHTGVAPGIYGNNLKIENILLDDSLNAKVSRYNIPLPSKIAHIEQNATNHIGSTNDAEKEDIYQLGIILLEVITGKQITSSSEIEELKEELENGSSEATSVIRSAIDPSLRGTYAYESMKTAVQITINCLSKVSSQRPSIEDVLWNLQYAMQVQESWTSSGNLSTKL

SEQ ID NO: 2429 - protein, 738 aa, Glycine max
  misc_feature (176)..(176): Xaa can be any naturally occurring amino acid
MKNLWLCFSYLFPAAIILVLLTPSSVAQLSPSEGRILFQVQKLLEYPQALQGWNRWTNLCFLPSSPSLKIVCSNGHVTELTIIGNKTSPSLHNPKESAWTSLQTLSGRFSIDSFFTVMTKLSNLKMLSLVSLGLWGPLPAKINRFWSLEVLNISSNFIYGGIPQSISSMRNLKSLXLVDNLFNGSVPDLQSLSSLEELNLGGNNLGPGFPSVGKNLVTIMLRNNSLRSHIPPQLVHFDKLQVFDVSSNDFFGNIPSFIISLPSLQYLNLASNHLSGNLSVNMACSSSLTFVDISHNLLVGKLPSCFGSMSSKAKVLYSGNCLSTKNRLNDQQHPFSFCKREGALAVKPPAKNLKKESNLGTKLGLMLGIIVGIVVIGGLLVLLVVCIIRKSKAERSPHKMDKSVANKYSTSVSPRPIGTRHIPQAMKQAAVGLPPYRIFTSEEIEDATNNFDPSNLIEEGSQGQLYKGWLRDGSVVLVNCVKIKQKGLPHSIMQQVEVLHNLRHRHMVSVLGHCVITEQEHPQTTSTVFIVFEYISNVSLRDQLSDGRKREMLKWPQRMAMSIGIARGVQFLHTGVAPGIYGNNLKIENILLDDSLNAKVSRYNIPLPSKIAHIEQNATNHIGSTNDAEKEDIYQLGIILLEVITGKQITSSSEIEELKEELENGSSEATSVIRSAIDPSLRGTYAYESMKTAVQITINCLSKVSSQRPSIEDVLWNLQYAMQVQESWTSSGNLSTKL

SEQ ID NO: 2430 - protein, 242 aa, Glycine max
MARAVSSSCARLTMRLFSTTTTTTTTTAAFAVTLPKPSSLSVSTRRFLFPLSHAIVPPSTRVAGIRCRVNRAGDSAYSPLNSASSSSSSFSDRPPTEMAPLFPGCDYNHWLIVMDHPGGEGATKQQMIDCYIQTLAKVLGSEEEAKKKIYNVSCERYFGFGCEIDEETSNKLEGLPGVLFVLPDSYVDPENKDYGAELFVNGEIVQRSPERQRRVEPQPQRHQDRPRYNDRTRYVRRRENTQ

SEQ ID NO: 2431 - protein, 144 aa, Glycine max
MPRAGLSAGSSKVDVAIDLGNPLLNRTVDGFLKIGAVGACRVAAEDAFDCLQSGSVSKHKLEKTLEKMCKEGAYWGAVAGVYVGMEYGVERVRGEYDWKNALIGGIASGALISAASNNKGNKIAQDAITGGGIAPRIEFINYLT

SEQ ID NO: 2432 - protein, 230 aa, Glycine max
  misc_feature (36)..(36): Xaa can be any naturally occurring amino acid
  misc_feature (128)..(128): Xaa can be any naturally occurring amino acid
LVSEFIWYRAPPRVSYLGPPPPILSCGICTGFGATXVNVAKPKPGSSVAIFGLGAVGLAAAEGARVSGASRIIGVDLLSARFEEAKNFWVNEFVNPKDHDKPVQQVIAEMTNGGVDRAVECTGSIQAXMVSAFECVHDGWGLAVLVGVPSKDDAFKTAPINFLNERTLKGTFYGNYKPRTDLPSVVEKYMSGELEVDKFITHTVPFSEINKAFDLMLKGQSIRCIIRMQE

SEQ ID NO: 2433 - protein, 92 aa, Glycine max
MVGVVLNDRFVKKVRVKCNDDDTICDLNKLVAAHTGSRAVKIRIQKLYTIYNDHITLKDYEIHDRMCLAGMVKKNPTKRIWWMINYYGVCMG

SEQ ID NO: 2434 - protein, 430 aa, Glycine max
MDPQAFIRLSIGSLGLRCTGIELSTTKSGIQTLSLPCVCEIRLRGFPVQTSSVPVISSTEVIPDTQNVAFSFYLEESDLKALLAPGCFYNTHACLEIAVFSGRKGSHCGVGNKRQQIGIFRMQVGPEWGEGKPVILFNGWIGIGKNKQDNGKPGAELHLKVKLDPDPRYVFQFEDITTLSPQIVQLQGSIKQPISDLWNDRVSQIDSLSAYWSGSNDISDLETERRERKGWKVTIHDLSGSAVAAAFITTPFVPSSGCDWVARSNPGSWLIVRPDIGRSESWQPWGKLEAWRERGIRDTVCCRFHLLSEAQEGGEFLMSEIHISAEKGGEFFIDTEKHMRTVATAASPIPSPQSSGDFGALSPLVGGFVMSCRVQGEGKRSKPSVQLAMRHVTCVEDAAIFMALAAAVDLSIVACKPFRRKVRRGFWHSM

SEQ ID NO: 2435 - protein, 497 aa, Glycine max
  misc_feature (154)..(154): Xaa can be any naturally occurring amino acid
EFSFNREKYDNPDSWANSFEQQYGANLREDDRRDSQLSSVDQMRGMNMPNFAAMEQTRMLANTLAQNGDPKFQNSKFLQFVSKMSRGELIIDDNQVKENALPASGDWATEYNQQYNHGHAWAGEFLNDKVYHGPDQWANEFTSEGRQHDAVDDXWVNEFSKLNVNDWADEFGQQFGEGALGDNSTSDSWAQAYDEFLNEQVAAKQQLDSSRGVYVFSDLNPYVGHPNPLKEGQDLFRKGLLSEAVLALEAEVLKNPENAEGWRLLGIAHAENDDDQQAIAAMMRAQEADPTNLEVLLALGVSHTNELEQTAALKYLYGWLRHHPKYGTLAPPEMADSLYYADVARLFNDAAELSPDDADVHIVLGVMYNLSREYDKAIASFERALKLKPQDYSLWNKLGATQANSVQSADAIMAYQQALDLKPNYVRAWANMGISYANQGMYDESIRYYVRALAMNPKAENAWQYLRISLSCASRNDMLEACDSRNLDLLQKEFPLQ

SEQ ID NO: 2436 - protein, 273 aa, Glycine max
  misc_feature (222)..(222): Xaa can be any naturally occurring amino acid
LADSPRDVILSYRRALLHRRNLDAKTIAKIQKEFVVFLLYSGGEAILSNLRSHMDSSFVPRNNLEEAILLLMILLRKISLNKIEWDPSILDHLSFALSVSGDLTALAHQWEELLPGTINRRERYHALSLCYYGAGNDLVALNLLRKLLSSREDPKHVPSLLMASKICSMNPDLAKDGASLACKVLENLDGRCDQLESLSSCLLGVSLSAHSKIAISNSERVXKQSEALHSLETASKVTRMRNPPVIYYLSLECAEQKKLDVALHYAKCFLNLE

SEQ ID NO: 2437 - protein, 192 aa, Glycine max
  misc_feature (77)..(77): Xaa can be any naturally occurring amino acid
  misc_feature (184)..(184): Xaa can be any naturally occurring amino acid
GSRNNLEEAFLLLMILLRKISLNKIEWDPSILDHLSFALSVSGDLTTLAHQWEELLPGTINRRERYHALSLCYYGAXENPDLAKDGASLARKVLENLDGRCDRLESLSSCLLGVSLSAHSKIDISNSERVEKQSEALHSLETASKVTKMSNPLVIYYLSLECAEQRKLDAALHYAKCFLNLEVXSNIKGWLL

SEQ ID NO: 2438 - protein, 62 aa, Glycine max
YALYAYDQHLNMILGDVEEIVTTVEIDDETYEEIVRTTKRTVPFLFVRGDGVILVSPPLRTA

SEQ ID NO: 2439 - protein, 320 aa, Glycine max
HASASTELPTCPVCLERLDQDTGGILTTICNHSFHCSCISKWADSSCPVCRYCQQQAEKSICFVCQTTENLWICVICGYVGCGRYKGGHAIIHWKETQHCYSLEVETKRVWDYVGDNYVHRLIQSKTDGKLIELNTQCAHADNGCGSCSCEDNAMNEAILNSKVEAIVNEYNELLATQLENQKLYFESLLQEVKEESERKISKAVQKAISLKQQKIQSKIDRCKKEKKFLDDLNENLVKNEDIWKTKILAIEEREKKTTRLMGDRVADLEMQLGDLMVCLEGGRTVEQLAASDEIKEGIILDKSIESSTTSGSDLVGRDA

SEQ ID NO: 2440 - protein, 498 aa, Glycine max
  misc_feature (260)..(260): Xaa can be any naturally occurring amino acid
MPMAKKRKLRSSNPEPTKPVEPQQQNQETVELDQQQQQPNPKQTLEDPNTMAVDESKQEEEEEEEDAEPQNAESEEEEEEEDEQQEEQEPETLEEQQDPETLAAANHAEANGSNEGNNEEEEEEDLTLEEEPVEKLLEPFTKEQLHSLVTQAVDMFPEFVDSVRRLADVDPAHRKIFVHGLGWDATADTLTAVFGKYGEIEDCKAVTDKVSGKSKGYAFILFKHRDDARKALKHPQKKIGNRTTSCQLASAGPVPAPPAXVTPVSEYTQRKIFVSNVNAEIDPQKLLEFFKQFGEVEDGPLGLDKNTGKPKGFALFVYKSVESAKKALEEPHKNYEGHTLYCQKAVDGPKGSKGYHHQQHSHPHHHHHHQPHYQRKEKNKYSSGGGGPSHGSGHLMAPSGSAVGGFNPGLPAQGLNPALGQALTALINQGAGLGLGNLLGGLGGAPVNQAGPPAPYANQPAMGYGNQPAMQPGYQNPQMGQGSGVRPHPGAGAPYMGH

SEQ ID NO: 2441 - protein, 128 aa, Glycine max
MILFFHLAPAGCSVNFEFLNYTAITSKCKGPRYPPKECCGAFKEFACPYADVLNDLTNECASTMFSYINLYGKYPPGLFSSECREGKFGLACPAVPPSSVSADDTANKALHCPFLLVMLTACFLILVF

SEQ ID NO: 2442 - protein, 165 aa, Glycine max
MVFSFNQSFCLSSSLLLLLMALCVSSLSDTVFNSQAAHTARNLLQAKKSCSVNFEFLNYTVITSKCKGPHYPPKECCGAFKEFACPYVDVLNDLTNECASTMFSYINLYGKYPPGLFASECHEGKLGLACPALPPSASADDTANQVVHCPSLLLMLTACFLILLF

SEQ ID NO: 2443 - protein, 243 aa, Glycine max
  misc_feature (210)..(210): Xaa can be any naturally occurring amino acid
  misc_feature (235)..(235): Xaa can be any naturally occurring amino acid
MASSLTFHWFLFLILWILVLCSHAHARFFTVDPVSDGFAAASGSKWQSILRLPTVLTGESVCEQTYGFLPCTTTVLGNLFLIIVYGFLMFKAATFLSGGSELLLEILGPGIVGGLFLPILGALPDAMLILVSGLSGSKEVAQSQVSVGMGLLAGSTTLLLTIIWGTCVIVGKCDIEGSIAIDSRDTRGFSLTGSGVSTDIWTSYAARIMXISVLPFVIVQLPQILNSTSGRHLAXLIALIVSL

SEQ ID NO: 2444 - protein, 159 aa, Glycine max
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRMAEKEPKEGKSPKKTAKSPKKADKKA

SEQ ID NO: 2445 - protein, 158 aa, Glycine max
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKATKSPKKTTQA

SEQ ID NO: 2446 - protein, 147 aa, Glycine max
  misc_feature (98)..(98): Xaa can be any naturally occurring amino acid
MAATNASIFASSTQPCLPVPPTIPNTLATPFLNVSSPRSYLVKKKHVKFSKKISAAAVATTTTTEEIQEYKLPSWAKFEIGRAAVYWKTMNGLPPTSXGFNQPIMCGGEPRAMLRKDRGKADAPIYSIQICIPKHGSLVFLFLDIFC

SEQ ID NO: 2447 - protein, 277 aa, Glycine max
MAATNASIFASSTQSCLPVSPTISNTLVSPFLNVSSPRSYLVKKKHVKFSKHISAAAVATTTTTEEIQEYKLPSWAKFEIGRAAVYWKTMNGLPPSSGEKLKLFYNPAATQLVPNEEFGIAFNGGFNQPIMCGGEPRAMLRKYRGKADAPIYSIQICIPKHALNLIFSFTNGVDWDGPYRLQFQVPKALQNKPIDFFNKGLAEELSKEGACEQAIFPDTNKVITKCAMIGNLSKEGGDRCDLNFVVGCTDPSSHLYNPLANVDDGTCTIELDSESEE

SEQ ID NO: 2448 - protein, 196 aa, Glycine max
  misc_feature (38)..(38): Xaa can be any naturally occurring amino acid
  misc_feature (62)..(62): Xaa can be any naturally occurring amino acid
  misc_feature (166)..(166): Xaa can be any naturally occurring amino acid
WGWYLEIGRAAVYWKTMNGLPPSSGEKLKLFYNPAATXTLSLMKNFGIAFNGGFNQPIMCGXGEPRAMLRKYRGKADAPIYSIQICIPKHALNLIFSFTNGVDWDGPYRLQFQVPKALQNKPIDFFNKGLAEELSKEGACEQAIFPDTNKVITKCAMIGNLSKEGXCTDPSSHLYNPLANVDDGTCTIELDSESEE

SEQ ID NO: 2449 - protein, 253 aa, Glycine max
  misc_feature (128)..(128): Xaa can be any naturally occurring amino acid
MAATNASIFASSTQSCLPVSPTISNTLVSPFLNVSSPRSYLVKKKHVKFSKHISAAAVATTTTTEEIQEYKLPSWAKFEIGRAAVYWKTMNGLPPSSGEKLKLFYNPAATQLVPRVRFGSAWLVKFHXSGGVNQPIMCGGEPRAMLRKYRGKADAPIYSIQICIPKHALNLIFSFTNGVDWDGPYRLQFQVPKALQNKPIDFFNKGLAEELSKEGACEQAIFPDTNKVITKCAMIGNLSKEGGDRCDLNFVVG

SEQ ID NO: 2450 - protein, 107 aa, Glycine max
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDY

SEQ ID NO: 2451 - protein, 568 aa, Glycine max
  misc_feature (364)..(364): Xaa can be any naturally occurring amino acid
MASSALISDTQQWKDLKAHVEDINKTHLRDLLSDDKRSQSMLVEFDDILLDYSRQQATPETIQKLFELAEAASLKEKIIRMYSGEHINSTENRSVLHVALRASRDAVIQSDGQNVVPEVWKVLDKIQEFSEQIRNGSWVGATGKALKDVVAIGIGGSFLGPLFVHTALQTDPEAVESARGRQLRFLANVDPIDVARNITGLNPETTLVVVVSKTFTTAETMLNARTLREWISSALGPLAVAKHMVAVSTNLTLVEKFGIDPNNAFAFWDWVGGRYSVCSAVGVLPLSLQYGFSVIEKFLTGASSIDQHMYSHPFERNVPVLMGRLGVWNVSFLGYPARAILPYWQALEMFGTHILNVCIKSNGXGVLIDGVPLPFEPGEIDFGEPGTNGQDSFYQLLHQGRVLAYWKKSEQLQKRTVSLNVEVVSNHDELMSNYFAQSDALAYGKTADQLQKENVSPHLVPHKTFSGNRPSLSLLLPSLNAYNIGQLLAIYEHRIAVEGFIWGINSFDQWGVELGKSLATQVRKQLNASRTKGEPIQGFNFSTTTMLTRYLQASSDVPADLSTVLPKI

SEQ ID NO: 2452 - protein, 197 aa, Glycine max
MGNAAVTPCFHPKNSSSSSSSKLIFWDGTMRCLKGKHIAGEIMYEFPDKVVCHADSFFIGHPIPALALEDELIQGEAYFVLPIDSFTCKTLSISSLLSLGSDPSKSTIKFGECPFEYLKGSNGRVLIKVMPEFITRLINRSKRPCCPSSNDNNNFLCSTPELRKHYQMLVKSKDQVWSPKLETISENKVRFSPCRFI

SEQ ID NO: 2453 - protein, 329 aa, Glycine max
MATNIGIMDAAYFVGRSEILSWINSTLQLNLSKVEEACSGAVHCQLLDAAHPGIVPMHKVNFDAKSEYEMIQNYKVLQDVFNKLKITKHIEVSKLVKGRPLDNLEFMQWMKRYCDSVDSGLQYNYNPLERREVCKGGRETSKKSANSQASTKGSTAQRPHSSHNARRNEVSNANPTNQAAKVARAAPSAGNPAPVYEEKITELKLSIDSLEKERDFYFAKLRDIEILCQTPEIEHSPIVAAIQKILYATDDNGMAVAEAQAMISVGRKEIEGLSPIAEVSEEKSSSETHKRKNIANIDFDVAGLATLSPRQRLSDVSDVHCSESPLMTC

SEQ ID NO: 2454 - protein, 524 aa, Glycine max
  misc_feature (64)..(64): Xaa can be any naturally occurring amino acid
  misc_feature (91)..(91): Xaa can be any naturally occurring amino acid
  misc_feature (103)..(103): Xaa can be any naturally occurring amino acid
  misc_feature (146)..(146): Xaa can be any naturally occurring amino acid
  misc_feature (203)..(203): Xaa can be any naturally occurring amino acid
  misc_feature (216)..(216): Xaa can be any naturally occurring amino acid
  misc_feature (276)..(276): Xaa can be any naturally occurring amino acid
MSGGGGGEEEATLEFTPTWVVAAVCTVIVAISLAAERLLHYGGKFLKAKDQKSLYEALQKIKEXELMLLGLISLLLTVTQNGITKICCSSXLTGHMLPSNLDXRLWTQRLTQSPTLKFVTASAKSHPLTPTLLLFLCSLLIHHPSXRLLFCFSLFQNKVPLLSLEALHHLHIFIFVLAVVHVSFSLLTVVFGGARIRQCRNNXWEDLIAKQNYETXVLKPKVTQVHQHDFIRGRFAGFDKDSAIVGWLLSFLKQFYGSVTKSDYVTLRHGFIMTHXCRTNPKFNFHKYMIRALEDDFKQVVGISWYLWLFGDIFLLLNINGWHTYFWIAFIGSVLLLAVGTKLEHVITQLAQEVAEKHAAIEGDLVVQPSDDHFWFHRPRVVLFLIHFILFQNAFEIAFFFWIWVTYGFDSCIMGQVRYIVPRLVIGVFIQVLCSYSTLPLYAIVTQMGTHYKRAIFNDHLQQNIVGWAQKAKKRKGLKADGNPGQGSSQESANTGIQLGSIFKKASAPGGSSSAPKADGINSV

SEQ ID NO: 2455 - protein, 125 aa, Glycine max
  misc_feature (8)..(8): Xaa can be any naturally occurring amino acid
MAEKLAPXKRHDFVHNGQKVFEWDQTLEEVNLYITLPPNVHSKAFHCKIQSKHLEVGIKGNPPYLNHDLSAPVKTDCSFWTLEDDIMHITLQKREKGQTWASPILGQGQLDPYATDLEQKRLMLQ

SEQ ID NO: 2456 - protein, 224 aa, Glycine max
  misc_feature (141)..(141): Xaa can be any naturally occurring amino acid
MGKSTNNNRDWTQMYAIYGMEQWQTLIFLLCQAMLFSVLSVLYLLYFDLVCNFFERIFSGAGGGTARFAAGITGSVTALSALCLFFAAANFFYSSVPLHFDMAQRIVSAVHDWSSVKLALDLGCCGRGILLNAVATQLKKXKGGPGRVVGLDPPKRHSAPQKLGFHPLKKTGPRPKLEPKGNKPFSNLGAAGKKWERGPGQKTLNPAPRRGQTPAARVCRVFSG

SEQ ID NO: 2457 - protein, 122 aa, Glycine max
  misc_feature (95)..(95): Xaa can be any naturally occurring amino acid
STNNNRDWTQMYAIYGMEQWQTLIFLLCQAMLFSVLSVLYLLYFDLVCNFFERIFSGAGGGTARFAAGITGSVTALSALCLFFAAANFFYSSVPXLHFDMAQRIVSAVHDWSSVKLALDLGC

SEQ ID NO: 2458 - protein, 332 aa, Glycine max
  misc_feature (173)..(173): Xaa can be any naturally occurring amino acid
  misc_feature (294)..(294): Xaa can be any naturally occurring amino acid
  misc_feature (317)..(317): Xaa can be any naturally occurring amino acid
MSVEEMQSQKRNVFDAETASSLVKELRDNFGSGRTRSYEWRVSQVKALLKAVVDNEEQIVDALRSDLAKPPLETIVYEVGMFKNSCEVILKELKQWMKPEKVKTSIRTFPSSAEIVPEPLGVVLVISAWNYPLLLSLDPVGGAIAAGNAVVLKPSEIAPASSSVLLKLIEKYXDNSFIRVVEGAVDETTALLQQKWDKIFYTGNGKVGRIVMTAAAKHLTPVVLELGGKSPVVVDSNFVLLIAASRIIAGKWGLNNGQACISPDYVITTKDYAPKLVDALKTELESYYGRNPVXSEDLSRNVISNCFSRLFLLFYDXKITGEIGYGGEKYIK

SEQ ID NO: 2459 - protein, 192 aa, Glycine max
  misc_feature (8)..(9): Xaa can be any naturally occurring amino acid
  misc_feature (15)..(16): Xaa can be any naturally occurring amino acid
  misc_feature (22)..(23): Xaa can be any naturally occurring amino acid
  misc_feature (28)..(29): Xaa can be any naturally occurring amino acid
VAVRVSNXXEMFLTXXHSDSNXXAGLAXXVIMDGSRTFLIEIQALCLTHCPVSSSLSNGINANKANIIKCVLIKQTGLHLQDNAMFLNVVSGMTVTETAGDLAIAAAICSSFLEFPIPEGTAFIGEIGLGGELRMVPRIEKRVNTLVKLGYRMCVVPKQAEKLLETEGLGKMKVVGCKDLKEVINAVFSRNN

SEQ ID NO: 2460 - protein, 355 aa, Glycine max
FGSSENTATMKEGRAEASMVMFGALDELFEKTRVRPKDVGVLVVNCSIFNPTPSLSAMIINHYKMRGNILSYNLGGMGCSAGIIGVDLAKDILQANPNNYAVVVSTEMVGYNWYQGKDRSMLIPNSFFRMGCSAVLLSNRRRDYSRAKYRLEHIVRTHKGADDRSFRCVYQEEDEQKLKGLKISKDLIEIGGDALKTNITTLGPLVLPFSEQLLFFSTLVWRHLFGSKNDGNSPSMKKPYIPDYKLAFEHFCVHAASKTILDELQRNLELSDKNIEASRMTLHRFGNTSSSSIWYELAYMEAKESVRRGDRVWQLAFGSGFKCNSVVWRAMRRVTKPSRNPWLDCINRYPAPLNN

SEQ ID NO: 2461 - protein, 242 aa, Glycine max
MSLFLLEIRQLAEIEAMAASKKLITREEWEKKLSDVKIRKEDMNKLVMNFLVTEGYVEAAEKFRMESGTEPDIDLATITDRMAVKKAVQSGNVEDAIEKVNDLNPEILDTNPQLFFHLQQQRLIELIRNGKVEEALEFAQEELAPRGEENQSFLEELERTVALLAFEDVSNCPVGELLDISQRLKTASEVNAAILTSQSHEKDPKLPSLLKMLLCAQNQLDEKAAYPRVNDLSTATLEDPAV

SEQ ID NO: 2462 - protein, 554 aa, Glycine max
  misc_feature (221)..(221): Xaa can be any naturally occurring amino acid
MGSSGFSWKLADHPKLPKGKTVAVVVLDGWGEATPNEYNCIHKAETPCMDSLKKGAPERWRLVRAHGTAVGLSTGDGMGNKNFQRVSLWLARDAILSGKFDQVRVNLPNGDMVGHTGDIEATVVACKAADAAVKMILDAIEQVGGIYVVTADHGNAEDMVKRDKSGKPLLGKDGIIENLTTRSLEPVPIAIGGHGLAPGVRFRNDVPTGGLANVAATVMNXMDSRLEAPYKFTNALEAVKKLRAEPKANDQYLPPFVIVDESGKPVGPIVDGDAVVTFNFRADRMTMIAKALEYENFDKFDRVRYPKIRYAGMLEYDGELKLPSHYLVSPPEIDRTSGEYLVYNGIRTFACSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNNVPTGGLANVAATVMNLHGFEAPSDYETTLIEVVDN

SEQ ID NO: 2463 - protein, 408 aa, Glycine max
FGSRLGRVLGHGSFAKVYHARNLKTGQHVAMKVVGKEKVIKVGMMEQVKREISVMKMVKHPNIVELHEVMASKSKIYISIELVRGGELFNKVSKGRLKEDLARLYFQQLISAVDFCHSRGVYHRDLKPENLLLDEHGNLKVSDFGLTAFSDHLKEDGLLHTTCGTPAYVSPEVIAKKGYDGAKADIWSCGVILYVLLAGFLPFQDDNLVAMYKKIHRGDFKCPPWFSLDARKLVTKLLDPNPNTRICISKVMESSWFKKQVPRKVEEVVEKVDLEEKIENQETMNAFHIISLSEGFNLSPLFEEKRKEEMRFATAGTPSSVISRLEEVAKAGKFDVKSSETKVRLQGQERGRKGKLAIAADIYAVTPSFMVVEVKKDNGDTLEYNQFCSKQLRPALKDIFWNSAPASA

SEQ ID NO: 2464 - protein, 553 aa, Glycine max
  misc_feature (140)..(140): Xaa can be any naturally occurring amino acid
  misc_feature (192)..(192): Xaa can be any naturally occurring amino acid
  misc_feature (318)..(318): Xaa can be any naturally occurring amino acid
MEQLVNFIIRPPRAEYDPKSDLLDQEFMLKGKWYQRKDVEIKNSRGDVLQCSHYLPIVSPEGKPLPCVIYCHGNSGCRADASEAAIILLPSNITVFTLDFSGSGISGGEHVTLGWNEKDDLKAVVNYLRDDVNVYLFGFXGRSMGAITSLLYGPQELLIPFLSEPFPKCSVLIQVPVACVSLEGPAHLQLQXAIQKKAKFDITDLNTIKVAKSCFVPALLGHAIDDDFIQPHHSDRIFEAYMGDKNIIKFDGDHNSPRPQFYFDSINIFFHNVLQPPEDEVGESFFDPMNDYFGKDVWRSVHELGYSNESSSKNKDEXSTSSTINAIEQVRSRRPMSRMEVPSDISSKDEHREHEEKCGNISPSSSSMISFELSNDDPFGSHVPATLEDDQYVEYQLDDLAGFPSTAEEEERMFMEAVMESLKDLEVRNPNAEQPTSSVSSVYVDAVEPSDKDASSGEISRPVETESSSLKHTTESKFKTTSSTSEEFEPLNGESNSISVKHSQNVVSASLQSSSETDVSHNTKATVTVVRNPAGHVMDGLMRRWDFNFFKNK

SEQ ID NO: 2465 - protein, 426 aa, Glycine max
MSEKEKGNNSEGQSTLLHGKYELGRVLGHGTFAKVYHARNLNTGQHVAMKVVGKEKVIKVGMMEQVKREISVMKMVKHQNIVELHEVMASKSKIYIAMELVRGGELFNKVSKGRLKEDVARLYFQQLISAVDFCHSRGVYHRDLKPENLLLDEHGNLKVSDFGLTAFSDHLKEDGLLHTTCGTPAYVSPEVIAKKGYDGAKADIWSCGVILYVLLAGFLPFQDDNLVAMYKKIHRGDFKCPPWFSLDARKLVTKLLDPNPNTRISISKVMESSWFKKPVPRKLAAEKVDLEEEKIESQLETINAFHIISLSEGFNLSPLFEDKRREEMRFATAGTPSTVISRLEEVAKAGKFDVRSSETKVRLQGQERGRKGKLAIAADIYAVTPSFMVVEVKKDNGDTLEYNQFCSKQLRPALKDIFWNSAPASA

SEQ ID NO: 2466 - protein, 63 aa, Glycine max
  misc_feature (20)..(20): Xaa can be any naturally occurring amino acid
  misc_feature (52)..(52): Xaa can be any naturally occurring amino acid
RKGCEKRCDDDTIGDLKKLXAFQTGTRLERIRILKWKTFYEEHITLQDYKIXHDCMRLELYYY

SEQ ID NO: 2467 - protein, 511 aa, Glycine max
MAQPSTGIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGLGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQHVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQSKKLDYCISANQDFPNKCNIFCSDCMLS

SEQ ID NO: 2468 - protein, 516 aa, Glycine max
  misc_feature (173)..(173): Xaa can be any naturally occurring amino acid
  misc_feature (187)..(187): Xaa can be any naturally occurring amino acid
  misc_feature (216)..(216): Xaa can be any naturally occurring amino acid
  misc_feature (233)..(233): Xaa can be any naturally occurring amino acid
  misc_feature (252)..(252): Xaa can be any naturally occurring amino acid
  misc_feature (262)..(262): Xaa can be any naturally occurring amino acid
  misc_feature (445)..(445): Xaa can be any naturally occurring amino acid
  misc_feature (491)..(491): Xaa can be any naturally occurring amino acid
  misc_feature (497)..(497): Xaa can be any naturally occurring amino acid
MAQPSTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKSVAELGLLYLGMGVSGGEEGARNGPSLMPGGSFEAFKYIEDILLKVAAQVPDSGXPCVTYIGKGGSGNXVKMIHDGIEYGDMQLMEEAYDLLKSVGKXSNNELQSVFSEWNKGEXLLSFLIEITADIFGIKDDXKGDGYLVDKXVLDKTGMKGTGKWTVQQAAELSIAAPTIEASLDARFLSGLKEERVEAAKVFKSGGIGDIVTDQPVDKKKLIDDVRKALYAAKICSYAQGMNLIRAKSIEKGWDLKLGVLARIWKGGCIIRAIFVDRIKQAYDRNPNLANLLVDPEFAKEIIDRQSAWRRVVCLAINSGISTPGMSASLAYFDXTYRRERLPANLVQAQRDYFGAHTYERVDIEGSYHTEWFKLAKQSRXLDYCIXTNQDFPNKCNVFCSDCMLS

SEQ ID NO: 2469 - protein, 511 aa, Glycine max
  misc_feature (484)..(484): Xaa can be any naturally occurring amino acid
  misc_feature (492)..(492): Xaa can be any naturally occurring amino acid
MAQPTTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGMGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQPVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQXKKLDYCIXANQDFPNKCNIFCSDCMLS

SEQ ID NO: 2470 - protein, 256 aa, Glycine max
MFLSLNFTNKHVSPSICCYCFFSFPTLHPQQQQSQPNNPPFLGFKGTSCFVEKHSCCLSVKPFCASQKRGTKIFCSMNMSAHQSDDHGKMKLDQLIDKVQKLWDISPEPVKKFPHNKALDNFIQLILDLIVVVVKYLAVPVFAVTSLSEMSYCAHERKLVFVPLPVLFGVAVAGILKETALQLSPRLRDAEIPWHLIAIAIFFTLIKLPGPYYPYWVRIIIPHFANGVLLRTLLFDALWDAWAKALKILGSGWLTH

SEQ ID NO: 2471 - protein, 139 aa, Glycine max
  misc_feature (105)..(105): Xaa can be any naturally occurring amino acid
MDAGGKIKKGAGGRKGGGPKKKPVSRSVKAGLQFPVGRIGRYLKKGRYAQRVGTGAPVYLAAVLEYLAAEVLELAGSAARDNKKNRIIPRHVLLAVRNDEELGHXLHMVINPVLLPKKTERAAKEPKSPSKATKSPKKA

SEQ ID NO: 2472 - protein, 150 aa, Glycine max
MDADGKIKKGAGGRKGGGPKKKPVSRSVKAGLQFPVGRIGRYLKKGRYAQRVGTGAPVYLAAVLEYLAAEVLELAGNAARDDKKNRIIPRHVLLAVRNDEELGKLLAGVTIAHGGVLPNINPVLLPKKSDRASKEPKSPSKATKSKGKGR

SEQ ID NO: 2473 - protein, 492 aa, Glycine max
  misc_feature (130)..(130): Xaa can be any naturally occurring amino acid
  misc_feature (197)..(197): Xaa can be any naturally occurring amino acid
  misc_feature (214)..(214): Xaa can be any naturally occurring amino acid
  misc_feature (228)..(228): Xaa can be any naturally occurring amino acid
  misc_feature (230)..(230): Xaa can be any naturally occurring amino acid
  misc_feature (287)..(287): Xaa can be any naturally occurring amino acid
MGRKRKVAPKSSVSAEPPLKQHQPKQQQDEDDDPPENAAQEYEEEVEEEVEEEEVEEEVEEEEEEEEDEEDEEEEEEDQKDQYQHQQQQQDEDDDPISKLLEPLSKDQLLILLCEAAAKHQDVAERIRRXADEDPVHRKIFVHGLGWDTTAGTLISSFRQYGEIEDCKAVTDKVSGKSKGYGFILFKTRRGARNALXKEPQKKIGNRMTACQLXASIGPVSNPPQTAXPXVAAPSSSVSEYTQKKIYVSNVGADLDPQKLLAFFSRFGEIEEGPPGALTRAPGRKPXGFCLFVYRSPESARRALEEPHKDFEGHILHCQKAIDGPKAGKLQQHGNVNAQAQRAQFQRNGSVGTNAAAGYGGGAALQPGHLMAPAGPGIGFNQSAAAAQAALNPAMAQALTALLASQGTLGLTNLLGSIGTSAAVNPGVPSAGAAVQGGYSAQPNISPGVVGGYGNQVGLQVAYPNQNQNQQIGQGGSGRGQYGGGSAPYMGH

SEQ ID NO: 2474 - protein, 52 aa, Glycine max
  misc_feature (12)..(12): Xaa can be any naturally occurring amino acid
  misc_feature (29)..(29): Xaa can be any naturally occurring amino acid
  misc_feature (34)..(34): Xaa can be any naturally occurring amino acid
  misc_feature (43)..(43): Xaa can be any naturally occurring amino acid
MSVSNIGMMDGXYFVGRNEILAWINTTLXLSLAXVEEAASGAXACPLMDAAH

SEQ ID NO: 2475 - protein, 261 aa, Glycine max
MYKERERGGVSVSASKSEDRKRINDVLDKHLERSSPSTSRPINTASKNSNLQVEESETESEESDVSGSDGDDTSWISWFCNLRGNEFFCEVDDDYIQDDFNLCGLSSQVPYFDYALDLILDVESSHGDMFTEEQNELIESAAEMLYGMIHARYVLTSKGMAAMLDKYKSYDFGRCPRVYCSGQPCLPVGQSDIPRSSTVKIYCPRCEDLYYPRSKYQGNIDGAYFGTTFPHLFLMTYGQLKPQKPAQGYVPRVFGFKVHKP

SEQ ID NO: 2476 - protein, 105 aa, Glycine max
MVTVQIKQFKSKNSLSIKKELSIMGFSLRGLQRRVDVPKGRVAVYVGENQKKRFVIPISYLNQPSFLEVLNQAEQEFGFDHPMGGLTIPCNENVFLDVTSRLHSR

SEQ ID NO: 2477 - protein, 148 aa, Glycine max
  misc_feature (32)..(32): Xaa can be any naturally occurring amino acid
LNCVPKEDFGGGHPDPNLTYAKELVERMGLGXTSNADPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDG

SEQ ID NO: 2478 - protein, 352 aa, Glycine max
MEIIMPSLERDLNDTRGYYESGKTKEASWRESQLKGLRRFLIEKQEDIMNALMHDLGKHQLEAFRDEIGTLIKTLNLALKSLKHWMSGKKAALPQLALLTSAEIVPEPLGVVLIISSWNFPFGISLEPLIGAVAAGNAAVLKPSELSPACSSLLASNLSTYLDNKAIKVIQGGPKETQQLLEQRWDKIFFTGSAHVGKIVMSAAVKHLTPVTLELGGKCPAVVDSLSSSWNIEVAVKRIIVGKYGACAGQACIAIDYVLVEKVYCFKLVELMKVWIKKMFGENPQQSKTIAKIVNKHHFSRLKNLLADKKVKESVIYGGSMDENDLFIEPTILLDPPLDSAVMAEETLALYS

SEQ ID NO: 2479 - protein, 120 aa, Glycine max
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPM

SEQ ID NO: 2480 - protein, 160 aa, Glycine max
  misc_feature (99)..(99): Xaa can be any naturally occurring amino acid
  misc_feature (152)..(152): Xaa can be any naturally occurring amino acid
ASSMISSPAVTTVNRAGAGMVAPFSGLKSIAGFPTKKTNNDITSIATIRGKVQFLHVWPPLGKKKIDTLSYLPYLDDAQLPNELEYLLTNVWIPCLEFXMEHIFMYREHYTSPGYYNSRYCTMLKLPMVGCTDASRVIKELLQAKTAYPNGXFIRIIGFD

SEQ ID NO: 2481 - protein, 277 aa, Glycine max
MAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSISEHMIESGWTRCFFHISEVGWPMYIVYVSLYLIFVEFGIYWMHRELHDIKPLYKHLHATHHIYNKENTLSPFAGLAFHPLDGILQAISHVIALFLLPMHFRTHIALLFIEAVWTANIHDCIHGKIWPVMGAGYHTIHHTTYRHNYGHYTVWMDWLFGTLREPEDLLKKD

SEQ ID NO: 2482 - protein, 159 aa, Glycine max
  misc_feature (112)..(112): Xaa can be any naturally occurring amino acid
SSLRRPPPRKFGNFEPDNYWSRVCEGETEGIIKRPWHFLWKSRRLMEIVSAIASRMNWDFDSVHVVRGEKAQNTQLWPNLDRDTSPDSLLMALNDKVGAGRYLYIATNEPDXSFFNPLKEKYKTHFLDDFKYLWDENSEWFTETKELSNGQPVEFDGYM

SEQ ID NO: 2483 - protein, 656 aa, Glycine max
MLPHKHTLVVVATVATLALAAVLAAPQADLASERAALLSLRSSVGGRTLFWNATRDSPCNWAGVQCEHGHVVELHLPGVALSGEIPVGIFGNLTQLRTLSLRFNALRGSLPSDLASCVNLRNLYIQRNLLTGQIPPFLFHLPDLVRLNMGFNNFSGPFPSAFNNLTRLKTLFLENNQLSGPIPDLNKLTLDQFNVSDNLLNGSVPLKLQTFPQDSFLGNSLCGRPLSLCPGDVADPLSVDNNAKGNNNDNKKNKLSGGAIAGIVVGSVVFLLLLVFLLIFLCRNKSAKNTSAVDIATVKHPETESEVLADKGVSDVENGGHANVNPAIASVAAVAAGNGGSKAEGNAKKLVFFGNAARAFDLEDLLRASAEVLGKGTFGTAYKAVLEAGPVVAVKRLKDVTISEKEFKEKIEAVGAMDHESLVPLRAYYFSRDEKLLVYDYMPMGSLSALLHGNKGAGRTPLNWEVRSGIALGAARGIEYLHSRGPNVSHGNIKSSNILLTKSYDARVSDFGLAHLVGPSSTPNRVAGYRAPEVTDPRKVSQMADVYSFGVLLLELLTGKAPTHALLNEEGVDLPRWVQSVVREEWTSEVFDLELLRYQNVEEEMVQLLQLAVDCAAQYPDKRPSMSEVVRSIQELRRSSLKEDQDQIQHDNDILL

SEQ ID NO: 2484 - protein, 715 aa, Glycine max
MLCACSSGEQFKFEEPPHSPESLATRDFSASGLSSRTGEWEPKFDDTQVEEAESTLKDALSLNYEEARALLGRLEYQRGNFDAALQVFQGIDIKGLTPRMIKAIAERTKQRKLRPKADMVVPNVMSLHSVSLLLEAILLKARSLEELGQCIEAAKECRIILDTVESALPNGMPEGIGEGCKLQEMFHKALELFPSLWIKAGFLDEAVTAYRRALVKPWNLEPRKLAAVEKDLAMILLYGGVEVSLPSQLQVWGKTAPKSSAEEAILLLLILMSKVAIREIDWDAEIMDHLTFALSVTGMFELLADHVEQILPGIYGRAERWYFLALCYSAAGHDGVALNLLRKACGSSEANHRPHFPSFLFGAKLCSLDPHHAHEGIKFSREVIVIAKQQNEHFLSQGHKFLGICYGAAARISVLDSERSIFQRESLDSLNCAAVNGSDDLEAIVSLGLENAIQRNLDAAYNNIMMYSDMTVGSSRGWQLLALIISAQQRFKDAETIVDFALDDSGGMGQLELLRLKAVLQISQQQPKEAIETYRILLALIQAKKELLLQDKNIDQEQAFRHEALTERKLEMEAWQDLATIYTDIGSLLDAKICVDKARLIEYFSPRSWHITGMLLEAQSLYKEAFVSFSVSLSIEPDYIPGIISTAELLMKLGMQSLPIARSFLMNALRLEPTNHDAWFNLGLVSKTEGSLQQAAEFFQAAYELKLSAPVQKFK

SEQ ID NO: 2485 - protein, 172 aa, Glycine max
  misc_feature (53)..(53): Xaa can be any naturally occurring amino acid
  misc_feature (118)..(118): Xaa can be any naturally occurring amino acid
  misc_feature (143)..(143): Xaa can be any naturally occurring amino acid
AYSMISSPTVTNVNPACAGMVAPFTGLKSIAGFPTRKTNNDITSIATNGGRVXCMHVWPPVGKKKFETLSYLPDLDDAQLAKEVEYLLKNGWIPCLKFELEHGFVYREHNRSPGYYDXRYWTMWNLPMTCCTDAYDVFKELQXANTAIANSFIQIIRFDNLLSVQCMSFDRY

SEQ ID NO: 2486 - protein, 168 aa, Glycine max
MIFSPSVTTVNRAGAGVVALFTGLMSMAGFPTENTNSDITYIASNCGRVQCVRVWPPFGKKKFETLFYLPDLDDAQLAREVIYLLRKGWIPCLEFELEHGFVYREHNRSPVLYYGLYWTMWKLSMCGCSDASHVLRDLLDAKSAYPCGFMRIIICHNVTQVHRISFIV

SEQ ID NO: 2487 - protein, 235 aa, Glycine max
PRSMPTSGALDRVAEKLDLPFFEVPTGWKFFGNLMDAGNLSVCGEESFGTGSDHIREKDGIWAVLAWLSIIAHRNKDKKPGEKLISVSDIVTEHWATYGRNFFSRYDYEECESEGANKMIEHLRDIVSKSKPGDQYGSYVLQFADDFAYTDPVDGSVVSKQGVRFVFTDGSRIIYRLSGTGSAGATVRVYIEQFEPDVSKHDVDAQIALKPLIDLAISMSKLKDFTGREKPTVIT

SEQ ID NO: 2488 - protein, 238 aa, Glycine max
LARSMPTSGALDHSSEITKDGPGIQVPTGWKFFGNLMDAGNLSVCGEESFGTGSDHIREKDRIWGYTSPWLSIIAHRNKDKNPGEKLISVSDVVMEHWATYGRNFFSRYDYEECESEGANKMIEYLRDILSKSKPGDQYGSYVLQFADDFTYTDPVDGSVVSKQGVRFVFTDGSRIIYRLSGTGSAGATVRVYIEQFEPDVSKHDVDAQIALKPLIDLAISVSKLKDFTGREKPTVIT

SEQ ID NO: 2489 - protein, 389 aa, Glycine max
MGDYKSFSFSKMMGCCGCFGFVQKPRPQTEGEETYSGDVTSNCTSGDDNEVQAVRNRSEDILNFRAENGMVCRPFPVKETCKLDRSEDENGNKMINEYVREYKIGCGSYGKVALYRSSVDGKHYAIKSFHKSHLQKLRVAPSETAMTDVLREVLIMKMVEHPNIVNLIEVIDDPESDDFYMVLEYVESKWVCEGTGHPCALGEETARKYLRDIVSGLTYLHAHNIVHGDIKPDNLLITRHGTVKIGDFSVSQAFEDGNDELRRSPGTPVFTAPECCLGLTYDGKASDTWAVGVTLYCMILGEYPFLGDTLQDTYDKIVNNPLVLPNDMNPPLKNLIEGLLSKDPRLRMSLGDVAEDSWVIGDDGPIPDYLCWCKMKSLGIEDNDESNTD

SEQ ID NO: 2490 - protein, 118 aa, Glycine max
MAISMISSRADTTVNRAGAGMVATFTGLKFMAGLPTRKTNNDITSIASNGGRVQCMQVWPPIVKNKFETLSYLPDLDDSQLAKEVEYLIMKRWIPCLEFELEHGFEYREHNRSPGYYD

SEQ ID NO: 2491 - protein, 166 aa, Glycine max
  misc_feature (54)..(54): Xaa can be any naturally occurring amino acid
  misc_feature (68)..(68): Xaa can be any naturally occurring amino acid
  misc_feature (106)..(106): Xaa can be any naturally occurring amino acid
  misc_feature (134)..(134): Xaa can be any naturally occurring amino acid
MRTKKKEVAYSMISCPVVTTRQRAHGDRYWTVPFTGLKSMAGFPTRKTNNDITXIASNGGRVQCMQVXWPPIGKKKIETLSYLPDLDDAQLAKEVEYLIRKGWIPXLEFELEHGFEYREHNGSPGYYQGLYWTXWKLPMSGCTDASQVLKEHQEAKTAYPNGFIRI

SEQ ID NO: 2492 - protein, 128 aa, Glycine max
  misc_feature (51)..(51): Xaa can be any naturally occurring amino acid
VCSMISSPAVTTVNRAGACMVAPFTALKSMVGFPWRKTTIDITFVAINGGXVQCMLVSPPIANKKFETLSYSPYLNDAQLLYEVKYHLKTGWIPCSQFDTDHGLGYHDHNRAPGYYYGLYWTMWKLPM

SEQ ID NO: 2493 - protein, 244 aa, Glycine max
  misc_feature (91)..(91): Xaa can be any naturally occurring amino acid
  misc_feature (177)..(177): Xaa can be any naturally occurring amino acid
HGGNVRCSVEVQISHGRSNPHFSAVPPLRFRNPNPNLSLLNLAASNSEGDALYTLKRSLSDPDNVLQSWDPTLVSPCTWFHVTCNQDNPSXTRVDLGNSNLSGHLVPELGKLEHLQYLELYKNNIQGTIPPELGSLKSLVSLDLYNNNISGTIPPSLGKLKNLVFLRLNDYRLTTQXNRLTGPIPKELSAVSSLKVVDVSNNDLCGTIPTSGPFEHIPLNNFENNPRLEGPELLGLVSYDTNCS

SEQ ID NO: 2494 - protein, 106 aa, Glycine max
ENPRGRYLKISEKTSATRSTIIVPFSGISWFLDLFNYYVNSDDQDLFSKELQLDTKVFYFDIGENRRGRILKVLGMNLSIPSYIQTTQIVTVQEDQKLPTTHNRNP

SEQ ID NO: 2495 - protein, 76 aa, Glycine max
  misc_feature (34)..(34): Xaa can be any naturally occurring amino acid
  misc_feature (49)..(49): Xaa can be any naturally occurring amino acid
  misc_feature (56)..(56): Xaa can be any naturally occurring amino acid
PQYKPKFDALLFGVKKAKGKSFKGFGGLEKEIFXVQGLKKKVCSLAAGXFFKSLLXLRKKFFFEVRNDNWGFWFFN

SEQ ID NO: 2496 - protein, 262 aa, Glycine max
  misc_feature (195)..(195): Xaa can be any naturally occurring amino acid
MYKERERVGVSVSASKSEDRKRINDVLDKHLERSSPSTSRPITSASKNSNLQVEESETESEESDVSGSDGDDTSWISWFCNLRGNEFFCEVDDDYIQDDFNLCGLSSQVPYYDYALDLILDVESSHGDMFTEEQNELIESAAEMLYGLIHARYVLTSKGMAAMLDKYKNYDFGRCPRVYCSGQPCLPVGQSGHPXRLSTVKIYCPRCEDLYYPRSGSHLDIDGAYFGTTFPHLFLMTYGQLKPQKPSQSYVPRVFGFKLHKP

SEQ ID NO: 2497 - protein, 387 aa, Glycine max
  misc_feature (237)..(237): Xaa can be any naturally occurring amino acid
  misc_feature (246)..(246): Xaa can be any naturally occurring amino acid
MAKPVSIEVWNPSGKYRVVSTKPMPGTRWINLLVQNDVRLEICTEKKTILSVEDIIALIGDKCDGVIGQLTEDWGEQLFSTLSKAGGKAFSNMAVGYNNVDVDAANKYGVAVGNTPGVLTETTAELAASLSLAAARRIVEADEFMRAGLYDGWLPHLFVGNLLKGQTVGVIGAGRIGSAYARMMVEGFKMNLIYYDLYQSTRLEKFITAYATFLKASGETPVTWKRAATMDEVLQEXDIISLHLVXNKVEPYHQVNKERLAKMKKEAILINCSRGPVIDEAALVEHLKQNPMFRVGLDVFEEEPYMKPGLAELKNAIVVPHIASASKWTREGMATLAALNVLGKIKGYPVWFDANRVEPFLNENAQPPAASPSIVNAKALGLPTSKL

SEQ ID NO: 2498 - protein, 125 aa, Glycine max
  misc_feature (65)..(65): Xaa can be any naturally occurring amino acid
KESVGNPLRLQSENHISLICRSSEQSMDFYHNVVGFYPIRRPVSLYYDGAWLFGYGIGIHLLEAXNSEKLPKMKEINPKDNHISLQCESMVAVEKMLIDMEIDSVRATVEERRIPVDHLRFLDRD

SEQ ID NO: 2499 - protein, 146 aa, Glycine max
  misc_feature (120)..(120): Xaa can be any naturally occurring amino acid
  misc_feature (134)..(134): Xaa can be any naturally occurring amino acid
  misc_feature (144)..(144): Xaa can be any naturally occurring amino acid
MGVLRKKHNKKSRRPSFKSVLTSILATQAAIFLLLLAGVSLAGTAVAFIASMPLFVVFSPILVPAGVATGLLATGLAAAGSSGAMAVSLILWVIKRVTGKEPPKIMSKVLRKVFPGGGTXHLNWQQNQKPSQRXAPAAAPSAAXCS

SEQ ID NO: 2500 - protein, 113 aa, Glycine max
MSKNKLCTPLSTLLRRTLTSFPQHFTSNFSQIKLSLHDSSLPFAPPSHNPTCDYYYSLGFFRKSLCSKSAEEIQRGCWNCHTVPHSEPFLVCESCRCIQPVDSSVDYFDIFGV

SEQ ID NO: 2501 - protein, 238 aa, Glycine max
MAESQGGSGGDDGASGSRRRGSTSRRAMAAQTQDEAMVESSPTTPCGACKFLRRRCVEGCIFAPHFGTDQGAAKFAAVHKVFGASNVSKLLSNIPVNRRNEASTTISYEAQARLSDPVYGCVSTILALQQQVATLQAELAMLQTQLMNSRFAYASALQTTQLQQPNMNTGALQPAYSNNSCASTNLLNLSTFNNNPSFVLEMDTAPSSSLEPLQLTRLSQCKEEDEEENKTQKAFNHR

SEQ ID NO: 2502 - protein, 148 aa, Glycine max
  misc_feature (129)..(129): Xaa can be any naturally occurring amino acid
MSGAGKKVADVAFKASRTIDWEGMAKVLVTDEARREFSNLRRAFDEVNTQLQTKFSQEPEPIDWDFYRKGIGAGIVDMYKEAYDSVEIPKYVDNVTPEYKPKFDALLVELKEAEQTSLKESERLEKELXDVKEISKKLSTMTADEYFE

SEQ ID NO: 2503 - protein, 582 aa, Glycine max
  misc_feature (276)..(276): Xaa can be any naturally occurring amino acid
MVLKSMVASASDLSLVSVAGNSPLDFKNRVFGGRLISLGFRFNKGSKCKGNERFNFEVRAAVEVGVERSKSKALEGGFGLDVVSEAELTVKGFAGLRKTKLVCTVGPACSSLEDLENLALGGMSVARLNMCHGTREWHRDVIRKIKKLNEEKGFCVSVMIDTEGSQIHVVDHGAPSSVKVEEGSNWVFTAEHYEGSRPFTVQTNYRGFSEGTEVGDELVIDGGMACFEVTEKTGNDLHCKCIDAGLFLPGAKFSFWRDGKLVRGKLNPTSQSLSNXMKSRGLISQGVDFFALSFVNHADSVKDLKMYLSTKSTKSIKVLAKIESLESLHKLEEIVQASDGIMVARGDLGVEIPLEQIPTVQEDIIYVCRQLNKPVIVASQLLESMVEYPTPTRAEVADVSEAVRQYADALMLSGESAIGSYGRKALAVLDMASSRMESWSREENRQSLVSHHQLGESLPECITEQICNCAVEMANNLGVDAIFVYTKYGHMASLLSRNRPNPPIFAFTNDDSTRMALTLQWGVVPILVDLSDDAESNISKSVQLMKSRGLISQGDVVLVVSDVAPTRASPMAFQSIQVKTII

SEQ ID NO: 2504 - protein, 111 aa, Glycine max
MERCDKVMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLV

SEQ ID NO: 2505 - protein, 176 aa, Glycine max
INVSLVAEAESALILVRHGESLWNEKNLFSGCCSVPLTNRGVEEAIEAGQRISYIPIDMIFTSALIRAQMTALLAMTRHSQKKVPIIIHDESEQATTWTQVYSEKTTKQSIHLDGLTSQEVTSLEISTGIPLLYIYKEGKFNSRGSPVGPTEAGVYAYTQSLAVYRQQLDDMSSCY

SEQ ID NO: 2506 - protein, 330 aa, Glycine max
  misc_feature (103)..(105): Xaa can be any naturally occurring amino acid
  misc_feature (130)..(130): Xaa can be any naturally occurring amino acid
RSRGRVKGGGWNWGNEEKERENQEKHCGRKRRVGPVDHGLVLSALSRALEVTELAYLDMTDKLLDTNPELALMGSCLLVALMRDEDVYVMNVGDSRHEGVLDXXXRKRVEFYVCEIGEAREVLSPVPRAXVEVPLGLGQIGSAQQKRLVALQLSTDHSTSIEEEVIRIKNEHPDDAQCIVNGRVKGRLKVTRAFGAGFLKQPKWNDAVLEMFRNEFIGTAPYISCSPSLCHHRLCQRDQFLILSSDGLYQYLNNDEVVSHVESFMEKFPEGDPAQHLIEELLLRAAKKAGMDFHELLDIPQGDRRKYHDDVTVMVISLEGRIWKSSGKYP

SEQ ID NO: 2507 - protein, 98 aa, Glycine max
MVCDKCEKKLSKVIVPDKWKDGARNVTEGGGRKINENKLLSKKNRWTPYGTATTKCTICKQQVHQDGKYCHTCAYSKGVCAMCGKQVLDTKMYKQSNV

SEQ ID NO: 2508 - protein, 92 aa, Glycine max
MEKQQQPSKETKPQNESGKESSTEGLPMEDSPYVKYKDLEDYKRQGYGAQGHQEPKPGRGAGATEAPTLSGAAVSSDAQATATDVINSKGVL

SEQ ID NO: 2509 - protein, 79 aa, Glycine max
MNSNSNSNVGGGFRSRLNHYLYSGDKKHVFVGLTLITAVFTIPWYFMSRGTKHQSHQDYLEKADKARSQRLSSSSASAK

SEQ ID NO: 2510 - protein, 149 aa, Glycine max
MISANRLIEMARKWQKMAVGNRKRISYPPRNHNNIVHMHYSSTANKGHFVVYSVDHKRFEVPLKYLSTNVFRELLDWSEEEFGLPSNGPITLPCDSVFLDYVISLIRERVPEEVEKALITSMVACHHEASSSSSRGLRQSNEPMIIYGF

SEQ ID NO: 2511 - protein, 282 aa, Glycine max
  misc_feature (164)..(164): Xaa can be any naturally occurring amino acid
ESATCPPPPDLDQLREHSKGEFDEHEVIRIVGKNPFLWHDHWPVKDYAKVFECLVLIDEIGQEADRVVSRIRAVGRETQSNSESMELDNNDSSSFQPLPYVAVHMRVEIDWMIHCKKLEQRLNTNQICSSKKEIMERVSNIKGLKTPSVVYLAGADKLLQNSSXLEGWEEGFLPYEKNKLGVDGIYKKYPYLIQSAIDYEVCLRADIFVGNSFSTFSTLIVLERTQKMITMGINMCGKDVRWPSYAYNIQQGESNGPMRWVTNMSHSTLQEISYGTNHIISC

SEQ ID NO: 2512 - protein, 212 aa, Glycine max
MMNASKFIKCVTVGDGAVGKTCMLICYTSNKFPTDYIPTVFDNFSANVAVDGSIVNLGLWDTARQEDYSRLRPLNYRGADIFVLAFSLISISSYENVLKKWMPELPRFAPNVPIVLVGTKLDLREDRGYVADHMGSNVITSAEGEELRKQLGAAAYIECSSKTQQNVKAVFDTAIKVVLQPQPPRRKEMARKKRHRRSGCSFVSIMCGGCAA

SEQ ID NO: 2513 - protein, 560 aa, Glycine max
  misc_feature (125)..(125): Xaa can be any naturally occurring amino acid
  misc_feature (443)..(443): Xaa can be any naturally occurring amino acid
  misc_feature (454)..(454): Xaa can be any naturally occurring amino acid
  misc_feature (469)..(469): Xaa can be any naturally occurring amino acid
  misc_feature (489)..(489): Xaa can be any naturally occurring amino acid
MEKKENGPSEKASNGGIDGPTNPMVTPLLNDLYQFTMAYAYWKAGKQQERAVFDLYFRKNPFGGEYTVFAGLEECIRFIANFKLTEEEIDFVRQCLSSSCEDGFLDYLRGLDCSDVEVYAIPEGXVVFPKVPLMRVEGPVAVVQLLETPFVNLINYASLVSTNAARHRNVAGKSKTLLEFGLRRAHGPDGGVGASKYCYIGGFDATSNVAAGKLFGIPLRGTHSHAFVSSYMSLDEITDRSLNRKDGSSTCDDFVSLVQTWLNKIQLSNGVFGETNQSELAAFTSYALAFPDGFLALVDTYDVMRSGIPNFCAVALALSDLGYKAVGIRLDSGDLAYLSCEVRKFFYSIENEFGVPGFGKLQITASNDLNEETLDALNKQGHEVDAFGIGTYLVTCYGSSCLYLFSLQQVELNNQPPMKLSEDVSKDHIRCKKCCYRLYGKRXGIPMVDIMTGXENEPSPKVGERILCXHPFQESKRAYVVPQRVEELXRCYWSGSTDIKKDTLPALRDIRERCINQLEQMRPDHMRRLNPTPYKVSVSAKLYDFIHFLWLNEAPVGELQ

SEQ ID NO: 2514 - protein, 125 aa, Glycine max
  misc_feature (103)..(103): Xaa can be any naturally occurring amino acid
MSKMADEKVISAPATGGGEDGLIAGDLSATEARVRPLETLLRAAPLGLCVAAMAVMLRDTQTNEYGTVSYSDLGGFKYLVYANGLCAAYSLVSAFYTAVPRPXATLSRSWIVFLLDQVFTYLILA

SEQ ID NO: 2515 - protein, 562 aa, Glycine max
QLRRPPPLFSTTTGNKVPVMYLPLFENFDRCGQYAWGAAALAFLYRALGNASLKTQSTISGCLTLLQCWSYFHLNIGRPKLNLELMHDRFPFVLRWKGKQSGPTANRDVVFYRKALDSLKPCDVEWLPYRNMDSMVIPEHIKSTLILGRSKTMLICFDKAERHLPNRCLRQYGMLQSIPDDVERWERKSRGVDGGVDLSGKMESELNDWMDRQVSIVDGDEGVDESEYMEWYLRITRKFIGRPISLSSEFQRTKINKSLQNAGLRDIAHIADTFSTKGLDPQQIESISRIRYIAHECLRDQFGGPVMASGSTQVELGKRVRGKERVRRKGGTGKRLRKDGVVQYNAVSEDEQAQYYGTAIEVGQLHLSHIERELNHAQLCTVDNEVSVVQLIHANADGENMQLCDPHIEVDESDLGYAAGEENNEDPDDVAAEFSHEELKHRAGEEIKQELNHLTGEENIEELNAANEIHFVQPSELCDVSHDIDSTLADAAAEVNHSQLGDSSVINPQQSSPTDNLVNSQLSHINPESELPSAKGAMEVSQHSSIETREDISQNGDCTVAV

SEQ ID NO: 2516 - protein, 151 aa, Glycine max
MSGVKKVTDVAAKAGKAIDWDGLAKMLVSDEARKEFANLRRTFEDVNHQLQTKFSQEPKPIDWEYYKKGIGSKVVDMYKEAYDSIEIPKYVDTVTPEYKPKFDALLIEMKEAEKTSLKESERIEKEIAELKELKKKISTMTADEYFAKHPE

SEQ ID NO: 2517 - protein, 154 aa, Glycine max
MSSKDKKPSNPSGGRTSGIRTLSDLNRRSGPDSDSDSDGPQEYYTGGEKSGMLVQDPTKEPKHDDVDEIFNQARQLEAVEGPLERPSSSRSFTGTGRLLSGESVPTALQQPEPVIHNIVFWSNGFTVDDGPLRKLDDPENAPFLDSIRKSECRK

SEQ ID NO: 2518 - protein, 347 aa, Glycine max
MMFDFARIWTRNTLIGLGLGQFLSLLITSTGFTSSELAKKGINAPTSQSFLNYVFLTLVYGTVLLYRRKALKAKWYYYIILGLVDVEANFLVVKAYQYTSLTSVMLLDCWSIPSVMLLTWLFLKTKYRFKKITGVVVCVAGLVLVVFSDVHSGDRAGGSNPRKGDLLVIAGATLYAISNVSEEFLVKNADRVELMAMLGLSGGIISAIQISILERNELKSIHWSAGAVRFPFVGFAVAMFMFYSLVPVLLKINGSTMLNLSLLTSDMWAVLIRIFAYHEKVDWMYFVSFGAVTIGLIIYSGGDRDENQHPPNAADDAHRPAAKHDEEATSGNHNIAAAAGSSKTWVA

SEQ ID NO: 2519 - protein, 158 aa, Glycine max
MYFEFNSRCTCIAWVPGGDGSFVVSHADGNLYVYEKNKDGAGDSSFPVVKDQTQFSVAHARYSKSNPIARWHICQGSINSISFSMDGAFLATVGRDGYLRVFDYSKEQLICGGKSYYGALVCCAWSMDGKYILTGGEDDLVQVWSMEDRKVVAWGEGH

SEQ ID NO: 2520 - protein, 534 aa, Glycine max
MASAVLANRNEPNWPKHRVGGAGFMGKVPFSNPNPKSKSNPKLANSKRTLSASDDASSINRRSNDFVTFSQYVSFNIASYTNKEINDLKDRLTSELERTQRIRNRIESGDLQPGQSFNGHPKKPSNKKVSGNKRPLPSNSATDLKRSHSEVGSLMKGCSQVLQKLMKHKHGWIFNAPVDVVGLQLTDYYDVIKQPMDLGTVKSNLSMNKYTTPSDFASDVRLTFNNALAYNPKGHDVYTVAEQLLARFEELYRPVHEKFEGSIVHDRESEEELQASSWSQVEPERVKKKENPIPPAKLHKEPPPQHPASSSNPPLVQSPVRTPSPMRAPPVKPLKQPKPKAKDPNKRDMSLEEKHKLGLGLQSLPPEKMEQVVQIIRRRNGHLKQDGDEIELDIEAVDTETLWELDRLVTNYKKMVSKIKRQALMGNIDNNNNDVQSNKGNGELPSSEKVDGGPVEVKKPKKVEAGDEDIDIGDEMPTSMFPPVEIEKDKDVVGGHASSSSSSSGSSSSDSSSSSDSDSGSSSGSDSEADNGHS

SEQ ID NO: 2521 - protein, 435 aa, Glycine max
  misc_feature (42)..(42): Xaa can be any naturally occurring amino acid
MASAVLANRNEPNWQRHRGGGAGFMGKTPFSNPNSKLANMQXTQSASDDASSINRRSNDALTHSQYVTFNIASCTKKELNDFKNLLVSELEQIRKLRNQIESSEFQPGQSLNGHPKKPSSKKVSGNKRPWPSNSATDLKRSHSEVGSLMKGCSQVLQKLMKHKHGWIFNAPVDVVGLQLTDYYDVIKQPMDLGTVKSNLSMNKYTTPSDFASDVRLTFNNALAYNPKGHDVYTVAELLLTRFEELYRPLHEKFEGSVGHDRESEEELQASSWSHVEPERVKKKENPTPPPPPPPEKLQQEPPQPPASSSNPPLLQSPVRTPSPMRAPPVKPLKPPKPKAKDPNKRDMSLEEKHKLGLGLQSLPPEKMEQVVQIIRRRNGHLKQDGDEIELDIEAVDTETLWELDRLVTNYKKMVSKIKRQALMGNIDNYKRRCAV

SEQ ID NO: 2522 - protein, 399 aa, Glycine max
PSNFAKDLKRSHSEAGNLMKCCSQVLQKLMKHKHGWVFNAPVDIVGLKLHYYCYIIKHPMDLGTGKSNLSKNVYATPADFASDVRLTFNNALAYNPKGHDVYTMAEQLLARFEELYRPVHEKFEGSISHDRESEEELQASSWSHVEPERVKKKEKPPPPPPAKLQQEPPLPPASSSNPPLLQSPVRTPSPMRVPPVKPLKQPKPKAKDPNKRDMSLEEKHKLGLGLQSLPPEKMEQVVQIIRRRNGHLKQDGDEIELDIEAVDTETLWELDRLVTNYKKMVSKIKRQALMGNTNNNNNDAQSNKGNGELPASEKVDGAPVEVKKAKKVQAGEEDIDIGDEMPTSMFPPVEIEKDKDVAGGRPRVRGRVGGSSSSDSSSSSDSDSGSSSGSDSEADNGLS

SEQ ID NO: 2523 - protein, 173 aa, Glycine max
MEGLPQGYRPNVGVCLINSDDQIFVASRLNVPGAWQMPQGGIEDGEEPKSAAIRELREETGIVSAEIIAEVQKWLTYDFPPAVKAKVNRLWGGEWHGQAQKWFLMRLTKDDSEVNLTNGEAEPEFAEWKWADPEEVIEQAVDYKRPTYEEVIRTFKPYFQGSGISAKCKSTKW

SEQ ID NO: 2524 - protein, 117 aa, Glycine max
MMEDPTTLLNSEYSRLFGEDTDLYNRIVLGALLPHSVWGPLPRFLQTWLRNYLGGVLLYLLSGLLWCFYIYYWKRNVHVPKGDDLRFESRLKEVLIIFCVCSVSNMIVFKRGYLWGN

SEQ ID NO: 2525 - protein, 264 aa, Glycine max
EDDSEIEFQRTRDKPMKLEKVLRLDSFLQPKDDPNKEISKVVRAIRKKLQQIEMLEDKQSNGHLLDDQQIAKLQSKSALESSLAELGVPVETSRYKESSSMLPEGKGSKKGKLSKKQRRKSGNSNIEQTEIEFVYSKSEAIPKSEDLLDIDIMGFPDSKVEEDAVCEQITADQGAKDLAFVVQKKDALELLKAKGPSPKASKKKSKKGGLSMFLSGALDEAPKEVATPPPTPKHEGPAWGGAKFMKGSASLREIQDEQSKIKPN

SEQ ID NO: 2526 - protein, 73 aa, Glycine max
MASRNSVAGFALFTFVFAVFSSLAGAQTLAPAPAPTSDGTSIDQGIAYLLMVVALVLTYLIHPLDASSSLSFF

SEQ ID NO: 2527 - protein, 63 aa, Glycine max
MSVSKLFFGALTIVWIVFSIFFPMAQAQSAAPAPAPTSDGTTIDQGIAYVLMLVALVLTYYIH

SEQ ID NO: 2528 - protein, 148 aa, Glycine max
  misc_feature (124)..(124): Xaa can be any naturally occurring amino acid
MPSSTFSGTVSSPKLSVAVDMGNPFLNLTVDGFLKIGAVGVTKSLVEDTYKAIDKGSVSKSTLEHALKKMCKEGFYWGSVAGVYVGTEYGIERIRGTRDWKNAMLAGAATGAVISAATNKGKDXVVIDAIMGGALATASQFLNNHYFY

SEQ ID NO: 2529 - protein, 160 aa, Glycine max
  misc_feature (11)..(11): Xaa can be any naturally occurring amino acid
  misc_feature (32)..(32): Xaa can be any naturally occurring amino acid
KGSDLVEVLKXLGKHAKSILLMSKVSILILKXENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMI

SEQ ID NO: 2530 - protein, 268 aa, Glycine max
  misc_feature (40)..(40): Xaa can be any naturally occurring amino acid
  misc_feature (58)..(58): Xaa can be any naturally occurring amino acid
  misc_feature (221)..(228): Xaa can be any naturally occurring amino acid
AVLGERKNVNLPGVVVDLPILTEKDKEDILEWGVPNKIDXIALSFVRKGSDLVEVLKXLGKHAKSILLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTXXXXXXXXIVVLTRGGSTAKLVAKYRPAVPILSVVVPVLSTDSFDWTC

SEQ ID NO: 2531 - protein, 387 aa, Glycine max
MDSEGEGVRTPKMGVEAEGALNSKMKGAGNVSSKDMIFRADKIDLKSLDAQLEKHLSRVWSRSIETKRPREEWEIDLAKLDLRYVVAHGAYGTVYRGTYDTQDVAVKVLDWGEDGVATAAETAALRASFRQEVAVWQKLDHPNVTKFVGASMGTSNLKIPPKNPMNADEESLPSRACCVIVEFVSGGTLKQYLFKSRRRKLAYKIVIQLALDLARGLNYLHSKKIVHRDVKTENMLLDTSRNLKIADFGVARVEAMNPSDMTGETGTLGYMAPEVLDGKPYNRRCDVYSFGICLWEIYCCDMPYPDLSFADVSSAVVRQNLRPDIPRCCPSALANIMRKCWDANPNKRPEMEEVVRMLEALDTSKGGGMIPEDQSSGCFCFAPTRGP

SEQ ID NO: 2532 - protein, 117 aa, Glycine max
MEQLRPPPLSGRQLSLAARLNSMVAQSRIGKYFRVAERNTTFTTELRAGTATFLTMAYILAVNATIIADSGGTCSVSDCIPLCSDPKTPLSKCPTHLLTRPGLSCKYPPVNPGYAAC

SEQ ID NO: 2533 - protein, 145 aa, Glycine max
MVENNLFEDIFRVEKLNPDDKKLFDKVTRIEARSEKFDMFMHLDINSEVYPLKVGQKFALVLVSSLNPDGTPDTGYYTQISRQSLANNFEYVMYGKLYRITEGSGREKAEMNISFGGLLMMLKGDTSHCNKFELDQRLYLLIRKV

SEQ ID NO: 2534 - protein, 331 aa, Glycine max
MEQRGRGRVCVTGASGFLASWLIKRLLLSGYHVIGTVRDLGKQKKYEYLWCLEGATERLQLVQADLMEESSFDNAIMGCKGVFHVASPVLNTISDPKSEILEPAVKGTLNVLRSCGKNPALCRVVLTSSSSTLRLRDDFDPNTPLDESSWSSLEICEKLQAWYAMAKTQAERAAWEYCIENGINLVTVLPSFIIGPSLPPNLCSTASDVLGLLKGETKRFQLLGRMGYVHIDDVALCQILVYENEGSHGRYLCSSTVMDEDDLAALLANRYPTLPISKRFEKLDRPNYELNTGKLRSLGFNFKSVEEMFDDCIASLVKQGHVTLQQGHGPI

SEQ ID NO: 2535 - protein, 283 aa, Glycine max
  misc_feature (38)..(38): Xaa can be any naturally occurring amino acid
  misc_feature (73)..(73): Xaa can be any naturally occurring amino acid
  misc_feature (99)..(99): Xaa can be any naturally occurring amino acid
  misc_feature (115)..(115): Xaa can be any naturally occurring amino acid
  misc_feature (174)..(174): Xaa can be any naturally occurring amino acid
  misc_feature (184)..(184): Xaa can be any naturally occurring amino acid
  misc_feature (200)..(200): Xaa can be any naturally occurring amino acid
  misc_feature (217)..(217): Xaa can be any naturally occurring amino acid
MAPPRGRGGFGGGGGFRGGGRGDRGRGRGGRGGGRGGXAGGGMKGGSKVVVHPHRHDGIFTAKGKEGALVTKXLVTGEAVYNEKRNTVQSEGGSKVEAXFWWPFRLQLATTMLRXIGKVWSKQGAGVLQLASVFGATVSHVKVFVDSIAYVCGGEFVHKSGRGPVGIQMKRMNXVFPYIKDTGXSAMSRMLVGILDAIFXDFVKYHQYSILELNGSXYLNQGCKCGISIKTKCKYSTLTEGEECDKVMSTRLIEDQSKSLEQFMLEPLERNHHLYGWWIHNAH

SEQ ID NO: 2536 - protein, 305 aa, Glycine max
MAPPRGGGGFRGGRGDRGRGRGGGGGRGGDRGTPFKARGGGRGGRGGGRGGGRGGGRGGMKGGSKVVVQPHRHDGIFIAKGKEDALVTKNLVPGEAVYNEKRITVQNEDSSKDEYRVWNPFRSKLAAAILGGVDNIWIKPGARVLYLGAASGTTVSHVSDVVGPTGVVYAVEFSHRSGRDLVNMAKKRTNVIPIIEDARHPAKYRMLVGMVDVIFSDVAQPDQARILGLNASYYLKTGGHFVISIKANCIDSTVPAEAVFESEVNKLKADQFKPFEQVTLEPFERDHACVVGGYRMPKKKKDAAE

SEQ ID NO: 2537 - protein, 308 aa, Glycine max
  misc_feature (191)..(191): Xaa can be any naturally occurring amino acid
  misc_feature (205)..(205): Xaa can be any naturally occurring amino acid
MAPPRGGGFRGGRGDRGRGRGGGGGRGGDRGTPFKARGGGRGGGRGGGGRGGGRGGGRGGMKGGSKVVVQPHRHDGIFIAKGKEDALVTKNLVPGEAVYNEKRITVQNEDGSKDEYRVWNPFRSKLAAAILGGVDNIWIKPGARVLYLGAASGTTVSHVSDVVGPTGVVYAVEFSHRSGRDLVNMAKKRTXMVIPIIEDARHPAXKYRMLVGMVDVIFSDVAQPDQARILGLNASYYLKAGGHFVISIKANCIDSTVPAEAVFESEVNKLKADQFKPFEQVTLEPFERDHACVVGGYRMPKKKKDAAE

SEQ ID NO: 2538 - protein, 141 aa, Glycine max
FLSLFPSNLIFCVTSFLSTSFTNIPILNYKYLCRSMPTSAALDVVAKHLNLKFFEVPTGWKFFGNLMDAGLCSVCGEESFGTGSDHIREKDGIWAVLAWLSILAYKNKDKLEDKLVTVEDIVRQHWATYGRHYYTRYDYEV

SEQ ID NO: 2539 - protein, 222 aa, Glycine max
RFQFRLGTLLCIDGTFATPLNQKALALGADLILHSLTKYMGGHHDALGGCISGSTKVVSQIRTLHHVLGGTLNPNAAYLFIRGMKTLHLRVQQQNSTGMRMAELLEAHPKVKRVYYPGLPSHPEHELAKRQMTGFGGVVSFEIDGDLHTTIKFIDSLKIPYIAASFGGCESIVDQPAILSYWDLPQSERAKYKIYDNLVRFSFGVEDFEDLKADVLQALEAI

SEQ ID NO: 2540 - protein, 396 aa, Glycine max
  misc_feature (300)..(300): Xaa can be any naturally occurring amino acid
  misc_feature (310)..(310): Xaa can be any naturally occurring amino acid
MAGPVVVTNGNLNPNDTRGKTITCKAAVAYGPGEPFVVERVLVHPPQKMEVRIKILFTTICHTDLSAWQGENEAQRAYPRIFGHEASGIVESVGEGVSDMNEGDLVVPIFNGECGDCKYCKCEKTNKCERFGVDAMKKVMVSDGATRFYTMDGKPIFHFLNTSTFTEYTVVDSACIVKIHIDGSNGDLNRNIKRLTLLSCGVSSGVGAAWNTADVHFGSTVAVFGLGVVGLAVAEGARARGASRIIGVDINSDKFIKAREMGITDFINPKDDERPVYEIIGEMTGGGVHYSFECAGNLNXLRDAFLSASXGWGLTVVLGIHASPTLLPIHPMELFDGRNIVGSVFGHAQLPYLLQSQCSVRLLKLLQMQLQKKRGEGSLGLHKAFQVMLLKLQLQQ

SEQ ID NO: 2541 - protein, 151 aa, Glycine max
MAQLMDKAKGFVAEKISGVQKPEADLSDMSVQHVGRDGATLSGRLDVRNPYSHTIPICEISYSLKSAGRDVASGTMPDPGSLVASDTTSLDIPVKVPYDFLMSLVKDAGKDWDLDYEMRVGLTVDLPIVGNFTLPLTKAGELKLPTLSDLF

SEQ ID NO: 2542 - protein, 278 aa, Glycine max
MSHFGRKLSRSSTVRRRFHHRVSLLQRCLLRVLHRILLCSGSKATNATYSMLPPALPSPPPPVSSDGELGREEMDLSSSAVFQTHDLDSDLVSLKISLLGDCQIGKTSFLAKYVGDEKEQQGNQREGLNQMDKTLVVEGARISYCIWEVQGDGKSEDQLPMACMDSVAILIMFDLTSRCTLNSVVGWYKEARKWNQTAIPVLIGTKFDDFIQLPIDLQWTIANEARKYAKALNATLFFSSATYNINVNKIFKFITAKLFDLPWTVERNLTVGEPIIDF

SEQ ID NO: 2543 - protein, 125 aa, Glycine max
  misc_feature (99)..(99): Xaa can be any naturally occurring amino acid
ASSLISSPAVISVNPAGAGMVAPLTGLKCMAGFPTRKTNNDLPFIATNGGRVECMRVWPPVGKKKFETLSYLPYLDDARLAKEIKFLLRKGWIPCLEFXMEHCFSYREHSQSPGYYDGTYWTMRN

SEQ ID NO: 2544 - protein, 309 aa, Glycine max
KVKVFDLEDLLRASAEVLGKGTFGTTYKAVMEDGPVVAVKRLKDVTVSEKEFKEKIDVVGVMDHENLVPLRAYYYSRDEKLLVHDYMPMGSLSAILHGNKGAGRTPLNWEMRSSIALGAARGIEYLHSQGPSVSHGNIKSSNILLTKSYDARVSDFGLTHLVGSSSTPNRVAGYRAPEVTDPRKVSQKADVYSFGVLLLELLTGKAPTHALLNEEGVDLPRWVQSVVREEWSSEVFDIELLRYQNSEEEMVQLLQLAVDCVVPYPDNRPSMSQVSQRIEELRRPSMKEATQDQIQQLDLINDIDDASSR

SEQ ID NO: 2545 - protein, 220 aa, Glycine max
LRRPPPKLRGLYARAKELSENEISASNALIGLLDGLLQSGASTAQKKKIEVGEQKKKRIKSDTDSARFSAASMRNQLDQAASLKGEQVAARVKSDDEKDEWFVVKVIHFDKETKEYEVLDEEPGDDEESTQKKYKLPMSYIIPFPKKGDPSSAPDFGQGRQVLAVYPGTTALYRATVASHRKRKSDDYILEFDDDEEDGALPQRAVPFYRVVALPEGHRQ

SEQ ID NO: 2546 - protein, 520 aa, Glycine max
  misc_feature (33)..(33): Xaa can be any naturally occurring amino acid
  misc_feature (73)..(73): Xaa can be any naturally occurring amino acid
  misc_feature (451)..(451): Xaa can be any naturally occurring amino acid
MLVLILERSLARRFLNYKKSGRLERLMFYENGXWLDFPKDVVDLVKKDLEVKQAAVEIESNGYHLLFDFLHLXRMDLKTGLQQPIALIDEAGCCFFPEIYAASDEEPYNLSKQEGGKSPDSYASNEIKLHLEVEINGVDQSRLSECSGESNALVKGIQIDTKENCCQYDVEVEDSINKKDCGNVGEDIQQHQDIGLDAYTESVYGKLDLNSVQKMFLKGMCSFGSTDSDIVEIYHCSGASMQARWELFQKQAEITKKNHGEANIRYAWLASSKGELSTMMNYGLSHYGLSGSKCTYGIGVHLAAVTCPDASVRYCDVDENGVRHLALCRVIMGNMEILRPGTDQFHPSSCEYDNGVDAIECPQYYVVWNMNMNTHIYPEFVVSFKVSSDAEGHFCGSEGKNVSGVNSACQGPHGLLHSESSTVDNGKAPSMVASTPKVPKSPWMPFPLLLXAIRNQVPPKGMDVIKIYYEQFRSKHISRDDFVKMLRLIVGDGLLRTTITNLQFKIPSGGELKGSIKKEV

SEQ ID NO: 2547 - protein, 95 aa, Glycine max
  misc_feature (65)..(65): Xaa can be any naturally occurring amino acid
MVCEKCEKKLSKVIVPDKWKEGASNTTEGGGRKINENKLLSKKNFRWTPYGNTKCTICKQQVHQXAKYCHTCAYSKGVISSFCICYHTYYFWYTN

SEQ ID NO: 2548 - protein, 271 aa, Glycine max
MSSPDIVSILENSKEFDRVRKEQEDILSEINKLHKKLQATPEVVEKPGDNSLARLKFLYTQAKDLSESEASISNLLINQIDALLPTGPQGQTRRRIGKEGNEQKRKRVKTESDISRLTPNMRSQLEACASLKGEQVAARVTPRNADKDEWFVVKVIHFDKESKEFEVLDEEPGDDEESSGQRQYKLPMANIIPFPKSNDPSSAPDFPPGKHVLAVYPGTTALYKATVVQGPRRRKTEDYVLEFDDDEEDGSLPQRTVPFRKVVPLPEGHRQ

SEQ ID NO: 2549 - protein, 98 aa, Glycine max
MALVRSLLGAKKILGRSVTAAASTSKRATSAAPKGFLAVYVGESQKKRYVVPISYLSQPSFQALLNKSEEEFGFDHPMGGLTIPCSEDIFITVTSRFQ

SEQ ID NO: 2550 - protein, 186 aa, Glycine max
RSSVRFSENPSKHVKFSLLPLSFATMEAPPEGYRRNVGICLMSNHKKIFAASRLDISFSWQMPQGGIDEGEDPRNAAIRELREETGVNSAEVIAEVPYWLTYDFPPKVREKLNIQWGSDWKGQAQKWFLFKFTGQDQEINLLGDGTEKAEFGEWSWISPEQVIELAVDFKKPVYKEVLAVFAPYFQ

SEQ ID NO: 2551 - protein, 121 aa, Glycine max
MNARGYRSTRTALFDGIEEGGIRSSAYSSHEIDEHENERAMDGLQDRVSILKRISGDINEEVETHNRMLDRMGNDMDSSRGFLSGTVDKFKTVFETKSSRRMGTLVASFVALFMLVYYLTR

SEQ ID NO: 2552 - protein, 193 aa, Glycine max
  misc_feature (37)..(37): Xaa can be any naturally occurring amino acid
  misc_feature (130)..(130): Xaa can be any naturally occurring amino acid
MENEFQDGKEEVIQAWYMDDSEEDQRLPHHREPKEFXPLAKLSELGVVSWNLNADNWEKDENLKKIREARGYSYVDICDVCPEKLPNYEAKLKNFFEEHLHTDEEIRYCLEGSGYYYEMRANVQRVRMAXREGARVRFPAGMFTYVGSALIKQCVFASLAHKSPMTFREGEITEGNHFVPLPLVPPDNSSPAF

SEQ ID NO: 2553 - protein, 131 aa, Glycine max
  misc_feature (5)..(5): Xaa can be any naturally occurring amino acid
  misc_feature (85)..(85): Xaa can be any naturally occurring amino acid
  misc_feature (128)..(128): Xaa can be any naturally occurring amino acid
MENEXQDGKEEVIQAWYMDDSEEDQRLPHHREPKEFIPLAKLSELGVVSWNLNADDWEKDENLKKIREARGYSYVDICDVCPEKXPNYEAKLKNFFEEHLHTDEEIRYCLEGSGYFDVRDQNEQWIRXAVK

SEQ ID NO: 2554 - protein, 457 aa, Glycine max
  misc_feature (171)..(171): Xaa can be any naturally occurring amino acid
MDHVIGGKFKLGRKIGSGSFGELYLGVNVQSGEEVAVKLESVKTKHPQLHYESKLYMLLQGGTGIPHLKWFGVEGDYNVMVIDLLGPSLEDLFNYCNRKLSLKTVLMLADQLINRVEYMHSRGFLHRDIKPDNFLMGLGRKANQVYIIDYGLAKKYRDLQTHKHIPYRENXANLTGTARYASVNTHLGVEQSRRDDLESLGYLLMYFLRGSLPWQGLRAGTKKQKYDKISEKKMLTPIEVLCKSYPLEFTSYFHYCRTLRFEDKPDYSYLKRLFRDLFIREGYQFDYVFDWTMLKYPQIGSSSRARPSGKPVINPGQSGERIERPSGGFSGAVEAFARRNGSGLVLQSEHSRHRSSDDVPSSKDVQADSERPRSSSRNGSSSKKPVLSSSRPSSSGEPSESRTSRLVLSSGRLSTTQRLQPGFESKTSLSRASATRGGRDDTLRSFELLSLGSGKRK

SEQ ID NO: 2555 - protein, 451 aa, Glycine max
MPSKRLQWRSLVLGCFKATKNQSLESPNIVSKKSSSSRIFLSDLSLSDYSSVSIMSDLSNSLVGSNLRIFTYQELSEVTHNFSKSNYLGEGGFGKVYKGFIDDNLKRGLKAQTVAVKALNLDGKQGHREWLAEVIFLGQLKHRHLVNLIGYCCEDEHRLLVYEYMERGNLEEKLFKGYLAALPWLTRIKIAIGAAKGLMFLHEEEKPVIYRDIKASNILLDSDYNPKLSDFGLAIDGPEKDQTHITTHVMGTHGYAAPEYIMTGYLTTMSDVYSFGVVLLELLTGKKSVDKKRPTREQDLVEWARPLLKDSHKLERIMDTRLEDQYSTEGARKFAALAYQCLSHHAKARPTMRTVVRTLEPLLELKDIPVGPFVYVVPSEEDKTKVNENDHVEINQGELKTKEKEEKGHHRQRKSRRNRRRVKPLRSLTAHSDTALYKTLGTNLYSPKQAQ

SEQ ID NO: 2556 - protein, 459 aa, Glycine max
MPSKRLQWRSLVLGCFKATKNQSLESPNIVSKKSSSSRIFLSDLSLSDYSSVSIMSDLSNSLVGSNLRIFTYQELSEVTHNFSKSNYLGEGGFGKVFKGFIDDNLKRGLKAQTVAVKALNLDGKQGHREWLAEVVFLGQLKHRHLVNLIGYCCEDEHRLLVYEYMERGNLEEKLFKALPWLTRIKIAIGAAKGLMFLHEEEKPVIYRDIKASNILLDADYNPKLSDFGLAIDGPEKDQTHITTHVMGTHGYAAPEYIMTGHLTTMSDVYSFGVVLLELLTGKKSVDKKRPTREQDLVEWARPLLKDSHKLERIMDTRLEDQYSTEGARKFAALAYQCLSHHAKARPTMRTVVRTLEPLLELKDIPVGPFVYVVPSEEESTKVNEKVTENEHVEINQGELKTKEKEEEEKGAKKEKGPPRQRKSRRNRRRVKPLRSLTAYSDTALYKTLGTNLYSPKQSQ

SEQ ID NO: 2557 - protein, 392 aa, Glycine max
IRHQAPSAVVEHDDAFGASPFLLVTDTGTSAGKLLGYVAKSDWTNHTDKGLRVGDYMAPPPKPVPWNADLNKINEIFESEKSGAVALEKDGEVVDLVVREEVERVKGYPKLVAPATVGADGEFMVGAAVGTREDDKERLEHLVKAGLNVVVLDSSQGNSIYQLEMVKYVKRVYPELDVIGGNVVTMYQAENLIQAGVDGLRVGMGSGSICTTQEVCAVGRGQATAVYKVSSIAYKSGVPVIADGGISNSGHIVKALSLGASTVMMGSFLAGSLEAPGAYVYQNGQRVKKYRGMGSLEAMTKGSDARYLGDTAKLKIAQGVVGAVKDKGSVLNFIPYTLQAVRQGFQDIGANSLQSAHDLLRSRVLRLGGPEWSSTSWKVEFMGLVSYEKKYF

SEQ ID NO: 2558 - protein, 467 aa, Glycine max
MELSTMFCLCASFLFIVLFRALIKPYYVSKRRDLPLPPGSMGWPYIGETFQMYSQDPNVFFASKIKRFGSMFKSHILGCPCVMISSPEAAKFVLNKAQLFKPTFPASKERMLGKQAIFFHQGEYHANLRRLVLRTFMPEAIKNIVPDIESIAQDCLKSWEGRLITTFLEMKTFTFNVALLSIFGKEEILYRDALKRCYYTLEQGYNSMPINVPGTLFHKAMKARKELAQIVAQIIWSRRQRKMIDYKDLLGSFMDEKSGLTDDQIADNVIGVIFAARDTTASVLTWIVKYLGENPSVLEAVNEEQECILKSKEERGEDKGLNWEDAKKMPITSRVIQETLRVASILSFTFREAVEDVEYQGYLIPKGWKVLPLFRNIHHSPDNFKEPEKFDPSRFEAAPKPNTFMPFGSGIHMCPGNELAKLEILVLLHHLTTKYRWSVVGAKNGIQYGPFALPQNGLPITLFPKNK

SEQ ID NO: 2559 - protein, 485 aa, Glycine max
  misc_feature (437)..(437): Xaa can be any naturally occurring amino acid
MELSTMFFLCASLLFIVLFFRTLIKPYYVSKRRDLPLPPGSMGWPYIGETFQMYSQDPNVFFASKIKRFGSMFKSHILGCPCVMISSPEAAKFVLNKAQLFKPTFPASKERMLGKQAIFFHQGEYHANLRRLVLRTFMPEAIKNIVPDIESIAQDCLKSWEGRLITTFLEMKTFTFNVALLSIFGKEEILYRDALKRCYYTLEQGYNSMPINVPGTLFHKAMKARKELAQIVAQIISSRRQRKQDFHKDLLGSFMDEKSGLTDEQIADNVIGVIFAARDTTASVLTWIVKYLGENPSVLEAVTEEQECILKSKEESGEDKGLNWEDAKKMPITSRVIQETLRVASILSFTFREAVEDVEYQGYLIPKGWKVLPLFRNIHHSPDNFKEPEKFDPSRFEAAPKPNTFMPFGSGIHMCPGNELAKLEILVLLHHLTTKYXGGLLWGAKKWDSIWALFALPQNGLTHHIIQEQVDNQSHIQYNPGFIVS

SEQ ID NO: 2560 - protein, 136 aa, Glycine max
MEGTVFTPCLEGMKNVKSEQGEMLTKPFLDLCKTILPVIDKFGAAMTLVKADIGGNISRLEKNYLSDPDKYKYLYTFVQGEIESKTAKGSSSCTNGLLWLTRAMDFLVELFRNLVAHQDWSMSQACGESYQKTLKK

SEQ ID NO: 2561 - protein, 394 aa, Glycine max
MAPIQKKSKTKKKTKKFKKHKQVSLVPVEPRTSETDWWDSFWHKNSTVPGYTVPGDEAEGFKYFFRVSKTTFEYICSLVREDLISRPPSGLINIEGRLLSVEKQVAIALRRLASGESQVSVGAAFGVGQSTVSQVTWRFIEALEERAKHHLNWPDFNQMQEIKLGFEASYGLPNCCGAIDATHIMMTLPAVQTSDDWCDQEKNYSMLLQGIVDHEMRFVDIVTGLPGGMSVSRLLKCSAFFKLSENGERLNGNVKAFGGDVIREYVVGGCSYPLLPWLMTPYETNGANGVSVPQFTFNHKHGAAKLLAVRAFSLLKGSWRILSKVMWRPDKRKLPSIILTCCLLHNIIIDCGDTLQQDVALSGHHDSGYQEQCCKQVDPLGRTMRDNLANHLRQ

SEQ ID NO: 2562 - protein, 560 aa, Glycine max
MASTSLFNFRLPLFNFNPLHHRRIKRPKSLLSSPRNSPRLVSSINDHLALTRVTYPLLQSHSAPKRRFHVGVQKEYSDGESSESIVSDATYQEEFSWSSVVLPFLFPALGGLLFGYDIGATSGATISLQSPELSGISWFNLSAIQLGLVVSGSLYGALLGSLVAFAIADFLGRKKQLITAALLYLFGGVITAYAPELGVLLAGRLIYGLGIGLGMHGAPLYIAETCPSQIRGTLVSLKELFIVLGILLGYFVGSFLIETVGGWRFMYGFSAPVAVLMGLGMWTLPNSPRWLLLRAVQGKGSFQDLKEQAIASLSKLRGRPPGDKESEKQIEETLVSLKSVYADQESEGNFLEVFQGPNLKAFIIGGGLVLFQQITGQPSVLYYAGPILQSAGFSAASDATKVSVVIGLFKLLMTWIAVLKGDDLGRRPLLIGGVSGIALSLVLLSAYYKFLGGFPLVAVGALLLYVGCYQISFGPISWLMVSEVFPLRTRGKGISLAVLTNFASNAVVTFAFSPLKEFLGAENLFLLFGAIATLSLLFIIFSVPETKGMSLEDIESKILK

SEQ ID NO: 2563 - protein, 93 aa, Glycine max
MGFRLPGIRCSSFSASQASSCKVSEVPKGYLAVYVGEKMKRFLIPVSFLNEPLFQELLSQVEEEFGYCHPMGGLTIPCKEDVFLNIASRPNRL

SEQ ID NO: 2564 - protein, 623 aa, Glycine max
  misc_feature (260)..(260): Xaa can be any naturally occurring amino acid
MDSPFIYSCFVQNSSPNLHELPVSQCQLEVHNNIQIYAVNNACVIVGGFGSYLLGLNRRTYEQAGVGTEGNNPGSTKEPGIGWMTAFLFVTSFVGLLALVPIRKIMIIDYKLTYPSGTATAVLINGFHTPKGDVMAKKQVHGFLKFFSASFLWAFFQWFYSGGDNCGFVQFPTFGLKAWKNSFYFDFSMTYVGAGMICSHLVNLSLLLGAVISWGIMWPLIRGLKGEWFPASISESSMKSLNGYNGLMLHLVFSKLEMFXYRVVYDITAMNIHATVKRKNPETFSDNQKPLPLDDLRRNEVFARESIPIWLACTGYILFSIVSIIVIPLMFPQLKWYYVVFAYLFAPSLGFCNAYGAGLTDMNMAYNYGKVALFVLSALAGKNDGVVAGLVGCGLIKSIVSISSDLMHDFKTGHLTFTSPRSMLLSQAIGTAIGCVVAPLTFFLFYKAFDVGNPDGDYKAPYAIIYRNMAILGVEGFSALPHHCLQLCYGFFTFAIAANLVRDLGPKKIGKWIPLPMAMAVPFLVGGYFAIDMCMGSLVVFLWHTLNRNEAGLMVPAVASGLICGDGLWILPSSILALLKIRPPICMSFLSAERTLQMKLKLLGVGGLGARRFQCQLELRSSQ

SEQ ID NO: 2565 - protein, 146 aa, Glycine max
  misc_feature (53)..(53): Xaa can be any naturally occurring amino acid
QWATSSTTLLLSSLTLGSTPSINSRNLSFFLLQNRSLNRPKKRVSFVVQAAKXPLLVEIPKVQPQFKPPFLGLTKTAEIWNSRACMIGIIGVFIVEFIINKGILQVIGLEVGKGLNLPLGTLFLVVLVNVVMHKVNLLFIDFKKFF

SEQ ID NO: 2566 - protein, 84 aa, Glycine max
  misc_feature (52)..(52): Xaa can be any naturally occurring amino acid
LSAMGFSLRGVQRRVDVPKGCVAVYVGENQKKRFVIPISYLNQPSFIELLNXKQEFGFDHPMGGLTIPCREDVFLGVTSRLHRR

SEQ ID NO: 2567 - protein, 305 aa, Glycine max
FGSRGYVLGLRVSPQHRRKGIGSSLVRTLEEWFTSKDVDYAYMATEKDNHASVSLFMDKFGYTKFRTPAILVNPVNHHCFQISPNIEIARLKIDQAEYLYRRFMGSTEFFPNDIGNILRNKLSLGTWVAYFKGDIAWGDFGSDGQVPNSWAMLSVWNSGEIFKLRLGKAPFSCLVCTKSWWLIHKIFPCLKLPTIPDFFNPFGFYFMYGVHHEGPFSGKLVRALCQFVHNMGAESKDESNCRIIVTEVGGRDELNHHIPHWKLLSCPEDLWCIKALKNEGTNNKFHELTTKTPPTRALFVDPREV

SEQ ID NO: 2568 - protein, 480 aa, Glycine max
DDSTRHVVRALLRNCSYEVTAVSNGLQAWKVLDHASDGIDLVLTEVAMPILSGIGLLCKIMSHKTLKNIPVIMMSSHDSMGIVFKCLSKGAVDFLVKPIRRNELKNLWQHVWRRCHSSSGSGSESATHTRKFAKSRSNDACENNSDSSDENDYGSRDLSVRDGSGTQSSGSGSESATHTRKFAKSRSNDACENISDSSDENDYGSRDLSVRDGSGTQSSWTKCLAQVGSPHPVSPHKQLVDAPDSTCAQVMQTKTEKVSSRWVHATEKECHELIDPLDDVAMGKDLAMGISLNMRLEHPLKELSCNPMMGKGANKMSDVDDMQIIKRQSNACEKGQLEYNGDKTRTRENQAMNVIDVTDSNSPLAESRDLNTPNGFSGFSQSKANCCPKEHPSLELTLERLGEVRDGKNFTGEECNVLRHSDQSAFSKYNTASANQAQTGNVGSCSPLDNSSAAPNTETMHNFPSHSNGTPSNQKSNGSN

SEQ ID NO: 2569 - protein, 332 aa, Glycine max
MKFGKEFAAQMVPEWQEAYMDYGYLKSLLKDIMLHKQRKKPHSSATPAALMRKLSLNRTFSGLTHRYYQPVSPEHDIENQPILVHSVKRDGHEKYETNFLMAAEEGGEYELVYFKRLDDEFNKVDKFYRSKVEEVMKEAAELNKQMDALVAFRVKVEHPTASFDGSVEMTRLASDVSASATALHASTPRGVQLNRAQTGRIPTLIEDIKEEGSTHHGHSEESRDSEKGEEIQTTNKRVEVQNKKKKNITPIKPIRPASVEILNRVQLNNTCETPRSTIRGFIKYPGQTEINFTKENLSKVEETLKLAFIEFYQKLRLLKNYTFLNVLAFSKK

SEQ ID NO: 2570 - protein, 273 aa, Glycine max
NFPRQQGEKKNSDELAQKMAKLCDVYVNDAFGTAHRAEATTHGIAKFAPVACAGPLLAAELDALGKALGQPARPLAAIVAGSKVSTKLTILTSLAEKVDNLIVGGGIANTFMLASGLKIGKSLVEADLVGEAKAIIDMMAKRGASVPIPVDVVCAKEFSATAAATVKDVKDVTDDDMILDIGPKTASQLAEQIAKAGTVVWNGPVGVFEFDQFGEGTKTLAMAIANSKAFSIAGGGDTLAAIAKYNIADKVGYISTGRGAFPEFLERKTLPAV

SEQ ID NO: 2571 - protein, 397 aa, Glycine max
  misc_feature (62)..(62): Xaa can be any naturally occurring amino acid
  misc_feature (96)..(96): Xaa can be any naturally occurring amino acid
  misc_feature (119)..(119): Xaa can be any naturally occurring amino acid
  misc_feature (159)..(159): Xaa can be any naturally occurring amino acid
  misc_feature (178)..(178): Xaa can be any naturally occurring amino acid
MACPAMANGNDSLNLKPNETKGKTITCKAAVEYGPGKPFEVKNILIYPPQKMEDQTKVLSSXSFHTDLSSWPGMNEAQSAYPGILDPEASGIVKSXGDERFRSGLISICCAYSTDEKIXSVSVGNKLMCNAWIIGWLILIYVRVETGQFKSSLSYGAPXFHLFKTSTFLEHMVEDSSXVVKFLYTYHSLSIKNLTLLSCGVSTGVGAAWNTANVHSGSTVAVFGLGAVGLAVAEGARARGASKIIGVDINPDKFIKAMGVTNFINPKDEEKPVYERIREMTDGGVHYSFECTGNVDVLRDAFLSAHEGWGLTVVLGIHASPTLLPIHPMELFDGRNIVGSVFGGFKGRSHLPHFAKQCGQGVVKLDNFITHELPLEEIDKAFDLLITGKSLRCLLHF

SEQ ID NO: 2572 - protein, 356 aa, Glycine max
MPLENRVLDPKKSQNIAILLRALNVTIDEVCDALREGNCDTLGTELLESLLKMAPTKDEESKLKEFQDESPFKLGPAEKFLKVVLDIPFAFKRVDAMLYIANFDSELEYLKKSFETLEVACEELRKSRMFLKILEAVLRTGNRMNVGTNRGDAHAFKLDTLLKLVDIKGTDGKTTLLHFVVWEIVRTEGSHISGSNNNHAADNDHQYTLQDEVDFKKLGLQVVSGLSGELTNVKKTAAMDSDMLSSDVAKLARGIEKIVQVVKLNEESPLKETNQKFSDAMKCFLERGEQELSTIQAQEKNALSSVKEITQYFHENSAKEKAHPFRIFIIIKNCLSILNNIYRKVNKVDKKTLVSS

SEQ ID NO: 2573 - protein, 366 aa, Glycine max
  misc_feature (184)..(184): Xaa can be any naturally occurring amino acid
RREQLEFTPTWVVAVVCSVIVAASFAAERFLHYGGKFLKRKNQKPLYEALQKIKEELMLLGFISLLLTITQNGIIRICVPVGWTHHMLPCSLKDHGKEESTKTTSHFQTFFSFSDISGTARRLLAESESENEDHQPATGEKLGPWKGKVPLLSVEALRCASLKLFFTVLINADSIKTKKINSDXQIREWKHWEDSIGNDNKNETQPVLEPTVTHVHQHAFIQNRFTGLGKDSAVLGWVKSFFKQFYGSVTKLDYVTLRLGFIMTHCKGNPKFNFHKYMIRTLEDDFKKVVGISWYLWIFVVIFMLLNVHGWHAYFWISFIPLILLLAVGTKLEHVIIQLAHEVAEKHSAIEGELVVQPRDDHFWFN

SEQ ID NO: 2574 - protein, 167 aa, Glycine max
  misc_feature (47)..(47): Xaa can be any naturally occurring amino acid
QISPLADEKFQTFHSNPRLNPNPLFLSLYVPAHLHLMVFELVKNSLXAVQERFMNSDKVAPPIRIIVADGIEDVTIKVSDEGGGIARSGLPKIFTYLYSTARNPLDEHSDLGIGDNVTMAGYGYGLPISRLYARYFGGDLQIISMEGYGTDAYLHLSRLGDSQEPLP

SEQ ID NO: 2575 - protein, 52 aa, Glycine max
AQSDALAYGKTAEQLQKENVSPHLIPHKTFSGNRPSLSLLLPSLNAYNIGQV

SEQ ID NO: 2576 - protein, 243 aa, Glycine max
  misc_feature (188)..(188): Xaa can be any naturally occurring amino acid
LQRKSVSPAVSASSTTCASVKRQSWSPIQCSVTNVSEEVEQSQSVSSSERHEANDTDGAKPKLKALHWDKVRATSDRATVWDQIKSSSFQLNEDMMESLFGCKATNSAPKEPPRKKSVLPFVDQENRVLDPKKSQNIAILLRALNVTKDEVSEALLDGNPEGLGTELLETLVKMAPTKEEEIKLKNYXGDLSKLGSAERFLKAVLDIPFAFKRVEAMLYRANFDAEVNYLRKSFQPWRLQVRN

SEQ ID NO: 2577 - protein, 87 aa, Glycine max
DSSMISSPMLPLSTVARAGMYAPFSGLESMAVFPTRMTNNDITSFASYLGILQCMSGCAPDVKKTFDTLSYLPDLDDALLDYEVSIL

SEQ ID NO: 2578 - protein, 218 aa, Glycine max
  misc_feature (197)..(197): Xaa can be any naturally occurring amino acid
MPSSHLLLEEPIRMVSILEPSKPSFFSAMTKIVGTLGPKSRSVETISGCLKAGMSVARFDFSWHDPEYHQETLENLKAAIKSTKKLCAVMLDTVGAEMQVVNKSERAISLEANGLVVLTPDQGQEASSEILPINFDGLAKAVKKGDTIFIGQYLFTGSETTSVWLEVSEVKGQDVVCIIKNTATLAGSLFTLHASQXHIDLPTLTEKDKEVISTWGVK

SEQ ID NO: 2579 - protein, 256 aa, Glycine max
  misc_feature (177)..(177): Xaa can be any naturally occurring amino acid
  misc_feature (188)..(188): Xaa can be any naturally occurring amino acid
  misc_feature (208)..(208): Xaa can be any naturally occurring amino acid
  misc_feature (211)..(211): Xaa can be any naturally occurring amino acid
  misc_feature (215)..(216): Xaa can be any naturally occurring amino acid
  misc_feature (218)..(218): Xaa can be any naturally occurring amino acid
  misc_feature (224)..(225): Xaa can be any naturally occurring amino acid
  misc_feature (231)..(231): Xaa can be any naturally occurring amino acid
  misc_feature (235)..(237): Xaa can be any naturally occurring amino acid
  misc_feature (239)..(241): Xaa can be any naturally occurring amino acid
  misc_feature (243)..(243): Xaa can be any naturally occurring amino acid
PPPPPPGESGDVTLLFGLSGTGKTTLSADPKRKLIGDDEHCWTPDGVFNIEGGCYAKCVNLSGEKEPEIFNAIKFGSILENVLFTDDVNREVNYEDISITENTRATYPLQYIPNCKIPAVGGHPKNIFFLTCDAYGVLPPVAKLDHNQAMYHIISGYTAKVAGTEIGVKEPQATFSXCFGEVFLPLHXTVYAEMLAEKMNKHGANAWXINXGLEXXVXIGEGKXXDLKGTXSIIXXXPXXXFXKGNGTPAKLPRSF

SEQ ID NO: 2580 - protein, 217 aa, Glycine max
MVNTTAAMVSGGGKGGVLPLASLNHISIVCRSVEESLDFYMNVLGFTPIRRPGSFDFDGAWLFNYGIGIHLLQSEHPESLPAKKEINPKDNHISFQCESMVAVERRLKELGIPYIQRCVEEGGIYVDQIFFHDPDGFMIEICNCDKLPVVPLAGQTFAMAACKRVASVKQQQLPMPVAQVAQATPAPAAAAASQCIPAPNPALQRVGGEEAAHISCA

SEQ ID NO: 2581 - protein, 147 aa, Glycine max
APPPGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVRVPKIRYAGMLQYDGELKLPSRYLVSPPEIDRTSGEYL

SEQ ID NO: 2582 - protein, 95 aa, Glycine max
VAYFRDQIELQLLSGKNVMIQPHGNSLRSIIMYLDKLTSQEVISLELSTGIPMLYIFKEGRFIRRGSPIGPSEAGVYAYTRRLALYKQKLDNMFQ

SEQ ID NO: 2583 - protein, 36 aa, Glycine max
MFDDQDLGFFTNFLGIFIFVLVIAYHFVMADPKYEN

SEQ ID NO: 2584 - protein, 513 aa, Glycine max
MALLSSVLKQLPHELSSTHYLTVFFCIFLILLQLIRRNKYNLPPSPPKIPIIGNLHQLGTLPHRSFHALSHKYGPLMMLQLGQIPTLVVSSADVAREIIKTHDVVFSNRRQPTAAKIFGYGCKDVAFVYYREEWRQKIKTCKVELMSLKKVRLFHSIRQEVVTELVEAIGEACGSERPCVNLTEMLMAASNDIVSRCVLGRKCDDACGGSGSSSFAALGRKIMRLLSAFSVGDFFPSLGWVDYLTGLIPEMKTTFLAVDAFLDEVIAEHESSNKKNDDFLGILLQLQECGRLDFQLDRDNLKAILVDMIIGGSDTTSTTLEWTFAEFLRNPNTMKKAQEEVRRVVGINSKAVLDENCVNQMNYLKCVVKETLRLHPPLPLLIARETSSSVKLRGYDIPAKTMVFINAWAIQRDPELWDDPEEFIPERFETSQVDLNGQDFQLIPFGIGRRGCPAMSFGLASTEYVLANLLYWFNWNMSESGRILMHNIDMSETNGLTVSKKVPLHLEPEPYKT

SEQ ID NO: 2585 - protein, 240 aa, Glycine max
MFVKLLEAVLKAGNRMNAGTQRGNAQAFNLVSLRKLSDVKSTDGKTTLLRFVVEEVVRAEGKRAVLNRNHSLSRSSSRNSNSSVDSQNSAVSNEQRQREYITLGLPVVGGISSEFSNLRKAAVTDYKSFVGSISSLSARIVEIRELVSQCGNGKGGNFVREMNNFLENAEEELRLVREEQTRVMQLVKRTTDYYQGGSSKESAENPLYLFVIVKDFLGMVDQACIEIARNMQKRKTKTSL

SEQ ID NO: 2586 - protein, 440 aa, Glycine max
  misc_feature (195)..(195): Xaa can be any naturally occurring amino acid
SARAGGPDNDFGIKYNVNNGGPAPESVTDKIFQRTKEISAYKVLDAGELDLSKIGSSTYGPMEVEIVDSVKDYVTLLKDIFDFPLIKSFLQSNPSYRVLFDGLNGVTGPYAKAIFLDTLGLAPSSVQQCVPLPDFGGSHPDPNLTYAHSLVEVVERENIAFGAASDGDGDRNMIYGKGAFVTPSDSVAIIADWAXVIPYFKKTGIRGLARSMPTSNAIDYVAKAKGFEIFEVPTGWKFFGNLMDAGRLSICGEESFGTGSDHIREKDGIWAVIAWLNIIAAANQKTPGTGINELLQDHYTKYGRSFFSRYDYEEVSSEGSKQFTDNLDALFASSSFVGSKHGEFIVKKTTNFSYTDPIDGSVSKNQGHIVLFEDGSRVVFRLSGTGSQGATVRVYIERYSKDPSQFKKDTAEGLQPLIDAALEFTKLKEYLGRDKPTVIT

SEQ ID NO: 2587 - protein, 332 aa, Glycine max
  misc_feature (299)..(299): Xaa can be any naturally occurring amino acid
  misc_feature (325)..(325): Xaa can be any naturally occurring amino acid
MDIELPAATANESQQQKFALPVDSENKATVFRLFSLANPHMRAFHLSWVSFFACFVSSFAAPPLLPIIRDNLNLTATDIGNAGVASVSGAVLARIAMGTACDLVGPRLASASLIVLTAPFVYFTSIINSATSYLLVRFFTGFSLATFVSTQFWMSSMFSAPVVGSANGLSGGWGNLGGGATQLIMPLVFSLIRDIGATKFTAWRIAFFVPAMFQMLTAFSILIFGQDMPDGNFRRLKKSGEKAKDDFSRVLYHGVTNYRGWILALTYGYCFGVELTIDNIIAEYFYDRFNLKLTLLGIXAARLGLAYIFSKAGGGIYLDVWRKRXMKGKLWA

SEQ ID NO: 2588 - protein, 332 aa, Glycine max
MPTDTSSVSGEIVCVTGAGGFIASWLVKLLLEKGYTVRGTVRNPDDPKNGHLKELEGGKERLTLHKVDLFDIASIKAALHGCHGVFHTASPVTDNPEEMVEPAVKGTKNVIIAAAEAKVRRVVFTSSIGTVYMDPNTSRDALVDESFWSDLEYCKNTKNWYCYGKTVAEQAAWDVAKERGVDLVVVNPVLVIGPLLQPTINASTIHILKYLTGSAKTYVNATQAYVHVRDVALAHILVYETPSASGRFICAESSLHRGELVEILAKFFPEYPIPTKCSDEKNPRVKPYIFSNQKLKDLGLEFTPVKQCLYDTVKNLQENGHLPVPPKQKDSY

SEQ ID NO: 2589 - protein, 129 aa, Glycine max
IKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGS

SEQ ID NO: 2590 - protein, 174 aa, Glycine max
  misc_feature (15)..(15): Xaa can be any naturally occurring amino acid
  misc_feature (85)..(85): Xaa can be any naturally occurring amino acid
  misc_feature (157)..(157): Xaa can be any naturally occurring amino acid
PPHEAAGIVESVGEXVTDVQPGDHVIPCYQAECKECKFCKSGKTNLCGKVRSATGVGVMMNDMKSRFSVNGKPIYHFMGTSTFSXYTVVHDVSVAKINPQAPLDKVCLLGCGVPTGLGAVWNTAKVESGSVVAVFGLGTVGLAVAEGAKAAGASRVXGIDIDNKKFDVAKNFGV

SEQ ID NO: 2591 - protein, 374 aa, Glycine max
  misc_feature (100)..(100): Xaa can be any naturally occurring amino acid
MPKVRRLKSLSTDCNRPYPYPSNSKNIELHKPMNLLESADEMKEWEEARCPICMEPPHNGVLLKCSSYEKGCLPYMCNTSYRHSNCLDQFFRVLAPCSMXGGQLQPKLICPLCRGEIYGYMVLEPARRYMNSKLRSCSSETCEFQGTYPELRKHARSEHPSVRPSEVDPSRQCDWLRMEQERGLGDLFSSIHASSGADYNRDTILTGGLADLMSSFLYEIFISIEDVNRMASLLTNSRHRVPLYDRRSGTTNRVSNDTQTSQSARWRSNLPSVHQLERIARSRVRSNFPYLSSRDLEAEANRTARWRTNLSSLRTPRNEHQYRDLSAEVTSSTRMPRASQGTQTNPQSNISSSGRFPGRQLRWRDQSWSTNNHQ

SEQ ID NO: 2592 - protein, 175 aa, Glycine max
  misc_feature (84)..(84): Xaa can be any naturally occurring amino acid
ASSMISSPAVTTVNRAGARMVAPFSALKNMDGFPTTNTNNDITSIGINGGTPQCMQEWPTLGYKKYDTLSYLPDLDDALLTKEXKYLLKNGWIPCLEFQLEHGFAYRDHDRSPRYYDGRYWTMRNLPMFGCTDAYHVIKDLQEVNTVYPNGFIRIIEFNNFLQEQRISFIAYKTP

SEQ ID NO: 2593 - protein, 37 aa, Glycine max
AVHFVTFYMPLWGAILYNGFTYFQVIRMLNNATRVCI

SEQ ID NO: 2594 - protein, 255 aa, Glycine max
YYGTSKDLVALDLLRKLLRSREDQHHVPGLLMASKICCENSTLAEEGVSFAWQVLQNLDGRCNQLENHANFFLGVSLSAHSKLAASDSDRFKSQSEALHALETAGRTGNPLVLYHLSLEYAEQRKLDAAFYYAKCFLKLEGGSNVKGWLLLARILSAQKQFLDAESIVNAALDQTGKWDQGDLLRTKAKLQIAQGQLRNAIETYTQLKAVLQIQSKGFGSGKKLYKVSVLSVCCCNNLWVIVSPHIVCSKPVFGC

SEQ ID NO: 2595 - protein, 91 aa, Glycine max
YSKALDLDPKHVPSLISAAVALRQLGGRPLPAARCLLSDALRLDRTNHVAWFNLGLTYEDEGGSSSAALEAAECFQAAALLEETAPAEPFR

SEQ ID NO: 2596 - protein, 182 aa, Glycine max
  misc_feature (146)..(146): Xaa can be any naturally occurring amino acid
MLSIKRVPTVVSNYQKEETGEAAAAGGCGRNCLKSCCIQDARLPLYAFKRGEKVGGKELPLLGCKKHPVDFLDSLVLGEWEDRMQRGLFRYDVTTCETKVIPGKYGFIAQLNEGRHLKKRPTEFRVDKVLQPFDDNKFNFTIVGQXEVLFQLEISNDGEAQFFPNVPIDVENSPSFVAINVS

SEQ ID NO: 2597 - protein, 64 aa, Glycine max
MAGPRIAHATLKGPSVVKEICIGMVLGLAAGSVWKMHHWNEQRKTRAFYDLLEKDEISVVADEE

SEQ ID NO: 2598 - protein, 103 aa, Glycine max
MICCLLLTPNTIEYRPIVAKKRSSASTSEIDKLLKTVKQMAGPRIAHATLKGPSVVKEICIGMVLGLAAGSVWKMHHWNEQRKTRAFYDLLEKDEISVVADEE

SEQ ID NO: 2599 - protein, 259 aa, Glycine max
  misc_feature (150)..(150): Xaa can be any naturally occurring amino acid
MGRKFFVGGNWKCNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKXIAAKISNWDNVVLAYKPVWAIGTGKVATPAQAQEVHADLRKWVHDNVSAEVAASVRIIYEGSVNGGNCKKLAAQPHVDGFLVGGASLKPAGGHHKRCYCEKELKFVVRN

SEQ ID NO: 2600 - protein, 253 aa, Glycine max
MGRKFFVGGNWKCNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 2601 - protein, 198 aa, Glycine max
MVVNERPSKRMKRRVTADLCDFLTFPEPGVSASTEPFRNCVQRFLSHHARITFPPSLFPSLMTWQILFRVGDLLDAPDLSPAIVTLDIVEEDVTRSRASVYCDQCRVVGWSGHPVCRKRYHFIIRAASDAVEAYQRPRPCSRCGNLLQLSETRCRSCNFAITVDDLEDWVYLPIEDNTHLLHGVVHANGYGHLLTLNG

SEQ ID NO: 2602 - protein, 299 aa, Glycine max
  misc_feature (53)..(53): Xaa can be any naturally occurring amino acid
  misc_feature (242)..(242): Xaa can be any naturally occurring amino acid
  misc_feature (273)..(274): Xaa can be any naturally occurring amino acid
SVGDQVINLKEGDVVITTYIGECQECENCVSRKTNLCLTYPIRLTGLLPDNTXRMSILGQRLLHVLSCATWSEYMFSDANYTLKVYPTIDTAHASFILCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGXVFGGLRAISDLSILAAKATKRNSSSRTLTHXXHYRHNKAFDSKHQLCQVHNMHIYTH

SEQ ID NO: 2603 - protein, 225 aa, Glycine max
  misc_feature (110)..(110): Xaa can be any naturally occurring amino acid
MSLTIPSNLSKPAALRPKLSPKLRSAATTTIVCSTTNNNNNNNVSSDLKAFSAALALSSILLSAPLPAGADISGLTPCKESKQFAKREKQSIKKLESSLKLYEAGSAPGXWAIKASVEKTKRRFDNYAKQGLLCGGDGLPHLIVSGDQRHWGEFITPGILFLYISGWIGWVGRSYLIAIRDEKKPTMKEIIIDVPLASRLLFRGFSWPVAAYRELINGDLIAKDV

SEQ ID NO: 2604 - protein, 189 aa, Glycine max
MISGHWNVTDVCNALLGGFAAITAGCSVVEPWTAIVCGFVASVVLIACNKLAEKVKFDDPLEAAQLHGGCGAWGVIFTALFAKKEYVSQVYGEGRAHGLFMRGGGKLLAAHVIQILVIVGWVSATMGPLFWGLNKLKLLRISSEDELAGMDLTRHGGFAYAYEDDESHKHGIQLRKVGPNASSTPTTDE

SEQ ID NO: 2605 - protein, 286 aa, Glycine max
  misc_feature (149)..(149): Xaa can be any naturally occurring amino acid
MASLSCSANDLAPLFNDTAAANYLCAQFDSISRKLAETTYAVDNTYLLFSAYLVFAMQLGFAMLCAGSVRAKNTMNIMLTNVLDAAAGGLSYYLFGFAFAFGGPSNGFIGRHFFGLRDYPMGSSPSGDYSFFLYQWAFAIAAAGITSGXSIAERTQFVAYLIYSSFLTGFVYPIVSHWFWSSDGWASATRSHGNVLFGSGVIDFAGSGVVHMVGGIAVLWGALIEGPRIGRFDRSGRSVALRGHSASLVVLGSFLLWFGWYGFNPGSFLTIAKGYGSGGYYGQWSA

SEQ ID NO: 2606 - protein, 377 aa, Glycine max
MKCFFFKEKSKSAPELHKKKTPAVNRAANSTGSVSSPKSVKDLYREKEHSFRVFTLQELRDATNGFNRMLKLGEGGFGSVYKGSIAQPDGQGGDPIPVAIKRLNTRGFQGHKEWLAEVQFLGIVNHPNLVKLLGYCSVDGERGIQRLLVYEFMPNRSLEDHLFNKKLPTLPWKTRLEIMLGAAQGLAYLHEGLEIQVIYRDFKSSNVLLDADFHPKLSDFGLAREGPQGDQTHVSTAVVGTQGYAAPEYIETGHLKVQSDMWSFGVVLYEILTGRRSLERNRPTAEQKLLDWVKQYPADTSRFVIIMDARLRNQYSLPAARKIAKLADSCLKKNPEDRPSMSQIVESLKQALQYSDTTSQDIAESSSSSRSKLVRKK

SEQ ID NO: 2607 - protein, 378 aa, Glycine max
  misc_feature (254)..(254): Xaa can be any naturally occurring amino acid
  misc_feature (262)..(262): Xaa can be any naturally occurring amino acid
MKCFFFKEKCKSAPELHKKKTPAVNRAANSTGSVSSPKSVKDLYREKEHSFRVFTLQELRDATNGFNRMLKLGEGGFGSVYKGSITQPDGQGGDPIPVAIKRLNTRGFQGHKEWLAEVQFLGIVNHPNLVKLLGYCSVDAERGIQRLLVYEFMPNRSLEDHLFNKNLPTLPWKTRLEIMLGAAQGLAYLHEGLEIQVIYRDFKSSNVLLDADFHPKLSDFGLAREGPQGDQTHVSTAVVGTQGYAAPEYIETGXLKVQSDMXKFGVVLYEILTGRRSLERNRPTAEQKLLDWVKQYPADTSRFVIIMDPRLRNQYSLPAARKIAKLADSCLKKNPEDRPSMSQIVESLNQALQYSDTSLDIAESSSSSSSRFKLVRKK

SEQ ID NO: 2608 - protein, 177 aa, Glycine max
  misc_feature (10)..(10): Xaa can be any naturally occurring amino acid
  misc_feature (35)..(35): Xaa can be any naturally occurring amino acid
  misc_feature (69)..(70): Xaa can be any naturally occurring amino acid
MPRGSRDPLXVVGRVIGDVLDPFECSIPMRVTYQXKDVSNGCEFKPSQVVNQPRINIGGDDFRNFYTLXXVDPDAPSPSDPNFREYLHWLVTDIPATTGPTFGHEVVTYENPRPMMGIHRIVFVLFRQQGRETVYAPGWRQNFITREFAELYNLGLPVAAVYFNIQRESGCGGRRLC

SEQ ID NO: 2609 - protein, 547 aa, Glycine max
  misc_feature (224)..(224): Xaa can be any naturally occurring amino acid
  misc_feature (239)..(239): Xaa can be any naturally occurring amino acid
  misc_feature (242)..(242): Xaa can be any naturally occurring amino acid
MKNANGLISTTSSNTAQSQSTGLKTYFKTHEGRYKLYYDKTYPSTLLHYAHGKTVSQVTLAHLKDKPVPSTPTGQSSTFSATSGVRSAAARLWGGSNGGRSLSFVGGNGTSKSHGGNSRIGSIGASSTSSAMANPNFDGKGTYLIFNVGDAIFISDLNSQDKDPIKSIHFSNSNPVCHAFDQDAKDGHDLLIGLNSGDVYSVSLRQQLHRVSLRMLVWNWPSNXKINNSRCTCYINFLXGKXTSCFVSHADGNLYVYEKNKDGAGDSSFPVVKDQTQFSVAHARYSKSNPIARWHICQGSINSISFSMDGAFLATVGRDGYLRVFDYSKEQLICGGKSYYGALLCCAWSMDGKYILTGGEDDLVQVWSMEDRKVVAWGEGHNSWVSGVAFDSYWSSPNSNDNGETIMYRFGSVGQDTQLLLWDLEMDEIVVPLRRPPGGSPTYSTGSQSSHWDNVVPLGTLQPAPSMLDVPKISPLVAHRVHTEPLSGLIFTQESVLTACREGHIKIWMRPGVAESQSSTSENLLATNLKEKPSLSSKISSNSSYKQ

SEQ ID NO: 2610 - protein, 629 aa, Glycine max
  misc_feature (28)..(28): Xaa can be any naturally occurring amino acid
ESLVRGLFVSMIIGITFSIIITKLILTXGMVPNCNVSAALLAFVFIRTWTKLLHKAGFVAKPFNRQENTIIQTCAVTYYSIARPGGFASYLLGLNRTTYELTGVENEGNNPGAIKEPGFGWMTGFLFVVCFVGLFVLIPLRKIMIVDLKLTYPSGLATAVLINGFHTQGDKMAKKQVRGFTKYFCTSFLWGLFKWFFSGIEDCGFEQFPTFGLQAWKQTFYFDFSMTFVGAGMICSHLVNCSLLLGAVLSFGVMYPLIDRLKGDWFPDNLEETNMKGLYGYKVFVSIALILGDGIYNFTKILISTVLNVNERMRSKNNKNVAADRHENPTEDLKQTDEFLRETIPLRIGVIGYVVFTMISIIIIPQMFPQLKWFYVVVAYIFAPSLAFCNAFGTGLTDMNMAHNYGKVALFVIAAMSGRDNGVVAGLVGCGLVKSVVSVACTLMLDFKTAHYTCTSPKAMFICQVIGIAMGCVTAPLSFFLYYKAFDVGNPHGEFKAPYALIYRNMAIIGVQGFSALPQHCLQLCFGFFAFAIGVNMIRDFAPQKIGKWMPLPMVMAVPFLVGAYFAIDMFIGTVVVFAWQKLDSKKAELMVPAAASGLICGEGLWTLPAAILALARIKPPICMKFVPT

SEQ ID NO: 2611 - protein, 484 aa, Glycine max
  misc_feature (138)..(138): Xaa can be any naturally occurring amino acid
LPQIMIVDLKLTYPSGLATAVLINGFHTQGDKMAKKQVRGFTKYFCTSFLWGLFKWFFSGIEDCGFEQFPTFGLQAWKQTMTFVGAGMICSHLVNCSLLLGAVLSFGVMYPLIDRLKGDWFPDNLEETNMKGLYGYKXVFVSIALILGDGLYNFVKILVSSILSVHEKIKNRKNASSADQQRDNAEELKQKEVFLRDNISMWIGTGGYIVLSVISIIVIPLMFPQLKWFYVVVAYIFAPSLAFCNAFGAGLTDINMAYNYGKVALFTLAAVTGKENGVVAGLVGCGLIKSVISVSCILMQDFKTAHYTRTSPRAMFICQVIGIAMGCVTAPLSFFLYYKAFDVGNPHGEFKAPYALIYRNMAIIGVQGFSALPQHCLQLCFGFFAFAIGVNMIRDFAPQKIGKWMPLPMVMAVPFLVGAYFAIDMFIGTVVVFAWQKLDSKKAELMVPAAASGLICGEGLWTLPAAILALARIKPPICMKFVPT

SEQ ID NO: 2612 - protein, 270 aa, Glycine max
CSIVSLGLLIAYCLYQIFQPWIQRRKLEFIKHKHVILGLLTHLKKRALGRLLKENGEPDKEVIRRLFQTIDENQDDNLTHNELRALVIGIQFEEIDLDHDDAVKRIMDDFDTSGNERVDREEFVNGVSRWLQRAQRARVASGDAGPHTMKFLSDFHTETKREHDLLDVGGQVNEEAEGIENAKWISIKAVLLLLLGTIIAAAFADPLVDAVDNFSEATSIPAFFISFIFLPLATNSSEAVSAIIFASRDKRQTASLTFSEVCFLVFTLSL

SEQ ID NO: 2613 - protein, 375 aa, Glycine max
MGSKGKRKEQESIITRVMAHGGRYVQYNVYGNLFEVSSKYVPPIRPVGRGAYGIVCAAVNCDTHEEVAIKKIGNAFDNIIDAKRTLREIKLLRHMDHENIIAIRDIIRPPRKDAFNDVYIVYELMDTDLHQIIRSDQPLNDDHCQYFLYQLLRGLKYVHSANILHRDLKPSNLLLNSNCDLKIADFGLARTTSETDFMTEYVVTRWYRAPELLLNCSEYTSAIDVWSVGCIFGEIMTREPLFPGKDYVHQLRLITELLGSPDDASLGFLRSGNAKRYVRQLPQYRKQNFSARFPNMSPEALDLLEKMLIFDPNKRITVDEALCHPYLSSLHDINDEPVGPGQFNFDFEQPTCTEEHIKELIWRESVKYNPDPPSQ

SEQ ID NO: 2614 - protein, 159 aa, Glycine max
MGNCSSSDSTQVATAKLVLQDGRLQEFSYPVKVSFLLQKYPACFICNSDEMEFGDVVSAIDEDQVLQPGQLYFALPLSRLRHPLQPHEMAALAVKASSALMKTADKCGSRRKQILFSNEYDSNPKRVSPALAAGGGRGRTTAGAGGKGGFAALLSSIPE

SEQ ID NO: 2615 - protein, 335 aa, Glycine max
MADESVVESPVKRQRDDDEENAVSVSMVVEGGKVPLSNGLCSVIPGWFSEISSMWPGEAHSLKVEKILFQGKSEYQNVMVFQSSTYGKVLVLDGVIQLTERDECAYQEMITHLPLCSIPNPKKVLVIGGGDGGVIREVAHHSSVEKIDICEIDKMVVDVSKQYFPDVAVGYDDPRVTLHIGDGVAFLKEVPEGTYDAVIVDSSDPIGPAQELFEKPFFSSVAKALRPGGVVCTQAESIWLHMDIIEDIVANCRQIFKGSVNYAWTTVPTYPSGMIGFMLCSTEGPPVDFKHPVNPIDENESQKSVRPLKFYNSEIHTAAFCLPSFAKRKIGSKAN

SEQ ID NO: 2616 - protein, 142 aa, Glycine max
MQMDIVYTPSFISHRFSSSRHQCPSLSSSYSPFKLFCSNRDFKESQRNDDNNNKGDKSSTDWDKAWSKFKKQGGKKPFSKFSDKYVSWNPRRSEFPLSEEVDPIKRTERSNLSFWNSPTFTLGGAIIIVTFLLLYTILAPIK

SEQ ID NO: 2617 - protein, 149 aa, Glycine max
  misc_feature (106)..(106): Xaa can be any naturally occurring amino acid
MAHDTTVGLSMAGVVAPFTGLKCMAGFPTRKTNNDITSIASNGGRVQCMQVWPPVGKKKFETLSYLPDLDDAQLAKEVEYLLRKGWIPCLGFELEPRFVYREHNRXPGYYDGRYWTMWKLAMFGWPGASQEWNELKELPLYTGAGYCYH

SEQ ID NO: 2618 - protein, 63 aa, Glycine max
MAGGRVAHATLKGPSVVKEIFIGLTLGLVAGGMWKMHHWNEQRKTRSFYDMLEKGQISVVVEE

SEQ ID NO: 2619 - protein, 315 aa, Glycine max
MEAQPPTPSTAPPPPPQHLSYPDSVESSPRSRNTDSWDEPFAPASTKLRLMCSYGGHIVPRPHDKSLCYVGGDTRIIVSERATSLADLSTRLSKTFLNGRPFTLKYQLPNEDLDSLISVTTDEDLENMIDEYDRTAAAATSAVKPSRIRLFLFPTKPESTHSIPAQILDTSAKSDDWFLNALNGAGLLNRGFSDSASVNCLLGLDDEVAGNNLEPGSKDGVDGGVGGGGASQGGSFGNGKNLKQDVHSVPDSPMLETTSSFGSTSSSPSLANLPPIRVHVVEDQRVLGIEDQFAQIGVGVGPKQQPDEGFVLLSF

SEQ ID NO: 2620 - protein, 331 aa, Glycine max
MPLLLRRPLSPSLVSSFFLRRRSMSSKSDPISPSNTRIGWIGTGVMGRSMCGHLIKAGYSVTVFNRTISKAQPLLAMGANLAASPNSLASQSDVVFSIVGYPSDVRRVLLDPNSGALSGLSPGGVLVDMTTSEPSLAEEISKSASSAGCFSVDAPVSGGDLGAKNGKLSIFAGGDEATVKRLDPLFRLMGKVNFMGASGKGQFAKLANQVTIASTMVGLVEGIVYAHKAGLDVRKFLEAISTGAAGSKSIDLYGERILKRDFDPGFYVDHFVKDLGICLNECQRMGLALPGLALAQQLYLSLKAHGEGGLGTQALILALERLNNVSVQPSV

SEQ ID NO: 2621 - protein, 179 aa, Glycine max
GTQASEYPEIEALSRLDFGAALKVFLAKRLTSEFTLVTADVEEKSVIIGERNRVAIEALRAAMDKGHNKIAILYGGGHMPDLGRRLREDFDLVPSNVQWITAWSITKKDLNTDSFPFLKTIAKASGWPLNRYQTLALLIFSSVLALDLWFWELFFGTAVNWVSELGSELLRYVDNSPMI

SEQ ID NO: 2622 - protein, 415 aa, Glycine max
  misc_feature (303)..(303): Xaa can be any naturally occurring amino acid
  misc_feature (335)..(335): Xaa can be any naturally occurring amino acid
FTIANSTSCNCFSLLPSIQTKELENFGTPDFTIYNAGQFPCNRYTHYMTSSTSIDLNLARREMVILGTQYAGEMKKGLFSVMHYLMPKRQILSLHSGCNMGKDGDVALFFGLSGTGKTTLSTDHNRYLIGDDEHCWGDNGVSNIEGGCYAKCIDLSREKEPDIWNAIRFGTVLENVVFDEHDREVDYSDKSVTENTRAAYPIEYIPNAKLPCVGPHPKNVILLACDAFGVLPPVSKLNLAQTMYHFISGYTAMVAGTEEGIKEPQATFSACFGAAFIMLHPTKYAAMLAEKMQKHGATGWLVXNTGWSAGSYGNGSRINLQYTRKIIDAIHSGSXLNAEYKKTEIFGLEIPTEVEGVPSEILDPMNTWSNKKAYKETLLKLAGLFKNNFETFTNYKIGKGNNNLTEEILAAGPIF

SEQ ID NO: 2623 - protein, 387 aa, Glycine max
MEHKVATTTEGQSIRCKAAICRKAGEPLCIEEIIVAPPMPGEARIRIICSSLCQTDISFRNMQDHPAIYPRILGHEAIGVVESVGEDVTEVTKGDVVVPIFLPDCGECIDCKSSKSNLCSKFPFEVSPWMPRYATSRFTDLKGEIIHHFLSVSSFSEYTVVDIAHLTKIDPEVPPSKACLLSCGVSTGVGAAWRTAGVEPGSTVAIFGLGSIGLAVAEGARLCGATRIIGVDINSEKYEIGKKFGITDFVHSGECENKSASQVIIEMTDGGADYCFECVGNASLMHEAYASCRKGWGKTIVLGSDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 2624 - protein, 137 aa, Glycine max
  misc_feature (63)..(63): Xaa can be any naturally occurring amino acid
YTASFLSRLCRGSVAPECRRFRTRDAGNSAHEYLKKVVEIDWEDMKEAIPAFVALILMPLKYXIAYELIGGIGTYIVFNLWDWGWEGLGHFGLGKKTTSAAAMASDEDSHYHHGVNGILQNQHSPQNPTAKALQLEP

SEQ ID NO: 2625 - protein, 92 aa, Glycine max
MGFRLPGIRRASFAENQASSKAVEVPKGYLAVYVGERMKRFVIPISYLTQSSFQDLLSRAEEEFGYDHPMGGLTIPCSEDVFQNITSPLNGL

SEQ ID NO: 2626 - protein, 202 aa, Glycine max
MEETVFTPALEGIKLVKSEQGEILTQPFLDACKHILPVIDKFGAAMALVKSDIGGNISRLESKYSSNPTKFNYLYSLVQVEVETKTAKSSSSCTNGLLWLTRAMDFLVALFQNLIEHADWSMSQACTDSYNKTLKKWHGWLASSSFSVAMKLAPDRKKFMEVIQGTGDISADIQKFCTDFSPIFEENHKFLARCGLDDMKAS

SEQ ID NO: 2627 - protein, 200 aa, Glycine max
  misc_feature (185)..(185): Xaa can be any naturally occurring amino acid
  misc_feature (191)..(191): Xaa can be any naturally occurring amino acid
MKDSNSSSSSNRTEPIAQNIIKLISNLCFSLFVFSVLIFTVIAITYQPPDPWLQSTPALTNLFTQSENATFRIDSSVLRTGEDLSPSPQDPPLPPPPPSEPLIDITQQQIANSTVNSTADSTAYSTDAQPPSLPACDETLNCSNPRVLIARQRFNLRAFKSIAFFDYQPPMNGSVPRECDVAWRXRNKREXLWRKYRDFR

SEQ ID NO: 2628 - protein, 121 aa, Glycine max
  misc_feature (92)..(92): Xaa can be any naturally occurring amino acid
CLTLCYIFFAAAIAINLIRDLTPHKFSRFIPLPMAMAIPFYIGSYFAIDMFLGSFILFVWEKVNKAKADAFGPAVASGLICGDGIWTLPQSXLALAKVNPPICMKFLTRGDNVKVDKFLGG

SEQ ID NO: 2629 - protein, 102 aa, Glycine max
MEGTVFTPALEGIKLVKSEQGEILTQPFLDACKHILPVIDKFGAAMALVKSDIGGNISRLESKYSSNPTKFNYLYSLVQVEVETKTAKSSSSCTNGLLWLTR

SEQ ID NO: 2630 - protein, 194 aa, Glycine max
AKQLLIYSGESNMKRVWLEAGGKSPNIVFADAPDLQAAAESAASAIAFNQGEVCTAGSRLLVERSIKDRFLPLVIEALKAWKPGNPLDPETNVGALVDTQQMNTVLSYIESGHADGAKLVAGGKRTLQETGGTYVEPTIFDGVSNAMKIAQEEIFGPVLSVIAFHSVEEAISIANDTPYGLAAAVWTANISQAH

SEQ ID NO: 2631 - protein, 538 aa, Glycine max
  misc_feature (216)..(216): Xaa can be any naturally occurring amino acid
RGSLERSSSPRSSTCATPNAFSHYSSEANKGNQQQLEHVRKRLRPPSCAAVTKIKGKGKVKTQWVCCNCGHSTGKWWGQCPECQIVGTMNEFRESKLTGTKSSGGLAVSEDPVGSWLPQRPQELRPLKLEEINRRFNYQQWRIPLSGSFGNEVSTVLGGGLVPGSLTLVGGDPGIGKSTLLLQLNWKIAAMIAKECSDDEEPPVVYVSGEDQLRRXPPPDIYLYSSNDVEDILKKVQYLSPGALIVDSIQTVYLKGIMGSPGGIMQVKECTSALLRFAKKTNIPVLLIGHVTKSGDIAGPRVLEHIVDVVLYMEGEKYSSHRMLRAVKNRFGSADELGVFEMSHSGLQAVSNASEMFLSEQLLDSEILAGLAVAVIMDGSRTFLIEIQALCLSGSTGSRQVNGIQQKRADMIISVLIKQAGLRLQEHAVFLNVVSGLALTETAGDLAIAAAICSSCLEIPIPNDIAFIGEIGLGGELRMVPRMEKRVYTVAKLGYRMCIVPKVAEKALGTEGLEKMEVVGCRNLKEVINTVFLNIMRR

SEQ ID NO: 2632 - protein, 385 aa, Glycine max
  misc_feature (130)..(130): Xaa can be any naturally occurring amino acid
MSTKKNTWKSVILILSCYKVKCSLEESEKQVLKQGSFQRLCLSDVSNSSSTQAIEDISISFAGSKLYAFTLEELREATNSFSWSNMLGEGGFGPVYKGFVDDKLRSGLKAQTVAVKRLDLDGLQGHREWXEIIFLGQLRHPHLVKLIGYCYEDEHRLLMYEYMPRGSLENQLFRKYSAAMPWSTRMKIALGAAKGLAFLHEADKPVIYRDFKASNILLDSDFTAKLSDFGLAKDGPEGEDTHVTTRIMGTQGYAAPEYIMTGHLTTKSDVYSYGVVLLELLTGRRVVDKSRSNEGKSLVEWARPLLRDQKKVYNIIDRRLEGQFPMKGAMKVAMLAFKCLSHHPNARPTMSDVIKVLEPLQDYDDVFIGPFVYVAVSETGDKHKI

SEQ ID NO: 2633 - protein, 480 aa, Glycine max
  misc_feature (230)..(230): Xaa can be any naturally occurring amino acid
  misc_feature (425)..(425): Xaa can be any naturally occurring amino acid
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLPMATWKVAPALAAGCAAILKPSELASVTCLELAEICKEVGLPPGVLNILTGLGPEAGAPLAAHPXDVDKIAFTGSSATGSKIMTAAAQLIKPVSLELGGKSPIIVFEDVDLDKAAEWTIFGCFWTNGQICSATSRLIVHASFESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGXCSAVISNDLERCERITKAFNAGIGGIRYSEPCVTQSPWGGIITSGDVRRLEECGG

SEQ ID NO: 2634 - protein, 387 aa, Glycine max
  misc_feature (376)..(376): Xaa can be any naturally occurring amino acid
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKISFTGSSATGSRIMFGSASCWQPVSLELGGKSPIIVFEDVDLDKTAEWTIFGCFFTNGQICSATSRLIVHESIATEFVNRLVQWAKNIKISDPFEEGCRLGPIVSEGQYKKVLNCISTAKSEGATILIGGSRPEHLKRGTFVXPTIITDVTTSM

SEQ ID NO: 2635 - protein, 178 aa, Glycine max
  misc_feature (115)..(115): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPXYYDGRYWTMWKLPMCGYTDAAQILNKLQYANTTYPNSFIRIIIFHNIPQIQCISLITYKHPSF

SEQ ID NO: 2636 - protein, 154 aa, Glycine max
  misc_feature (151)..(151): Xaa can be any naturally occurring amino acid
GPPLESATAPPPGISMGVFDMCHRYLKERKQFGVPLAAFQLNQEKLARMLGNVQSMVLVGWRLCKLYESGKMTPGHASLGKAWNSRTAREVVSLGRELLGGNGILADFLVAKAFCDLEPIYSYEGTYDINSLVTGREVTGIASFRPAAPAXARL

SEQ ID NO: 2637 - protein, 168 aa, Glycine max
  misc_feature (122)..(123): Xaa can be any naturally occurring amino acid
  misc_feature (146)..(146): Xaa can be any naturally occurring amino acid
  misc_feature (152)..(152): Xaa can be any naturally occurring amino acid
  misc_feature (160)..(161): Xaa can be any naturally occurring amino acid
MAALPLATAEACDANAALIMNGDLRSLQPIFQIYGGRQIFAGPVVTLKIFEDNVLLREFLEEKGHGRVLVVDAGGSMRCAVLGGNLAQLMQNNGWAGIVVNGCIRDVDEINGCDVGVRALNXXPMKSNKKGVGEKHVPVTFAGTRXCDGEWXYADSDGIXXSRSELSV

SEQ ID NO: 2638 - protein, 200 aa, Glycine max
MVSSDKDPREDVLQAWYMDDSDEDQRLPHHKEPKEFVSLDQLAELGVLSWKLDADNHENDPELKKIREERGYTYMDVCEVCPEKLPNYEQKIKSFFEEHLHTDEEIRFCAAGSGYFDVRDRNEAWIRVWVKKGGMIILPAGIYHRFTLDESNYIKALRFFVGEPVWTPYNRPNDHLPARQQYVKDFVEKDVSNHAVDAAA

SEQ ID NO: 2639 - protein, 201 aa, Glycine max
RVSYVGPPPLARCAAASDIVPSSPRATDNPPALRCLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADEFKKGVEGATKFLLSKLKDLQFFVGESMKDDASVVFAYYKDGATNPTFLYFSHGLKEIKC

SEQ ID NO: 2640 - protein, 125 aa, Glycine max
  misc_feature (22)..(22): Xaa can be any naturally occurring amino acid
  misc_feature (37)..(37): Xaa can be any naturally occurring amino acid
MQYYETRTKEYYDVAQGQSRQXYGQNHQGYGQSQSRXVYGHSPTLNYRSHGGFLDGLFKGKNGQKGQNGLGSFIGKHKNQDTNKDHEHGKLLGQHEKKTQETNKGVNGLRMFINCGEKKLKKQNE

SEQ ID NO: 2641 - protein, 181 aa, Glycine max
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 2642 - protein, 123 aa, Glycine max
  misc_feature (56)..(56): Xaa can be any naturally occurring amino acid
  misc_feature (67)..(67): Xaa can be any naturally occurring amino acid
NATPTRAEVSDIAIAVREGSDAIMLTGETAHGKFPLKAAKVMHTVAVRTEATTPGXQMPPNKGQVFXNHTSEKLAYHATMTANTTGTATVGITRSGIMASVKSHDRPSSTIIALTESKRIQQR

SEQ ID NO: 2643 - protein, 247 aa, Glycine max
  misc_feature (155)..(155): Xaa can be any naturally occurring amino acid
MLNKTLSFAMGCCSCFGFIRTPNRQSQRSKPTTNNNLCQEPLLDDDIEDEEGEPLYNDEVTNNSGDEGAEETRPKRSEEILNFRVENGMICRQFPVKETRKLVRTEDENGNKMINEYIRECKIGSGSYGKVALYQSSVDGKNYAIKAFHKSHLLXLRVSPSETAMTDVLREVLIMKMLEHPNIVDLIEVIDDPQSDNFYMVLEYVEGKWICEGSGPTCGLGEETARRYLRDIVNMWKEKGYTRSRRP

SEQ ID NO: 2644 - protein, 177 aa, Glycine max
  misc_feature (5)..(5): Xaa can be any naturally occurring amino acid
  misc_feature (8)..(9): Xaa can be any naturally occurring amino acid
  misc_feature (15)..(16): Xaa can be any naturally occurring amino acid
MAEEXRCXXPEGHRXXVNNCGFFGSTATMNLCSKCYSAIRLKEQEEASTKSTIETALSSASSAKPSSSTSPPPSAVDVLMESPPPSAAEVEVAVTVTVAVASSSISINSGSVAQPNRCATCRKRVGLTGFKCRCGVTFCGAHRYPEEHACGFDFKTVGREEIARANPVIKAEKLRRI

SEQ ID NO: 2645 - protein, 213 aa, Glycine max
VGVAEMTVEFGKGCRDIVKQSLVNDDSYIVKNFGRDSYIGKTVTEPFANLFQKLSFFNEYLPEDKDPLHAWSVIFFVSILAFLALYANFERDAYAAAPVKHVFVHPPSATCVVLPDGRYMAYKEQGVSSHRARFSVIAPHSYLSSKLARIPGVKDSLLQEFGIRLLTYDLPGFGESDPHPNRNLESSGTDMAFVATGFRWYVLLCVSYSSGSM

SEQ ID NO: 2646 - protein, 266 aa, Glycine max
  misc_feature (168)..(169): Xaa can be any naturally occurring amino acid
  misc_feature (177)..(184): Xaa can be any naturally occurring amino acid
MQSLGQNEASLACPQGCCPTSLLFNPPPPPPQSQNTTAKPRNSSAECRHSFAATTASSIFPNTKFTNHESLPSLHESFSEFKKVYPQYSETDQVDHVRAKEYYHLSFSNQSCLDYIGIGLFSYYQRQHHHDTSKTQLASSSTPQYSDNIPFFSISYKTGNLKTLLLHXXQESEFESXXXXXXXXFLNISDNDYFMVFTANRTSAFKLVADSYPFQSSKKLLTVYDYESEAVEAMISCSEKRGAKAMSAEFSWPRLRIRSTKLRKII

SEQ ID NO: 2647 - protein, 698 aa, Glycine max
  misc_feature (97)..(97): Xaa can be any naturally occurring amino acid
  misc_feature (147)..(147): Xaa can be any naturally occurring amino acid
EDLQIIVGQLQPRSEKTDSSLTRWEEYCRWGAWFIRVTLKCNGNCCKKLRLNRGGLWSPPLSSKHIPQPQGAIICWERFLHIRSLKVLLVEIDDSTXRMLSLTLLRNCSYEVIEVAIRIASFRKILEDLTNHIDLVLTEVAMPGLSXGIGLLYKIMGHKTRKNIPVVMMSSHDSMGLVFKCLSKGAVDFLVKPIRKNELKNLWQHVWRRCHSSSGSGSESGTQTQKSIKSKSLEKSDNNSGSNDEDDNESIGLNNVDGSDNGSGTQSSWTKRAVEVDSHKPVSQWDQIAECPDSTCAQVVHSNAEMGGNKVVPLAAKDCAEQNEQLVKTAGSQHSNAPDVGPSKFSEQINRGQLDLNCENQSSKLRCKGLSLSDAITSTCDSQMHSGEFEALNKKPKSSDIENKGTNNDEELPSLELSLKRLRGVEDADITIQDDRNVLRRSDQSAFSRYNAASNTKKSPTGCVGSNSPYNNSLEVTKKDSSHDIQSHSCGNPPNQNSNGASNNIDMGSTTNNAYAKSAVMSEPSGASTTKCLYQTSAFQPLPPDHDAESIKKMATAAPHCGSSNVEEVLVEGNVGNHSINRSVSGSNNGSNGQNGSSTAVNAGGTNTESNNGLTGNSGSGDASGSGSANRVDQNKTSQREVALTKFRQKRKERRERCFHKKVRYQSRKRLAEQRPRFRGQFVRQTSNENASEATTDS

SEQ ID NO: 2648 - protein, 89 aa, Glycine max
  misc_feature (38)..(38): Xaa can be any naturally occurring amino acid
  misc_feature (45)..(45): Xaa can be any naturally occurring amino acid
MGFRFPSIRQASFMASQATSKFVDAPKGYFAVYVGEKXRFMIPVXYLNQPSFQDLLNEAEEEFGYDHPMGGLTIPCSEDVFQRITSCLN

SEQ ID NO: 2649 - protein, 113 aa, Glycine max
ISHQKLVQMLGNIQAMILVGWRLCKLYESGKMTPGQASLGKSWITLRARETAALGRELLGGNGILADFLVAKAFCDLEPIYTYEGTYDINTLVTGREVTGFASFKPVAQRSRL

SEQ ID NO: 2650 - protein, 254 aa, Glycine max
  misc_feature (109)..(109): Xaa can be any naturally occurring amino acid
AAFRFVTCMSSLRCCAPLCEDTLPDFLMAYQFTSQVQALRSFEFYICYYGWGDFKQRETSCKSNRIFIAFSFIVAVIPYWSRCLRRLFEEKDKMQGYNALKYFLTIAAXVCLRTAYTLHQGMGLKVMAWIFSISTAIFSTYWDLVLDWGLLQRHSKNRWLRDKLLVPQKSVYFAAMVLNVLLRFAWLQTILNLNFSSLHRQAMVSIVANLEIIRRGIWNFFRIENEHLNNVGKYRAFKFVPLPFNYEEEEDKDE

SEQ ID NO: 2651 - protein, 624 aa, Glycine max
  misc_feature (310)..(310): Xaa can be any naturally occurring amino acid
SNGNYTANSIYQTNLNTLLSTLTSHTEIDYGFYNFSHGQNSDKVYAIGLCRGDVKPDECRSCLNNSRVSLTRLCPKQLEAINWEEKCMLRYSNRAIFHTMDASFSYHMNNVNNATDAEEFNKVLGELLRNLSDKAASGDSRRKYAADTAVFANLQTIYGLVQCTPDLSRQDCGKCLHWSLADFGNVFKNKVGAVVLRPSCNVRYEIYPFYDEPTPSASVPLSLKEKGNSLRTTIAIVVPTVLVVVALLIFISIYFRRRKLARKNLLADEDDDEIELAESLQFNFDTIKVATNNFSDSNKLGEGGFGAVYXRLSNGQVIAVKRLSSDSGQGGVEFKNEVLLLAKLQHRNLVRLLGFSLEGKEKLLVYEYVPNKSLDYFIFDPTKKERLDWDRRYKIIQGIARGLLYLHEDSRLRIIHRDLKASNVLLDEEMIPKISDFGMARLIVAGQTQENTSRVVGTYGYMAPEYIMHGQFSIKSDVFSFGVLVLEIVSGQKNHGIRHGKNVEDLLNFAWRSWQEGTVTNIIDPILNNSSQNEMIRCTHIGLLCVQENLANRPTMANVALMLNSCSITLPVPTKPAFFMDSATTSLPNMSWEVNSGTTRSNQSTTKSAHDSVSETSISELYPR

SEQ ID NO: 2652 - protein, 645 aa, Glycine max
MGKMHKNRKQAGGHGTPREETDMQEQEMDIRKIMKDVENFSYSHMSWKERKKIENRNVVSLGGKPRRQKGSSQQRQSITTQESHLTLYTSSPFVFLYFSAFFLLLCIVSRIGWSKNKECVLCGVVWFFTFASSFCEKTHTQREMATTRVVAEQKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGIPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 2653 - protein, 201 aa, Glycine max
MALCRFAYSYSPASASTIFRFPKYPSKHTKFSLLPLSFSTMEAPPEGYRRNVGICLMNNHKKIFAASRLDIPNAWQMPQGGIDEGEDPRNAAIRELREETGVNSAEVIAEVPYWLTYDFPPKVREKLNIQWGSDWKGQAQKWFLFKFTGQDQEINLLGDGTEKAEFGEWSWISPEQVIELAVDFKKPVYKEVLAVFAPYFQ

SEQ ID NO: 2654 - protein, 248 aa, Glycine max
MAGIAFGSFNDSFSLASIKAYIAEFISTLLFVFAGVGSAIAYAKLTSDAPLDPTGLVAVAICHGFALFVAVSVGANISGGHVNPAVTFGLALGGHITILTGLFYWIAQLLGSIVACFLLNYVTGGLPTPIHSVASGVGAVEGVVTEIIITFGLVYPVYATAADPKKGSLGTIAPIAIGFIVGANILAAGPFSGGSMNPARSFGPAVVSGDFHDNWIYWVGPLIGGGLAGLIYGNVFIRSDHAPLSSEF

SEQ ID NO: 2655 - protein, 130 aa, Glycine max
  misc_feature (14)..(14): Xaa can be any naturally occurring amino acid
MAPAVMASSATTVXAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQV

SEQ ID NO: 2656 - protein, 168 aa, Glycine max
MLVYTDLLTGDELLSDSFPYKEIENGILWEVEGKWTTQGCVEVNIGANPSAEEGGEDEGVDDSVQKVVDIVDTFRLQEQPTYDKKGFIAYIKKYIKLLTPKLNAEDQEAFKKGIEGATKYLLPKLKDFQFFVGESMHDDSTVVFAYYKEGATNPTFLYFGHGLKEVKC

SEQ ID NO: 2657 - protein, 688 aa, Glycine max
  misc_feature (254)..(254): Xaa can be any naturally occurring amino acid
MALIPSMMLFSFLSFLVILKSEANNDQLQFVYHYCNNEYGNITTETYSDNRNNLLSNMYYDKENDYGFYNSSYGQDPDKVYAIGFCRGDANLDKCRSCLEKSAVLLRERCPVQKEGIGWFDECMLRYTNHSIFGVMVTQPNNIMCNTKNAPKDPRSAAGFDQVVHNLLNELRNRTTTVADPESDSSRSRKFFAEGDAPVQSSNVTIHALIQCTPDISSQNCTRCLEHAMTNILYCDGKRGGRYLGPSCSVRYEXSIPFFEPIVHHAPPPQPATQVTTTTGKEKSNPSRTIIAIVVPVVAVVVLLVAFTYNYLGARRRRQKPFQSEGGEGELDNDIKIDELLQFDFATIKFATNNFSDANKLGQGGFGIVYKGTLSDGQEIAIKRLSINSNQGETEFKNEILLTGKLQHRNLVRLLGFCFSRRERLLIYEFVPNKSLDYFIFDPNNRVNLNWERRYNIIRGIARGLLYLHEDSRLQVVHRDLKTSNILLDEELNPKISDFGMARLFEINQTQASTNTIVGTFGYMAPEYIKYGQFSVKSDVFSFGVMILEIVCGQRNSEIRGSEENAQDLLSFAWKNWRGGTVSNIVDDTLKDYSWNEIRRCIHIGLLCVQEDIADRPTMNTVLLMLNSDSFPLAKPSEPAFLMRDKSSLPTAMLSGGQHSEVTRSGYSGSQSAQESSIMAPITEPYPR

SEQ ID NO: 2658 - protein, 311 aa, Glycine max
  misc_feature (158)..(158): Xaa can be any naturally occurring amino acid
MSSSNGNGGKKPAPSGGRGGIRTLADINRGPSGFPGAGGSGSDSDEPQEYYTGGEKSGMLVQDPTRRNNVDSIFEQARVMGAQQVPLPSFEGQSSSSTSFAGTGRLLSGDAQTAPAAPQPPQDVLHNIHFWNNGFTVDDGPLRAYEDAANADFIESIXKSQCPQELEPADRRTAVHVNVIKRHGDYEEPARPRSAFQGVGRTLGGSSADESPAPAPVTQEPHGAPRSIGIVVDDSQPFTSIQLRLADGTRMVARFNLNHTVGDIRSFIDASRPGAARPYQLQTGFPPKQLTDPTQTVDQAGLKNSVIMQKM

SEQ ID NO: 2659 - protein, 200 aa, Glycine max
MAGMQKLPYGDVDSSLRALAGRAEGFGRLAIGGLHGPLYFVTTLSDDGPGSLREGCRRKEPLWIVFEVSGTIHLSSYLSVSSYKTIDGRGQRVKLTGKGLRLKECEHIIICNLEFEGGRGHDVDGIQIKPNSRHIWIDRCTLRDYDDGLIDITRQSTDITVSRCCFGQHDKTMLIGADPTHIGDRCIRVTIHHCFFDGTR

SEQ ID NO: 2660 - protein, 268 aa, Glycine max
  misc_feature (133)..(133): Xaa can be any naturally occurring amino acid
MQHFSEEDKREYTLDEEEMETQNVILKTSRSKKDACILEKSLSRRYPNLVFHEALKEEKEKLHVELSRSRTNNDPEQCRVIEHLIEVTKNVVNMSPNKKVTKIVSGKHVIGKYAYLYISWSRHITDNAIASEXTLSLESGDKSQSEWKTDLFGCCREPCLCLKTCFFPCGTFSWIANVVTRGETSRKRAMTNLVAYSIFCGCCCYSCCIRRKLRNQFNIEGGLCDDFLTHLMCCCCAMVQEWRELELSGFGDCQERKMFPPPNQFMES

SEQ ID NO: 2661 - protein, 159 aa, Glycine max
PSVRTHTLGRCIRKDPSHCFFDGTRQRQPRVRFGKVHLYNNYTRNWGIYAVCASVESQIYSQCNVYEAGTKKKTFEFYTEKAADKEEQKSGFIISEGDMFLNGAEPSLLTENREESMFHPSEYYPTWTMEAAGHSLREVLLLCTGWQSICRPVDNMVLQ

SEQ ID NO: 2662 - protein, 346 aa, Glycine max
FGSSFGVHFFTYSELEEATNFFDPARELGDGGFGTVYFGKLHDGRVVAVKRMYENSYRRVEQFVNEVEILTGLHHQNLVSLYGCTSRHSRELLLVYEYIPNGTVADHLHGQRAKPGTLAWHTRMNIAIETASALVYLHASEIIHRDVKTNNILLDNHFSVKVADFGLSRLLPTHATHVSTAPQGTPGYVDPEYNEYYQLTDKSDVYSFGVVLIELISSMPAVDISRRRHEINLSNMAIKKIQSGALHEIVDTTLGFETDFKVRKMISAVAELAFQCLQSSKDVRPSMAEVLDRLEDIRSDGSHRSKHEVLDISEDDAALLKNVPPPPSPDSHLVTISNSTPPNDSQ

SEQ ID NO: 2663 - protein, 283 aa, Glycine max
LVIATVMTRLFEKIDRNRDNFISQSELKELIMNIKFVKASMEVEEAVALVIEELDIDKDRTINEKEFVAGFEKWLSSTSAPAPVSDSDNANFTTLSFVHICKTWEEADIVVEERQNNAVVDKSIWAWIKAITYVMLGIAMLSILAEPLTESVHNFSNSAGFHPFFMSFILAPLATNAREATSAIKEASHKKPRTTSLAISEIYGGVFMNNILGFFAISVLIFVREVTWQFSAELLVVAIVCAITGITASFHSIFPIWSSFIAILLYPLSLVLVFILDHVLNYN

SEQ ID NO: 2664 - protein, 733 aa, Glycine max
RFDELAIDAKLPKTRFSQCIGMNESKEFAGELFDALARRRGITSASITKDQLREFWEQITDQSFDSRLQTFFDMVDKDADGRITQEEVKEIIALSASANKLSKIQNRAEEYAALIMEELDPDNLGYIELYNLEMLLLQAPAQSTHITTDSRVLSQMLSQKLVPTKEYNPIKRGFRSLAYFVEDNWKRIWVIALWLSICAGLFTWKFIQYKHRAVFDVMGYCVTSAKGAAETLKFNMALILLPVCRNTITWLRSKTKLGMAVPFDDNINFHKVIAFGIAIGVGIHAISHLTCDFPRLLHATDEEYEPMKQFFGEDRPNNYWWFVKGTEGWTGIAIVVLMAIAYTLAQPWFRRNRLKLPKPLKRLTGFNAFWYSHHLFVIVYGLFIIHGYFLYLSKKWYKKTTWMYLAIPMILYGCERLLRAFRSGYKSVKILKVAVYPGNVLALHVSKPQGFKYSSGQYIYVNCSDVSPFEWHPFSITSAPGDDYLSVHIRTLGDWTSQLKGVFAKACQPASDGQSGLLRADMLQGNNKPRMPRLLIDGPYGAPAQDYKNYDVILLVGLGIGATPLISILKDVLNNIKQHKDVEEGEVEKDKRKPFATKRAYFYWVTREEGSFEWFKGVMNEVEENDKEGVIELHNYCTSVYEEGDARSALITMLQSLHHAKNGVDIVSGTRVKTHFARPNWRNVFKHAAIKHPDQRVGVFYCGAHGLVGELKKLSLDFSRKTSTKFDFHKENF

SEQ ID NO: 2665 - protein, 406 aa, Glycine max
  misc_feature (379)..(379): Xaa can be any naturally occurring amino acid
PRVRLLVGFGIAIGVGLYAISHLTCDFPRLLHATDVEYKPMKQFFGDERPNNYWWFVKGTEGWTGVVMVVLMAIAFILAQPWFRRNRLKLPKPLKKLTGFNAFWYSHHLFVIVYVLFIIHGYFLYLSKKWYKKTTWMYLAVPMILYGCERLLRAFRSGYKSVRILKVAVYPGNVLALHVSKPHGFKYSSGQYIYVNCSDVSPFEWHPFSITSAPGDDYLSVHIRTLGDWTSQLKGVFAKACQPASDGQSGLLRADMLQGNNKPRMPRLLIDGPYGAPAQDYKNYEVILLVGLGIGATPLISILKDVLNNIKQHKDVEQGAVEKDNKRKPCATKRAYFYWVTREEGSFEWFKGVMNEVEENDKEGVIELHNYCTRVYEEXDARSALITMLQSLHHAKNGVDIRSGTR

SEQ ID NO: 2666 - protein, 694 aa, Glycine max
  misc_feature (532)..(532): Xaa can be any naturally occurring amino acid
EDDDSTRHVVRALLQNCSYKVTAVSNGLQAWKVLEDPENGIDLVLTEVAMPILSGIGLLCKIMSHKTLKNIPVIMMSSHDSMGIVFKCLSKGAVDFLVKPIRRNELKNLWQHVWRRCHSSSGSGSESATLTRKFAKSRSNDAYENNSDSSDENDYGSRGLSIRDGSDNGSGTQSSWTKCLAQVGSPHPVSPHKQLVDAPDSTCAQVMQTKTEKVSSRWVHATEKECHELIDLDDVARVKDLAMGISLNMQLEHPLEELSSNPIVGKGANKMSDVDDMQIIKRKSNVCEKGQLEYNGDKTGTQENQAMNVIDVTDSNSPQAESRDLNTPNGFSGFSQSKANCCPKEHPSLELTLKRLGEVGDAKNVTGEECNVLRHSDQSAFSKYNTVSANQAQTGNVGSCSPLDNSSAAPNTETMHNFPSHSNGTPSNQKSNGSNNINDRASTNTYLGTKPDTFDKKPESGRGIGSYNSCELLTVQNNSISSSQKKTSAWEEYTEIIKESVGGSEQGFQVEHTYYQLHHYNHIAHKAAVDPXSDHDLLLKSSTPQCVSSNAFGGPAESNAANYGVDGNAVESDHGSNNGQDGSNNLTIRTINVENGNVAAGSIGIGGIDRKSIGNGTDEVRLALREAALTKFRLKRKERCFEKRVRYHSRKKLAEQRPRIKGQFVRRIVSEGKEEKDKQSDNLVPGDNSIDIPQ

SEQ ID NO: 2667 - protein, 115 aa, Glycine max
  misc_feature (35)..(35): Xaa can be any naturally occurring amino acid
  misc_feature (42)..(42): Xaa can be any naturally occurring amino acid
MATNIGIMDAGVFVRRTENLSWINLTLQLNLSQIXRALSGRXYCHLFYTAHTQIVPIHTVNFDTQSACVMIHNYTVLQDVFNKLKITKHIEVSKLVKGRPLDNLQFMQWMKRYCD

SEQ ID NO: 2668 - protein, 104 aa, Glycine max
LHHYNLKLLIVTEGARGCRYYTKDFKGWVAGYEVEAIDTTGAADSFVGGLLSIVAAHNHIYKDEKRLREALDFANACAAFTVTGRGAIPSLPTKDAVLRIMFSY

SEQ ID NO: 2669 - protein, 274 aa, Glycine max
EASRFSDRVLERLFSKAGTGFVSVVVGSFARNLVLGFYDAESVGTRSQSDVPGWVNVICDERCGKLIGDCVQTFVSTAVAVFLDKTKDVNTYDEMLAGLSNPKHQENVKGILVSMCNGAVETFVRTSHQVLTNRSVRSNSGLSVSPVVVPVSEEGCLKQEALLQQLKIGSSVNGVQDVGWLEQIKSTLLVPVNQRFVLDVTGRVTIETVRSFVAFLLWRISDGFKSSVSKVHEEVLGKGLEVVRYVGAKSSVILTLCLALYLHIMGGSRILLPA

SEQ ID NO: 2670 - protein, 478 aa, Glycine max
  misc_feature (102)..(102): Xaa can be any naturally occurring amino acid
GKFLKAKDQKSLYEALQKIKEELMLLGFISLLLTVTQNGITKICVRPSLTRHMLPCNLDAGEHSTPESESATKIGYCVRKVTPSHSLTFLFLRSHLIHHPSXRLLFCFSLFQNKVPLLSLEALHHLHIFIFVLAVVHVSFSLLTVVFGGARIRQWKHWEDSIAKQNYETGRVLKPKVTQVHQHDFIRGRFAGFDKDSAIVGWLLSFLKQFYGSVTKSDYVTLRHGFIMTHCRTNPKFNFHKYMIRALEDDFKQVVGISWYLWLFVVIFLLLNINGMLQDRNFCFAFVQLLLAVGTKLGHVITQLAQEVAEKHAAIEGDLVVQPSDEHFWFHRPHVVLFLIHFILFQNAFEIAFFFWIWVTYGFDSCIMGQVRYIVPRLVIGVFIQVLCSYSTLPLYAIVTQMGTHYKRAIFNEHLQQNIVGWAQKAKKRKGLKADGNPGQGSSQESANTGIQLGSIFKKASAPGGSSSATKADGTNSV

SEQ ID NO: 2671 - protein, 106 aa, Glycine max
TKAIAGKISNWGNVVLAYEPVWALGTGKVASPAQAQEGPADLRKWVHANVRAEVAASVKIIYGGFVNGGNCKKLAAQPDVDGFLVGGAPPKPGFVGIINAAPVKKN

SEQ ID NO: 2672 - protein, 355 aa, Glycine max
  misc_feature (162)..(162): Xaa can be any naturally occurring amino acid
  misc_feature (172)..(172): Xaa can be any naturally occurring amino acid
  misc_feature (251)..(251): Xaa can be any naturally occurring amino acid
  misc_feature (262)..(262): Xaa can be any naturally occurring amino acid
MKEESTGLIIGISIGVVIGVGLAISALFCLRYHRKRSQIGNSSSRRAHTIPIRENGVASCTILSDSTLGPESPVRSARHGMSFWLDGFKKSSNMVSASGIPEYSYKDLQKATYNFTTLIGQGAFGPVYKAQMSTGETVAVKVLATNSKQGEKEFQTEVMLLXGRLHHRNLVXIWVGYCAGKGQHMLVYVYMSKGSLASHLYSEENGALGWDLRVHIALDVARGIEYLHDGAVPPVIHRDIKSSNILLDQSXMRARVADFGLXAREEMVDKHAAIRGTFGYLDPEYISSGTFTKKSDVYSFGVLLFEIIAGRNPQQGLMEYVELVRSLSLPSNHIEDNGSGCYFWEIYSGLPYKTI

SEQ ID NO: 2673 - protein, 220 aa, Glycine max
MSLTIPTNLVLNPRSNKSLTQSLPKSTARFVCSDDKSATQQQSMKAFSAAVALSSILLSAPMPAVADISGLTPCKESKQFAKREKQQIKKLQSSLKLYAPESAPALALNAQIEKTKRRFDNYGKYGLLCGADGLPHLIVNGDQRHWGEFITPGLLFLYIAGWIGWVGRSYLIAISDEKKPAMKEIIIDVPLASRLIFRGFIWPVAAYRALLNGDLIAKDV

SEQ ID NO: 2674 - protein, 127 aa, Glycine max
MAAPLPRAPVSSPASRAALCPARSNPCTAAAPSSGALGWRRRQPCPMLSIAPGSARSTPAALAVDPKVEALLDSVKWDVKGLAVAIAQNVDTGAILMQGFANKEALAATISTRKATFYSRSGPSLGD

SEQ ID NO: 2675 - protein, 689 aa, Glycine max
MASNSELVRTVVESVLGVSVSDSVMVIAATSVALVIGLLVFVWRKSSDRSKEQKPLAVPKLLVKEEEEDEVDAGSGKTRVAIFFGTQTGTAEGFAKALAEEIKARYEKAAVKVADLDDYAMDDDQYEEKLKKESLAFFMLATYGDGEPTDNAARFYKWFTEGKDERGTWLQHLTYGVFGLGNRQYEHFNKIGKVVDEDLSEQGAKRLVTFGLGDDDQSIEDDFSAWKETLWPELDQLLRDEDDANTVSTPYTAAILEYRVVIHDPTVTSSYDNHVNVANGNAVFDIHHPCRVNVAVQRELHKPESDRSCIHLEFDISGTGITYETGDHVGVYADNCDETVEETGKLLGQDLDLLFSLHTDKEDGTPLGSSLLPPFPGPCTLRFALAHYADLLNPPRKASLVALAAHTSEPSEADRLKFLSSPQGKDEYSKWLVGSQRSLLEVMAEFPSAKPPLGVFFAAVAPHLQPRYYSISSSPRFSPQKVHVTCALVCGPTPTGRIHKGVCSTWMKNAIPLEKSRDCSWAPIFIRTSNFKLPADHSIPIIMVGPGTGLAPFRGFLQERLALKEDAVQLGPALLFFGCRNRQMDFIYEDELKNFMEQGALSELIVTFSREGPEKEYVQHKMMDKAANLWNLISQGGYLYVCGDAKGMARDVHRTLHTIVQQQENVDSSKAEAIVKKLQMDGRYLRDVW

SEQ ID NO: 2676 - protein, 164 aa, Glycine max
  misc_feature (67)..(67): Xaa can be any naturally occurring amino acid
  misc_feature (85)..(85): Xaa can be any naturally occurring amino acid
ASSMISSPAVTTVNRAGAGMVAPFTGLKSMAGFPTRKTNDGITSIASNGGTVHCVQVWPPFGKKKFXTLSYLPDLNDAQLANDVXYLLRKGWIPCLESDLDHGFMYREHNRSPSYYDGRYWTMWNLPMFGCADASHVSNELQDVYTAYPLGSIPFTLVDDARQI

SEQ ID NO: 2677 - protein, 345 aa, Glycine max
  misc_feature (148)..(148): Xaa can be any naturally occurring amino acid
FYFVTVVSDNQKPLPLDDLRRNEVFARESIPIWLACTGYILFSIVSIIVIPLMFPQLKWYYVVFAYLFAPSLGFCNAYGAGLTDMNMAYNYGKVALFVLSALAGKNDGVVAGLVGCGLIKSIVSISSDLMHDFKTGHLTFTSPRSMLXSQAIGTAIGCVVAPLTFFLFYKAFDVGNPDGDYKAPYAIIYRNMAILGVEGFSALPHHCLQLCYGFFTFAIAANLVRDLGPKKIGKWIPLPMAMAVPFLVGGYFAIDMCMGSLVVFLWHTLNRNEAGLMVPAVASGLICGDGLWILPSSILALLKIRPPICMSFRCAERTLQMKLKLLGVGGLGARRFGGGALRASR

SEQ ID NO: 2678 - protein, 126 aa, Glycine max
MNARRDGRNNRVALFDGIEEGGIRASSLYSSSSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 2679 - protein, 126 aa, Glycine max
MNARRDGRNNRVALFDGIEEGGIRASSLYSSTSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 2680 - protein, 170 aa, Glycine max
  misc_feature (121)..(121): Xaa can be any naturally occurring amino acid
  misc_feature (143)..(143): Xaa can be any naturally occurring amino acid
AASLIASPPVCTDHRAGAGLDAPFIRLTSMHGCPPRKTNHDFPSLACYGGRVRCMHACAPIGWKKYETLSYLPDLAHARLVEEGKYLPSKGWMPCLLVILDHGLVHRARARPPACYHGRYXPMRELAIYGCTDASHAWEELPXARTDCPPGCLRINGCNCLRSAQGMSFI

SEQ ID NO: 2681 - protein, 128 aa, Glycine max
  misc_feature (19)..(19): Xaa can be any naturally occurring amino acid
  misc_feature (39)..(39): Xaa can be any naturally occurring amino acid
MMLDFARIWTRNTLIGLGXGQFLCLLITTTGFTSFELAXKGINAPTSQGLLNYVLLTLDYGTGVLYRRTALKAKWYYYIILGLDDVEAHVLVVKAYQYTSLTSVMLLDCWTIPTVMLATRLSLKTKYR

SEQ ID NO: 2682 - protein, 503 aa, Glycine max
  misc_feature (118)..(118): Xaa can be any naturally occurring amino acid
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCXEFYADLAEKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 2683 - protein, 503 aa, Glycine max
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLLMATCCFVRCLVSSLLCCHVLLCAIFRTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 2684 - protein, 117 aa, Glycine max
RPLFKEARALLGRLEYQRGNFDAALQVFQGIDIKGLAPRMIKAIAERTKQRKPRSKADIMVPNVMSLRSVSLLLEAILLKARSLEELGQCIEAAKECRIILDTVESALPNGMPEGIW

SEQ ID NO: 2685 - protein, 72 aa, Glycine max
MAAWTSVGLVAVAVLVVGIAMPASAAVQPPAPAPSSDGTSIDQGIAYVLMLVALVLTYLIHPLDASSPYRLF

SEQ ID NO: 2686 - protein, 118 aa, Glycine max
  misc_feature (17)..(17): Xaa can be any naturally occurring amino acid
HAYAFTAGLALSSIVLXAGLRGGADISTLTPCKESKQLPNREKQSIKNLESPLKLYEAGSALALAINASVENTNRRFDNYAKQGLLCGGYGLPHLIVSGDQKHCGEFNTLRILYLDIS

SEQ ID NO: 2687 - protein, 642 aa, Glycine max
MEGENASNKVIELMNEIASISDYRPPVKKQYCNLARRLKLLIPMFEEIRDMNKDALPDNTSNAVLAFKEALESAMELLRFGSEGSKLYLVLERDEIMNKFYKVTAQLEQSLGGISYDKLDISDEVKEQVELVLAQFRRAKGRVDEPDVRLYEDMLSVYNNSSDAATDPSVLSQLAEKLKLMGIADLTQESLALHEMVASSGGDPGARIEKMSMLLKKIKDFVQIENLVKDDNLGGKGIFSKVYGLCLELMKDPVIVSTGQTYERTCIEKWLQAGHGTCPKTQQTLTSTVLTPNYVLRSLIAQWCEANGIEPPKRPSDSQPSKSASAYSPAEQSKIESLLQKLTSVSPEDQRSAAGEIRLLAKRNADNRVAIAEAGAIPLLVGLLSVPDSRTQEHAVTALLNLSIYENNKGSIVSSGAVPGIVHVLKKGSMEARENAAATLFSLSVIDENKVTIGSLGAIPPLVTLLSEGNQRGKKDAATALFNLCIYQGNKGKAVRAGVIPTLMRLLTEPSGGMVDEALAILAILASHPEGKATIRASEAVPVLVEFIGNGSPRNKENAAAVLVHLCSGDQQYLAQAQELGVMGPLLELAQNGTDRGKRKAGQLLERMSRLVEQQQEVPIQTETQAQNEDTQPPLITNPDDS

SEQ ID NO: 2688 - protein, 503 aa, Glycine max
  misc_feature (15)..(15): Xaa can be any naturally occurring amino acid
  misc_feature (406)..(406): Xaa can be any naturally occurring amino acid
MDFTTPPIEDGFTAXKLFTQGFSYTYDDVIFLPHYIDFAADAVDLSTRLTRRLPLAVPFVASPMDTVSESAMAAAMASLGGIAVVHSNVPAAVQAAILRRAKSRRVPILSDPAFAAPSAVVEHDDAFGASPFLLVTDTGTSVGKLLGYVARSDWTNQTDKGLRVGDYMAPPPKPAPWNADLNKINEIMESEKSGAVALERDGEVVDLVVREEVERVRGYPKLVAPATVGADGEFMVGAAVGTREDDKERLEHLVKAGLNVVVLDSSQGNSIYQLEMVNYVKRVYPELDVIGGNVVTMYQAENLIQAGVDGLRVGMGSGSICTTQEVCAVGRGQATAVYNVSLIAYKSGVPVIADGGISNSGHIVKALSLGASTVMMGSFLAGSLEAPGAYVYQNGQRVKKYRGMGXSLEAMTKGSDARYLGDTAKLKIAQGVVGAVKDKGSVLNFIPYTLQAVRQGFQDIGASSLQSAHDLLRSRELRLEVRSGAAQVEGGVHGLVSYEKKYF

SEQ ID NO: 2689 - protein, 281 aa, Glycine max
  misc_feature (166)..(166): Xaa can be any naturally occurring amino acid
MAATSSLCSSTLQSQINGFCLHKTSLSHPRSLTFSRKKISTTVKATSRVDKFSKSDIIVSPSILSANFAKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAXKAGVVLNPATPLSAIEYVLDVVDLVLIMSVNPGFGGQSFIESQVKKISDLRRVCAEKGVNPWIEVDGGVGPANAYKVIEAGANALVAGSAVFGAKDYAEAIRGIKTSKRPEAVAV

SEQ ID NO: 2690 - protein, 307 aa, Glycine max
MGSPGSGRFAGAIPWTSLLNHKKKRNATKSNLDLPLSRPPVVPNPIRSPPSSVAMGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAGQPDVDGFLVGGASLKPEFIDIINAATVKSA

SEQ ID NO: 2691 - protein, 75 aa, Glycine max
MAFLRAASEVLAIYTLVFTIFSPAVLEAQSLSLAAAPAPSRDGTSIDQGIAYVLMVVALVLTYLIHPFDASSHHF

SEQ ID NO: 2692 - protein, 218 aa, Glycine max
  misc_feature (35)..(35): Xaa can be any naturally occurring amino acid
  misc_feature (48)..(48): Xaa can be any naturally occurring amino acid
  misc_feature (63)..(63): Xaa can be any naturally occurring amino acid
KERTAELVRKSMASSLGFEFLTKKPYSPPSWASHXHPLPSHFFSLAHXWNLPNLPTNGSSCVXRDDLSGMQLSGNKVRKLEFLMADAIAQGADSIITIGGIQSNHCRATDVAAKYLNLDCFLILRTSDLLVDQDPGLTGNLLVERMVGAHVHLISKQEYAKIGSVVCLVLLHYFFFSVSYIIIIIIIIVILLLLLIIYLFIFFLDTHQCPKRKIDQGR

SEQ ID NO: 2693 - protein, 237 aa, Glycine max
MATSIGIMDSAYFVGRNEILSWINNRLQLNLSRIEEAASGAVQCQMMDMTYPGVVPMHKVNFDAKTEYDMIQNYKVLQDVFNKLKIEKHIEVGRLVKGRPLDNLEFLQWLKRYCDSVNGGIMNENYNPVERRIKVGKDRNHKCSVKSSKSLQTNMINSGSGNTLSPNRTSGTKQFRSNEAAGGVNSSVEIQALSKEMSVAIKKVLYADDPKESALEEAQDYLNQRLNAVEDEAEIEA

SEQ ID NO: 2694 - protein, 275 aa, Glycine max
MATSIGIMDSAYFVGRNEILSWINNRLQLNLSRIEEAASGAVQCQMMDMTYPGVVPMHKVNFDAKTEYDMIQNYKVLQDVFNKLKIEKHIEVGRLVKGRPLDNLEFLQWLKRYCDSVNGGIMNENYNPVERRVKGGKDRNHKCSVKSSKSLQTNMINSGSGNTLSPNRTSGTKQFRSNEAAGGVNSSVEIQALSKEITDLKSAVDLLEKERDFYFAKLRDIEILCQTPEVENFSMSVAIKKVLYADDPKESALEEAQDYLNQRLNAVEDEAEIEA

SEQ ID NO: 2695 - protein, 277 aa, Glycine max
  misc_feature (22)..(22): Xaa can be any naturally occurring amino acid
  misc_feature (99)..(99): Xaa can be any naturally occurring amino acid
MATSMGIMDSAYIAGRNEILRXINDRPKLSFTRIDQAASGALLWLMMAMTYPRVVPMHKVYFEVKTEYDMIQNYKVIQDVFSKLKIEKHIEAGKHVKGXPLDNLEFLQWLKRYCDSVNGGIMNENYNPVERRIKGGKDRNVKSLKSSKSLQTNTMNHSGSGDSLRSKQLRSSGGADGVNSSAEIQALSKQVSDLKLSVDHLEKERDFYFAKLRDIEILCQASELENDPMSLAIKKILYAADAKGSALDEAQEYLNDVINGGEDEAEAEAEAEVETEA

SEQ ID NO: 2696 - protein, 124 aa, Glycine max
  misc_feature (3)..(5): Xaa can be any naturally occurring amino acid
  misc_feature (79)..(81): Xaa can be any naturally occurring amino acid
  misc_feature (85)..(86): Xaa can be any naturally occurring amino acid
  misc_feature (102)..(103): Xaa can be any naturally occurring amino acid
MIXXXLVNLSLLLGAILSFGVIWPLIDRRKGDWFPTNLDESNMKALYGYKVFLTVALILGDGLYNFVKILVSSILSVHXXXKNRXXASSADQQRDNAEELKXXEVFLRDNISMWIGTGGYIVLS

SEQ ID NO: 2697 - protein, 323 aa, Glycine max
MELQCAIKKDATELIGNTPMVYLNNIVEGCMARIAAKLESMQPCFSIKDRTAFSMIKDAEDKGLITPGKSVLVEATSGNTGIGMAFVATLKGYKVIVAMPASVSLERKIVLGAFGAEVYLTDPTKGTNAVLRKAEEIVNNTPGSYMLRQIDNPANPKIHYETTGPEIWRDSGGKVDALVAGVGTGGTITGAGRLGKERNPNVKLYGIEPVESAVLSGGPPGDHLIQGIGNGLIPSVLDFNLLDEVIQISSEEAIETAKLLALKEGLLMGISSGAAAAAAIKLGKRPENAGKLIVVVFPSYGERYLSSPLFESIRHEAEQMTFD

SEQ ID NO: 2698 - protein, 202 aa, Glycine max
ICFLSFLPFPSISCRHFVPNLTIGAPVIESLRKHTKAYLDCHLMVTNPLDYVEPLAKAGASGFTFHVETSKDNWKELIQRIKSHGMIPGVALKPGTPVGEVYPLVEAENPVEMVLVMTVEPGFGGQKFMAETMDKVRILRKKYPSLDIEVDGGLGPSTIDVAASAGANCIVAGSSVFGAPEPAQVISLLRSSVEKAQQTSIQ

SEQ ID NO: 2699 - protein, 398 aa, Glycine max
  misc_feature (90)..(90): Xaa can be any naturally occurring amino acid
  misc_feature (123)..(123): Xaa can be any naturally occurring amino acid
  misc_feature (131)..(131): Xaa can be any naturally occurring amino acid
SVALWSVERLSYLSFKSILKFKPCPRKTTKTKFSDKKADEEVVVVNASTWIDDGFEFDPEECKEANGKWECNHSIKPLYSDISCPYIDRXLPWGKNGRNDSDFRHWEWQPEDCALPRFHPRAXAANLVGGXATLHKGNPWESFVCLVEWVIPHKHKSMQLGRVHSVFTAKAYNATIEFYWAPYLVESNSDIDIIDIKKRIIKVDAIAERAKDWTGVDILVFNTYVWWMSGIRIKTIWGSFANGQEGYEEFDTPVAYKLALKTWANWIDSTINPNKTRVFFTTMSPTHTRSQDWGNMEGVKCFNETKPVRKKKHWGTGSDKRIMSVVAKVTKKMKVPVTFINITQISEYRIDGHCSVYTETGGKLLTEEERANPQNADCIHWCLPGVPDTWNQILLAML

SEQ ID NO: 2700 - protein, 559 aa, Glycine max
MFGLIGRKASLLGGSGRRRRWLSFAAAAAATTTTNGGAMEELLSQLQSHVQKALAGGGPEAVKRNTSRNKFLPRERIDRLLDPGSSFLELSQLAGHYLYEEPLPSGGVVTGIGPVHGRLCMFVANDPTVKGGTYYPITVKKHLKAQGDLLLQCKLPCIYLVDSGVAFLNKQAEMLPDREKLGTIFYNQSVMYAKGNPQIALVLGSCTAGGAYIPAMADESVMVKRHVYIFLAGPPLVKAATGEEVSAEDLGGATVHCKTSGVSDYFAQDELHALALGRNIIKNLHMAGKDVLANGLQNINYEYKEPLYDINELRSIAPTDLRQQFDIRSVIDRIVDGSEFDEFKKLYGTTLVTGFARIFGQPVGIIGNNGILFNESALKGAHFIELCTQRNIPLVFLQNITGFMVGSRSEANGIAKSGAKMVMAVSCAKVPKVTIMVGGSFGAGNYAMCGRAYSPNFLFLWPNARISVMGGAQAAGVLAQIEKGNKKRQGIQWSKEEEDKFKGKVVEAYEREASPYYSTARLWDDGIIDPADTRKVIGLSISASLNRDIQNTKYGVFRM

SEQ ID NO: 2701 - protein, 574 aa, Glycine max
MLGRAAFSRTGSFRPENLGQNAMAMIGNVCFSFFVIGVLVFTIMAATYEPEDPLFHPSTKITTFLTSKSNATFKSDNSVVRTGEDFMAANETAFGSIINSTDVDNLASAEIIDAGDAAAATQCDVSGPIDCKDPEVFHLMMRATIDKFQDIHFYRFGKPAPGSNDSTCDMATCDMAWRFRPKEGKAAAFYKDNRRFVIDRSANCSLSVVSIGEYHTGVNARKRKKHQKAGLEKTPLDMYQANTLPVVGEIVNDSLPVVESESSFSHGKYLLYEGGGDRCKSMNHYLWSFLCALGEAQYLNRTLIMDLSICLSSIYTSSKQDEEGKDFRFYFDFEHLKEAASVLDKEQFWADWNQWQQKDGMSLHLVEDFRVTPMKLMDVKDALIMRKFGSVEPDNYWYRVCEGETESVVQRPWHLLWKSRRLMDIVSAISSKLNWDYDSVHVVRGEKARNKELWPNLDAHTSPDALLSTLRDKIDEGRNLYIATNEPDTSFFDPLKDKYTTHFLDEYTELWDENSEWYSETTKLNNGIPVEFDGYMRVSIDTEVFFRGKKQLETFNDLTSDCKDGINTCNVAAN

SEQ ID NO: 2702 - protein, 211 aa, Glycine max
MAAGALVLALVAALAVALAGANSEGDALSALRRSLRDPGGVLQSWDPTLVNPCTWFHVTCDRDNRVTRLDLGNLNLSGHLVPELGKLEHLQYLELYKNNIEGTIPSELGDLKNLISLDLYKNNVSGTIPPTLGKLKSLVFLRLNGNRLTGPIPRELAGISSLKVVDVSGNNLCGTIPTTGPFEHIPLSNFERNPRLEGPELQGLAVYETNC

SEQ ID NO: 2703 - protein, 431 aa, Glycine max
  misc_feature (98)..(98): Xaa can be any naturally occurring amino acid
MVLSWTRRNVFRRAKKEKEQSQLEVEVVIPNHFRCPVSLELMTDPVTLSTGITYDRVSIEKWIEGGNRTCPVTNQVLTTFDLIPNHAIRMMIQDWCVXNSSYGIDRIPTPRIPISAYEVSDTCTRILSACQRGDDKRCQELVGKIKVWSRESERNKRCIVGAGAGAVLAYAFDCFSSNSIEKHVVVLEEVLEVMTWMIPFGEEGVSKLSSGASLNSLVWFLEGKDLASRQSAALLLKEVCVQELAKVGKVVEALVKMVREPIGSTSTKACLATIFNLVSLAANREGIAQRFVELGLVSLLLEAIVDGEKGVCEKALGVLDCICDCEKGKEVVKSNALALPLVVRKLLRVSPLASGFAVSILRKICDKREEGILIEALQVGLFQKLLVLLQVGCDESTKENATGLLKLLNGYRNKAECTDSSLNFEHLKKPF

SEQ ID NO: 2704 - protein, 489 aa, Glycine max
MAVPATVAAVPASLYVGDLHSEVVDHHLFEAFAEFKTMDSVRVCRDRVTMKSLCYGYVNFKSQQDAIRAMKLKNNSYLNGKVIRVMWSHPDPSARKSGRGNVFVKNLAGSIDNAGLHDLFQKYGNILSSKVVMSGDGKSKGYGFVQFESEESANNAIEKLNGSTVGDKQIYVGKFVRKGDRILPGYDAKYTNLYIKNLDSDITEALLQEKFSSFGKIISLVISKDDNGLSKGFAFVNYENPDDARKAMEAMNGLKFGSKNLYVARAQKKAEREQILHRQFEEKRKEQILKYQASNLYVKNIDDDVTDKELRDLFSSCGTITSVKVMRDDKGISKGFGFVCFSNPEEANKAVRSFNGCMFHRKPLYIAIAQRKMDRKTQLNLHYAPQQTGLDGSSTPVIPGGFPPYFYHSVASQMFQSGLLYQPLGLRSGWRANDSVPPTRSFQQSQVPNFTRHHRQNRSRMNGNVNSLGKAHSGVYIPQYYQAVEYLAV

SEQ ID NO: 2705 - protein, 206 aa, Glycine max
MMEKGSVVEAAVTRSPMQMKMGDHELEGNTTSALRTAETFLRLFPVGLCVSALVLMLKSSQQNEYGSVDYSDLGAFRYLVHANGICAGYSLFSAVIAAMPCPSTIPRAWTFFLLDQVLTYIILAAGAVSTEVLYLAENGDAATTWSSACGSFGRFCHKVTASVAITFVAVFCYVLLSLVSSYKLFTKYDAPASRPTEAIEVAAFPG

SEQ ID NO: 2706 - protein, 154 aa, Glycine max
  misc_feature (137)..(137): Xaa can be any naturally occurring amino acid
MDGSKAKKVAAKKFGGPRKKSVTKSIKAGLQFPVGRIGRYLKKGRYAQRVGSGAPVYLAAVLEYLAAEVLELAGNAAKDNKKSRIVPRHLLLAIRNDQELGRLLSGVTIAHGGVIPNINPVLLPKKAAEKAEKAGRXPKSPKKTAKSPKKATKA

SEQ ID NO: 2707 - protein, 404 aa, Glycine max
PRVRSYASNEIKLHLEVEINGVDQSRLSECSGESNALVKGIQIDTKQNCCQYDVEVEDSINKKDCGNVGEDIQQHQDIGLDAYTESVYGILDLNSVQKMFLKGMSSFGSTDSDIAEIYQCSGASMQARWELFQKQAELTKKNHGEANIRYAWLASSKGELSTMMNYGLSHYGLSGSKCTYGIGVHLAAVTCPDASVRYCDVDENGVRHLALCRVIMGNMEILQPGTGQFHPSSCEYDNGVDSIECPRYYVVWNMNMNTHIYPEFVVSFKVSSDAEGHFCGSEGKNVSGVNSACQGPHGLLHSESSTVDNGKAPSMVASTPKVPKSPWMPFPLLLDAIRNQVPPKGMDVIKIYYEQFRSKHISRDDFVKMLRLIVGDGLLRTTITNLQFKIPSGGELKGSIKKEV

SEQ ID NO: 2708 - protein, 681 aa, Glycine max
MLLKLLPLLVFLLIPVSSQPNQLFYAGFKGLGSNNMTLDGVAEIEPNGVLKLTNDSSKVMGHAFYPTPFRFKNSSGGKAFSFSSSFALAIVPEFPKLGGHGLAFTIAPSKDLKAHPSQYLGILDSSNIGNFSNHLFAVEFDTAKDFEFGDIDDNHVGIDINSLASNASASAGYYTGDDDSSKQNLTLQSRVPILAWVDYDAAKSVVHVTISASSTKPKRPLLSYHVDLSPILKESMYVGFSASTGLLASSHYILGWSFKINGPAPPLDLSSLPQLPGPKKKHTSLIIGVSVSVVVLALCAVLFGIYMYRRYKNADVIEAWELEIGPHRYSYQELKKATKGFKDKELLGQGGFGSVYKGTLPNSNTQVAVKRISHDSNQGLREFVSEIASIGRLRHRNLVQLLGWCRRLGDLLLVYDFMENGSLDKYLFNEPETILSWEQRFKVIKDVASALLYLHEGYEQVVIHRDVKASNVLLDGELNGRLGDFGLARLYEHGTNPSTTRVVGTLGYLAPEVPRTGKATPSSDVFAFGALLLEVACGLRPLEPKAMPEDMVLVDCVWNKFKQGRILNMVDPKLNGVFNEREMLMVLKLGLLCSNGSPTARPSMRQVVRFLEGEVGVPDELRKPGEGGYQEGFDEFLHSLESSSFDQMNTGSYGRNRDMDSSFPSLTGTSLFSPHGKGQTM

SEQ ID NO: 2709 - protein, 375 aa, Glycine max
  misc_feature (189)..(189): Xaa can be any naturally occurring amino acid
  misc_feature (202)..(202): Xaa can be any naturally occurring amino acid
MNKTMEENEKAFNVNGREVIPLLAPFKMGKFNLSHRIVLAPLTRTRSYNFMAQPHAALYYSQRTTKGGFLIGEASGVSDTAQGYPNTPGIWTREQVEAWKPIVRAVHENGGIFFCQLWHAGRVSNYVYQPNGEPPISSTNKAVQGSSTQYPPPRRLRTDEIPEIVNDFRMAAKNAIEAGFDGVEIHGSXGYLLEQFLKDKVXDRDDEYGGSLENRCRFPLMVVKAVCDDIGADKVGVRLSPFANYCNCVDSNPQALGIYMAQSLSQLGILYCHVIEPRMLTMFEKHETDVSLLPIRKAFNGTFIVAGGYNRSEGNRVIANGGADLVAYGRLFLANPDLPKRFELDVELNKADRSTFYTTDPVVGYTDYPFLENDC

SEQ ID NO: 2710 - protein, 87 aa, Glycine max
AVPKGHLAVYVGEEDGQFRPVLIPVIYFTHPLFSDLLREAEKKFGFEHPGGITIPCRLPEFERVKTRIASGSGQRGRTRRLGWRLHY

SEQ ID NO: 2711 - protein, 341 aa, Glycine max
MSHLQGYDPSCLREFILEILGRSSPYGNAGLQILDRNWGAGWHLLSLLLATKPSQRISCLDALRHPFLCGPRWRVVPSMDIIRWGLGSTAMRIREKYIYRQPQQSRLAHFIDLMEMLNPHPQPRNWLELLPGKWRLLYSTGKHVGLTLRQPPLRVLVSDVHLTVTRESKLKDNLSFGSDIGFSVMIGQDWPHDKAGKSGRLQVNSLFTLRSGRRLYLKQDKTTEKFFFGPSSNVEALAQKFKGKKWRKIVPFKEFPSSLPAAKLASGDIDVRMNLDDPLNRNVDTARNVLQELRTQIPPEIFDLSRLVCGTYVDSRMLVLRGVNGSALLFTRSFVDRNGSS

SEQ ID NO: 2712 - protein, 150 aa, Glycine max
  misc_feature (114)..(114): Xaa can be any naturally occurring amino acid
  misc_feature (120)..(120): Xaa can be any naturally occurring amino acid
KSKASFPTRRHNNDIHSIASNVERVQSMQAWPPDGRQKCETLSYLPDIDHAQLATEVEYLFRKGCIPCMEFELEHGFVHREHDRSAGSFDGGSWTTCKMPTFGCTEASQVFKEXLYRVRXACPYGFIRIIGIVNVRRVQGIGFFADKPTG

SEQ ID NO: 2713 - protein, 164 aa, Glycine max
LSLFVTQKYWVEKKSNGNCFMLYARALSITWAEFKTLTTGHVGTIIELAKLKKVCWLEVRGKFDIRKLLPGILYQVSFLIMLEDSSEGWEVPINVRLVLPGGKRQQHKENLNEKLRESWMEILVGEFVASEKDVGEMEISMYEHEGGMWKTGLVIEGVAIKPKN

SEQ ID NO: 2714 - protein, 396 aa, Glycine max
LELMKDPVIVSTGQTYERTCIEKWLQAGHGTCPKTQQTLTSTVLTPNYVLRSLIAQWCEANGIEPPKRPSDLQPSKSASAYSPAEQSKIESLLQKLTSVSPEDQRSAAGEIRLLAKRNADNRVAIAEAGAIPLLVGLLSVPDSRTQEHAVTALLNLSIYENNKGSIVSSGAVPGIVHVLKKGSMEARENAAATLFSLSVIDENKVTIGSLGAIPPLVTLLSEGNQRGKKDAATALFNLCIYQGNKGKAVRAGVIPTLMRLLTEPSGGMVDEALAILAILASHPEGKATIRASEAVPVLVEFIGNGSPRNKENAAAVLVHLCSGDQQYLAQAQELGVMGPLLELAQNGTDRGKRKAGQLLERMSRLVEQQQEVPIQTETQAQNEDTQPPLITNPDDS

SEQ ID NO: 2715 - protein, 346 aa, Glycine max
MAHPTSSSGQSNDLTKEDCKETSSVVVCFGEMLIDFVPMVGGVSLAEAPAFKKAPGGAPANVAVGISRLGSSSAFIGKVGADEFGYMLADILKQNNVETSGMRFDSNARTALAFVTLRADGEREFLFFRNPSADMLLQESELDKDLLKKARIFHYGSISLIDEPCKSAHLAAMSIAKNSGCILSYDPNLRLALWPSADAARKGIMDIWDQADVIKISEDEITFLTGGDDPYDDNVVLKKLFHPNLKLLIVTEGSQGCRYYTKAFKGRVSGVKVKPVDTTGAGDAFVSGILHCIASDQTIFQDEKRLRKALYFANVCGALTVTQRGAIPALPTKEAILQFLLEAAVI

SEQ ID NO: 2716 - protein, 379 aa, Glycine max
MSTAGQVIKCRAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 2717 - protein, 346 aa, Glycine max
  misc_feature (173)..(173): Xaa can be any naturally occurring amino acid
  misc_feature (175)..(175): Xaa can be any naturally occurring amino acid
  misc_feature (196)..(196): Xaa can be any naturally occurring amino acid
  misc_feature (209)..(209): Xaa can be any naturally occurring amino acid
  misc_feature (216)..(216): Xaa can be any naturally occurring amino acid
MAHFTSSGKSDNLTKEDCIGKSALVVCFGEILIDFVPTVCGVSLAEAPAFKKAPGGAPANVAVGISRLGGSSAFVGKVGADEFGYMLVDILKKNNVETSGMKFDPNARTALAFVTLRADGEREFLFFRNPSADMLLQESELDKNLIKKAKIFHYGSISLIDEPCKSAHLAAMXLXKESGCIPSYDPNLRLALWANXWKAARDGIKWVYXGGSKAGXVLKISEEEITFLTGGDDPYDDNVVLNKLFHPNLKLLIVTEGSEGCRYYTKEFKGRVAGVEVKPVDTTGAGDAFVSGIIYSLASDQSLFQNEEHLRKALYFANVCGAITVTERGAILALPTKEAVFQFAAT

SEQ ID NO: 2718 - protein, 157 aa, Glycine max
  misc_feature (104)..(104): Xaa can be any naturally occurring amino acid
  misc_feature (139)..(139): Xaa can be any naturally occurring amino acid
GIRHEAGAGMVAPFTGLKSMAGFPTRKTNNDITSIASNGGRVQCMQVWPPVGKKKFETLSYLPDLDDAQLAKEVEYLLRKGWIPCLEFHLEHGFVFREHNRSPXYYHGRYWTMWKLPMCGRTVASQVVKELKEDKTECXSGFIRVIGCTTAPSAVFE

SEQ ID NO: 2719 - protein, 138 aa, Glycine max
MVLTSISIVSSSSSFLSDSPSTSSPTTRIRPFFFHSSNRAPLFVFPRAHLPSATLRASSSSVSTPHENGSPEQFLKSNSIADFLRFKRRADGGVSAELQTALVSYKKRFPWSLMRPFLQVDLVSTIHIADEEYVFCLS

SEQ ID NO: 2720 - protein, 206 aa, Glycine max
  misc_feature (111)..(111): Xaa can be any naturally occurring amino acid
  misc_feature (185)..(185): Xaa can be any naturally occurring amino acid
  misc_feature (187)..(187): Xaa can be any naturally occurring amino acid
MKFGKEYTSQMVPEWQEAYMDYNFLKSHLKEIQRFRQRTKPPTATPRGLRRKLTLYRAFSGLTQQKHYQQLSPSEHDIESQPIMVHSVNNHDGYEKYQTTFLMTSEEGGEXYELVYFKRLDDEFNKVGKFYRSKVEEVMTEAAILNKQMDALIAFRIKVENPTGSFDRSIEMTRLASDVASSSAXLXASTPKGAKLNSNSFFQPFN

SEQ ID NO: 2721 - protein, 128 aa, Glycine max
MSLKMAILILGLLAMFLLVSSEVASTNSKEVTNGVEDAKYPGGGYGGGYPGNGGGGYPGRGGGYPGRGGGYPGRGGGYPGRGGGYPGRGGGYCRYGCCGGRTYNGGCRRCCYYAGEAVAAQTQDKTHN

SEQ ID NO: 2722 - protein, 474 aa, Glycine max
  misc_feature (130)..(132): Xaa can be any naturally occurring amino acid
MQTLNEVSQTCPQCCCCSCTTPFFNSPTSQQHNTAPKIRNSSAEWRHSFAVTTTSSIFPNTQFTNHESLPSLHESFNEFTKAYTQYSETEQVDHVRAKDYSHLSLSNQTCLDYIGIGLFSYSQLEHHETXXXQVPSSYSDIPFFSLSCKTGSLKTLLLHGGQDSEFEAAMRKRIMCFLNISENDYFMVFTANRTSAFKLVADSYQFQTSRRLLTVYDYESEAVEAMISSSKKRGARAISAEFSWPRLRIQTTKLRKMIERKRKKKKRKGLFVLPLSSRVTGARYPYLWMSIAQENGWHVLVDACALGPKDMDCFGLSLFQPDFLICSFYKVFGENPSGFGCLFIKKSAISSLESSSSAGIVNLVPEKQPHQLSDDSSGTDLEIKNKSLPTCLHEEKPFPLSSFSGPMQTKQSETVEEGEPPDSKLKAPQCSEIEEVQQEPVQTPKTSNVQESDIQFRCLDQVDSLGLILITNRS

SEQ ID NO: 2723 - protein, 149 aa, Glycine max
  misc_feature (82)..(82): Xaa can be any naturally occurring amino acid
  misc_feature (117)..(117): Xaa can be any naturally occurring amino acid
MIKSPRPTRAEATDVANAVLDGTDCVMLSGETAAGAYPELAVQTMAKICLQAESCVDYSAVFKSIMSSAPIPMSPLESLASXAVRTANSAKATLILVLTRGGTTARLVAKYRPSMPXLSVVVPELKTVEFDWICSDEGPARQSLIVRGV

SEQ ID NO: 2724 - protein, 107 aa, Glycine max
  misc_feature (92)..(92): Xaa can be any naturally occurring amino acid
MASSMISSPAVITVDRACAGMVAPFTGLKSMAGFPTRKTSNDITSIAINRGKVHCMHVLPPIGNKMFETLSYLPYLDDAQLAKEVEYLLMKXWIPCLEFELEHRFAY

SEQ ID NO: 2725 - protein, 168 aa, Glycine max
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHALKEVKC

SEQ ID NO: 2726 - protein, 622 aa, Glycine max
MKTEKNSGSASKGKVRKKMETCIIKVLNFSTKKGDVYKAEPPLDLKEAFSKFARGENQMKKDQLLRFMVEHQGENISTIEDLDKIVEKFLQLGSSCSSTKTSSTRIVDVYRKQGLSLNDFIDFLLLGDFNGPLKDEVHHDMDAPLSHYFMYTGHNSYLTGNQLTSESSDEPIIEALKQGVRVIELDLWPSKSSNNDGIKVVHGRTFTTSVPVSKCLQSIKDYAFHKSDYPVILTLEDHLTPKHHDKFAKMATEIFGETLYFPETDHLTEFPSPESLKKRIIISTKPPKECRQSAIISKPVPNGREPSEEESRGLELPSSVAKLKTEDRNSSDEDQEDVNTSDNKPNQQDARQYKHLIAIHGGKSKGSMKNRLKDDIKVRRLSLSEKKLKSASESHGADLIRFTQRNILRVFPKGERVQSSNFRPYLGWLYGVQMVAFNMQGHGKSLRLMRGMFKANGGCGYVKKPEFLIRTLPHEEVFDPKKPPSVKQILKVKVYKGDGWSLDFSPTDFDRFSPPDFYTEVSIVGVPADCDKNKTRVKTDTWYPVWDEEFEFKLRVPELALLRIEVKDKDKGKKDDFAGQTCLPISELRNGFRSVPLYDRKGKKYKSVTLLMRFKLETLNKL

SEQ ID NO: 2727 - protein, 175 aa, Glycine max
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIDFQPPGCEESAKA

SEQ ID NO: 2728 - protein, 118 aa, Glycine max
  misc_feature (113)..(113): Xaa can be any naturally occurring amino acid
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKXNGERE

SEQ ID NO: 2729 - protein, 379 aa, Glycine max
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHSKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 2730 - protein, 133 aa, Glycine max
MSYRRDNRSSRSSLVDGFDSLEEGGLRASSSYSREINEHDNDKAIESLEDRVSFLKRLTGDIHEEVESHNQLLDRVGIKMDGSRGMMMGTMDRFKNVTFFFFFSVLCSLVVYFTLAFIFIYYLIRMLGYFTLG

SEQ ID NO: 2731 - protein, 450 aa, Glycine max
  misc_feature (236)..(236): Xaa can be any naturally occurring amino acid
  misc_feature (253)..(253): Xaa can be any naturally occurring amino acid
MAVSAITGARLTLGMSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTAAIEKLLTLVXGEIAAVFLEPVVGNAGXNNTLLVFDEVMTGFRLSYGGAQEYFGITPDITTLGKIIGGGLPVGAYGGRRDIMEKVAPAGPMYQAGTLSGNPLAMTAGIQTLQRIKEPGTYEYLDKITGELLVEGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 2732 - protein, 214 aa, Glycine max
  misc_feature (78)..(78): Xaa can be any naturally occurring amino acid
  misc_feature (153)..(153): Xaa can be any naturally occurring amino acid
  misc_feature (201)..(201): Xaa can be any naturally occurring amino acid
  misc_feature (206)..(206): Xaa can be any naturally occurring amino acid
MAVSAITGARLTLGIGLAIPLSSPTRSRTVAMAVSVDPKTDNKLTLTKSEEAFAAAKVRMTSLFLPSFLLSILIFDFXFQELMPGGVNSPVRAFKSVGGQPIVIDSVKGSRMWDIDGNEYIDYVGSWGPAIIGHADDQVLSALVETMKKGTSXGAPCLLENTLAELGINAVPSIEMVRFVNSGTEACIGAQRLARAYTGRXKIIKXEGCYMAML

SEQ ID NO: 2733 - protein, 466 aa, Glycine max
MAVSAITGARLTLGMSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTEAIEKLFEANKGEIAAVFLEPVVGNAGFIVPKPDFHSFLRKITKENNTLLVFDEVMTGFRLSYGGAQEYFGITPDITTLGKIIGGGLPVGAYGGRRDIMEKVAPAGPMYQAGTLSGNPLAMTAGIETLQRIKEPGTYEYLDKITGELVEGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 2734 - protein, 493 aa, Glycine max
  misc_feature (465)..(465): Xaa can be any naturally occurring amino acid
SYVGPPPPPPIQCNDCLDGAISRIPHCCNITFCGGGVRPSCNIAYCGGVIRPSCNIRFENYRFYNHTTMLDPEIPPSWPASPPFADISPEPEESGNTIVIVISIVVPTVVVVLLICLRLYLRRRKARKNLGVKEDEVEDEIKIAESLQFNFNTIQVATEDFSDSNKLGQGGFGAVYRGRLSNGQMIAVKRLSRESGQGDTEFKNEVLLVAKLQHRNLVRLLGFCLEGKERLLVYECVPNKSLDYFIFDPTKKAQLDWEKRYKIITGVARGLLYLHEDSRLRIIHRDLKASNILLDEEMSPKIADFGMARLVLVDQTQANTSRIVGTYGYMAPEYAMHGQFSVKSDVFSFGVLVLEILSGQNNSGIHHGENVEDLLSFAWRSWKEGTAINIVDPSLNNNSRNEMMRCIHIGLLCVQENLADRPTMATIMLMLDRYSLSLPIPAKPAFYMNSRTESLPDMQSWEYNXRETGSSESIIKSAQESENEASITKQYAR

SEQ ID NO: 2735 - protein, 206 aa, Glycine max
  misc_feature (163)..(163): Xaa can be any naturally occurring amino acid
  misc_feature (172)..(172): Xaa can be any naturally occurring amino acid
MGVTPKIAPSMLSSDFANLASEAQRMLHFGADWLHMDIMDGHFVPNLTIGAPVIESLRKHTKGYLDCHLMVTNPLDYVEPLAKAGASGFTFHVETSKDNWEELIQRIKSHGMTPGVALKPGTPIEEVYPLVEAGNPVEMVLVMTVEPGFGAQKFMAVMMDKVXRILRIKYPXFTVAGSSVFGAPEPVQVISLLRNSVEKAQQTLIQ

SEQ ID NO: 2736 - protein, 221 aa, Glycine max
  misc_feature (217)..(217): Xaa can be any naturally occurring amino acid
MGVTPKIAPSMLSSDFANLASEAQRMLHMDIMDGHFVPNLTIGAPVIESLRKHTKGYLDCHLMVTNPLDYVEPLAKAGASGFTFHVETSKDNWEELIQRIKSHGMTPGVALKPGTPIEEVYPLVEAGNPVEMVLVMTVEPGFGGQKFMPEMMDKVRILRKKYPSLDIEVDGGLGPSTIDVAASAGANCIVAGSSVFGAPEPVQVISLLRNSVEKAQXTLIQ

SEQ ID NO: 2737 - protein, 346 aa, Glycine max
LEPLGVVGHITPWNFPNTMFYIKVAPSLAAGCTMVLKPAEQTPLSALFNAHLAKLAGIPDGVINVVPGFGPTAGAALSSHMDVDKVSFTGSTQTGREIMQAAAKSNLKQVSLELGGKSPLIIFDDADIDKAAELALLGILYNKGEVCVASSRVLVQEGIYDEFEKKLVEKAKAWVVGDPFDPKVQQGPQVDKEQFEKVLSYIEHGKKEGATLLTGGKTVGNKGYFIEPTIFSNIREDMLIAQDEIFGPVMALKKFKTIEEAIKSANNTKYGLAAGIVTKNLDTANTVSRSIRAGTIWINCYFAFGDDVPFGGYKMSGFGKDHGLEALHKYLQVKSVVTPLYNSPWL

SEQ ID NO: 2738 - protein, 267 aa, Glycine max
FGSSFHGRTLGALALTSKVQYRMPFEPVMPGVTFLEYGNAQAAVELIKQGKIAAVFVEPIQGEGGIYSATKEFLQSLRNACDETGALLVFDEVQCGLGRSGFLWAHEAYGVFPDMMTLAKPLAGGLPIGALLVTERVASAINYGDHGSTFAGSPLVCSAALAVLDKISKPDFLSSVSKKGLYFKELLREKLGENRHVKEIRGVGLIIGIDLDVPASPLVDACRSSGLLVLTAGKGNVVRLVPPLIITEKELEQAAGILCQTLPVLDN

SEQ ID NO: 2739 - protein, 632 aa, Glycine max
  misc_feature (91)..(91): Xaa can be any naturally occurring amino acid
  misc_feature (284)..(284): Xaa can be any naturally occurring amino acid
MAVPPSVAAAPASLYVGDLHPNVSDNHLVDAFSDFESLASVRVCKDSSTGKSLCYGYVNFVSPQDAIRAIELKNNSTLNGKAMRVMWSRRXPDARKNAIGNLFVKNLPESIDNTGLQDMFKKYGNILSSKVVMSEDGKSKGYGFVQFESEESSNVAIEKLNGSTVGDKQLYVGKFVKKSDRILPGPDARYTNLYMKNLDLDVSEATLQEKFSSFGKIVSLVIAKDNIGMSKGFGFVNYDNPDDAKKAMEAMNGSKLGSKILYVARAQKKAEREQILHHQFEEKXSEQILKYKGSNIYVKNIDDHVSDEELRDHFSACGIITSAKIMRDDKGISKGFGFVCFSTPEEANKAVNTFHGFMFHGKPLYVALAQRKEDRKAQLQLQYAQQVAGLSGPSTAIIPGGYPPYYYAATGVISHVPPRAGLMYQHLPMRPGWGANGFALPARSFQQSPVPAVSNNTRQHRQNRGRLNGNPIAQGNTHSVTYLPQAQQISQPVISSSTQQRTGQAKYLPSGRQRDMEKGSGSSSSGSNSGRGSQGSEMLHSMLAGAAPEQQKEILGEHLYMLVHKLKPTLAAKITGMLLEMDNGELLLLLESPESLSAKVEEAVQVLKNSKTKVSGQDVLHSNFLSAEVAVN

SEQ ID NO: 2740 - protein, 148 aa, Glycine max
MAEHLFEDIFHVTRIDPDGKKFDRVNRIEARSEQLEMYMQLDIATDVYPMHMGDKFTMVLAPTLNLDGTPDTGYYTQAGRKTLADKYDYVMHGKLYKISEDNSSKDKGPTKVEIYASFGGLLMLLKGDPSSAANLELDQRLFLLIRKV

SEQ ID NO: 2741 - protein, 639 aa, Glycine max
  misc_feature (39)..(39): Xaa can be any naturally occurring amino acid
HASAVIITTGKTEIVTATSSKALKDVAYSGSEDEEEERXTTNPDAKKAEPFMSKTTLRSDNHEVSKEELRRQHQAELARQKNEETARRLAGGGSETGESRSSARTSAELMAYKNINDLPPPREMMIQIDQKNEAVLLPINGSMVPFHVAFIRTVSSQQDTNRNCYVRIIFNVPGTPFSPHDANSMKFPGSIYLKEASFRSKDSRHISEVVQSIKTLRRQVVARESERAERATLVTQEKLQLANNRFKPIRLSDLWIRPAFGGRGRKIPGTLEAHVNGFRYSTTRQDERVDIMFPNIKHAFFQPAENEMITLLHFHLHNHIMVGNKKTKDVQFYVEVMDMVQNVGGGKRSTYDPDELEEEQRERQRKNKINVEFQTFVNRVNDLWGQPQFNGLDLEFDQPLRELGFPGVPHKSSVFIVPTSACLVELIETPFLVVTLSEIEIVNLERVGLGQKNFDMTVVFKDFKRDVLRIDSIPSTSLDGIKEWLDTTDIKYYESRLNLNWRQILKTITDDPQSFIEGGGWEFLNLEATDSESENSEESDKGYEPSDVEPESDSEDEASDSESLVESEDDDDDEDSEEDSEEEKGKTWEELEREASNADREKGNESDSEEDRKRRKAKSFGKSRGASLSSSMPKRSKLR

SEQ ID NO: 2742 - protein, 562 aa, Glycine max
  misc_feature (152)..(152): Xaa can be any naturally occurring amino acid
MAQVVASRSIQSTPLCPTSGSARDRTQNLLKPPSFASKVFPLGENNNKRSKLRLRSLQISARKSAPSEVIPMSPEDDPKIEEHLQHLRGVQPFGENSVGMWSKPTFRRKTKIVCTIGPSTNTREMIWKLAEAGMNVARLNMSHGDHASHQKXIAIMLDTKGPQVRSGDLPQPINLTTGQEFTFTIRRGVGTADCVSVNYDDFVNDVDVGDMLLVDGGMMSLVVKSKTEDSVKCEVVDGGELKSRRHLNVRGKSATLPSITEKDWDDIKFGVDNKVDFYAVSFVKDAQVVHELKNYLKSCDADIHVIVKIESADSIPNLHSIITASDGAMVARGDLGAELPIEEVPLLQEEIITICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETFTRALDLLQKQGMVKSGEEVALVQSGTQPIWRFQSTHNIQVRTV

SEQ ID NO: 2743 - protein, 578 aa, Glycine max
MSHVVVTRSIHTSLTRPTSGSAHHRAQTLLKPPTFASKVFPQQRNNPSKVCSRSCLVNARKSAPTEVVPVSPEDDSKIEEELQHSRGMRQLGDTSVGMWSKPTFRRKTKVVCTIGPSTNTREMIWKLAEAGMNVARLNMSHGDHASHQKIIDLVKEYNAQSKDNVIAIMLDTKGPEVRSGDLPQPINLTTGQEFTFTIRRGVGTADCVSVNYDDFVNDVDVGDMLLVDGGMMSLVVKSKTEDSVKCEVVDGGELKSRRHLNVRGKSATLPSITEKDWDDIKFGVDNKVDFYAVSFVKDAQVVHELKNYLKSCDADIHVIVKIESADSIPNLHSIITASDGAMVARGDLGAELPIEEVPLLQEEIISICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETFTRALDLLQKQGMVKSGEEVALVQSGRQPIWRFQSTHNIQVRTVKTK

SEQ ID NO: 2744 - protein, 580 aa, Glycine max
MAQVVASRSIQSTPLCPTSGSARDRTQNLLKPPSFASKVFPLGENNNKRSKLRLRSLQISARKSAPSEVIPMSPEDDPKIEEHLQHLRGVQPFGENSVGMWSKPTFRRKTKIVCTIGPSTNTREMIWKLAEAGMNVARLNMSHGDHASHQKVIDLVKEYNASHEDNVIAIMLDTKGPEVRSGDLPQPITLMPGQEFTFTIRRGVGTADCVSVNYDDFVNDVDVGDMLLVDGGMMSLVVKSKTEDSVKCEVVDGGELKSRRHLNVRGKSATLPSITEKDWDDIKFGVDNKVDFYAVSFVKDAQVVHELKNYLKSCDADIHVIVKIESADSIPNLHSIITASDGAMVARGDLGAELPIEEVPLLQEEIISICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETFTRALDLLQKQGMVKSGEEVALVQSGRQPIWRFQSTHNIQVRTVKTK

SEQ ID NO: 2745 - protein, 124 aa, Glycine max
MGSRARQGRRLQTMMKCMCLREPLKGEDETVPSSDSLAIREFYSSTASGRSGPDGEIEMMGSGSGNMDEAELSLRESGIMDIMGNEEARALLGKDEYQEGNIEAALHVYERINISAVTSKMKIS

SEQ ID NO: 2746 - protein, 279 aa, Glycine max
MQPFFGDRPSDYWYFVKSWEGVTGIIIVVLMAIAFTLANPRFRRGRAKLPKPFNKFTGFNAFFFSHHVFDIVYALLAVHGIKLYLTKEWYKKTTWMYLAIPITIYALERLVRAFRSSIKSVRILKVTLYPGNVLSLKMSKPHGFSYKSGQYMFVNCAAVSPFEWHPFSITSAPDDDYLSVHIKILGDWTRSLKAKFTQACQQPLNGQSGLLRAECLKGDNSPSSFPKVLVDGPYGAPAQDYREYEVVLLVGLGIGATPMISILKDMVNNFKAIDEEEGI

SEQ ID NO: 2747 - protein, 515 aa, Glycine max
MYLAIPITIYALERLVRAFRSSIKSVRILKVTLYPGNVLSLKMSKPHGFSYKSGQYMFVNCAAVSPFEWHPFSITQTPDDDYLCQNMGRMTGIIIVVLMAIAFTLANPRFRRGRAKLPKPFNKFTGFNAFWYSHHLFVIVYALLVVHGIKLYLTKEWYKKTTWMYLAIPITIYALERLVRAFRSSIKSVKILKVTLYPGNVLSLKMSKPQGFSYKSGQYMFVNCAAVSPFEWHPFSITSAPDDDYLSVHIKILGDWTRSLKAKFTQCCQQPVNGQSGLLRAECLQGDRSPSTLPKVLIDGPYGAPAQDYKQYEVVLLVGLGIGATPMISILKDIVNNMKAMEEEEGSNIEEGGASSGFGNKSPRGSSPHKKSSSSNFNTRRAYFYWVTREQGSFDWFKGVMNEVAEEDHRGVIELHNYCTSVYEEGDARSALIAMLQSLNHAKNGVDIVSGTRVKSHFAKPNWRAVYKRIAVSHPRSRVGVFYCGPPALTKQLGQLASDFSHNTNTKYDFHKENF

SEQ ID NO: 2748 - protein, 168 aa, Glycine max
LCCFQGRPKGVTPKYSLKPLVPRLSQLLGIEVTMANDSIGEEVEKLVTQLPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLEKVNVLLLGGGMIF

SEQ ID NO: 2749 - protein, 106 aa, Glycine max
SMIFFPAGTTVNRAGARMGGSFTGLKFMGGFPTKKNNHDLTFIGCNRGRIPCMPVWAPIGKKKFETLFYLPDLDDAPLGKEVEYLLRKGWISCVEFELEHRFVYRE

SEQ ID NO: 2750 - protein, 523 aa, Glycine max
  misc_feature (497)..(497): Xaa can be any naturally occurring amino acid
  misc_feature (509)..(509): Xaa can be any naturally occurring amino acid
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKLVSPSEVSVDTTEGGNTVVKGKHIIIATGSDVKSLPGITIDEKKVVSSTGALALTEIPKRLIVIGAGYIGLEMGSVWGRLGSEITVVEFASEIVPTMDAEVRKQFQRSLEKQGMKFKLKTKVVGVDTSGDGVKLTLEPAAGGDQTTLEADVVLVSAGRTPFTAELGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFLANSRAKAIDNAEGLVKILAEKETDKILGVHIMAPNAGELIHEAAIALQYDASSEDIARVCHAHPTMSEAVKEAAMATYDKXHSHLKRRLLLSXLLSFLSKNFTMTWR

SEQ ID NO: 2751 - protein, 418 aa, Glycine max
SARARAEFGSSFAKVYHARHLKTGKSVAMKVVGKEKVVKVGMMEQIKREISAMNMVKHPNIVQLHEVMASKSKIYIAMELVRGGELFNKIARGRLREEMARLYFQQLISAVDFCHSRGVYHRDLKPENLLLDDDGNLKVTDFGLSTFSEHLRHDGLLHTTCGTPAYVAPEVIGKRGYDGAKADIWSCGVILYVLLAGFLPFQDDNLVALYKKIYRGDFKCPPWFSSEARRLITKLLDPNPNTRITISKIMDSSWFKKPVPKNLMGKKREELDLEEKIKQHEQEVSTTMNAFHIISLSEGFDLSPLFEEKKREEKELRFATTRPASSVISRLEDLAKAVKFDVKKSETKVRLQGQEKGRKGKLAIAADLYAVTPSFLVVEVKKDNGDTLEYNQFCSKELRPALKDIVWRTSPAENPTLA

SEQ ID NO: 2752 - protein, 152 aa, Glycine max
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPANTILCSDGTITLT

SEQ ID NO: 2753 - protein, 99 aa, Glycine max
  misc_feature (32)..(32): Xaa can be any naturally occurring amino acid
DSHYSNGLPSTLVPERASFAANQASSKAVEVXPKGYLAVYVGERMKRFVIPVSYLTQPSFQDLLSRAEEEFGYDHPMGGLTIPCSEDVFQHITSRLNGL

SEQ ID NO: 2754 - protein, 92 aa, Glycine max
MGFRLPAIRRASFNANQSASKSAELPKGYLAVYVGDKQKRFVIPISYLNQPSFQDLLSQAEKEYGYDHPMGGLTIPCSEDVFQHITSRLNGQ

SEQ ID NO: 2755 - protein, 180 aa, Glycine max
MEEKRKMAGLLRHIAAALLFLVTAASTAGASTYYASDPNLGSARVIFQLNHGDIEFGFFPRVAPKTVEHIFKLVQLGCYNTNHFFRVDKGFVAQVADVMGGRKAPMNKEQEQQAEKSIVGEFSTVKHVRGILSMGRYSDPDSASSSFSILLGDAPHLDGQYAVFGRVTKGDDTLKKLERL

SEQ ID NO: 2756 - protein, 196 aa, Glycine max
  misc_feature (183)..(183): Xaa can be any naturally occurring amino acid
APPPHMHAALKCAKEFIDVTGGSVSKGWRLLLLVLSAQQRYSEAEVVTDAALDETAKWEQGPLLRIRAKLKVAQALPMEAVEAYRTLLALVQAQRKAYGSVKNGTEDNEDKVREVEVWHGLANLYSSLSYWRDAEICLQKAKALKTYSATTLHVEGNKHELHEKIQDAVAAYFNAISMEVEHXVPSKVSIGALLSK

SEQ ID NO: 2757 - protein, 243 aa, Glycine max
  misc_feature (23)..(23): Xaa can be any naturally occurring amino acid
  misc_feature (32)..(32): Xaa can be any naturally occurring amino acid
  misc_feature (48)..(48): Xaa can be any naturally occurring amino acid
  misc_feature (89)..(89): Xaa can be any naturally occurring amino acid
  misc_feature (107)..(107): Xaa can be any naturally occurring amino acid
  misc_feature (114)..(114): Xaa can be any naturally occurring amino acid
QCNVENIQLDISWDDVVCPTSIXVPHNSVLLXCSSYDKGCLSFVCDTXYMHSNCLDRFKKAYGMPSSASLGSVVSNCQCNLSCPLCRGXVFGWVIVDKARIHLNENXRCCEEEXCAFIGSYSELQKHAQLEHPHACPSKIDPVRQLDWKNFQQSSEIIDVLSTIHSEIPRGVVLGDYVIEYGDDDSADEFEDFPGDEGSVASVEYGEYRIDEIDDDFVSTIGYLRGGSGFRRSQRRHSRFYDN

SEQ ID NO: 2758 - protein, 239 aa, Glycine max
  misc_feature (106)..(106): Xaa can be any naturally occurring amino acid
  misc_feature (116)..(116): Xaa can be any naturally occurring amino acid
SRSAGLIGSHLCIWRRNGKRSIFPSLEGKFVKGSCMRYFDPEAVVGCDDGAVRVFDMYSRKCSQIITMHYAPITCLCLSEDQLIMSGSTSGCITTVRSFLCSAGSXLRSSDARELXKLLWSNRVSPNVIYSLQHMHSDTSTLAVGGIDGILRLLNQNDGSVVSSCVMGDKLLSTFQSPSGSIQRRKGSRLPENIYINIDLIPKTARPSITCLAVGMKKIVTTHNTNDIRLWKFKSKISL

SEQ ID NO: 2759 - protein, 436 aa, Glycine max
MSVTAGVSDTVIAVRDKLRGKIGQTKVKRYWPGKVPEWADDENEDAAPADIRPSREAALEKAFPRHQEDTAIVRKDDRRLRRLAQSRIDNREEVRADHRRIRQAEIVSTIEEEARRQEWLEFEEEDENALAERRRLIKEKLLQREQEEALPQEEEEEEEEEEEEEESEYETDSDEEYTGVAMVKPVFVPKSERDTIAERERLEAEELALEEKRKRRLEERRIETKQIVVEEIRKDEEIQKNLEMEANIADVDTDDEVNEAEEYEAWKVREIGRIKRDREDREAMLKEKEEIEKVRNMTEEERREWERRNPKPAPPPKQKWRFMQKYYHKGAFFQNESDDRAATVGSDGIFARDFSAPTGEDKMDKTILPKVMQVKHFGRSGRTKWTHLVNEDTTDWNNPWTYNDPLRAKYNDKMAAMNAPIVKPKGSRKLKDWESR

SEQ ID NO: 2760 - protein, 148 aa, Glycine max
  misc_feature (19)..(19): Xaa can be any naturally occurring amino acid
MMQYYETREKEYYDVAQGXSRQGYGQNHHQGYDQSHTRPVYGHSPTMNHRSHGGFLDGLFKSKNGQNGLGTFLEHKSHEANKGHGHGKLLGQHQKKTHETDKGVNGLGTFINNGEKKHKKQNEHKKKKNKDGHGSGNESGSSSGSDSD

SEQ ID NO: 2761 - protein, 171 aa, Glycine max
  misc_feature (40)..(40): Xaa can be any naturally occurring amino acid
MQFRLGRRVVRVAKWVFGRVRIKTRPGYHHRLGSGSSPIXKNPITTRLLTWGQKLKRGAKTLCGKNGSGYLPIGSDPLCDRAPAVPKGHLAVYVGEEDGGFRRVLIPVIYCNHPLFSDLLREAEKEFGFEHPGGITIPCRLTEFERVKTRIASGSGQRGRTRRLGWPLQHY

SEQ ID NO: 2762 - protein, 133 aa, Glycine max
FGSRQNSTGMRMAKLLEAHPKVKRVYYPGLPSHPEHELAKRQMTGFGGVVSFEIDGDLHTTIKFIDSLKIPYIAASFGGCESIVDQPAILSYWDLPQSERAKYKIYDNLVRFSFGVEDFEDLKADVLQALEAI

SEQ ID NO: 2763 - protein, 321 aa, Glycine max
  misc_feature (128)..(128): Xaa can be any naturally occurring amino acid
  misc_feature (142)..(142): Xaa can be any naturally occurring amino acid
MQLTTTGYGFTISGLYMVLGLVSVSSMEDIQLDISWDDAVCPICLDFPHNSVLLRCSFYDKGCRAFVCDTNQLHSNCLDRFKNSCGMPSSPVSNAISTENTENSDDHEVSNGQYHVTISLFSCVFFGXCIVDKARIHLDDKXRCCDEVRCTFMGSYLELQEHAQLEHPHARPSKIDPARQLDWENFQQSSEIIDVLSTIHSEIPRGVVLGDYVIEYGDDDARDEFEDFPGDEGNWWTSCILYFDNFRRSRNRRTRVSHTGRDNRRLSYDTSNSDEGSVVSMEYADYRIEEIDDDFVSTSGSSRGSSGYRRSHRRRSRFYDN

SEQ ID NO: 2764 - protein, 264 aa, Glycine max
MAALRTGTGPLGTDWRRFRRTRSITEFVTTTAVELHSLQKKKSAPTTPVTGFQAPFATLTEEERHKQQLQSISASLASLTRETGPNLVKGDPARKSDTQKVTHVHHHQEGIKEPQATFSACFGAAFIMLHPTKYAAMLAEKMQKHGATGWLVNTGWSAGSYGNGSRIKLQYTRKIIDAIHSGSLLNAEYKKTEIFGLEIPTEVEGVPSEILDPMNTWSNKKAYKETLLKLAGLFKNNFETFTNYKIGKGNNNLTEEILAAGPIF

SEQ ID NO: 2765 - protein, 118 aa, Glycine max
  misc_feature (24)..(24): Xaa can be any naturally occurring amino acid
  misc_feature (33)..(33): Xaa can be any naturally occurring amino acid
  misc_feature (46)..(46): Xaa can be any naturally occurring amino acid
GSKVFLRLTVPILGDELINTGWNXCRSCNGNPXADRHLLMVPALDXGQVYVVDVKTDPGAASWPKVAEPAIIVQKTGLANPHPSDCLAYGDIMISSLGNEDGNAAGNGSLSIDSELNV

SEQ ID NO: 2766 - protein, 493 aa, Glycine max
MDNLESRISIGLTFNDVLLVPQYSTVNSRSEIDLRTRFSKNVPLNVPIVSSPMDTVTETDMAIEMARWGGLGIVHRYNTIEDQANMISQVKRAESFVITTPYTISQSTTVRAVQALSKAYRVQTFLVTDDTHKPNELADPVQKHKLVGILTGRDLRIALNGDQLVEEIMTPRERLTTTYDPEISLKEAKSLMINNRVEKLPIITEKNDVLGLITLRDIILREQRPLANLDTFGRLRVGAAVGAKDDYLERAKKLIDVGTDVLVVDIANGHAQLCIDAVERLKEQFTVDVVAGSIASREGAENLIKAGADGIRCGIGSGAICTTRLVAGSGVPQLSAIFDAASVCNEAGVPLISDGGNGNSGNMCKALAAGADCVMVGRLIAGCDESPGQVLLKDGKRVKIYRGMAGYGANLSKAQRTNAAEPHSLNFTPEGVEGYIPYCGPLKDVLNQFAQGIKSGMSYCGSHEIMEMKKKAKFIRLSQSAIVESGVHDINKL

SEQ ID NO: 2767 - protein, 273 aa, Glycine max
MFLCWYCQKSGVHHAVNPDPYRGIFGSDGEKYARDVQDIINFGTSGNVAAFISEAIQGVGGIIELAPGYLPVVYNAIKKAGGLFIADEVQAGFGRTGSHFWGFEAHNVVPDIVTIAKGIGNGIPLGAVVTTPEIAEVLTRRSYFNTFGGNPVCTAAGLAVLKVIEKEQLQQNAFVVGSHLKERLTALKDKYELIGDVRGRGLMLGVELVTDRELKTPAKNETLHVMDQMKELGVLIGKGGYYGNVFRITPPLCFTKEDADFVADAMDLTLSRM

SEQ ID NO: 2768 - protein, 162 aa, Glycine max
  misc_feature (124)..(124): Xaa can be any naturally occurring amino acid
LNDVVSKSFVGRYFKLEARKSCFTRELRAAMATFLTMVYIITVNATIIAVSGGTCSVEDCSSPTRPDCKVKPDVGYESCLAKTKSDLVVATAVSGLIGSLAMGLIANLPLSLAPGMGPNTYFAXNLDGFHGTEPLSYQTALAVISVEGIDFLLVSAVALTGK

SEQ ID NO: 2769 - protein, 352 aa, Glycine max
FGSRQEQAARALANLAAHGDSNSNNAAVGQEAGALEALVQLTRSPHEGVRQEAAGALWNLSFDDRNREAIAAAGGVQALVALAQACANASPGLQERAAGALWGLSVSETNSVAIGREGGVAPLIALARSEAEDVHETAAGALWNLAFNASNALRIVEEGGVSALVDLCSSSVSKMARFMAALALAYMFDGRMDEYALVGTSSESISKSVSLDGARRMALKHIEAFVLMFSDPQAFAAAAASSAPAALAQVTEGACIQEAGHLRCSGAEIGRFITMLRNPSSILKACAAFALLQFTIPGGRHAMHHASLMQSLGAPRVLRGAAAAATAPLEAKIFARIVLRNLEYHQIEQTLL

SEQ ID NO: 2770 - protein, 432 aa, Glycine max
MASKEFSGLCSLAPSLSESILCTTGLKMYMLESKGGAIACMFLSLFFLGTWPALLTMLERRGRLPQHTYLDYSITNFLAALLIAFTLGGIGKGTHDQPNFLVQLAQDNWPSVLFAMGGGLFLSLGNLSSQYAFAFVGLSVTEVITASITVVIGTTLNYFLDDKINKAEILFPGVGCFLIAVFLGSAVHSSNAADNKAKLSNFTGDYKDGDISFKDGDIVKSKDLESGSSSADNVEAGTAVFLMELEEKRAIKVFGKSTLIGLALTFFAGLCFSMFSPAFNIATNDQWNTLKKGVPHLTVYTAFFYFSISCFVIAMILNITFLYHPVLNLPKSSFKAYLADSDGRVWALLAGLLCGFGNGLQFMGGQAAGYAAADAVQALPLVSTFWGVILFGEYRKSSRRTYILLGSMLFMFIVAVAVLMASSGQRNSTAKE

SEQ ID NO: 2771 - protein, 92 aa, Glycine max
MGFHLPSIRRALFAPNQGSSKTVDVPKGYLAAYVGDKMKRFVIPVSYLNQPSFQELLSQAEEEFGYDHPMGGLTIPCSEDVFQHITSCLNGL

SEQ ID NO: 2772 - protein, 526 aa, Glycine max
MHSSPLLLEEPIRMASILEPSKPTFFPAMTKIVGTLGPKSRSVDIISHCLDAGMSVARFDFSWGDPEYHQETLENLRVAIKSTKKLCAVMLDTVGPELQIENKTDHPITLEADTLVVLTPDQNKEASSNLLPLNFTGLSKAVKKGDTIFIGKYLFTGSETASVWLEVSEVEGEDVTCLVKNTATLSGSLFTVHVSQIHIDLPTLADKDKEVISTWGVQNNIDFLSLYTRHVEDIRHAREFLSKLGDLKQTHIYAKIENIEGMKHFDEILREADGIILARGNLGIELPPEKVFLFQKAAIYKCNMVGKPVVVTRVVDSMTDNLRPTRAEATDVANAVLDGSDAILLGAETLRGQYPVETISIVGKICAEAEKVHNQDLYFKKAVKYVGEPMSHLESIASSAVRAAIKVKASVIICFTSSGRAARLIAKYRPTMPVISVVIPQLKTNQLRWTFTGAFEARQSLIVRGLFPMLADPRHPAESRSGTNESILKVALDHGKAFGIIKPHDRVVVCQKVADSSVVKILELED

SEQ ID NO: 2773 - protein, 504 aa, Glycine max
MSALSNSSSSHGNSFLKMPAIKFTKLFINGDFVDSISGRTFETIDPRKEEVIARVSEGDKEDIDIAVKAARQAFDSGPWPRLPGSERAKIMMKWADLVDENIEELAALDTIDAGKLYYINKVAEIPSATNALRYYAGAADKIHGDVLKMNGDFHAYTLLEPIGVVGHIIPWNAPSLSFFIKVSPSLAAGCTMVLKPAEQTPLSALFYAHLAKLAGIPDGVLNIVPGFGPTAGAAISSHMDIDAVSFTGSIEVGREVLQAAAWSNLKPVSLELGGKSPLIIFNDADIDKASELALFGIMSNKGEICVAGSRVFVQEEIYDEFEKKLVEKAKSWVVGDPFDPKSLQGPQADRNQLEKILSYIEHGKREGATLLTGGNTVGNKGYYIEPTIFCNVKEDMLIARDEIFGPVLALMKFKTMEEAIKSANNTKYGLAAGIVTKNLDTANTMSRSIRAGIVWINCYLTVGSDVPFGGYKMSGFGRDLGLQALHKYLQVKSVVTPIHNSPWL

SEQ ID NO: 2774 - protein, 155 aa, Glycine max
MHDFCFTIPYGFAVLAGGLLGYLRRGSTASLAGGAGVGGLLLLAGFVSLKAFEKRRISYLALALETLCALALTFVMGQRYLETSKIMPASVVAGLSVLMSAFYLFKIKLVTRGATQFFLPTKKRGVPPRGGFGGGPPPKKKGGGGGPPPPHKKKK

SEQ ID NO: 2775 - protein, 78 aa, Glycine max
LYLSTCREEANELCQTLENNEDEKRTASEMADVLYHAMVLLAKKGVKIEDVLQVLRLRFSQSGIEEKKSRVSQKSVDD

SEQ ID NO: 2776 - protein, 418 aa, Glycine max
  misc_feature (394)..(394): Xaa can be any naturally occurring amino acid
IIIAINKIDKDGANPERVMQELSSIGLMPEDWGGDIPMVPISALKGKNIDDLLETVMLVAELQELKANPDRSAKGTVVEAGLDKSKGPFASFIVQNGTLRRGDIVVCGEAFGKVRALFDDGGKRVDEATPSIPVQVIGLNNVPIAGDEFEVIESLDTARERAETRAESLRNERISAKAGDGKVTLSSLASAVSSGKLSGLDLHQLNIILKVDLQGSIEAVRKALEILPQDNVTLKFLLEATGDVSTSDVDLAVASKAIILGFNVKAPGSVKSYAENKAVEIRLYKVIYELIDDVRKAMEGLLEPVEEQVTIGSAVVRAVFSSGSGRVAGCMVTEGKILNDCGIRVKRKGKVVHVGILDSLRRVKEIVKEVNAGLECGLGLEDFDDWEEGDILEXPSTHFRRRGPLKRPQPQWHLPWRE

SEQ ID NO: 2777 - protein, 82 aa, Glycine max
SAMFLKSVDRFNDLVVSVYVTAGHTRLMLLHDSRNEDGIKSFFQEVHELYIKILLNPLYLPGSRITSTHFDTKVRALARKYL

SEQ ID NO: 2778 - protein, 93 aa, Glycine max
MVENNLFEDIFRVEKLNPDDKKLFDKVTRIEARSEKFDMFMHLDINSEVYPLKVGQKFALVLVSSLNPDGTPDTGYYTQVINLLSFTRNLFLL

SEQ ID NO: 2779 - protein, 126 aa, Glycine max
  misc_feature (13)..(13): Xaa can be any naturally occurring amino acid
  misc_feature (25)..(25): Xaa can be any naturally occurring amino acid
  misc_feature (27)..(27): Xaa can be any naturally occurring amino acid
  misc_feature (47)..(47): Xaa can be any naturally occurring amino acid
  misc_feature (60)..(60): Xaa can be any naturally occurring amino acid
SSMICSPAGATVXRGGGGMVAPFAXLXSMGGLPTGETRADITCVASXGGRAPCFFFWPPXGAKKGEILSYLPEVGDAQLAKEVESLLRKGWIPCLEFELEPGFVSRAPGRAPRIYDGRSRSLGKLA

SEQ ID NO: 2780 - protein, 151 aa, Glycine max
  misc_feature (105)..(105): Xaa can be any naturally occurring amino acid
MPWARLSGSPRLDVAIDMGNPFLNLTVDGFLKIGAVAATRSAAEDTYHIIQKGLWNISSHDFEKTLKKMCKEGVYWGTIAGVYVGMEYGVERIRGTRDWVILSTXKNAMIGGAVTGALVSAASNNKKDKIAIDAITGAAIATAAEFINYLT

SEQ ID NO: 2781 - protein, 101 aa, Glycine max
TFRGVCYSSFLAHEVWFVLLQLKKMCKEGVYWGTIAGVYVGMEYGVERIRGTRDWKNAMIGGAVTGALVSAASNNKKDKIAIDAITGAAIATAAEFINYLT

SEQ ID NO: 2782 - protein, 225 aa, Glycine max
  misc_feature (216)..(216): Xaa can be any naturally occurring amino acid
MMPSVKPDASDKDSEPFVEVDPTRRYGRYSELLGYGAVKKVYRAFDQEEGIEVAWNQVKLRNFSYDPSMVDRLYSEVRLLRSLTNKNIISLYSVWREEKHNTLNFITEVCTSGNLREFRKKHKHVSMRALKKWSKQILEGLNYLHLHDPCIIHRDLNCSNVFVNGNTGQVKIGDLGLAAIVGKNHSAHSILGTPEFMAPELYEEDYTEMVDIYSFXMCVLEMVTL

SEQ ID NO: 2783 - protein, 143 aa, Glycine max
MPWVRLSESPRLDVAIDMGNPFLNLTVDGFLKIGAVAATRSAAEDTYHIIQKGNISSRDFEKTLKKMCKEGVYWGTIAGVYVGMEYGVERIRGTRDWKNAMIGGAVTGALVSAASNNKKDKIAIDAITGAAIATAAEFINYLT

SEQ ID NO: 2784 - protein, 128 aa, Glycine max
  misc_feature (124)..(124): Xaa can be any naturally occurring amino acid
MVSEAANAGIDRVLWTEAEIATRVAEVASELAADIRRLAEPAVVVGVATGAFLFLADLVRRVDVPLAVDLVRVESYGDGTESSGRPRVTSDLKVDVAGKHVVVVEDIVDTGNTVSCLIAHLQKXGALS

SEQ ID NO: 2785 - protein, 223 aa, Glycine max
  misc_feature (10)..(10): Xaa can be any naturally occurring amino acid
  misc_feature (112)..(112): Xaa can be any naturally occurring amino acid
  misc_feature (214)..(214): Xaa can be any naturally occurring amino acid
  misc_feature (218)..(218): Xaa can be any naturally occurring amino acid
LILGDGIYNXLIVRGRVTITEMWRASSKQLPVVTEVQDDESSQLQSEEKRRDEVFLKDRIPTWFAASGYVGLAAISIATIPIIFPPLKWYLVPCSYILAPALAFCNSYGTGXFTDWSLASTYGKIGLFIIAAAVGQNGGVIAGVASCAVMMSIVATAADLMQDFKTGYLTLSSAKSMFVSQLIGTAMGCVIAPLTFWMFWTAFDIGSPDAPYKXPYAXIFREM

SEQ ID NO: 2786 - protein, 88 aa, Glycine max
MSELLFDDIFKVEKVDPDGKKYDKVSRIVARSEKCDMNMLLDVNTEIYPMGEKERFLMALSPSLVLNTKGGICIVWWASVDAERTCFP

SEQ ID NO: 2787 - protein, 160 aa, Glycine max
MSELLFDDIFKVEKVDPDGKKYDKVSRIVARSEKCDMNMLLDVNTEIYPMGEKERFLMALSPSLVLNTKDGSVSIQDKFEYIMHGRLYNITKPQLEKKKKKEKRSESQPEENEECSKPQLEVEVYASFGGLQLMLKGHASHCVKFAVDQKLFLLIRKVES

SEQ ID NO: 2788 - protein, 293 aa, Glycine max
DISDQSSEKIHRKQIKHLFLDLFVAGPVVAVKRLKDVTISEKEFKEKIEAVGAMDHESLVPLRAYYFSRDEKLLVYDYMPMGSLSALLHGNKGAGRTPLNWEVRSGIALGAARGIEYLHSRGPNVSHGNIKSSNILLTKSYDARVSDFGLAHLVGPSSTPNRVAGYRAPEVTDPRKVSQMADVYSFGVLLLELLTGKAPTHALLNEEGVDLPRWVQSVVREEWTSEVFDLELLRYQNVEEEMVQLLQLAVDCAAQYPDKRPSMSEVVRSIQELRRSSLKEDQDQIQHDNDILL

SEQ ID NO: 2789 - protein, 168 aa, Glycine max
MVVYQGTLTSDELLFYSFPYKEIDNGMLWEVEGKWVCKGAVDVDIGANPSAEGGREDEGVDDAAVKVVDIVDTFRLQEQPAFDKKQFVTFMKRFIKNLTPKLDAEQQEFVKKHIEGATKYLLSKIKDFPFFVAESMGDDARLVLAYYKDSAADPTFLYSASAFEEVSC

SEQ ID NO: 2790 - protein, 218 aa, Glycine max
  misc_feature (127)..(127): Xaa can be any naturally occurring amino acid
MAYSVIPASLFNFLVPNSARGSLRTSFTARISCCLERSEKNSVNMLVYQDLLTGDELLSDSFRYKEIENGMLWEVEGKWVVKGAVDVDIGANPSAEGGGEDEGVDDAAVKVVDIVDTFRLQLPYFCXEQPAFDKKQFVTFMKRFIKNLTPKLDAEQQELFKKHIEGATKYLLSKIKDFQFFVGESMGDDACLVFAYYKDGAADPTFLYFAYALKEVKC

SEQ ID NO: 2791 - protein, 123 aa, Glycine max
MLVYQDLLTGDELLSDSFRYKEIENGMLWEVEGKWVVKGAVDVDIGANPSAEGGGEDEGVDDASVKVVDIVDTFRLQEQPAFDKKQFVTFMKRFIKNLTPKLDAEQQELFKKHIEGATRYLAF

SEQ ID NO: 2792 - protein, 356 aa, Glycine max
IRLEVCIIKNTATLAGSLFTLHASQIHIDLPTLTEKDKEVISTWGVKNKIDFLSLSYTRHAKDVRQAREFLSKLGDLSQTQIFAKIENVEGLTHFDEILQEADGIILSRGNLGIDLPPEKVFLFQKSALYKCNMAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKVALDHGKSLGVIKSHDRVVVCQKLGDASVVKIIELED

SEQ ID NO: 2793 - protein, 527 aa, Glycine max
  misc_feature (60)..(60): Xaa can be any naturally occurring amino acid
MPSSHLLLEEPIRMVSILEPSKPSFFSAMTKIVGTLGPKSRSVETISGCLKAGMSVARFXFSWHDPEYHQETLENLKATIKSTKKLCAVMLDTVGAEMQVVSKSEKAISLEANGQVVLTPDQGQEASSEILPINFDGLAKAVKKGDTIFIGQYLFTGSETTSVWLEVSEVKGQDVVCIIKNTATLAGSLFTLHASQIHIDLPTLTEKDQEVISSWGVKNKIDFLSLSYTRHAEDVRQAREFLSKLGDLSQTQIFAKIENVEGLTHFDEILQEADGIILSRGNLGIDLPPEKVFLFQKSALYKCNMAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKFALDHGKALGVIKSHDRVVVCQKLGDASVVKIIELED

SEQ ID NO: 2794 - protein, 160 aa, Glycine max
  misc_feature (92)..(92): Xaa can be any naturally occurring amino acid
PRVRAGKPAVLTRVVDSMTDNLRPTRAEATDVANAVLDGSDAILLGAETLRGLYPVETISTVGKICAEAEKVFNQDLYFKKTVKYVGEPMTXHLESIASWLERAAIKVKASIIICFTSSGRAARLIAKYRPTMPVLSVVIPRLKTNQLKWSFSGAFEVEF

SEQ ID NO: 2795 - protein, 500 aa, Glycine max
AREKIPHLLELGINAVELLPVFEFDELEFQRRPNPRDHMINTWGYSTINFFAPMSRYASAGGGSVNASREFKQMVKSLHSAGIEVILDVVYNHTNEADDAFPYTTSFRGIDNKAYYMLDNNGQLLNFSGCGNTLNCNHPVVMELILDSLRHWVTEYHVDGFRFDLASVLCRGIDGSPINAPPLIRAIAKDAVLSRCKIIAEPWDCGGLYLVGSFPNWDRWAEWNGKYRDDVRKFIKGDSGVKGSFATRVAGSSDLYRVNNRRPYHSINFVIAHDGFTLRDLVSYNFKHNKANGEGGKDGSNDNFSWNCGFEGETDDASIRALRSRQMKNFHLALMISQGTPMMLMGDEYGHTRYGNNNSYGHDTAINNFLWDQLDARKSDHFRFFSKVIKYRHAHEVFSRENFLNTNDITWHEDNWENPDSKFLAFTLHDRSGGDIYVAFNSHDYFVKVLLPTPPKKRNWFRVADTNLKSPDDFVLDGVPSVGNTYNIAPYSSILLEAKF

SEQ ID NO: 2796 - protein, 108 aa, Glycine max
MGMRDLVSGAAACGDSSSSSSANPLASLANALIGSSSKTPERLKEIPTSTPTDPTSQFYSTALPANQLPGTELYEPLLNANSHASEFLHKFPGTTGLDETWDEIQPDG

SEQ ID NO: 2797 - protein, 169 aa, Glycine max
KLSGTVKKVTDVAFKVGRNIDWDGMAKLLVSDEARREFSNLRRAFDEVNSQLQTKFSQEPEPIDWDYYRKGIGTRLVDMYKEHYESIEIPKFVDTVTPQYKPKFDALLIELKEAEEKSLKESERLEKEIAEVQELKKKLSTMTADEYFEKHPELRKKFDDEIRNDNWGY

SEQ ID NO: 2798 - protein, 145 aa, Glycine max
  misc_feature (55)..(55): Xaa can be any naturally occurring amino acid
EGFAIRSDVGEKKLLLLFVFHILQEPEPIDWDYYRKGIGTRLVDMYKEHYESMFXLCILIFLIEVPKFVDTVTPQYKTKFDALLIELKEAEEKSLKESERLEKEIVEVQELKKKLSTMTADEYFEKHPELRKKFDDEIRNDNWGY

SEQ ID NO: 2799 - protein, 135 aa, Glycine max
EGFAIRSDVGEKKLLLLFVFHILQEPEPIGWDYYRKGIGTRLVDMYKEHYESIEVPKFVDTVTPQYKTKFDALLIELKEAEEKSLKESERLEKEIVEVQELKKKLSTMTADEYFEKHPELRKKFDDEIRNDNWGY

SEQ ID NO: 2800 - protein, 497 aa, Glycine max
MAAGTGLFAEILDGDVYKYYADGEWKKSASGKSVAIINPTTRKTQYKVQACSQEEVNKVMDLAKSAQKLWAKTPLWKRAELLHKAAAILKEHKAPIAECLVKEIAKPAKDAVTEVVRSGDLVSYTAEEGVRILGEGKFLVSDSFPGNERTKYCLTSKIPLGVILAIPPFNYPVNLAVSKIAPALIAGNSIVLKPPTQGAVSALHMVHCFHLAGFPKGLINCVTGKGSEIGDFLTMHPGVNCISFTGGDTGIAISKKAGMIPLQMELGGKDACIVLEDADLDLVAANIIKGGFSYSGQRCTAVKVVLVMESVADALVEKVKAKVAKLTVGPPEDDCDITPVVSESSANFIEGLVLDAKEKGATFCQEYKREGNLIWPLLLDNVRPDMRIAWEEPFGPVLPVIRINSVEEGIHHCNASNFGLQGCVFTKDVNKAIMISDAMETGTVQINSAPARGPDHFPFQGIKDSGIGSQGITNSINMMTKVKTTVINLPSPSYTMG

SEQ ID NO: 2801 - protein, 514 aa, Glycine max
MNGGDEVVAAPAAPPHPLEWKFSQVFGERTAGEEVQEVDIISAIEFDKSGDHLATGDRGGRVVLFERTDTKDHGGSRRDLERMDYSIGRHPEFRYKTEFQSHEPEFDYLKSLEIEEKINKIRWCQTANGALFLLSTNDKTIKFWKVQEKKVKKISEMNVDPSKSMGNGSIASSSNSSSSRPYLVNGGSPDRYNYISNDFSFPPGGLPSLRLPMVSSHETSLVARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRVATGSYSNLFRVFGCAPGSAEATTLEASKNPMRRQVPTPSRPSRSLGNSITRVVRRGAEAPGVDANGNSFDFTTKLLHLAWHPSENSIACAAANSLYMYYA

SEQ ID NO: 2802 - protein, 514 aa, Glycine max
MNGGDEVVAAPAGPPQPLEWKFSQVFGERTAGEEVQEVDIISAIEFDKSGDHLATGDRGGRVVLFERTDTKDHHGSRRDLERMDYSISRHPEFRYKTEFQSHEPEFDYLKSLEIEEKINKIKWCQTANGALFLLSTNDKTIKFWKVQEKKVKKVSDMNVDPKAMGNGSIASSSNSSSSKSYLANGVSPDGPYNYLNNDFSFPPEGVPSLRLPLVTSHETSLVARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRVSTGSYSNLFRVFGCVPGSTDAMTLEASKNPMRRQVPTPSRPSRSLGNSITRVVRRGAESASVDANGNSFDFTTKLLHLAWHPTENSIACAAANSLYMYYA

SEQ ID NO: 2803 - protein, 302 aa, Glycine max
  misc_feature (28)..(28): Xaa can be any naturally occurring amino acid
  misc_feature (35)..(35): Xaa can be any naturally occurring amino acid
  misc_feature (54)..(54): Xaa can be any naturally occurring amino acid
  misc_feature (72)..(72): Xaa can be any naturally occurring amino acid
  misc_feature (86)..(86): Xaa can be any naturally occurring amino acid
  misc_feature (111)..(111): Xaa can be any naturally occurring amino acid
  misc_feature (118)..(118): Xaa can be any naturally occurring amino acid
  misc_feature (142)..(142): Xaa can be any naturally occurring amino acid
  misc_feature (174)..(174): Xaa can be any naturally occurring amino acid
  misc_feature (192)..(192): Xaa can be any naturally occurring amino acid
YDTRLMYRCRRVFAHFNDYHINSISSNXDGDSFLXVNNKRMNLGHLVMSNANFXAIDDVKPTDVKYLITVIXSAEFKHTYCKTFAXSSSKVPICLVGVLQYALCPSYIQLXEAIKEPXSSGLIFKRLLSPKFQTMTFGQEGXKYTLILTSQTLKFWDFNMDCGLFDTFQVKDSXRTELYDLYENDLIFDNFXCCLSGDGLRVSTGSYSNLFRVFGCVPGSTEATTLEASKNPMRRQVPTPSRPSRSLGNSITRVVRRGAESAGVDANGNSFDFTTKLLHLAWHPTENSIACAAANSLYMYYA

SEQ ID NO: 2804 - protein, 99 aa, Glycine max
MSAVNITNVAVLDNPTAFLNPFQFEISYECLVPLDDDLEWKLTYVGSAEDETYDQQLESVLVGPVNVGTYRFVFQADPPDPLKIREEDIIGVTVLLLTC

SEQ ID NO: 2805 - protein, 321 aa, Glycine max
  misc_feature (40)..(40): Xaa can be any naturally occurring amino acid
  misc_feature (71)..(71): Xaa can be any naturally occurring amino acid
  misc_feature (112)..(112): Xaa can be any naturally occurring amino acid
  misc_feature (121)..(121): Xaa can be any naturally occurring amino acid
  misc_feature (219)..(219): Xaa can be any naturally occurring amino acid
SPRRGSCLLGRSSNFKIIKQVEYYFKRMKNLPTDKYLLGXVKRNKEGVWSLVSVICFLFRKNKRKLTPRTXPLMVVDWKESSLLVVSGDGRRVKRLNPLRFNESRDHKLYTXVLVENLPEXDHSKKNIQQIFHEAGNIKRITIHDPHSTSESAKQHNKQEMLISNKLHALVEYETMEAAEKAVAMLNNEQDWRNGMRVKLLKGMGKYGHKKTSLERTSXEKNSSRPEQTGDEENHGSNDHHEDTHEEEDGDHLSKDKGGQRYRNQGRSRKHKYRAGNGMGHGSAPSTHAAEASKSPPGPRMPDGTRGFAVGRGRPPVPASN

SEQ ID NO: 2806 - protein, 405 aa, Glycine max
MEGGEQVLPSATTVAAAGYPNVSPPPLADPVGASDLAAAASDDVVAEPEIHALISDEEHDHDHDHEHEHEHDHDLEHDHEHEHDHHEDRDDHAAVAAVSLEDLKLKIIKQVEYYFSDENLPTDKYLLGFVKRNKEGFVPVSVIASFRKIKKLTRDHAFIVAALKESSLLVVSGDGKRVKRLNPLRFNESRDHKLYTVLVENLPEDHSRKNIQQIFHEAGNIKRITIHDPHSTSESTRHIKQEMLISNKLHALVEYETIEAAEKAVAMLNNEQDWRNGMRVKLLKGMGTYGHKKQAWKGSHSEKNSSRHVSEQTGDEENHGSNEHREDAHEEEDGDHLSKDKGGQRYRNQGRSRKHKYRAGNGMGHGSTPSTHAAEASKPPPGPRMPDGTRGFAIGRGRFPVPASN

SEQ ID NO: 2807 - protein, 208 aa, Glycine max
KLWGCPRGGRRFFPEALFSLAFLSSRAATHSANTIQQPQTQLPPTTPPPRRRPPNHPASVLAAREKKSEMAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINPVLLPKKSAEKAEKEPKSPKKTAKSPKKA

SEQ ID NO: 2808 - protein, 439 aa, Glycine max
MHRSLKVAVIGAGVSGLAAARELRHEGHNVVVLEKSNHVGGMWAYDPKTDSDPLGLDPTRETVHSSLYLSLRTNLPRQLMGFSDFPFVKNESGDPRTFPGHEEVLRFLEGFAGEFGINELTQFETEVVRVERKGNEWVVESRTSRDGDSVSREGFDAVVVCSGHFVEPKLAEVPGIDTWRGFQMHSHNYRVPQPFHNQVVILIGLGPSAFDISREIAQVAREVHVATRLNPDLAGMKLGDYGKIMFRTAVKCVFEDGLVAFEDGFSVYADAIIHCTGYKYHFPFLETNGLVTVDDNRVGPLYKHVFPPALSPWLSFIGLTFKNSVYQIIELQCKWVAKVLSGKVLLPTEKEMMESVKEYYQLMEENGLPKRYTHSLYPLQADYKHWLVAEIGLPPLEEWKENMLKQCFKNFVEMNEKYRDEWDDTYWDAIIHGAPASEK

SEQ ID NO: 2809 - protein, 445 aa, Glycine max
MATIKAVKARQIFDSRGNPTVEVDVILSDGTFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENKEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 2810 - protein, 238 aa, Glycine max
HVLIDACALGPKDMDSFGLSPCQLPWPPPPLYKVFGENPSGFGCLFVKKSAITTLESSSCAGIVNLVPDRLLLHPSEDKDSSKQKPLSILQEQDLSSLSSFSGRIQTSQAIKVEQELSELQIIAAPAKPKQGSGRVEAKGPVESLQSKKAQDGSENGGFNIDCRCLDQVDSLGLIMITNRTRYLINWLVNSMMKLKHPNAEGVPLVKIYGPKVKFDRGPALAFNVFDWKGEKVEPVLV

SEQ ID NO: 2811 - protein, 231 aa, Glycine max
KPIDGQKTGTSGLRKKVKVFMQDNYLANWIQALFNSLPPEDYKNGLLVLGGDGRYFNQEAAQIIIKIAAGNGVGKILVGKEGILSTPAVSAVIRKRKANGGFIMSASHNPGGPEYDWGIKFNYSSGQPAPESITDKIYGNTLSISVIKIADIPDVDISKVGVTKFGSFSVEVIDPVSDYLELLETVFDFQLIKGLLSRPDFRFIFDAMHAVTGAYAKPILVDKLGASLDSI

SEQ ID NO: 2812 - protein, 127 aa, Glycine max
  misc_feature (21)..(21): Xaa can be any naturally occurring amino acid
RTVNQVKIWGAKAGVVLTPGXPPLSAIEYILDVVDLVLIMSVNPGFGGQSFIESQVKKISDLRRLCAEKGVNPWIEVDGGVGPANAYKVIEAGANALVAGSAVFGAKDYAEAIRGIKTSKRPEVVAV

SEQ ID NO: 2813 - protein, 138 aa, Glycine max
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREA

SEQ ID NO: 2814 - protein, 267 aa, Glycine max
  misc_feature (248)..(248): Xaa can be any naturally occurring amino acid
GSSSSRIGSSSTIESSINPEKLVFHIVTDKKTYAPMHAWFATNSIKSVVEVRGLHQYDWSEEVNAGVKEMLETNHLIWKQYYNKEKDLDYTQEHSRYLEALRPSSLSLMNQLRIYLPELFPDLKKIVFLDDDVVVQHDISSLWELDLNGKVIGSVLKSWCGDGCCPGSKYTNYLNFSHPPISSKFNGDQCVWLYGMNIFDLEAWRRTNITETYHQWLEINLKSGMTMWNPGVLPPAFIASEGHVHPIXSSMLVTDLGYRHQSAEIAK

SEQ ID NO: 2815 - protein, 286 aa, Glycine max
  misc_feature (97)..(97): Xaa can be any naturally occurring amino acid
  misc_feature (115)..(115): Xaa can be any naturally occurring amino acid
  misc_feature (171)..(171): Xaa can be any naturally occurring amino acid
  misc_feature (224)..(224): Xaa can be any naturally occurring amino acid
EEELCNSCCCCGNTLNCNHPVVMELILDSLRHWVTEYHVDGFRFDLASVLCRGIDGSPLNAPPLIRAIAKDAVLSRCKIIAEHWDCGGLYLVGSFPXWETDDASIRALRSRQMKXSKGDSGLIGSFATRVAGSSDLYSVNNRRPYHGINFVIAHDGFTLRDLVSYNFKHNXDNGEGGKDGSNDNFSWNCGFEGETDDASIRALRSRQMKNFHLALMISQGTPMXAFNSHDYFVKVLLPTPPKKRNWFRVADTNLKSPDDFVLDGVPSVGNTYNIAPYSSILLEAKF

SEQ ID NO: 2816 - protein, 615 aa, Glycine max
  misc_feature (405)..(405): Xaa can be any naturally occurring amino acid
MSLGRAGVNGSFATRVAGSAHLYSVNNRRPYHSINFVIAHDGFTLRDLVSYNFKHNKANGEGGKDGSNDNFSWNCGFEGETDDASIRALRSRQMKNFHLALMISQGTPMMLMGDEYGHTRHGNNNSYGHDTAINNFLWDQLDARKSDHFRFFSKVIKYRHAHEVFSRENFLNTNDITWHEDNWENPDSKFLAFTLHVWSGGGILAAFHSHELRGPLPHTTSFRGIDNKVYYMLDNNGQLLNFSGCGNTLNCNHPVVMELILDSLRHWVTEYHVDGFRFDLASVLCRGIDGSPLNAPPLIRAIAKDAVLSRCKIIAEPWDCGGLYLVGSFPNWDRWAEWNGKYRDDVRKFIKGDSGVKGSFATRVAGSSDLYSVNNRRPYHGINFVIAHDGFTLRDLVSYNFKHNXANGEGGNDGSNDNFSWNCGLEGETDDASVRALRSRQMKNFHLALMISQGTPMMLMGDEYGHTRNGNNNSYGHDTAINNFLWDQLDARKSDHFRFFSNMIKYRHAHEVFNHESFLSKNDITWHEDNWDNHDSKFLAFTLHDKSGGDIYLAFNAHDYFVKVLLPAPPKKRNWFRVVDTNLKSPDDFVLDGVPNVGNTYNIAPYSSILLEAKF

SEQ ID NO: 2817 - protein, 433 aa, Glycine max
  misc_feature (148)..(148): Xaa can be any naturally occurring amino acid
  misc_feature (154)..(154): Xaa can be any naturally occurring amino acid
  misc_feature (169)..(169): Xaa can be any naturally occurring amino acid
  misc_feature (300)..(300): Xaa can be any naturally occurring amino acid
  misc_feature (305)..(305): Xaa can be any naturally occurring amino acid
  misc_feature (347)..(347): Xaa can be any naturally occurring amino acid
  misc_feature (399)..(399): Xaa can be any naturally occurring amino acid
  misc_feature (426)..(426): Xaa can be any naturally occurring amino acid
EDLPRSNVLYGYRIDGPGDRGKGHRFDSSIVLVDPYAKLVEGRRYFGDISLKLSKFLGTYDFDSLPFDWGENYKLPNISEKDLVIYEMNVRAFTSDESSGLDSNIRGSYLGVIEKIPHLLELGINAVELLPVFEFDESDGITDGLCDXYDLILXIDFFLLVFPLKTCPXGDSGVKGSFATRVAGSSDLYSVNNRRPYHGINFVIAHDGFTLRDLVSYNFKHNEANGEGGNDGSNDNFSWNCGWEGETDDASVRALRSRQMKNFHLALMISQGTPMMLMGDEYGHTRNGNNNSYGHDTDTXINNFXWDQLDARKSDHFRFFSNMIKYRHAHEVFNHESFLSKNDITWXEDNWDNHDSKFLAFTLHDKSGGDIYLAFNAHDYFVKVLLPAPPKKRNWFRVXDTNLKSPDDFVLDGVPNVGNTYNIAPXSSILLEA

SEQ ID NO: 2818 - protein, 380 aa, Glycine max
MGGVTSSMAAKLAFFPPHPASYKVVKDELTGLLLLSPFPHRENVEILKLPTRRGTEIVSMYVRHPMAASTVLYSHGNATDLGQMYELFIQLSIHLRVNLIGYDYSGYGQSSGKPSEQNTYADIEAVYKYLEENYGVKQEDIILYGQSVGSGPTLDLASRLPRLRAVVLHSPILSGLRVMYPVKRTYWFDIYKNIDKIPLVKCPVLVIHGTADEVVDCSHGKQLWELCQQKYEPLWLKGGNHCNLELYPEYLRHLRKFISSVEKPPSQRVSFRRSIDRVEQSRGSTDCFETPRKSTDQRDKPRKSTDRTDKLKFHEFKFNNTEKLEKIRVQFDQMERSRRSVEYNDKSRSIEFQDKSRRSVNVQFERPRKSIDWLDRIRAS

SEQ ID NO: 2819 - protein, 183 aa, Glycine max
MEESVLTKRPREEEPLENKDSTYELLESLSKRHRSYNHILSLLESEEDDSTQDLSSLITSLQQEITNCASDSDTLLNQHSLTNTTTTTTTNSNLEDCSSSTTKYSSDMMEEHDDKEGVMRHLLEASDDELGIPNKEDESLDLGEDGFKFNGGDMFSSICDGLLWELEDEAANYYDLLQSQLFL

SEQ ID NO: 2820 - protein, 232 aa, Glycine max
  misc_feature (200)..(200): Xaa can be any naturally occurring amino acid
  misc_feature (218)..(218): Xaa can be any naturally occurring amino acid
  misc_feature (226)..(226): Xaa can be any naturally occurring amino acid
MAVMAVHQFAQCITCHAWSPDQSMVALCPNNNEVHIYRLVEDKWEKLYVLQKHDQVISGIDWSARSNRIVTASHDRNSYVWNLEGSEWVPTLVILRLNRAALCVQWSPKENKFAVGSGAKTVCICYYEQENNWWVSKLIRKRHDSSVTSVSWHPDNILLATTSTDGKCRVFSTFIKGVDARDSKKGTSPDSKFGEQIVQXLDLSSSWTFGVKWSPSGXTLAYVGHXSMIYFC

SEQ ID NO: 2821 - protein, 289 aa, Glycine max
  misc_feature (200)..(200): Xaa can be any naturally occurring amino acid
  misc_feature (218)..(218): Xaa can be any naturally occurring amino acid
  misc_feature (273)..(274): Xaa can be any naturally occurring amino acid
MAVMAVHQFAQCITCHAWSPDQSMVALCPNNNEVHIYRLVEDKWEKVHVLQKHDQVISGIDWSTRSNRIVTASHDRNSYVWNLEGSEWVPTLVILRLNRAALCVQWSPKENKFAVGSGAKTVCICYYEQENNWWVSKLIRKRHDSSVTSVSWHPDNILLATTSTDGKCRVFSTFIKGVDARDSKKGTSPDSKFGEQIVQXLDLSSSWTFGVKWSPSGXTLAYVGHNSMIYFVDDVGPSPLAQNVVFRDLPLRDVLFVSERKVIGVGFDCNPMXXAADERGNLVLLLISF

SEQ ID NO: 2822 - protein, 530 aa, Glycine max
  misc_feature (240)..(240): Xaa can be any naturally occurring amino acid
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVGCMSFVKDAAGYIAVRFLIGFSMATFVSGLSFMSTMFNCCTIPVTLVPAPQWGNMFLPPSKDVNKSTEEYYYTAEWNEEEKQKGLHLNSLKFAENSGXLVLTLGQDLPDGNLGALRKKGDVAKDKFSKVLWYAITNYRTWIFALLYGYSMGVELTTDNVIAEYFYDRFNLKLHTAGIIAASFGMANLVARPFGGYASDVAARLFGMRGRLWTLWILQTLGGVFCIWLDRANSLPIAVLAMILFSIGAQAACGAAFGIIPFISRSSLGIISGLTGAGGNFGSGLTQLVFFSTSKFSTSTGLSLMGVMIVACTLPVSVVHFPQWGSMFLPPSKDVSKSTEEFYYTSEWNEEEKQKGLHQQSLKFAENSRSERGKRVASAPTPPNTTPTHV

SEQ ID NO: 2823 - protein, 116 aa, Glycine max
MAVHSESASSEKKSSNGVNELLTFNAENMQSNMKIIYYSRTFLSIIGGVVAGILGFTGLKGFVFYLLLMAFTSFCLVAKAKFSTHTYFDSWNRVLLDGFLGGLMSFVLFWTYPSLL

SEQ ID NO: 2824 - protein, 162 aa, Glycine max
  misc_feature (153)..(153): Xaa can be any naturally occurring amino acid
KSNGTKRSDFFGERAKMCLRYSLCLILFSLISLQGFAKKTGDVSELQIGVKFKPATCEVKAHKGDMIKVHYRGKLTDGTVFDSSFERDEPFEFELGSGQVIKGWDQGLLGACVGEKRKLKIPAKLGYGEQGSPPTIPGGATLIFDTELIAVNXKPAGGEQEQ

SEQ ID NO: 2825 - protein, 650 aa, Glycine max
  misc_feature (486)..(486): Xaa can be any naturally occurring amino acid
  misc_feature (551)..(551): Xaa can be any naturally occurring amino acid
MPGFGSARVRGPSLARPRANRVVALAHRPPVRWLPAALDGAPVAAGWPACLPAVPGAAIPGWPPRRAVAPVQLVFIRRGSPCNVYRARDLEQRKVVALKKVRFDNLEPESVRFMAREIHILRRLLLPIVPALRGTAASALNSEFFSTMPLPCDPSSLPKSPPSLEFAAALRDEEARRQGAAGSKGQRHDLERRGARESRLLIDNNGILKIADFGLASFFDPNQAQPLTSRVVTLWYRPPELLLGATYYGTAVDLWSTGCILAELYAGKPIMPGRTEVEQLHKIFKLCGSPSEDYWRKSKLPHATIFKPQQPYRRCVSETFKEFPAPAIELIEILLSIDPADRGTSASALNSEFFSTKPLPCDPSSLPKYPPSKEFDAKVRDEEARRQGAAGSKGQRHDIERRGARESRAIPAPDANAELVLSIQKRQGQANSQSRSEKFNPHPEEVASGFPIDPPRPSQAAGLIADPPVHQHKRSSHSGPLTQKSXAAWANKAGKNQEDAPKISMGGDLSTVSGLVAARRSMLSDDRREWSGSSQAEAPKLISRFPGSFKXASESMMQQDQKHHAHAPQKEEGRGSRNKDSNLVGYGSKGHKIHYSGPLLVPSSNHDQMLKDHDRQIQEAVRRARLDKAKMRRLQAEGSQISNSLFVSGR

SEQ ID NO: 2826 - protein, 120 aa, Glycine max
MAGPFELGSSKKKPGDGVNDLLTFNAENMQSNMKIIYYSRTFLSIIGGVVAGILGFTSLKGFVFYFLLMMVTSLGLVAKARFSIHSYFDSSNRVLLDGFLGGLMSFVLFWTFAFDIVHIF

SEQ ID NO: 2827 - protein, 429 aa, Glycine max
  misc_feature (179)..(179): Xaa can be any naturally occurring amino acid
  misc_feature (203)..(203): Xaa can be any naturally occurring amino acid
MIPSGIMKYPRGKLPLPIIVITTCVLVFVAILYVERLSFLSSKSIFKFKPCPRKTTKTKSSDKKADEEVVVVNASTWIDDRFDFDPEECNVANGKWVFNHSIKPLYSDISCPYIDRQFSCVKNGRNDSDYRHWEWQPEDCTLPRFNPELALRKLQGKRLLFVGDSLQEDQWESFVCWVXWVIPHKHKSMRLDSISYYLKNKAXMETYVFWVLFPIRITVLPMICITQINRVEELNVIAEQHKEATVIYHLNFVLNVWWMSGIRIKTIWGSFANGQEGYEEFDTPVAYKLALKTWANWIDSTINPNKTRVFFTTMSPTHTRSQDWGNMEGVKCFNETKPVRKKKHWGTGSDKRIMSVVAKVTKKMKVPVTFINITQISEYRIDGHCSVYTETGGKLLTEEERANPQNADCIHWCLPGVPDTWNQILLAML

SEQ ID NO: 2828 - protein, 152 aa, Glycine max
LSSWLFNLQIFEPWVQKRRLEYVKHDHLILKILQHVQKNTLQRIFTKNGTPNVSAIRRLYREIDQDGSSGISASEVKDLLLKNKVTETNFDEEKEIKEVLKVFDLDGDKKINKEEFVSGFTKWLDQTKHALKKQYFSREITQRHLSGFWTMD

SEQ ID NO: 2829 - protein, 66 aa, Glycine max
MSGTGKKGSDEAFKEGRNIDWDGMAKLLVYEEARREFSKLRCACDEGNSQRQTKFSQEHEPKEWDE

SEQ ID NO: 2830 - protein, 217 aa, Glycine max
  misc_feature (83)..(83): Xaa can be any naturally occurring amino acid
SAVPHVRTAARRRQKGGALFRLIWDVTAFSSTQRFFLSPSLLILLLLIALSASSLTPTCVSDSDSDSQAPHAGRNLLHAKKKXSVNFWFLNYTVITCERKGPQYPPKQCCAAFKEFACPYANAINESTNDRAAIMFSYINLYGKHPFRFSARVCRPGKKGITINCPASAASPPSGFTRWHWFGNSPDTCVTVIVEVCFPWCYVTCNKVCSALTLVKC

SEQ ID NO: 2831 - protein, 162 aa, Glycine max
MAAAANTAVFVSPSQPLSSKRSFLYSSTVSPIQRRFPRRKLELQVKAVATTLAPLEEIKEYKLPSWAMFEMGTAPVFWKTMNGLPPTAGEKLKLFYNPAATKLTPNEDYGVAFNGGFNQPIMCGGEPRAMLKKDRGKADSPIYTMQICIPKHAVNLIFSFTN

SEQ ID NO: 2832 - protein, 241 aa, Glycine max
SCRSMPTSAAPDVVAKHLNLKFFEVPTGWKFFGNLMDAGLCSVCGEESFGTGSDHIREKDGIWAVLAWLSILAYKNKDKLEDKLVTVEDIVRQHWATYGRHYYTRYDYENVDAGAAKELMAYLVKLQYSLSEVNQIVKGIRSDVSNVVHGDEFEYNDPVDVSISSHQGIRYLFEDGSRLIFRLSGPGSEGATIRLYIEQYEKDPSKIGRLSNEALAPLVEVALKLSKMEEFTGRSAPTVIT

SEQ ID NO: 2833 - protein, 112 aa, Glycine max
  misc_feature (37)..(37): Xaa can be any naturally occurring amino acid
MASTACFVIVSKNDIPIYEAEVGSAPKKEDLAYHHQXFILHAALDVVQDLAWTTNAMFLRSVDRFNDLVVSVYVTAGHTRFMLLHDSRSEDGIKSFFQEVHELYIKIFLNPL

SEQ ID NO: 2834 - protein, 319 aa, Glycine max
  misc_feature (83)..(83): Xaa can be any naturally occurring amino acid
  misc_feature (89)..(89): Xaa can be any naturally occurring amino acid
  misc_feature (143)..(143): Xaa can be any naturally occurring amino acid
LGVQIVKAPDSVGPKPKQTEAAVPDGRDLLLQHGRLYMDAKPTDPEPAIMIASLANLIENDAFVPAHRPHALSEGVTTYLTPXVAGLIXQKELDYLVGAVSNPKRPFAAIVGGSKVSSKIGVIESLLEKVDILLLGGGMIFTXYNAQGLSVGSSLVEEDKLDLATSLLAKAKERGVSLLLPSDVVIAHKFAPDANSRVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 2835 - protein, 516 aa, Glycine max
  misc_feature (398)..(398): Xaa can be any naturally occurring amino acid
MNGGDEVVAAPASPPQPLEWKFSQVFGERTAGEEVQEVDIISAIEFDKSGDHLATGDRGGRVVLFERTDTKDHCGSRRDLERMDYSISRHPEFRYKTEFQSHEPEFDYLKSLEIEEKINKIKWCQTANGALFLLSTNDKTIKFWKVQEKKVKKVSDMNVDPKLMGNGSIASSSNSGSSKSYLANGVSSDGPYNYLNNDFSFPPGGVPSLRLPLVVTSHETSLMARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENXDSIFDKFECCLSGDGLRVSTGSYSNLFRVFGCVPGSTEATTLEASKNPMRRQVPTPSRPSRSLGNSITRVVRRGAESAGVDANGNSFDFTTKLLHLAWHPTENSIACAAANSLYMYYA

SEQ ID NO: 2836 - protein, 169 aa, Glycine max
QKLKGKNGMANPLQLKSLNHISIVCASVEKSVDFYVNVLGFSPIKRPSSLDFNGAWLFNYGIGIHLLQSEDPEGMPKLVPINPKDNHISFQCESIAAVEKRLQQMKIEYVKNRVEESGIFVDQLFFHDPDGMMIEICNCDNIPVVPLTEDKVWSCSRFNCNIQNHQQQI

SEQ ID NO: 2837 - protein, 495 aa, Glycine max
MAAMQRPLKRTIAIAKLRACFSSLRPAAAADIVASPPPQLPPFDHQPHPYNGPFADEVLAKRKTFLGPSVFHYYKKPCRCVSDQAKIYGFSKCSSVKLNIVEGKMQYLYDDSGRRYLDAFAGIVTVSCGHCHPEILNAITEQSKLLQHATTIYLHHTIGDFAESLAAKMPGNLKVVYFVNSGSEANELAMMMARLYTGSLGMISLRNAYHGGSSSTLGLTALNTWKYPIPEGHVHHVMNPDPYRGAFGADAASYANDVQDHIDYGTSGKVAGFIAETMQGVGGAVELAPGYLKLVYDIIHKAGGVCIADEVQTGFGRTGSHYWGFETQGVIPDIVTMAKGIGNGLPLGAVVTTPEIASVLAQKIQFNTFGGNPVCSAGGLAVLRVLDKEKRQAHCADVGSHLLERLRFLMERHDIIGNVRGRGLMVGIELVTDRDNKTPAKAETAVVFEKLRELGVLVGKGGLHGNVFRIKPPMCFSKDDADFLVDALDYSLSKL

SEQ ID NO: 2838 - protein, 375 aa, Glycine max
  misc_feature (173)..(173): Xaa can be any naturally occurring amino acid
  misc_feature (189)..(189): Xaa can be any naturally occurring amino acid
  misc_feature (212)..(212): Xaa can be any naturally occurring amino acid
STVSISLISNSARAVESLGNDPDDVALFLHTSGTTSRPKGVPLTQHNLFSSVNNIKSVYRLTESDSTVIVLPLFHVHGLIAGLLSSLGTGAAVALPAAGRFSASSFWKDMIKYSATWYTAVPTIHQIILDRHSNSPEPVYPRLRFIRSCSASLAPAILGKLEEAFGAPVLEAXPMTEASHLMASDPLPXGGPHKAGSVGKPVGHEMGILDEXGRVQEAGVSGEVCIRGFNVTNGYKNNVAANTPSFLFDWFHTGDIGYFDSDGYLHLVGRIKELINRGGEKISPIEVDAVLLSHPEIAQAVAFGVPDAKYGEEIYCAVIPREGSNVDEAEVLRFSKTNLASFKVPKKVFITDSLPKTATGKILRRLVAEHFVSQI

SEQ ID NO: 2839 - protein, 583 aa, Glycine max
  misc_feature (19)..(19): Xaa can be any naturally occurring amino acid
MVLFNVSRVETTPFDGQKXPGTSGLRKKVKVFVQPHYLHNFVQSTFNALTVEKVRGATLVVSGDGRYFSKEAIQIITKMSAANGVRRVWIGQNGLLSTPAVSAVIRERVGADGSRATGAFILTASHNPGGPHEDFGIKYNMENGGPAPEGITDKIYENTTTINEYLIASDLPDVDITTTGVTSFTGPEGPFDVEVFDSASDYIKLMKSIFDFESIRKLLSSPKFTFCYDALHGVGGAYAKSIFVDELGAQESSLLNCTPKEDFGGGHPDPNLTYAKELVARMGLGKSEPQDDPPEFGAASDGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKNKDKLEDKLVTVEDIVRQHWATYGRHYYTRYDYENVDAGAAKELMAYLVKLQSSLSEVNQIIKGIRSDVSNVVHGDEFEYNDPVDGSISSHQGIRYLFEDGSRLIFRLSGTGSEGATIRLYIEQYEKDPSKIGRLSNEALAPLVEVALKLSKMEEFTGRSAPTVIT

SEQ ID NO: 2840 - protein, 76 aa, Glycine max
MATSIGIMDSAYFVGRNEILSWINNRLQLSLSRIEEAAFGAVRGPMMGMTYAVVDPMHRVNCEGKTEYEFMPDYMV

SEQ ID NO: 2841 - protein, 292 aa, Glycine max
MEGNSGGGGGGGGGNDVELLCKTLQVEHKLFYFDLKENPRGRYLKISEKTSATRSTIIVPFSGISWVLDLFNYYVNSDDQDLFSKELQLDTQVFYFDIGEKSKGRFFEVSEASVSRNRSTIIVPAGSSRDEGWAAFRNILAEINEASRLFILPNQQNSESSEHLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMAVANVRTIDPPSKMNANLG

SEQ ID NO: 2842 - protein, 740 aa, Glycine max
  misc_feature (97)..(97): Xaa can be any naturally occurring amino acid
  misc_feature (185)..(185): Xaa can be any naturally occurring amino acid
  misc_feature (472)..(472): Xaa can be any naturally occurring amino acid
  misc_feature (524)..(524): Xaa can be any naturally occurring amino acid
  misc_feature (545)..(545): Xaa can be any naturally occurring amino acid
MKNLWLCFSYLFPAAIILVLLTPSSVAQLSPSEGRILFQVQKLLEYPQALQGWNRWTNLCFLPSSPSLKIVCSNGHVTELTIIGNKTSPSLHNPKEXLGLPFKHCLGRFSIDSFFTVMTKLSNLKMLSLVSLGLSRSFTSNDQRSFGPSEVLNISSNFIYGGIPQSISSMRNLKSLVLVDNLFNXGSIPDLQSLSSLEELNLEGNNLGPGFPSLGKNLVTIMLRNNSLRSHIPPQLVHFDKLQVFDVSSNDFFGNIPSFIISLPSLQYLNLASNHLSGNLSVNMACSSSLTFVDISHNLLVGKLPSCFGSMSSKAKVLYSGNCLSTKNRLNDQQHPFSFCKREGALAVKPPAKNLKKESNLGTKLGLMLGIIVGIVVIGGLLVLLVVCIIRKSKAERSPHKMDKSVANKYSTSVSPRPIGTRHIPQAMKQAAVGLPPYRIFTSEEIEDATNNFDPSNLIEEGSQGQLIAIRXLHRLSKIPPIRLAAQTMQTRKISISWVLFNLNVITGKQITSSTEIEELKEEXRTTSTVFIVFEYISNVSLRDXLSDGRKREMLKWPQRMAMSIGIARGVQFLHTGVAPGIYGNNLKIENILLDDSLNAKVSRYNIPLPSKIAHIEQNATNHISSTNNAEKEDIYQLGIILLEVITGKQITSSSEIEELKEELENGSSEATSVIRSAIDPSLRGTYAYESMKTAVQITINCLSKVSSQRPSIEDVLWNLQYAMQVQESWTSSGNLSTKL

SEQ ID NO: 2843 - protein, 246 aa, Glycine max
  misc_feature (183)..(184): Xaa can be any naturally occurring amino acid
  misc_feature (196)..(196): Xaa can be any naturally occurring amino acid
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPXXVVVDLPTLTEKXRKTFFDGGVPNKIDMIALSFVRKGSDLVNVRKVLGPHAKTIQLMSNVFFC

SEQ ID NO: 2844 - protein, 228 aa, Glycine max
MATQSYLLNLNTFRVHAGISGRQCKPSIFKPTNFGFGVWKSSKYHTKRNVNGNSGVMQCCSCYTEVGASAGITISSLVDAATTQISLNSDVDLNTLKLSMPETSPASSDFMTRLVLADLDPATAKLAIGFLGPFLSVFGFLFIVRIVMSWYPKLPVGKFPYVIAYAPTEPLLIPTRKVIPPLAGVDVTPVVWFGLITCLNEILVGPQGLLVLLSHKSISLHIWNLWMK

SEQ ID NO: 2845 - protein, 242 aa, Glycine max
MSLLWLVIRQLAEIEAMAASKKLITREEWEKKLSDVKIRKEDMNKLVMNFLVTEGYVEAAEKFRMESGTEPDIDLATITDRMAVKKAVQSGNVEDAIEKVNDLNPEILDTNPQLFFHLQQQRLIELIRNGKVEEALEFAQEELAPRGEENQSFLEELERTVALLAFEDVSNCPVGELLDISQRLKTASEVNAAILTSQSHEKDPKLPSLLKMLLCAQNQLDEKAAYPRVNDLSTATLEDPAV

SEQ ID NO: 2846 - protein, 232 aa, Glycine max
  misc_feature (119)..(119): Xaa can be any naturally occurring amino acid
MANPSGNHEEEQTTHVASSFNGNLAPDTSPTALAMKHNPGIALDWTLQEQTILEEGLSLFASEPNLTRYAKIAQNLNNKTVRDVALRVRWMNKKENCKRRKDDFPRKSKDKKVLLSFIXCHELTAQPNGSLYALAMTMMDNDDGISHIAIGGPTGELLEQNAQAFTIISTNLAALQFQGNVNLFSQTRDNIIKILNDMNDMQEAMKQMPPLPFKINETIFNSILSKTNQHMQ

SEQ ID NO: 2847 - protein, 205 aa, Glycine max
  misc_feature (157)..(157): Xaa can be any naturally occurring amino acid
PTRAALMDEANRSTVIRNNPAALLALCWYWATDGVGSKDMVILPYKDSLLLFSRYLQQLVMESLGKEFDLNGNRVNQGISVYGNKGSTDQHAYIQQLREGVHNFFVTFIEVLHDRPPGHDWELEPGVTCGDYLFGMLQGTRSDLYANNRESLTIRLXRTVGALIGLYERAVGIYASLVNINAYHQPGLGNMACGRGMLNCIQMKT

SEQ ID NO: 2848 - protein, 635 aa, Glycine max
  misc_feature (40)..(40): Xaa can be any naturally occurring amino acid
  misc_feature (45)..(45): Xaa can be any naturally occurring amino acid
  misc_feature (79)..(79): Xaa can be any naturally occurring amino acid
FEYLLSCTITIKGNYKNSSIYLTIHNSFKTDLTYLAQIDXGFYNXSHQPKTEKVDAIKLCKRVAKPDECRSCLNNSRVXLTRLCPKQFEAIKWEEKCMLRYSNRAIFHTMDASFSYPMSNINNATDAEEFNKVLGELLRNLSDKAASGDSRRKYAADTAVFANLQTIYGLVQCTPDLSRQDCGDCLHWSLADFGNVFKNKVGAVVLRPSCNVRYEIYPFYDEPTPSASVPLSLKEKGNSLRTTIAIVVPTVLVVVALLIFISIYFRRRKLARKNLLADEDDDEIELAESLQFNLDTIKVATNNFSDSNKLGEGGFGAVYQGRLSNGQVIAVKRLSSDPGQGGVEFKNEVLLLAKLQHRNLVRLLGFSLEGKEKLLVYEFVPNKSLDYFIFDPTKKARLDWDRRYKIIRGIARGLLYLHEDSRLRIIHRDLKASNVLLDEEMIPKISDFGMARLIVAGQTQENTSRVVGTYGYMAPEYIMHGQFSIKSDVFSFGVLVLEIVSGQKNHGIRHGENVEDLLNFAWRSWQEGTVTNIIDPILNNSSQNEMIRCTHIGLLCVQENLANRPTMANVALMLNSCSITLPVPTKPAFFMDSATTSLPNMSWEVNSGTTRSNQSTTKSAHDSVSEASISELYPR

SEQ ID NO: 2849 - protein, 135 aa, Glycine max
  misc_feature (34)..(34): Xaa can be any naturally occurring amino acid
  misc_feature (60)..(60): Xaa can be any naturally occurring amino acid
DMAILPYKDSLLLFSRYLQQLVMESLGKVFDLDXYIQQLREGVHNFFVTFIEVLRDRPPXHDWELEPGVTCGDYLSGMLQGTRSALYANNRESITVTVQEVTPRTVGALIGLYERAVGIYASLVNINAYHQPGKI

SEQ ID NO: 2850 - protein, 171 aa, Glycine max
CLRRLFEEKDKMQGYNALKYFLTIAAVCLRTAYTLHQGMGLKVMAWIFSISTAIFSTYWDLVLDWGLLQRHSKNRWLRDKLLVPQKSVYFAAMVLNVLLRFAWLQTILNLNFSSLHRQAMVSIVANLEIIRRGIWNFFRIENEHLNNVGKYRAFKSVPLPFNYEEEEDKDE

SEQ ID NO: 2851 - protein, 200 aa, Glycine max
  misc_feature (89)..(89): Xaa can be any naturally occurring amino acid
  misc_feature (117)..(117): Xaa can be any naturally occurring amino acid
  misc_feature (172)..(172): Xaa can be any naturally occurring amino acid
FIFALQVLIAILLCPLNIVYRSSRMFFLTCLIHCICAPLYKVTLPDFFMADQFTSQVQALRSFEFYICYYGWGDFKQRETSCKSNRIFXSFSFIVAVIPYWSRFLQCLRRLFEEKDXMQGYNALKYFLTIAAVCLRTAYTLHQGMGLKVMAWIFSISTAIFSTYWDLVLDWXLLQRHSKNRWLRDKLPLLRLIWQSSMQL

SEQ ID NO: 2852 - protein, 674 aa, Glycine max
MGTETSSVDISEPLLVDSHGNEEKEEYLREEVPEWKEQITIRGLVVSAVLGTLFCIITHKLNLTVGIIPSLNVAAGLLGFFFVRTWTGLLTKMGFFTKPFTRQENTVIQTCVVACYGLAFSGGFGSSLIAMDERTYELIGPDYPGNRAEDVKNPGLGWMMGFMFVVSFLGLFSLVPLRKVMVLDYKLTYPSGTATAMLINSFHTKTGAELAGNQVRQLGKYLSISFCWSCFKWFFSGIGDSCGFDNFPSFGLTLFKNTFYFDFSPTYVGCGLICPHLVNCSVLLGAIISWGFLWPFVSEHAGDWYPADLGSNDFKGLYGYKVFISIALILGDGIYNLIKIILITIREMWRTSSKQLPVVTEVQDDENSQLQSEEKKREEVFLKDRIPTWFAASGYVGLAAISIATIPIIFPPLKWYLVLCSYILAPALAFCNSYGTGLTDWSLASTYGKIGLFIIAAAVGQNGGVIAGVAACAVMMSIVATAADLMQDFKTGYLTLSSAKSMFVSQLIGTAMGCVIAPLTFWMFWTAFDVGSPDAPYKAPYAVIFREMAILGVQGFSELPKYCLEMCGGFFLAALVINLLRDVTPKKFSQYIPIPMAMAVPFYIGAYFAVDMFVGTVILFVWERLNRKDAEDYAGAVASGLICGDGIWTIPSAILSILRIDPPICMYFGPSTSS

SEQ ID NO: 2853 - protein, 192 aa, Glycine max
IRLEQDFKTGYLTLSSAKSMFVSQLIGTAMGCVIAPLTFWMFWTAFDVGSPDGPYKAPYAVIFREMAILGVQGFSELPKYCLEMCGGFFAAALAINLLRDVTPKKFSQYIPIPMAMAVPFYIGAYFAVDMFVGTVILFVWERLNRKDAEDYAGAVASGLICGDGIWTIPSAILSIMRIDPPICMYFGPSTSS

SEQ ID NO: 2854 - protein, 150 aa, Glycine max
  misc_feature (110)..(111): Xaa can be any naturally occurring amino acid
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVXXAHGGVLPNINPVLLPKKSERASKEPKSPSKATKSKGKGR

SEQ ID NO: 2855 - protein, 232 aa, Glycine max
KLMAGSAHVGKIVMSAAVKHLTPVTLELGGKCPAVVDSLSSSWNIEVAVKRIIVGKYGACAGQACIAIDYVLVEKVYCFKLVELMKVWIKKMFGENPQQSKTIAKIVNKHHFSRLKNLLADKKVKESVIYGGSMDEQNLFIEPTILVDPPLEAAIMSEEIFGPLLPIITVEKIEDSIKFINSRPKPLALYVFTKNQTLQRRMISETSSGSVTINDAILQVIPIPYQALIFHS

SEQ ID NO: 2856 - protein, 546 aa, Glycine max
MPSINYLDVSSNKFTGMLFNNMSCNDDLHFVNLSSNLLKGELPTCLEPKTRVVLYARNCLSNKNQDQHPSDFCSNEALAVTIIPHQQKHKRTTSKAIIVSSMGGLVGGMLIVGVVILVVSRVHKKQVVKIPSKSTLEHAISQEHNEDEVKTTTRSIMEHIIKRVPDKRAVETLTRSIKEHVMSRVNSKRVVRASTRSIIEHVSSANTAKLLNDARYISETMKMGASLPAYRTFALEELKEATNNFDESSFISEGPRGQIYKGVLSDGMQIAIRGLKMRKKHGPQTYMHHVEMISKLRHSHLVSALGHAFESNQDDSSVNNVYLIFEFVQNKSLRSCVSGSSGEKLSWTQRITAAIGGVKGIQFLHTGIVPGLYSNNLKITDILLDNNHNVKISSYNLPLSAENKRMISKGTSPGLKGKVQARIQDADKNDVYDIGVVLLETILGRPIMFHNEVGTLKDLLQVSIKTDDIARRSIVDPAVHKECSDESLMTTMEICVRCLSGDPTERPSVENILWNLQFAAQVQNSWRRDSSDHDHSYSPAPSSRET

SEQ ID NO: 2857 - protein, 115 aa, Glycine max
MPCLNLSTNVNLDGVDTSSILSEATSTVASIIGKPEAYVMIVLKGSVPISHGGSEQPAAYGELVSIGGLSPDVNKKLSAGIASILENKLSVPKSRFYLKFYDTKGSNFGWNGSTF

SEQ ID NO: 2858 - protein, 374 aa, Glycine max
  misc_feature (63)..(63): Xaa can be any naturally occurring amino acid
LATSGTHIWATPLDPPIASPAPRHISPRFIISITTILTQPYPILQSFLCPYTHVDTTLRSLAXQAEGFGRFAIGGLHGPLHPVTSLADDGPGSLRDACRRKEPLWIVFEVSGTIQLSSYLNVSSHKTIDGRGQRIKLSGKGLRLKECEHVIICNLEFEGGRGHDVDAIQIKPNSKHIWIDRCTLSDFDDGLIDITRESTDITISRCHFSQHDKAMLIGADPTHVGDRCMRVTIHHCFFNGTRQRQPRVRFAKVHLYNNYIRNWGIYAVCASVESQIFSQHNIYEAGQKKVAFKYLTEKAADKEVGATGTIRSEGDIFLNGAQKGLMTEDVGCNMFHPSEHYPSWTVEAPTDDLKQILHHCTGWQSLAKPADQTL

SEQ ID NO: 2859 - protein, 366 aa, Glycine max
MGNSHGHRHRKHGNSVPPNTVPPPHKYNPHPTTSNSTMLSLPYTHVDTTLRSLAAQAEGFGRFAIGGLHGPLHPVTSLADDGPGSLRDACRRKEPLWIVFEVSGTIQLSSYLNVSSHKTIDGRGQRIKLSGKGLRLKECEHVIICNLEFEGGRGHDVDAIQIKPNSKHIWIDRCTLSDFDDGLIDITRESTDITISRCHFSQHDKAMLIGADPTHVGDRCMRVTIHHCFFNGTRQRQPRVRFAKVHLYNNYIRNWGIYAVCASVESQIFSQHNIYEAGQKKVAFKYLTEKAADKEVGATGTIRSEGDIFLNGAQKGLMTEDVGCNMFHPSEHYPSWTVEAPTDDLKQILHHCTGWQSLAKPADQTL

SEQ ID NO: 2860 - protein, 133 aa, Glycine max
MSLTIPSNLVLNKSLAQCVPKSAARFVCSDDKSATQQQQSMKALSAAVALSSILLSAPMPAVADISGLTPCKESKQFAKREKQQIKKLESSLKLYAPESAPALALNAQIEKTKRRFDNYGKYGLLCGADGLPH

SEQ ID NO: 2861 - protein, 323 aa, Glycine max
MEPQCRIKKDATELIGNTPMVYLNNIVDGCVARIAAKLEYMQACCSVKDRIALSMIEDAEKKGLITPGKTVLVEYTSGNTGIGLAFIAALRGYKLQVTMPSYVSLERKIILRAFGAEVYLTDPAKGIDGVIQKAEELIAKTPDSFMLNQFENPANPNIHYETTGPEIWRDSGEKIDALVSGIGTGGSIAGAGRFLREKNPDIKLYGVEPAESPVLNGGQPGKHLIQGIGAGIIPKVLDVNLLDEVIQVSSEEAIETAKLLALKEGLLMGISSGAAAAAAIKVGKRPENAGKLIVVIFPSFGERYLSSPLFESIRKEAEQMTFD

SEQ ID NO: 2862 - protein, 214 aa, Glycine max
MGASQSQEELQSQQQFQQHQHPNELTRRESLLLSPAASNNTKQFSNSTKVVDNVTAANSTNTNCFMLNARALSITWAENPDYWTWVQDKDESGTMIELPNLKMVCWLEVHGKFDTRKLSLGILYQVSFIVMLKDSAQGWEVPINVRLVLPGGKKQQHKENLNEKLRECWIEIPVGEFVASEKDVGNLEISMYEYEGGKWKTGLIIQGIVIKPKN

SEQ ID NO: 2863 - protein, 124 aa, Glycine max
MNARRDNRNNRVSLFDGIEEGGIRASSVYSSSHEIDEHDNEQALDGLQDRVNLLKRLSGDINEEVDSHNRMLDRMGNDMDSSRGVLSGTMDKFKMVFETKSNQRMFTLVASFVVLFLIIYYLTR

SEQ ID NO: 2864 - protein, 303 aa, Glycine max
MHPAMYEDHVALGCHATRKLRCSERLPSFVKSRSCSCCNPCSPNGNRLTGSHIMEAEKCPLEKTTETPDVSTTITIAKPSGDESLEKQVSVGPRFQAEVPEWTGVFSESDSKWLGTHVWSLKNDTEPATATDVGRGRQEMCSCEFHGSVECVRLHIAENRMKLKLELGSEFYRLGFDRIGEEVSLQWTTEEEQRFKDIMKSNISSKNKYFWNNPSKYFPKKTRRNLVNYYFNVFLIQLRTYQNRVTPESVDSDDDEVEFGSFSDGFGMDAVKSLGDDFLECSLNKQCTDLKYTKLECKFDNWI

SEQ ID NO: 2865 - protein, 391 aa, Glycine max
  misc_feature (123)..(123): Xaa can be any naturally occurring amino acid
  misc_feature (151)..(151): Xaa can be any naturally occurring amino acid
MATATTNSSPSAQRHVGFSRRTQAPRQLDDDSPPVNKYRLLSEIMARAPYAVLERETYSDLLCDQCGSGELPEELLLCDKCDKGFHMKCVRPIGARVPIGSWLCPNCQGGKRVRTFSHKKITXEYPLQINIKNMMSKHYHIISDWNFFFLXICSELLDAKKRKKCSRPLVLHKKKRRLLPFVPTKDLNRRLKQMGSLASALTALNMEFSDHLTYLPGMAPRCANQALLENGGMQTLSKEDMETLEQCIALSKRGEFPPFMVVYDSREGYTVEADDLIKDMTIIAEYTGDVDYLDTRERDDCDSMMTLLLGAESSQSLVICADKRGNIARFISGINNHTQEGRKKQNCKCVRYNVNGECRVFLVAIRDISKGERLYYDYNGHEYQYPTHHFV

SEQ ID NO: 2866 - protein, 496 aa, Glycine max
MGLNRTPRHNPVLPTKSPILSRSHSRSQTMKTTQIFGVSLSLILINLAAIMERADENLLPSVYKEVSETFNAGPSDLGYLTFVRNFVQGLSSPLAGILVINYDRPTILAMGTFCWALSTAAVGVCHDFLQVAFWRAINGFGLAIVIPALQSFIADSYKDGVRGTGFGLLSLVGNLGGIGGGVLATVMAGQQFWGIQGWRCAFILMATLSALIGFLVLLYVVDPRKRFPTTRDASESSDRDDTVYKGNASAASIWIDSWAATKAVIKVKTFQIIVLQGIIGSLPWTAMVFFTMWFELIGFDNNTSATLLSLFAIGCAMGSFIGGSIADQLSQVYPHSARTMCAQFSAFMGIPFSWFLLKVIPQSVSSFPIPSSRSSRSSRSSRSSRAAANAPMFAEVVPVKHRTMIYAFDRAFEGSFSSIAAPLVGILSEKMFGYNSKSVDPIKGSSPEALALSKGLLSMMAVPFGLCCLCYTPLYYIFRRDRENARMLAVKEEEMM

SEQ ID NO: 2867 - protein, 345 aa, Glycine max
MAHPTSSGQSHDLKKEDCKETRSLVVCFGEMLIDFVPTVGGVSLAEAPAFKKAPGGAPANVAVGISRLGGSSAFIGKVGADEFGYMLGNILKQNNVETSGMRFDSNARTALAFVTLRADGEREFLFFRNPSADMLLQESELDKDILKQARIFHYGSISLIDEPCKSAHLAAMSIAKNSGCILSYDPNLRLALWPSADSARKGIMDIWDQADVIKISEDEITFLTGGDDPYDDNVVLKKLFHPNLKLLIVTEGSQGCRYYTKAFKGRVAGVKVKPVDTTGAGDAFVSGILYCIASDQTIFQDEKRLRKALYFANVCGALTVTERGAIPALPTKEAILQFLLEAAVI

SEQ ID NO: 2868 - protein, 255 aa, Glycine max
  misc_feature (129)..(129): Xaa can be any naturally occurring amino acid
MSLLWLVIRQLAEIEAMAASKKLITREEWEKKLSDVKIRKEDMNKLVMNFLVTEGYVEAAEKFRMESGTEPDIDLATITDRMAVKKAVQSGNVEDAIEKVNDLNPEILHTKTQLFFNRRQRRLIPIIFXHLQQQRLIELIRNGKVEEALEFAQEELAPRGEENQSFLEELERTVALLAFEDVSNCPVGELLDISQRLKTASEVNAAILTSQSHEKDPKLPSLLKMLLCAQNQLDEKAAYPRVNDLSTATLEDPAV

SEQ ID NO: 2869 - protein, 219 aa, Glycine max
MDGDSSWSARLSSASRRYQSALQSRSDMFMGFDENDGDDDIREEFLCPFCSEYFDIVGLCCHIDEEHPMEAKNGVCPVCALRVGVDMVAHITLQHGSIFKMQRKRKSRKGGSYSTLSLLRKELREGNLQSLFGGSSCIVSSSNADPLLSSFILPLANEHASSQPHLHTETRSSKKCSDETVSTRNVETSTLSVKDKEEKAKRCEFVQGLLLSTILDDNL

SEQ ID NO: 2870 - protein, 639 aa, Glycine max
  misc_feature (280)..(280): Xaa can be any naturally occurring amino acid
  misc_feature (286)..(286): Xaa can be any naturally occurring amino acid
HASAVIITKDKTEIVTATSSKALKDVAYSFNEDEEEERPSTKPDAKKAEPFMSKTTLRSDNHEVSKEELRRQHQAELARQKNEETARRLAGGGSETGESRSSARTSAELMAYKNINDLPPPREMMIQIDQKNEAVLLPINGSMVPFHVAFIRTVSSQQDTNRNCYVRIIFNVPGTPFSPHDANSMKFPGSIYLKEASFRSKDSRHISEVVQSIKTLRRQVVARESERAERATLVTQEKLQLANNRFKPIRLSDLWIRPAFGGRGRKIPGTLEAHVNGWPXLATHKXEPPPIMFPNIKHAFFQPAENEMITLLHFHLHNHIMVGNKKTKDVQFYVEVMDMVQNVGGGKRSTYDPDELEEEQRERQRKNKINVEFQTFVNRVNDLWGQPQFNGLDLEFDQPLRELGFPGVPHKSSVFIVPTSACLVELIETPFLVVTLSEIEIVNLERVGLGQKNFDMTVVFKDFKRDVLRIDSIPSTSLDGIKEWLDTTDIKYYESRLNLNWRQILKTITDDPQSFIEGGGWEFLNLEATDSESENSEESDKGYEPSDVEPESDSEDEASDSESLVESEDDDDDEDSEEDSEEEKGKTWEELEREASNADREKGNESDSEEDRKRRKAKSFGKSRGASLSSSMPKRSKLR

SEQ ID NO: 2871 - protein, 515 aa, Glycine max
MNGGDEVVAAPAAPPHPLEWKFSQVFGERTAGEEVQEVDIISAIEFDKSGDHLATGDRGGRVVLFERTDTKDHGGSRRDLERMDYSIGRHPEFRYKTEFQSHEPEFDYLKSLEIEEKINKIRWCQTANGALFLLSTNDKTIKFWKVQEKKVKKISEMNVDPSKSMGNGSIASSSNSSSSRPYLANGGSPDRYNYISNDFSFPPGGVPSLRLPMVVTSHETSLVARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRLATGSYSNLFRVFGCAPGSAEATTLEASKNPMRRQVPTPSRPSRSLGNSITRVVRRGAETPGVDANGNSFDFTTKLLHLAWHPSENSIACAAANSLYMYYA

SEQ ID NO: 2872 - protein, 515 aa, Glycine max
MNGGDEVVAAPAGPPHPLEWKFSQVFGERTAGEEVQEVDIISAIEFDKSGDHLATGDRGGRVVLFERTDTKDHGGSSRDLERVDYSIGRHPEFRYKTEFQSHEPEFDYLKSLEIEEKINKIRWCQIANGALFLLSTNDKTIKFWKVQEKKVKKISEMNVDPSKSMGNGSIASSSNSSSSRPYLANGGSPDRYNYISNDFSFPPGGIPSLRLPMVVSSHETSLVARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRLATGSYSNLFRVFGCAPGSAEATTLEASKNPMRRLVPTPSRPSRSLGNSITRVVRRGAETPGVDANGNSFDFTTKLLHLAWHPSENSIACAAANSLYMYYA

SEQ ID NO: 2873 - protein, 137 aa, Glycine max
ESISRLVLLSPKLARPTLLLWAVFFGNPFSYYGLVLLTTELNGHSKCMPDKLQTEKSQDVKYKSVFIASFAELPGLLLSAAAVDKLGAKLSMSTMFFMCWIFLLPLLFYLAESLTTSFLFLARICITTTFTIGYIYA

SEQ ID NO: 2874 - protein, 299 aa, Glycine max
MPRYDDKYGNTRLYVGRLSSRTRSRDLERVFSRYGRVRGVDMKNDFAFVEFSDPRDADDARYNLDGRDVEGSRIIVEFAKGGPRGSRDREYMGRGPPPGSGRCFNCGIDGHWARDCKAGDWKNKCYRCGERGHIEKNCKNSPKKLSQRGRSLSRSPVRSRSPRRGRSRDRSYSRDHSYSRSRSPVRRERSPVSEARSQSREPSKIRKHSASPDQSSPRKRGDTSPGNDRLATHQDGSDYSDGPRGKSRSPASPARDRDEGGYDSPKANGHSRSPSRSPRDDDRSPIDEDDDNHRRSQSP

SEQ ID NO: 2875 - protein, 299 aa, Glycine max
MPRYDDKYGNTRLYVGRLSSRTRSRDLERVFSRYGRVRGVDMKNDFAFVEFSDPRDADDARYNLDGRDVEGSRIIVEFAKGGPRGSRDREYMGRGPPPGSGRCFNCGIDGHWARDCKAGDWKNKCYRCGERGHIEKNCKNSPKKLSQRGRSLSRSPVRSRSPRRGRSRDRSYSRDHSYSRSRSPVRRERSPVSEDRSQSREPSKIRKHSASPDQSSPRKRGDTSPGNDRLATHQDGSDYSDGPRGKSRSPASPARDRDEGGYDSPKANGHSRSPSRSPRDDDRSPIDEDDDNHRRSQSP

SEQ ID NO: 2876 - protein, 415 aa, Glycine max
MDLPLLSKSLQFSLRNKNYLLLIALFGASGYAAYNSPYVAQKRRRIAKLLRAFVSLAELISNSADIVAVISNDLNRFLASESDEIPNSLKQLAKIAKSNDFSTSLARLSEAVTLGIFLGYKSHAGNDYNGNKDNIPSEITAEASRFSDRVLERLFSKAGTGFVSVVVGSFARNLVLGFYDAESVGTRSQSDVPGWVNVICDERCGKLIGDCVQTFVSTAVAVFLDKTKDVNTYDEMLAGLSNPKHQENVKGILVSMCNGAVETFVRTSHQVLTNRSVRSNSGLSVSPVVVPVSEEGCLKQEALLQQLKIGSSVNGVQDVGWLEQIKSTLLVPVNQRFVLDVTGRVTIETVRSFVAFLLWRISDGFKSSVSKVHEEVLGKGLEVVRYVGAKSSVILTLCLALYLHIMGGSRILLPA

SEQ ID NO: 2877 - protein, 259 aa, Glycine max
  misc_feature (199)..(199): Xaa can be any naturally occurring amino acid
MRKCTVQALGLAIAFFLLLILLTPSIPQPQRYHDFADKREFFGIPNALNVISNFLFMVIGLIGLVLCHRMNYFNISLQGELWGWTCFYVAVTSVAFGSSYYHFGPNDAGLVWDRLPMSVAFASLLAILVIERIDAKKGTISIVSLIMAGIMSNVYWRFFGDIRLYVLAQGASCIAIPLMATLLPPMYTHSAYWLWASGXFYVLAMLQEAADRVIYLLTFHIVSGHTLKHLSAAMVPIILTVMLAKRSVYSEKLLHAKSA

SEQ ID NO: 2878 - protein, 321 aa, Glycine max
  misc_feature (66)..(66): Xaa can be any naturally occurring amino acid
MSTAAAAGGDMEAGFAKLQGEDFEYYMQTYSIVLGRNSKKSTVDVDLSSLGGGMNISRHHARIFYXDFARRRFALEVLGKNGCLVEGVLHLPGNPPVKLDSQDLLQIGDKEFYFLLPVRSILVGPVGPRHYPNHAAPGPVVPHYNNYHLGPGPVKKAPRREYYEEEFDDEDDVGGRKMRRDGYDGYGYAGGKSSLSAPMDKKSEGRSRVDRDADNLQLQQLEEKDVVSSVATVLSDLCGPGEWMPMEKLHTELLEQYSSVWHHNRVRRYLTSEDWPGPESKGKPWYGLLMLLRKYPEHFVINTRSKGRVTHEFVSLVSLLS

SEQ ID NO: 2879 - protein, 190 aa, Glycine max
  misc_feature (175)..(175): Xaa can be any naturally occurring amino acid
IRLWVDGEKFLTSEPPEVVQARNDNSHGTNFPDSPEPIYGTQFLPRKFKIAVTVPTDNSVDILTNDIGVVVVMDDDGEPQGFNIYVGGGMGRTHRLETTFPRLAEPLGYVPKEDILYAVKAIVVTQRENGRRDDRKYSRLKYLISSWGIEKFRGVVEQYYGKTFEPFRALPEWEXKSYFGWHEQGDGSSL

SEQ ID NO: 2880 - protein, 138 aa, Glycine max
  misc_feature (135)..(135): Xaa can be any naturally occurring amino acid
MLVYTDLLTGDELLSDSFPYKEIENGILWEVEGKWTTKGCVEVNIGANPSAEEGGEDEGVDDSVEKVVDIVDTFRLQEQPTYDKKGFIAYIKKYIKLLTPKLTPEQQEEFKKGIEGATKYLLPKLKDFQFFVGEXMHD

SEQ ID NO: 2881 - protein, 143 aa, Glycine max
  misc_feature (95)..(95): Xaa can be any naturally occurring amino acid
MALNNGVPATGTGLIVSFGEMLIDFVPTVSGVSLAEAPGFLKAPGGAPANVAIAVSRLGGKAAFVGKLGDDEFGHMLAGILKENGVRADGINFDXGARTALAFVTLRADGEREFMFYRNPSADMLLKPEEIKNSHETITRKKK

SEQ ID NO: 2882 - protein, 182 aa, Glycine max
MPSSESSTGFSETICVTGAGGFIASWMVKLLLEKGYTVRGTLRNPDDPKNGHLKEFEGASQRLTLHKVDLLHLDSVRSVINGCHGVFHTASPVTDNPEEMVEPAVNGAKNVIIAAAEAKVRRVVFTSSIGAVYMDPKRSIDLVVDESCWSDLEFCKNTKNWYCYGKAVAEEAAWDTAQEKRV

SEQ ID NO: 2883 - protein, 72 aa, Glycine max
  misc_feature (37)..(37): Xaa can be any naturally occurring amino acid
IILSCCCYTCCIRRKLRKMLTIRGGFIDDFLSHLMCXCCALGKKGEKCRSVVLKVLRRPTQDLHPRSTWNHK

SEQ ID NO: 2884 - protein, 370 aa, Glycine max
MSFREGKIEGEDRECEESVLGSTESKSVRENGSLASTQLTVDENLLVDPKLLFIGSKIGEGAHGLCGFSRYGNKIVAIKVLHRGSTSEERASLENRFAREVNMMSRVHHDNLVKFIGACKDPLMVIVTELLPGMSLRKYLTSIRPKLLDLDVAINFALDIARAMDWLHANGIIHRDLKPDNLLLTADQKSVKLADFGLAREETVTEMMTAETGTYRWMAPELYSTVTLRQGEKKHYNNKVDVYSFGIVLWELLTNRMPFEGMSNLQAAYAAAFKQERPGIPDDISPELAFVIQSCWVEDPNLRPSFSQIIRMLNAFLFTLSPPSPPLPVPPDNEPEVATTSNGTITEFSARNRGKFGFLRQLFSSKRTKN

SEQ ID NO: 2885 - protein, 186 aa, Glycine max
  misc_feature (29)..(29): Xaa can be any naturally occurring amino acid
  misc_feature (112)..(112): Xaa can be any naturally occurring amino acid
  misc_feature (115)..(115): Xaa can be any naturally occurring amino acid
RVSYVGPPQQVSPIEYGHVLLIPRIFECXPQRIDRESFLLALHMAVEADNPYFRLGYNSLGAFATINHLHFQAYYLALPFPIEKAPTKKIASLNGGVKISELLKYPVRGLVXEGXDTLEDLSNVVSDACICLQNNNIPFNVLISDCGKQVYLLPQCYAEKQALGEVDAELLDTQVNPAVWEISGHM

SEQ ID NO: 2886 - protein, 461 aa, Glycine max
VQWALGKAGEDRVHVVVSEELGWLFVGIYDGFNGGDAPEFLMGNLYRAVHNELQGLFWELEEEEQPLPQESNPVVEGTESKRRKLWELLAEDGLDLSGSDRFAFSVDDALSVNNANAGSAVSRRWLLLSKLKQGLTKQKEGEGRGWNMGNEEKERENQEKHCGRKRRVGPVDHGLVLSALSRALEVTELAYLDMTDKLLDTNPELALMGSCLLVALMRDEDVYVMNVGDSRAIVAHYEPKEVDSSVELGSKRGVESGAQSIVEVPLGLGQIGSAQQKRLVALQLSTDHSTSIEEEVIRIKNEHPDDAQCIVNGRVKGRLKVTRAFGAGFLKQPKWNDAVLEMFRNEFIGTAPYISCSPSLCHHRLCQRDQFLILSSDGLYQYLNNDEVVSHVESFMEKFPEGDPAQHLIEELLLRAAKKAGMDFHELLDIPQGDRRKYHDDVTVMVISLEGRIWKSSGKYP

SEQ ID NO: 2887 - protein, 215 aa, Glycine max
LICGGKSFYGALLCCAWSMDGKYILTGGEDDLVQVWSMEDRKVVAWGEGHNSWVSGVAFDSYWSSPNSNDNEETVRYRFGSVGQDTQLLLWDLEMDEIVVPLRRPSGGSPTYSAGSQSSQWDSVVPLGTLQPAPSMLDVLKISPLVTHRVHTEPLSGLIFTQESVLTACREGHIKIWIRPAAAESQSSNAETLLSTSLKEKPSILSKVGNSSHRQ

SEQ ID NO: 2888 - protein, 180 aa, Glycine max
LEPNRLERLEKCHDQPRVRGVAFDSYWTSPNSNDNGETVTYRFGSVGQDTQLLLWDLEMDEIVVPLRRPPGGSPTYSTGSQSSHWDNVVPLGTLQPAPSMRDVPKISPLVAHRVHTEPLSGLIFTQESVLTACREGHIKIWMRPGVAESQSSNSENLLATSLKEKPSLSSKISSNSSYKQ

SEQ ID NO: 2889 - protein, 444 aa, Glycine max
  misc_feature (145)..(145): Xaa can be any naturally occurring amino acid
  misc_feature (194)..(194): Xaa can be any naturally occurring amino acid
  misc_feature (204)..(204): Xaa can be any naturally occurring amino acid
  misc_feature (230)..(230): Xaa can be any naturally occurring amino acid
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGXKKLLKTFLVKVAYTGNDMMETNLPVQVFMVIPVGTYELKVAEDNGDGAXEHLWRRLERXYKSFVTEYPIVSIEDPFDQDDWEALXLSLMLRSEAMYKLIVIIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 2890 - protein, 288 aa, Glycine max
IRLEGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 2891 - protein, 475 aa, Glycine max
  misc_feature (354)..(354): Xaa can be any naturally occurring amino acid
MTVFLATRLVLRRSPPLLWRRSFSRAAVEAEKDTVAVPSLPLFDYSPPPYAGPTADEILAKRREYLSPSILHFYKNPVNIVEGKKQYLFDEKGRRYVDAFGGIATVCCGHCHPDVVEAIVNQTKKLQHSTVLYLNNAIADFAQALTSKLPGNLKVVFFTNSGTEANELAILIARLYTGCHDIISLRNAYHGNAAGTMGATAQSIWKFNVVQSGVHHAVNPDPYRGIFGSDGEKYARDVQDIINFGTSGNVAAFISEAIQGVGGIIELAPGYLPAVYNTIKKTGGLFIADEVQAGFGRTGSHFWGFEAHNVVPDIVTMAKGIGNGIPLGAVVTTPEIAEVLTRRSYFNTFGGNPXCTAAGLAVLKVIEKEQLQQNAFVVGSYLKERLTALKDKYELIGDVRGRGLMLGVELVTDRELKTPAKGETLHVMDQMKELGVLIGKGGYYGNVFRITPPLCFTKEDADFVADAMDLTLSRM

SEQ ID NO: 2892 - protein, 201 aa, Glycine max
  misc_feature (19)..(19): Xaa can be any naturally occurring amino acid
  misc_feature (30)..(31): Xaa can be any naturally occurring amino acid
  misc_feature (112)..(112): Xaa can be any naturally occurring amino acid
  misc_feature (120)..(120): Xaa can be any naturally occurring amino acid
  misc_feature (160)..(160): Xaa can be any naturally occurring amino acid
GPRIGRFDRSGRSVALRGXHSASLVVLGTXXLWFGWYGFNPGSFLTIAKGYESGGYYGQWSAIGRTAVTTTLAGSTAALTTLFSKRLLAGHWNVIDVCNGLLGGFVACHSDXTLVEQWTXVCEWVSDGVAFVLGLISQPRRYSTMICWSAAQFHGGCGAXGIYVTGLFAKKEYVEEIYGGGRPFGALMGGGGRLLAAQVIQ

SEQ ID NO: 2893 - protein, 287 aa, Glycine max
LCTESRGGVGSKSEVTSVDRKRINDVLDKQLERSSPSTSRAAGAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 2894 - protein, 537 aa, Glycine max
MAALNLCRMALRSSKLLSRPYHRLSVQLQMQMQPSSPPLTRKMSMDAQSVASQLNSSGLLRTQGLIGGKWSDAYDGKTIKVYNPATGESIVDVACMGGRETNDAISAAYDAYGSWSKTTAAERSKLLRKWYDLLMVHKEELAQLITLEQGKPLKESVGEIVYGAGFIEFAAEEAKRIYGDIVPAPFSDRRLFVLKQPVGVVGAITPWNFPLAMITRKVGPALACGCTVVIKPSELTPLTALAAVELSIQAGIPPGVVNVVMGNAPDIGDALLASPQVRKITFTGSTAVGKKLMAGSAETVKKVSLELGGNAPCIVFDDADLDVAVKGTLAAKFRNSGQTCVCANRIIVQEGIYEKFANALRDAVQNMKVGDGFSEGVSQGPLINEAAVKKVESLIHDATSKGAKVILGGKRHSLGLTFYEPTVISDVNSDMHISREEAFGPVAPLLRFKTEEEAIRIANDTNAGLGSYVFTNSIQRSWRVAEALEYGLVGVNEGVISTEVAPFGGFKQSGLGREGSKYGMDEYLEIKYVCFGNMNKE

SEQ ID NO: 2895 - protein, 47 aa, Glycine max
MVCEKREKKLSKVIVPDKWKEGASNTTEGGGRKINENKLLSKKNRSF

SEQ ID NO: 2896 - protein, 231 aa, Glycine max
MYTKGGATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 2897 - protein, 339 aa, Glycine max
NWNVDGILIPSSSSSSSKNRFSVTFLKMDEDSLKRYTDCVYFLASPLTCKKGAECEYRHNEIARLNPRDCWYWLSGQCLNPTCAFRHPPLDGHTGAPVPSEPTQTSLPANKTLVPCYFFFNGFCNKGDRCSFLHGPDDSIFNIKPVKNENGSTDALNLENKAPSGNRTGVTSTPTDRSVAAPKNLSDLKHQPKEDHQLELPKNVKQQGDYLELSASEYKEAAVSRSDSSIPDDGFVHNVPHLCTGQSSEEQVNSHIEPEEWWESSPHSPGFDVLVHDEVENLGYEEDSEYLPVVDRDEQELNDQYFRYEFIDPVEYDTICPEADILYEQETYDGYRCLE

SEQ ID NO: 2898 - protein, 179 aa, Glycine max
  misc_feature (114)..(114): Xaa can be any naturally occurring amino acid
MASSMISSPAVTTVNRAGAGMVAPFTGLKSMAGFPTRKTNNDITSIASNGGRVLCMQVWPPIGKKKFETLSYLPDLDDAQLAKEVEYLLRKGWIPCLEFELEHGFVYREHYRSXLEYYDGRYWTMWKLPMFGCTDASQVLKELQEAKTAYPNGFIRIIGFDNVRQVQCISFIAYKPPGF

SEQ ID NO: 2899 - protein, 463 aa, Glycine max
  misc_feature (134)..(134): Xaa can be any naturally occurring amino acid
MPSKRLQWRSLVLGCFKATKNQSLESPNIVSKKSSSSRIFLSDLSLSDYSSVSIMSDLSNSLVGSNLRIFTYQELSEVTHNFSKSNYLGEGGFGKVFKGFIDDNLKPGLKAQTVAVKALNLDGKQGHRAWNSAXLEPGQLKHRHLVNLIGYCCEDEHRLVVYEYMERGNLEEKLFKGYLAALPWLTRIKIAIGAAKGLMFLHEEEKPVIYRDIKASNILLDADYNAKLSDFGLAIDGPEKDQTHITTRVMGTHGYAAPEYIMTGHLTTMSDVYSFGVVLLELLTGKKSVDKKRPTREQDLVEWARPLLKDSHKLERIMDTRLEDQYSTEGARKFAALAYQCLSHHAKARPTMRTVVRTLEPLLELKDIPVGPFVYVVPSEEESTKVNEKVTENEHVEINQGELKNKEKEEEEKGDKKEKGPPRQRKSRPNRRRVKPLRSLTAYSDTALYKTLGTNLYSPKQSQ

SEQ ID NO: 2900 - protein, 140 aa, Glycine max
  misc_feature (23)..(23): Xaa can be any naturally occurring amino acid
  misc_feature (80)..(80): Xaa can be any naturally occurring amino acid
  misc_feature (109)..(109): Xaa can be any naturally occurring amino acid
  misc_feature (124)..(124): Xaa can be any naturally occurring amino acid
PLIYEFQTCLFTSCRTRKLLWSXRVSPNVIYSLQHMHSDTSTLAVGGIDGILRLLNQNDGSVVSSCVMGDKLLSTFQSPXGSIQRRKGSRLPENIYINIDLIPKTARPXITCLAFGMKKIVTTXNTNDIRLWKFKSKISL

SEQ ID NO: 2901 - protein, 185 aa, Glycine max
MESAALSRIGLAGLAVMGQNLALNIAEKGFPISVYNRTASKVDETVDRARNEGSLPLTGQYTPRDFVLSLQRPRSVIILVKAGAPVDQTIAALSDHLDPGDCIIDGGNEWYENTERRMSLVADKGLLYLGMGVSGGEDGARHGPSLMPGGSHQAYSNVQDILHKIAAQVEDGPCVTYIGEGGSGN

SEQ ID NO: 2902 - protein, 158 aa, Glycine max
MAEEHRCQAPRFCANNCGFFGSPATQNMCSKCYRDFQLKEQQSSNAKMVLNQSLVPSPPPAVISQPSSSSSAAVDPSSAVVDDAPRESEEVKAPQQNRCMTCRRRVGLTGFKCRCGMMLCGTHRYPEQHACEFDFKGMGREQIANANSVVKGEKLDKI

SEQ ID NO: 2903 - protein, 111 aa, Glycine max
  misc_feature (106)..(107): Xaa can be any naturally occurring amino acid
  misc_feature (110)..(110): Xaa can be any naturally occurring amino acid
MVLNQSLFPSPPPAVISQPSSSSSAAVDPSSAVVDDAPRESEEVKAPQQNRCMTCRRRVGLTGFKCRCGMMLCGTHRYPEQHACEFDFKGMGREHIAKANSVVKGXXLYXI

SEQ ID NO: 2904 - protein, 159 aa, Glycine max
MKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNNVPTGGLANVAATVMNLHGFEAPSDYETTLIEVVDN

SEQ ID NO: 2905 - protein, 287 aa, Glycine max
MPRYDDKYGNTRLYVGHLSSRTRSRDLERAFSRYGRVRGVDMKNDFAFVDFSDPRDADDARYNLDGRDVDGSRIIVEFAKGAPRGSREYLGRGPPPGSGRCFNCGLDGHWARDCKAGDWKNKCYRCGERGHIERNCKNSPKKLSTRRGRSYSRSPVRSHSPRRGRSRDRSYSRDRSYSRSRSPVRREESPVREDRSQSPQHKNSPQPSKTRKHSPSPDRSPQRRGDTSPDNDRLSRSPARDREDRGYDSPKVNGRSGSPSRSPRDDDRSPIDDEDNHRHSPRGSESP

SEQ ID NO: 2906 - protein, 218 aa, Glycine max
  misc_feature (206)..(206): Xaa can be any naturally occurring amino acid
MCLLLIFIALLGSKKKPRAESARGGDKDGNAAGNGFLLLDSEFNVKGRWEKPGHSPLFGYDFWYQPRHNTMISTSWGAPSAFTKGFNLQHLSDGLYGRHLHVYSWPGGELRQTMDLGDSGLIPLEIRFLHDPAKDTGFVGSALTSNMIRFFKTQDESWSHEVAISVKPLKVQNWILPEMPGLITDFLISLDDRFLYFVNWLHGDIXQYNIEDVKNPKL

SEQ ID NO: 2907 - protein, 307 aa, Glycine max
PRVRKNIKRENNQYDNFAILVVDQGRSIAMDIGGEVEETVRELRQYFKTGKTKSVTWRKNQLTALLDLVHENEDAIFKALHQDLGKHPVEAYRDEVGGVEKSASNALSCVEKWMAPKKSDIPFLFFPAKGEVLSEPLGVVLIFSSWNFPIILTLDPIIGAISAGNVVVIKPSEQSPASSSFLATTIPRYLDSNAIKVIEGGPDVCEQLLLQKWDKIFFTGSPRVASVVMSAAAKNLTPVTLELGGKCPAILDSLPNPSEFELAVKGIVGGKWGPCSGQACIGIDYLLVEEKFSSAVVFITIINSYFC

SEQ ID NO: 2908 - protein, 154 aa, Glycine max
KQGTATLGGQIKDLVILSYEDRLVLFSRYLPQLVMESLGQEIDLNGNRVNQGISVYGNKGSTDQHAYIQQLREGVHNFFVTFIEVLRDRPPGHDWELEPGVTCGDYLFGVLQGTTSALSANNRQSITVTVQDVTPRSDGALVALYERAAGIYAA

SEQ ID NO: 2909 - protein, 386 aa, Glycine max
MAKPVSIEVWNPSGKYRVVSTKPMPGTRWINLLIQNDVRLEICTEKKTILSVEDIIALIGDKCDGVIGQLTEDWGEELFSALSKAGGKAFSNMAVGYNNVDVDAANKYGVAVGNTPGVLTETTAELAASLTLAAARRIVEADEFMRAGLYDGWLPHLFVGNLLKGQTVGVIGAGRIGSAYARMMVEGFKMNLIYYDLYQSTRLEKFVTAYAAFLKANGETPVTWKRAATMDEVLQEADIISLHPVLDKTTYHLVNKERLAKMKKEAILINCSRGPVIDEAALVEHLKHNPMFRVGLDVFEEEPYMKPGLAELKNAIVVPHIASASKWTREGMATLAALNVLGKVKGYPVWFDANRVEPFLNENARPPAACPSIVNAKALGLPTSKL

SEQ ID NO: 2910 - protein, 371 aa, Glycine max
  misc_feature (272)..(272): Xaa can be any naturally occurring amino acid
MATTNPFDLLGDDAEDPSQLIAAEQLKAAAAASAATAAPKKAPAQQNKPAQLPTKPPPPAQAVRDARNEPVRGGRGGGRGGGRGFGRGRGFSRDSSNDENSFPTSRAPYNQGPFEEGDAGKSSERRSYGGPRVPYRGGRRGGFSNGETGEGEDGRPRRAFDRRSGTGRGNEFKREGSGRGNWGTQTDELAQVTDEDANETEKNLGDEKPAVEEDVADGNKDSPTNETEEKEPEDKEMTLEEYEKVLEERRKAFQALKTEERKVDTKEFESMXQALSSKKDNHDIFIKLGSDKDKRKEAFEKEEKSKKSVSITEFLKPAEGEAYYNPGRGRGRGRGSRGGGGGGGVYRGSSTNNAPAPSIEDPGHFPNLGAK

SEQ ID NO: 2911 - protein, 220 aa, Glycine max
  misc_feature (78)..(78): Xaa can be any naturally occurring amino acid
MLIFLSFVEVKLFQCQPCQFHRCTELYLPHQTYYTRTTSIKVSMADQNEPSEVNMQIGIMREKLKETLPVSVQEFPWXKAEHILLDRLLNLAQETVKWSLVLFFIFSSVSDVVYTFSINRELVIPVGLFVGCLAADFLKEISQELFHKSEEKGLKRHLLGMYCLFVFVKFMSTWFAALPQVFLLHVANGGLMQVLWHLRIFMEDGKNKQETSSSSSLEAS

SEQ ID NO: 2912 - protein, 135 aa, Glycine max
MATTACFIIVSRNDIPIYEAEVGVAAKREDAAQLHQFILHAALDIVQDLAWTTSAMYLKSVDRFNELVVSVYVTAGHTRLMLLHDSRNDDGIKSFFQEVHELYIKTLLNPLYLPGSRITSSHFDTKVRALARKYL

SEQ ID NO: 2913 - protein, 338 aa, Glycine max
MNNIESYPPVLRHLDHHQLPPPPNPDPDKDPTQQDSDPIPIIDFSCLNHDKSKLDEACKDWGFFRLVNHGIPMTLLKKLQEVAKELFSLSFEAKEGACSGSPVSYFWGTPALTPSGTTTRGPQNMNWVEGFDVPLSQLPHFNPHQLPTLESIRLPIKDYKTHLSRIATTLFEAMAKNLDLSLKPSEPYLAENTGMVRVYRYPNCSDANVGWGMEAHTDSCPVLSILNQDDEVSGLQVLKDDQWLTVKPISNTLIVNLGDMMQAISDDRYKSVTHRVSINKHKERISICYFVFPGEDVAIESYKYKPFTYNEFRAQVQQDIKALGYKVGLSRFQHHEEC

SEQ ID NO: 2914 - protein, 166 aa, Glycine max
MDDAETKGRIEETVRRVLQESDMDEVTESKIRKQASEQLGLDLSQPHFKAFVKQVVKAFLQEEEQRQQQQQQDEDDDDEEEEQGGVSKGKEYDDEGDLIICRLSDKRRVTIQDFRGKTLVSIREYYKKDGKELPTSKGISLTEEQWSTFKKNVPAIEKAIKKMESS

SEQ ID NO: 2915 - protein, 491 aa, Glycine max
  misc_feature (151)..(151): Xaa can be any naturally occurring amino acid
  misc_feature (169)..(169): Xaa can be any naturally occurring amino acid
MGGTCADLHHHESDIELTDAERIGTDVGPDSGTKSQGEEAEGQHYVEVTMDIHRDSVALHSVKTVAADDVDMVEEEEEEGDKLGLMGKKRLEKKTSFGASVVQSAANRMKQLKRLASFSKPAPKHFERTKSAVGHALTGLKFISKTDGGAXWVEVEKRFHKLTATTDGXVPRALFAQCLGLNKESEAYAEKLFDTLARQRGIQGGSINKIQMKEFWDHISDQSFDTRLKTFFDMVDKDADGRITQEEIKEIICLSATANKLSNIQKQAEEYAALIMEELDPDDTGYIMIDNLETLLLHGPEETTRGESKYLSQMLSQKLKPTFADSAVMRWCRDAKYFLLDNWQRSWVLALWIGVMFGLFAYKFVQYRRKAAYEVMGHCVCMAKGAAETLKLNMALILLPVCRNTITWLRNKTKLGVVVPLDDNINFHKVIAVAIAVAVAVHSIYHLTCDFPRLLHASDEKYKLMQPFFGDRPSDYWYFVKSWEGVTGIII

SEQ ID NO: 2916 - protein, 73 aa, Glycine max
MIEVVLNDRLGKKVRVKCNDDDTIGDLKKLVAAQTGTRADKIRIQKWYTIYKDHITLKDYEIHDGMGLELYYN

SEQ ID NO: 2917 - protein, 536 aa, Glycine max
  misc_feature (117)..(117): Xaa can be any naturally occurring amino acid
  misc_feature (139)..(139): Xaa can be any naturally occurring amino acid
  misc_feature (156)..(156): Xaa can be any naturally occurring amino acid
  misc_feature (429)..(429): Xaa can be any naturally occurring amino acid
  misc_feature (443)..(443): Xaa can be any naturally occurring amino acid
MVVNERPSKRMKRRVTADLRDFLTFPEPGVTASGQPFRNCVQRFLSDHARITFPPSLFPSLMTWQILFRVGDIVSGPDLSPAMVTLDIVEEDVTRCRTSVYCDQCRVVGEHIRRVCXLSDCRLHAFSITSNKIVSKTQXCSRCGNLLQLSETRCRXCNFAITVDDLEDWVYLQIEDNTHLLHGVVHANGYGHLLTLNGREGGSKLLSGFDIMNFWDRLCAAISVRKVSVMDLSKKFGLEYRLLHAITNGHSWYGNWGYQFGTGSYALTQNAYKNAVNTLSSMLLSSFSFHGRGPRSRLECVISLYQSLAETELLTIKDLFSFLLTLILECRKPVAMRTSKQTSNLLCAWTGNDVEDVQHALIKVLLASGVCTEAKWVTRRTLKGAVCRGVSSPELLDYCLKHLPGKLAANGMIVCSRCNPISSGIEFRXRLNTWLCFYTIIPXLEPWCNGLSTNSGYPTDAQLISDLTFLFDSIIHPDKMVCYRPKNMRKRVADSARKLLDCKQFMKDYKPYEMAVELPSLWWLLSPAGLSPHMFL

SEQ ID NO: 2918 - protein, 381 aa, Glycine max
MSSSTVGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 2919 - protein, 548 aa, Glycine max
RGSLERSSSPRSSTCATPNAFSHYSSEANKGNQQQLEHVRKRLRPPSCAAVTKIKGKGKVKTQWVCCNCGHSTGKWWGQCPECQIVGTMNEFRESKLTGTKSSGGLAVSEDPVGSWLPQRPQELRPLKLEEINRRFNYQQWRIPLSGSFGNEVSTVLGGGLVPGSLTLVGGDPGIGKSTLLLQLNWKIAAMIAKECSDDEEPPVVYVSGEETKLGKHNKQLSNVGPPPPDIYLYSSNDVEDILKKVQYLSPGALIVDSIQTVYLKGIMGSPGGIMQVKECTSALLRFAKKTNIPVLLIGHVTKSGDIAGPRVLEHIVDVVLYMEGEKYSSHRMLRAVKNRFGSADELGVFEMSHSGLQAVSNASEMFLSEQLLDSEILAGLAVAVIMDGSRTFLIEIQALCLSGSTGSRQVNGIQQKRADMIISVLIKQAGLRLQEHAVFLNVVSGLALTETAGDLAIAAAICSSCLEIPIPNDIAFIGEIGLGGELRMVPRMEKRVYTVAKLGYRMCIVPKVAEKALGTEGLEKMEVVGCRNLKEVINTVFLNIMRR

SEQ ID NO: 2920 - protein, 269 aa, Glycine max
  misc_feature (267)..(267): Xaa can be any naturally occurring amino acid
MSSQRADLECRIFPEPDASEIDHFDRLPDSLLLLVFNKIGDVKALGRCCVVSRRFHSLVPQVENVVVRVDCVISDDDSSSSSAASDKSRGPFWNLLRLVFGGIVKPIQTLGQFLGPKRPSSSSVTSPSSTTSSSPLAVGTDDDSDAGVTHHSPTQVLKNFNEIRLLRIELPSGELGIEDGVLLKWRADFGSTLDNCVILGASSVFHPKDNNLTDPILPTTNCNAYDDNGSIPDSFYTNGGLKLRVAWTISSLIAACARHYLLQPIIXEH

SEQ ID NO: 2921 - protein, 259 aa, Glycine max
SRADSARDPYLWMSIAQENGWHVLIDACALGPKDMDSFGLSLFQPDFLICSFYKVFGENPSGFGCLFVKKSAITTLESSSCAGIVNLVPDRLLLHPSEDKDSSKQKPLSILQEQDLSSLSSFSGRIQTSQAIKVEQELSELQIIAAPAKPKQGSGRVEAKGPVESLQSKKAQDGSENGGFNIDCRCLDQVDSLGLIMITNRTRYLINWLVNSMMKLKHPNAEGVPLVKIYGPKVKFDRGPALAFNVFDWKGEKVEPVLV

SEQ ID NO: 2922 - protein, 112 aa, Glycine max
KVEPVLVQKLADRNNISLSYGFLHHIWFADKYAEDKGKVLQTKEGRVQGVITNKKKDRDELGVTVVTAALSFLANFEDVYKLWTFVARFLDADFVEKERWRYTALNQKTIEV

SEQ ID NO: 2923 - protein, 346 aa, Glycine max
MEKLQLHVPRVKLGSQGLEISRLGFGCVGLSGLYNAPLSHEAGCSIIKEAFNMGVTFFDTSDFYGLNHDNEIMIGKALKELPREKVQLATKFGLVRSDGVFAGVKGTPEYVRQCCEASLKRLDVEYIDLYYQHRVDTSVPIEDTMGELKKLVNEGKIKYIGLSQASPDTIKRAHAVHPISALQMEYSLWTRDIEEEIIPLCRQLGIGIVAYSPLGRGFFAGKAVVETLPSQSLLSMHPRFTGENLEKNKLFYKRLDDLASKHACTPSQLALAWLLHQGNDIIPIPGTTKLKNFENNIGSLTVKLTEEDLRELSEAVPVYEVAGTREYGMLSNYTWKFATTPPKQLS

SEQ ID NO: 2924 - protein, 190 aa, Glycine max
QERGALRCHEHTSKLDQWTLTHKQVELVDKAGFGYLRSIPAISLDNPLISALVERWRRETNTFHLNVGEMTVTLKDVALLLGLAIDGEPVIGITYTACSSVCEKYLGRSPESGYTSGGMVKLSWLKEFFSRCPEDAPLEVIEQHTRAYLLYLVGSTIFSTTTGNKVPVMYLPLFENFDRCGQYAWGAAGT

SEQ ID NO: 2925 - protein, 201 aa, Glycine max
  misc_feature (176)..(176): Xaa can be any naturally occurring amino acid
MANNGAKDPLLSGSLDATQKTKQQLLNKRRLLRSRSAPHAELVPTETNCNESIPRTASIFQNLHPSFKRMAIYLAVYLGVGALIFYLVRNQIKGQKTDGILDALYFTIVTMTTVGYGDLVPNSHLAKLLACAFVFSGMALIGLIVSKAADYLVEKQELLLVKAMRMHQKIGSTEIXREVETNKTRYKLFSSLFPFLLILII

SEQ ID NO: 2926 - protein, 286 aa, Glycine max
MHTLLRSTLRTKTASSLAYAAVSRSAQENLLQAPLLSRSNSTEASLAKDTSSNDVKNGQGFKGHSMLAPFTAGWQTTDLHPLVIEKSEGSYVYDINGKKYLDALAGLWATSLGGSEPRLVDAAIAQLKKLPFYHSFWNRTTLPSLDLAKELLEMFTARKMGKAFFVNSGSEANDTQVKLVWYYNNALGRPDKKKFIARAKSYHGSTLIAASLSGLPALHQKFDLPAPFVLHTDCPHYWRYHLPGETEEEFSTRLAKNLEQLILKEGPETVIHSNACKVHEHLFQWF

SEQ ID NO: 2927 - protein, 673 aa, Glycine max
TRPCEFKANCFFFKFFAGSIFLVFTAPMLIIAFLAIAHLILTGEDQLQEKKTSKLPRFRLWTFPVLVKGPFGVVSATELIGIVLVLLYVIWALYAYTVRALDFISEFDVPSFRDKSIIMFKVMGLRTGAIGLMCLAFLFIPVSRGSVLLRYIDIPFEHATRYHVWLGHLTMVLFTVHGLLYVVAWAMEGHLVQELVQWKDIGVANLPGVISLLAGLLMWVTSLPGVRTWNFELFFYTHQLYVVFIVFLALHVGDFVFTMAAGGIFLFVLDRFLRFCQSRRTVNVISSRCLPCGTVELVLSKPQSLRYNALSFIFVQVRELSWLQWHPFSVSSSPLDGKNHLAILIKVLGKWTEKLRQRITDVDAQKDSCVITTSVEGPYGHEVPYHLMYENLILVAGGIGLSPFLAILSDILHRVREGKPCQSRNILLVWAVKKSNELPLLSTIDMESICPSFSNKVNIDIHIYVTRESDPPLEEGYSYKPIKSSFCPMASDCGMSVLVGTGDNFWSGLYVISSTVGFVILLALLYVYYVTPFHIETWWYRGLLYVICMVASVVIFGGSVVAMWHIWEKQNSLKDKSNDTKVDKIHQNGSLTPKDQSQVSSIAKSTVIHYGSRPNFKEIYDSISEKWGLVDVGVIVCGPSTLQTSVAEEIRSHSMTRQRHHSIFHFHSHSFDL

SEQ ID NO: 2928 - protein, 93 aa, Glycine max
MGFRIAGIVRRTSFYTTQAASKRVDVPKGYAAVYVGDKMRRFTIPVSYLNEPSFQELLSQAEEEFGYDHPMGGLTIPCKEEEFLNVTAHLNEL

SEQ ID NO: 2929 - protein, 190 aa, Glycine max
  misc_feature (120)..(120): Xaa can be any naturally occurring amino acid
  misc_feature (141)..(141): Xaa can be any naturally occurring amino acid
  misc_feature (174)..(174): Xaa can be any naturally occurring amino acid
  misc_feature (180)..(180): Xaa can be any naturally occurring amino acid
MVVNERPSKRMKRRVTADLRDFLTFPEPGVTASGQPFRNCVQRFLSDHARITFPPSLFPPSSVGPFPRPLWSLSLLVRRNVPRCRPSVYCDPCPVVGWSGLPVCRNRSPFIIRVASDAVXFSRPCSRCGNLLQFSETRCRXCNFAITVDDLEEFGCIFRLKITTIFLHGVVHAXNGYGHXLLTLNGRKRW

SEQ ID NO: 2930 - protein, 276 aa, Glycine max
APPPQPPHFRLTHPTHKANLELTHSLMASSALISDTQQWKDLKAHVEDINKTHLRDLLSDDKRCQSMLVEFDDILLDYSRQQATPETIQKLFELAEAASLKEKIIRMYSGEHINSTENRSVLHVALRASRDAVIQSDGQNVVPEVWKVLDKIQEFSEQIRNGSWVGATGKALKDVVAIGIGGSFLGPLFVHTALQTDPEAVESARGRQLRFLANVDPIDVARNITGLNPETTLVVVVSKTFTTAETMLNARTLREWISSALGIENGQYSKWTLMMN

SEQ ID NO: 2931 - protein, 355 aa, Glycine max
MIDGSRFNLPTNNNNNNNMNNIESYPPVLRHLDHHQLPPPPNPDPDKDPTQQDSDPIPIIDFSCLNHDKSKLDEACKDWGFFRLVNHGIPMTLLKKLQEVAKELFSLSFEAKEGACSGSPVSYFWGTPALTPSGTTTRGPQNMNWVEGFDVPLSQLPHFSPPQLPTLESIRLPIKDYKTHLSRIATTLFEAMAKNLDLSLKPSKPYLAENTGMVRVYRYPNCSDANVGWGMEAHTDSSVLSILNQDDEVSGLQVLKDDQWLTVKPIPNTLIVNLGDMMQAISDDRYKSVTHRVSINKHKERISICYFVFPGEDVAIESYKYKPFTYNEFRAQVQQDIKALGYKVGLSRFQHHEEC

SEQ ID NO: 2932 - protein, 401 aa, Glycine max
  misc_feature (238)..(238): Xaa can be any naturally occurring amino acid
MTQAQIQPVKLGTQGFEVLLTTLLALILIIDTINLILIVIQQVKGRDESQSATKMTQAQIQPVKLGTQGFEVSKLGFGCMGLTGAYNDPLQEQDGISVIKYAFSKGITFFDTADVYGANANELLVGKALKQLPREKIQIATKFGIASRGFPDMKIKGSPEYVRSCCEASLKRLDVEYIDLYYQHRVDTSVPIEETVGELKKLVEEGKVKYIGLSEASPDTIRRAHAIHPITAVQIEWXLLWTRDIEEEISPSLQGLGIGIVPYSPLGRGFFGGKGVLENVPTSSFLTLHPRFQAENINKNKRIYEQIESLAKKYQSTPPQLALAWVLHQGNDVVPIPGTTKIKNLDQNIGALSLKFTESDLREISEAVPIHDVAGSQYFFGNDKDSWKFANTPPKDPRVST

SEQ ID NO: 2933 - protein, 174 aa, Glycine max
PRVRVCEGEAAKNIQRPWHAVWKSKRLMNIVTEISGRLDWDFDAVHVVRGEKAQNKELWPHLDYDTSPDVLVEKLKWMVQPWRHLYIATNEPYYNYFDKLRSNYKVHLLDDYKELWGNTSEWYNETTLLNNGKPVEFDGYMRVAVDTEVFYRGKTRVETFYNLTKDCKDGVNTC

SEQ ID NO: 2934 - protein, 81 aa, Glycine max
FITMLRNPSSILKACAAFALLQFTIRGGRHAMHHASLMQSLGASRVLRGAAAAATAPLEAKIFARIVLRNLEYHQIEQALA

SEQ ID NO: 2935 - protein, 403 aa, Glycine max
HASAHASVRLREDDRRAVHGKRNYTYSDVVRSVLGGRKFQLCGLAQYINLVGVTIGYTITASISMVAVKRSNCFHKHGHHVKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGKERWPNSQFVNGEHALNFPLCGTFPVNFFRVVWRTTYVIITALIAMMFPFFNDFLGLIGSLSFWPLTVYFPIEMYIKQSKMQRFSFTWTWLKILSWACLIVSIISAAGSIQGLAQDLKKYQPFKAQQ

SEQ ID NO: 2936 - protein, 396 aa, Glycine max
  misc_feature (392)..(392): Xaa can be any naturally occurring amino acid
MVTQQQPQPQLQVQPTPPSSQDEALKRNTDCVYFLASPLTCKKGNECEYRHSEYARVNPRDCRYWLSGNCLNPKCPFRHPPLDGLLGTQATAAGGPSVSPSQIPTASATHAPYNSSKQAVPCFFFQKGLCLKGDRCAFLHGPPTPTSSTGNKVAAQVPVTSQGVENPCFKKPFVSNEKYTQERKTSQGNVAKSSGISEAKPASKIETAPQRNMFEWEKKVPPPAVGFDNEVSRFKTTSPPVTNGPTVARPNRLHQARVPDDHNFQSGKDSDEFLRESSPGFDVLVADELRNSDYYHGEDEFGKARGQDERNLDSLNEYDLGHSGDYSLAADIDRERFRVPQGYESYDHMQEPYAWEQHRKPSSHLGRRTRRRSDSPENAEVSDLRHHLSKRXKGYG

SEQ ID NO: 2937 - protein, 144 aa, Glycine max
ILVLTHAVTAARRRQKGGLLTHAQLEHPHARPSKIDPARLLDWENFQQSSEIIDVLSTIHSEIPRGVVLGDYVIEYGDDDARDEFEDFPGDEGNWWTSCILYFDNFRRSRNRRRTRVSHTRRDNRRFSYDTSNSDEGSVVSMEY

SEQ ID NO: 2938 - protein, 527 aa, Glycine max
  misc_feature (139)..(139): Xaa can be any naturally occurring amino acid
  misc_feature (243)..(243): Xaa can be any naturally occurring amino acid
  misc_feature (271)..(271): Xaa can be any naturally occurring amino acid
MELNEDPGPIDNYVLYDQDNHVSSAVWDGHERGVLRCHEHTSMLDQWKLTPKQIKLVEKAGFGHLRLLAAMSLDNALIAALVERWRRETNSFHLTVGELTITLEDVSLLLGLAIDGEPVIGPISAPSSVCEKLLGRVPXDLNGGMVKLTWLKEFFSECPEDASQEEIERCTCAFLLYLVGSTIFSTTTGNKVPVIYLSLFEDFDKAGKFAWGPGALAFLYRALGNASLKSQSTISGCLTLVQXWCYSRLNVGLPKFNQEPDNNCFPFLLKXKGKSGAWMKCNVVSYRKALDSLNPCDVQWLPYNDMDCSSIPEDIKASLILRASRTMLLCFDKAERHLPDRCLRQFAMHQTIPKDVERWERKSRIVDHGVDLMGKMDLALKEWSERWVHVVEGGDIADEGEYMQWYQKITRKYIGRVTSSLESEYQRTVFLCLVIIVCLLLECMLISILLLDCYMLLQVTAMREIANIADIVSAEGLDSYNRELLDEVINIVHKCLTGQFEEIPNEKVKKKGKRKGRQKDHLSMEYE

SEQ ID NO: 2939 - protein, 228 aa, Glycine max
SGDSNLISFISMATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPKAPLEKVCLLGCGVSTETLLSMLSNEFMKMCLHNDVTFAYAAVYYWCLAILH

SEQ ID NO: 2940 - protein, 467 aa, Glycine max
MELSTMFCLCASFLFIVLFRALIKPYYVSKRRDLPLPPGSMGWPYIGETFQMYSQDPNVFFASKIKRFGSMFKSHILGCPCVMISSPEAAKFVLNKAQLFKPTFPASKERMLGKQAIFFHQGEYHANLRRLVLRTFMPEAIKNIVPDIESIAQDCLKSWEGRLITTFLEMKTFTFNVALLSIFGKEEILYRDALKRCYYTLEQGYNSMPINVPGTLFHKAMKARKELAQIVAQIISSRRQRKQDFHKDLLGSFMDEKSGLTDEQIADNVIGVIFAARDTTASVLTWIVKYLGENPSVLEAVTEEQECILKSKEESGEDKGLNWEDAKKMPITSRVIQETLRVASILSFTFREAVEDVEYQGYLIPKGWKVLPLFRNIHHSPDNFKEPEKFDPSRFEAAPKPNTFMPFGSGIHMCPGNELAKLEILVLLHHLTTKYRWSVVGAKNGIQYGPFALPQNGLPITLFPKNK

SEQ ID NO: 2941 - protein, 185 aa, Glycine max
  misc_feature (129)..(129): Xaa can be any naturally occurring amino acid
  misc_feature (150)..(150): Xaa can be any naturally occurring amino acid
  misc_feature (166)..(166): Xaa can be any naturally occurring amino acid
MSLTIPSNLSKPAALRPKLSPKLRSAATTTIVCSTTNNNNNNNVSSDLKAFSAALALSSILLSTPLPAGADISGLTPCKESKQFTKREKQSIKKLESSLKLYEAGSTPTLAIKASVEKTKRRFDNYAEXGLLYSSDRLPHLIVNRNQKHXSEFITPRILFLYISGXDQLDNQSCLITIKDEKKPT

SEQ ID NO: 2942 - protein, 713 aa, Glycine max
KCNGVAEEVKIGKGGIVESSSVQQHIPQPQGAIICWERFLHIRSLKVLLVEYDDSTRHVVTALLRNCSYEVIDAANGLQAWKILEDLTNHIDLILTEVAMPGLSGIGLLYKIMGHKTRKNIPVVMMSSHDSMGLVFKCLSKGAVDFLVKPIRKNELKNLWQHVWRRCHSSSGSGSESGTQTQKSVKSKSLEKFDNNSGSNGEDDNGSIGLNNGDGSDNGSGTQSSWTKHAVEVDSPKPVSHWDKIAECPDSTCAQVVHSNAEIGENKVVPLAAKECPEQKEQLVKTAGSKHSNAPDVGPSKFNDQINRGQLDLNCENQSSKLRCKGLSLSDAITSTSDSQMHSGGFEALYKKPKSSDIENKDTNNDEELPSLELSLKRLRGVEDAGIAIQDDRNVLRRSDQSAFSRYNAALNPKKSPTGCVGSNSPHNNSLEVTKKDSSHDIQSHSSGNPPNQNSNGASNNIDMGSTTNNAYAKSAVISEPAVASTTKCLYQTSAYQPEKNNLVCTSQQVVLHNTEDTTATMLAPPKLDRHKDSAAPDFHLHCENHNCIADNMKHQLPPDHDAESIKKMATAAPHCGSSNAVEVLVEGNVGNHSINRSASGSNNGSNGQNGSSTAVNAGGTNMKSNNGLTGNSGSGDASGSVSANRVDQNKTSQREAALTKFRQKRKERRERCFHKKVRYQSRKRLAEQRPRFRGQFVRQSSNENASEATTDS

SEQ ID NO: 2943 - protein, 303 aa, Glycine max
  misc_feature (225)..(225): Xaa can be any naturally occurring amino acid
GLVSVSSMEDIQLDISWDDVACPICLDFPHNSVLLHCSSYDKGCRAFVCDTNQLHSNCLDRFKNSCGMPSSPVSNATSTETTENSDDHEVSNGQCNLTCPLCRGEVSGWVIVDKARIHLDEKKRCCDEVRCTFMGSYLELQEHAQLEHPHARPSKIDPARQLDWENFQQSSEIIDVLSTIHSEIPRGVVLGDYVIEYGDDDARDEFEDFPGDEGNWWTSCILYLXNFRSSRNRRRTRVGDQSRVNRHLSSDTSNSDEGSVASVEYGEYRLDEIDDDFVSTIGHLRGESGFRRSRRRHSRSNDN

SEQ ID NO: 2944 - protein, 278 aa, Glycine max
  misc_feature (129)..(129): Xaa can be any naturally occurring amino acid
MAATNASIFASSTQPCLPVPPTIPNTLATPFLNVSSPRSYLVKKKHVKFSKKISAAAVATTTTTEEIQEYKLPSWAKFEIGRAAVYWKTMNGLPPTSGEKLKLFYNPAATQLVPNEEFGIAFNVKFHPXGGFNQPIMCGGEPRAMLRKDRGKADAPIYSIQICIPKHALNLIFSFTNGVDWDGPYRLQFQVPKALQNKPIDFFNKGLAEELSKEGACEQAIFPDTNKIITKCAMIGNLSKEGGDRCDLNFVLGCTDPSSHLYNPLANVDDGTCTIELD

SEQ ID NO: 2945 - protein, 520 aa, Glycine max
  misc_feature (141)..(141): Xaa can be any naturally occurring amino acid
MSGGGGGEEEATLEFTPTWVVAAVCTVIVAISLAAERLLHYGGKFLKAKDQKSLYEALQKIKEELMLLGFISLLLTVTQNGITKICVRPSLTRHMLPCNLDAGEHSTPESESATKIGYCVRKVTPSHSLTFLFLRSHLIHXPRPRLLFCFSLFQNKVPLLSLEALHHLHIFIFVLAVVHVSFSLLTVVFGGARIRQWKHWEDSIAKQNYETGRVLKPKVTQVHQHDFIRGRFAGFDKDSAIVGWLLSFLKQFYGSVTKSDYVTLRHGFIMTHCRTNPKFNFHKYMIRALEDDFKQVVGISWYLWLFVVIFLLLNINGWHTYFWIAFIPVVLLLAVGTKLGHVITQLAQEVAEKHAAIEGDLVVQPSDEHFWFHRPHVVLFLIHFILFQNAFEIAFFFWIWVTYGFDSCIMGQVRYIVPRLVIGVFIQVLCSYSTLPLYAIVTQMGTHYKRAIFNEHLQQNIVGWAQKAKKRKGLKADGNPGQGSSQESANTGIQLGSIFKKASAPGGSSSATKADGTNSV

SEQ ID NO: 2946 - protein, 306 aa, Glycine max
  misc_feature (233)..(233): Xaa can be any naturally occurring amino acid
  misc_feature (294)..(294): Xaa can be any naturally occurring amino acid
GPDSRVDPRVRCPAPCEGSCVLGIIENPVSIKSIECAIIDKAFEEGWMVPRPPVKRTGKRVAIVGSGPSGLAAADQLNKMGHTVTVYERADRIGGLMMYGVPNMKTDKVDIVQRRVNLMAEEGIDFVVSANVGHDPLYSLDRLREENDAIVLAVGATKPRDLPVPGRELSGVHFAMEFLHANTKSLLDSNLEDGNYISAKGKKVVVIGGGDTGTDCIGTSIRHGCSSVVNLEXLLPQPPPTRAPGNPWPQWPRIFRVDYGHQEAAAKFGKDPRSYEVLTKRFIGDENGVLKGLXVIRVCWEKDATD

SEQ ID NO: 2947 - protein, 504 aa, Glycine max
MAWRELGKKRIYMNFTRALSTTPFRHVAGSNFASIFTVQSVCASARCVPDFINLSSLGVAGFGRETKECEIRCFHASSQVWARSDGPLGLQTPKRVYVKRGGRNQLPVGAPYACRNVPATKSNPDKTIEIFEGMTLVELAKRTGRSVSSLQDILTNVGEKVQSEFELLSMDIAELVTMEAGINVKRLHSAEGAEILPRPAVVTVMGHVDHGKTSLLDALRQTSVAAKEAGGITQHIGAFVVVMPSGASITFLDTPGHAAFSAMRARGAAVTDIVVLVVAADDGVMPQTLEAMSHAKAANVPIVVAINKCDKPGANSEKVKMQLASEGLLLEEMGGDVQVVEVSATEKIGLDNLEEALLLQADMMDLKARIDGPAQAYVVEARLDKGRGPLVTTIVKAGTLVCGQHVVVGSQWGRIRAIKDMAGKLTRRATPAMPVEIEGLRGLAMAGDDVIVVHSEERARMLSSGRQRKYEENRLRNKMIQDKPTTSDDSKEVPRWVEMPVIVK

SEQ ID NO: 2948 - protein, 446 aa, Glycine max
MDGDDETSGPMIDEIYANGGGVGDDGDKRSRRAIMSGDQLDIEAYAALYSGRTKIMRLLFFADKMNNAATQLEALRMAYDEIKKGENTQLFREVVQKIDGRLGPNYDMDAAWCDTVDRRAEQKKEKLENELNAYRTNLIKESIRMGFNDFGDFYYAHGQLGDAFKSYVRTRDYCTTSKHIIHMCMSAILVSIEMGQFSHVTSYVSKAEQAPDAPEAVTVAKLRCAAGLANLEAKKYKLAARKFLETGPELGSHYNDVIASQDVATYGGLCALATFDRAELKSKVIDNSNFRNFLELVPEVRELINDFYSSHYASCLEYLGNLKANLLLDIHLHDHVETLYDQIRHKALIQYTHPFVSVDLNMMANAFKTTVAGLEKELEALITDNQIQARIDSHNKILYARHADQRNATFQRVLETGREFDRDVRSMLLRSNLIKHEFNLRALRKL

SEQ ID NO: 2949 - protein, 505 aa, Glycine max
MSSLSNNSSSSHGNSFLQMPPIKFTKLFINGDFVDSLSGRTFETIDPRTEEVIARVSEGDKEDIDIAVKAARQAFDSGPWPRLPASERAKIMMKWADLIDENIEELAALDTVDAGKLNYINKVVEIPSATNALRYYAGAADKIHGEVLKMNGDFHAYTLLEPIGVVGHIIPWNAPSLSFFIKVSPSLAAGCTMVLKPAEQTPLSALFYAHLAKLAGIPDGVLNIVPGFGPTAGAAISSHMDIDVVSFTGSIEVGREVMQAAARSNLKPVSLELGGKSPLIIFNDADIDKAAQLALFGIMSNKGEICVASSRVFVQEEIYDEFEKKLVEKAKSWVVGDPFDPKSLQGPQADRNQLEKILSYIEHGKREGATLLTGGNTVGNKGYYIEPTIFCNVKEDMLIARDEIFGPVLALMKFKTMEEAIKSANNTKYGLAAGIVTKNLDTANTMSRSIRAGIVWINCYLTVGSDVPFGGYKMSGFGRDLGLQALHKYLQVKSVVTPIHNSPWL

SEQ ID NO: 2950 - protein, 192 aa, Glycine max
MSAAEEAKVPAVEKPVEEVKAPKLAKEKKPKAPKEKKPKQAKTASHPPYLQMIKDALIALNEKGGSSPYAIAKYMEEKHKAVLPANFKKILGLQLKNQAARGKLVKIKASYKLAEAAKKVKESTAKATKESRPKRNKIATAVAPKKTEAVKKPAKKVGPKKTKKVSTPAKPKQPRSIRSPTKRARKAAVAAA

SEQ ID NO: 2951 - protein, 73 aa, Glycine max
RFHSFCRTAADIKKDSLPALRDIRERCINQLEQMRSDHMRRLNPTPYKVSVSAKLYDFIHFLWLNEAPVGELQ

SEQ ID NO: 2952 - protein, 784 aa, Glycine max
MQQHVQDPGYLLQQQFEQHQQLQSQQPQQQFEQQHHQHQQTLPQQQQQFIHGTHFIHHNPAIGPDARASSLSLTLTMEAQPPTPSTAPPPLPPHLSYPDSVESSPRSRNTDSWDEPFAPASTKLRLMCSYGGHIVPRPHDKSLCYVGGDTRIIVSERATSLADLSMRLSKTFLNGRPFTLKYQLPNEDLDSLISVTTDEDLENMIDEYDRTAASATSAVKPSRIRLFLFPTKPESTHSIPAQILDTSAKSDDWFLNALNGAGLLNRGFSDSASVNCLLGLDDEVAGNNLEPGSKDGVDGGGGGGGFGGGGASQGGSFGNGKNLKQDVHSIPDSPMLETTSSFGSTSSSPSLANLPPIRVHVVEDQKVLGIEEQFAQMGVGVGQKQQQQDEGFVLLSSPPPPPVPATLAAVGVPIGPATVVAGEYHNRVVSDDERSDHGVSVGYRKPPTPPPQVQSQTQAQSQAQTQTLAPQFQQKSTGGGAVVDLPSPDSVSSDSSLANAISRSKPAVYQEQVQIQSGTTRVPSNPVDPKLNVSDPHGRIQMQQHVQDPGYLLQQQFEQHQQLQSQQPQQQFEQQHHQHQQTLPQQQQQFIHGTHFIHHNPAIPAYYPVYPSQQHPQHPQVYYVTARQAQAYNLPVQQANMGESAGNIASSRPQTPPNPSTLVQQPATYNPIRNAPMPKTEMNAYRAATAGTPQLVQVPTSQHQQQYVTYSQIHHPSQSMAPNSAAPANYAFDYADPAHAQIYYSQPMAPTMPSQYQTMMMQEGSAQHPSDSVKQQQIRTSQPL

SEQ ID NO: 2953 - protein, 202 aa, Glycine max
  misc_feature (109)..(109): Xaa can be any naturally occurring amino acid
  misc_feature (150)..(150): Xaa can be any naturally occurring amino acid
MPRYDDKYGNTRLYVGRLSSRTRSRDLERVFSRYGRVRGVDMKNDFAFVGLLEFSDPRDADDARYNLDGRDVEGSRIIVEFAKGGPRGSREDLGQGPPTGSGLCFDCGXDGHWARDCKTGDGKNKCFLSGERGHIEKNCKNSPKKLRHGXSFRSHSAHHGRRRDRSYSRDRSYSRSISPVGRERSPVSEDRSESSTLLDKKA

SEQ ID NO: 2954 - protein, 171 aa, Glycine max
  misc_feature (162)..(162): Xaa can be any naturally occurring amino acid
  misc_feature (165)..(165): Xaa can be any naturally occurring amino acid
HFTISVSAFSLFYNGLHHRRVDASRRIVGNLRRGSVSGVLTSSVSKAHPRRHTSEVSLAGDFSLRRVAVVLSSRSGGEHSVSVTKLSRLSTTSSSPLAVGTDDDSDAGVTHHSPTQVLKNFNEIRLLRIELPSGELGIEDGVLLKWRADFGSTLDNCVILGXFLXLPPQRQ

SEQ ID NO: 2955 - protein, 606 aa, Glycine max
MAAVRLLLLLLFPFSSLSLSENEALLNLKKSFSNPVALSSWVPNQNPCSSRWLGVICFNNIINSLHLVDLSLSGAIDVNALTQIPTLRSISFVNNSFSGPIPPFNQLGALKSLYLAHNQFSGQIPSDFFSQLASLKKIWISNNKFSGPIPSSLTNLRFLTELHLENNEFSGPVPELKQDIKSLDMSNNKLQGEIPAAMSRFEAKSFANNEGLCGKPLNNECEAGGSSEVGSGWGMKVVIVLIVAVALAFIFALTRSKRRHDDDFSVMSRDHVDEVVQVHVPSSNHSRGASEGGSKKESSSSKKGSSRGGMGDLVMVNDEKGVFGLPDLMKAAAEVLGNGGLGSAYKAAMNNGLSVVVKRMREMNKVSRDIFDAEMRRFGRLRNLNIITPLAYHYRKEEKLFVTEYMPKGSLLYVLHGDRGSSHADLNWPIRLNIVKGIARGLDFIYSEFSNEDLPHGNLKSSNVLLTENYEPLLSDFAFHPLINPNYAIQTMFAYKTPDYVSYQHVSQKTDVYCLGIIVLEIITGKFPSQYHSNGKGGTDVVHWVFTAISERREAELIDPELMSNHSNSLNQMLQLLQVGAACTESNPDQRLNMKEAIRRIEEVQV

SEQ ID NO: 2956 - protein, 200 aa, Glycine max
MASSDKDPREDLLQAWYMDDSDEDQRLPHHKEPKEFVSLDQLAELGVLSWKLDADNHENDPELKKIREERGYTYMDVCEVCPEKLPNYEQKIKSFFEEHLHTDEEIRFCAAGSGYFDVRDCNDAWIRVWVKKGGMIILPAGIYHRFTLDESNYIKALRFFVGEPVWTPHNRPNDHLPARQQYVKDFVEKDVGNHAVDAAA

SEQ ID NO: 2957 - protein, 535 aa, Glycine max
MYRPHPPHLINHLIPLQFPKMATLSSYDHFIFTALAFFISGLIFFLKQKSKSKSKKFNLPPGPPGWPIVGNLFQVARSGKPFFEYVNDVRLKYGSIFTLKMGTRTMIILTDAKLVHEAMIQKGATYATRPPENPTRTIFSENKFTVNAATYGPVWKSLRRNMVQNMLSSTRLKEFRSVRDNAMDKLINRLKDEAEKNNGVVWVLKDARFAVFCILVAMCFGLEMDEETVERIDQVMKSVLITLDPRIDDYLPILSPFFSKQRKKALEVRREQVEFLVPIIEQRRRAIQNPGSDHTATTFSYLDTLFDLKVEGKKSAPSDAELVSLCSEFLNGGTDTTATAVEWGIAQLIANPNVQTKLYEEIKRTVGEKKVDEKDVEKMPYLHAVVKELLRKHPPTHFVLTHAVTEPTTLGGYDIPIDANVEVYTPAIAEDPKNWLNPEKFDPERFISGGEEADITGVTGVKMMPFGVGRRICPGLAMATVHIHLMMARMVQEFEWGAYPPEKKMDFTGKWEFTVVMKESLRATIKPRGGEKVKL

SEQ ID NO: 2958 - protein, 353 aa, Glycine max
  misc_feature (303)..(303): Xaa can be any naturally occurring amino acid
MGWSFSISVLLFLTFLIQIHGRGFAENYGCNLFQGSWVYDESYPLYATSQCPFIEKEFDCQNNGRPDKFYLKYRWQPAGCNLTRFNGEDFLRRHRGRSLMFVGDSLSLNQWQSLTCMLHIAVPLAPYNLVRNGDLSIFTFPTYGVKVMFSRNAFLVDIVSESIGRVLKLDSIQAGQTWKGIDILIFDSWHWWLHTGRKQPWDLIQVGNRTVRDMNRLVAYEIALNTWAKWIDYNIDPTRTRVLFQGVSPDHQNPAQWGEPRANFCAGQNKPISGLRYPGGPNPAEVVLEKVLKAMQKPVYLLXDLPPLSQLRIDGHPSVYGHGGHLDMDCSHWCLAGVPDTWNELLYVSLFQN

SEQ ID NO: 2959 - protein, 199 aa, Glycine max
YEHFLLCLVSDFFFPKFNFFCRKQVHGFLKFFSASFLWAFFQWFYSGGDNCGFVQFPTFGLKAWKNSFYFDFSMTYVGAGMICSHLVNLSLLLGAVISWGIMWPLIRGLKGEWFPASIPESSMKSLNGYKVFISIALILGDGLYNFVKVLYFTATNIHATVKRKNPETFSDNQKPLPLDDLRRNEVFARESIPIWLACT

SEQ ID NO: 2960 - protein, 128 aa, Glycine max
  misc_feature (58)..(58): Xaa can be any naturally occurring amino acid
  misc_feature (90)..(90): Xaa can be any naturally occurring amino acid
  misc_feature (115)..(116): Xaa can be any naturally occurring amino acid
MIDHSLRGEDLMNPMGVLIVSNEELKEIESLGREDIEEAPIVPEDVSRIAPWIRQITXRGLVASFLIGIIYSVIVMKLNLTTGLVPNLNXSAALLGFVFIRAWTKVLGEAKIASXXFPRQENTIIQTW

SEQ ID NO: 2961 - protein, 178 aa, Glycine max
  misc_feature (115)..(115): Xaa can be any naturally occurring amino acid
  misc_feature (122)..(122): Xaa can be any naturally occurring amino acid
  misc_feature (144)..(144): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELEHGFIYHKHNKSPXYYNRHYXTMWKLPMFGCTDASQVLKELQXANTAYPNSFIHIIRFDNIHQIHCISFITYKLPSF

SEQ ID NO: 2962 - protein, 178 aa, Glycine max
MASSMISSPAVTTVNRAGAGMVAPFTGLKSMAGFPTRKTNNDITSIASNGGRVQCMHVWPPIGKKKFETLFYLADPDDAQLAKEGEYPLKKGWIPCLEIQVEHRFVYREHNRAPRYYHGRLWTMWKLAMFGCTDASQGVKELQEAKTAYPNGFIRIIGFDNVRQVQWINFIGYKPPGF

SEQ ID NO: 2963 - protein, 178 aa, Glycine max
  misc_feature (86)..(86): Xaa can be any naturally occurring amino acid
  misc_feature (102)..(102): Xaa can be any naturally occurring amino acid
  misc_feature (115)..(115): Xaa can be any naturally occurring amino acid
  misc_feature (125)..(125): Xaa can be any naturally occurring amino acid
  misc_feature (144)..(144): Xaa can be any naturally occurring amino acid
  misc_feature (158)..(158): Xaa can be any naturally occurring amino acid
  misc_feature (174)..(174): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVXYLLKKGWIPCLKFQLXHGFMYREHNMSPXYYYGHYWTMXKLPIFGCTDTSQVLKDLQXAKTAYLNNFIHIIXFNIIHQLHIIIFITYXPSYF

SEQ ID NO: 2964 - protein, 124 aa, Glycine max
MASSMISSPAVTTVNRAGAGMVAPFTGLKSMAGFPTRKTNNDITSIASNGGRVQCMQVWPPIGKKKFETLSYLPDLDDAQLAKEVEYLLKKGWIPCLEYEYEHGYVYREHNRSTIYYDRRYLTM

SEQ ID NO: 2965 - protein, 175 aa, Glycine max
  misc_feature (101)..(101): Xaa can be any naturally occurring amino acid
  misc_feature (114)..(114): Xaa can be any naturally occurring amino acid
ASSMISSPDATTVNRAGAGMVAPFTGLKSMAGFPTKKTNNDITSIASSGGRVQCMQVWPPDGKKRLETLSYLPHLDDAQLAQEVQYLLRKGCIPCLEFESXHGFAYREHNTSPXYYDGRYWTMCKLPMFGCTDASHVWNELQEANTAYANGFIRIIGFDNARQVHSISCIGYKPP

SEQ ID NO: 2966 - protein, 176 aa, Glycine max
  misc_feature (115)..(115): Xaa can be any naturally occurring amino acid
  misc_feature (125)..(125): Xaa can be any naturally occurring amino acid
MAHSMISFRAVTTVNRARADMVAPFTGLKSMAGFSTRKTNNVITSIASNRGRVQCMHVWPPVGKKKTETLFYLPDLDDAQLAKEVECPVRKGWIPCYELEFEHAFVYREHNKSPXYYNGHYWTMXKLPIFDCTNTAQVWKELQETKTAYPNDFIHIIGFDDVLQMQVINYITYKPA

SEQ ID NO: 2967 - protein, 165 aa, Glycine max
  misc_feature (50)..(50): Xaa can be any naturally occurring amino acid
ASSMISSPAVTTVNRAGAGMAAPFTGLKSMAGFPTWKTNNDLASVASNGXRLQCMLVWPPVGKMIFETLCYLPDLDDAQLAKEVESLLKKGWIPCMEFELEHSFEYREHSCVPGYYNGRYCTMCKLPMVGCTMLPTCMNDILEAKTVVPRGYIRLSGLGNVRQVQ

SEQ ID NO: 2968 - protein, 153 aa, Glycine max
ISCPDDTTANRAGAGMVVPFTDLKSMVGFHTRKTSHDITCIASNGRRVQCMQVWPPVDKKKVETLSYLPDLDDAQLAKEVQYLLRKGWIPCLEFESQHGFPYREHNRSPRYYDGRYWTMWKLPMFDCTDACQVLKELQEAKTPYPIDLIRIIG

SEQ ID NO: 2969 - protein, 341 aa, Glycine max
  misc_feature (27)..(27): Xaa can be any naturally occurring amino acid
MSSIILYEQALKSTSQHSGYKIGKDGXDVAHFFGLSGTGKTTLSTDHNRYLIGDDEHCWGDNGVSNIEGGCYAKCIDLSREKEPDIWNAIRFGTVLENVVFDEHDREVDYSDKSVTENTRAAYPIEYIPNAKLPCVGPHPKNVILLACDAFGVLPPVSKLNLAQTMYHFISGYTALVAGTEEGIKEPQATFSACFGAAFIMLHPTKYAAMLAEKMQKHGATGWLVNTGWSAGSYGNGSRIKLQYTRKIIDAIHSGSLLNAEYKKTEIFGLEIPTEVEGVPSEILDPMNTWSNKKAYKETLLKLAGLFKNNFETFTNYKIGKGNNNLTEEIIACWSNLFNTI

SEQ ID NO: 2970 - protein, 351 aa, Glycine max
GSFISSTAALATLSGPKTGRRARDKRVVKDDLTKNDLWWGKGSPNIEMDEHSFMVNRERAVDYLNSLDKVFVNDQFLNWDTENRIKVRIVSARAYHSLFMHNMCIRPTPEELENFGTPDFTIYNAGQFPCNRYTHYMTSSTSIDLNLARREMVILGTQYAGEMKKGLFSVMHYLMPKRQILSLHSGCNMGKDGDVALFFGLSGTGKTTLSTDHNRYLIGDDEHCWGDNGVSNIEGGCYAKCIDLSREKEPDIWNAIRFGTVLENVVFDEHDREVDYSDKSVTENTRAAYPIEYIPNAKLPCVGPHPKNVILLACDAFGVLPPVSKLNLAQTMYHFISGYTALVAGTVQEQF

SEQ ID NO: 2971 - protein, 414 aa, Glycine max
FSLVYKVDNWVGDRCIRPTPEELENFGTPDFTIYNAGQFPCNRYTHYMTSSTSIDLNLARREMVILGTQYAGEMKKGLFGVMHYLMPKRQILSLHSGCNMGKDGDVALFFGLSGTGKTTLSTDHNRYLIGDDEHCWGDNGVSNIEGGCYAKCIDLSREKEPDIWNAIRFGTVLENVVFDEHDREVDYSDKSVTENTRAAYPIEYIPNAKLPCVGPHPKNVILLACDAFGVLPPVSKLNLAQTMYHFISGYTALVAGTEEGIKEPQATFSACFGAAFIMLHPTKYAAMLAEKMQKHGATGWLVNTGWSAGSYGNGSRIPRVRPRVRIDAIHSGSLLNAEYKKTEIFGLEIPTEVEGVPSEILDPVNTWSNKKGYKETLLKLAGLFKNNFETFTNYKIGKGNNNLTEEILAAGPIF

SEQ ID NO: 2972 - protein, 416 aa, Glycine max
  misc_feature (137)..(137): Xaa can be any naturally occurring amino acid
  misc_feature (195)..(195): Xaa can be any naturally occurring amino acid
  misc_feature (248)..(248): Xaa can be any naturally occurring amino acid
CWFQMPMWQINLRSSETMESEPYPEHPGEPDCSYYIRTGLCRFGATCRFNHPPNRKLAIAAARMKGEFPERIGQPECQYYLKTGTCKFGATCRFHHPRDKAGIAGRVALNILGYPLRPNEPECGYYLRTGQCKFGNXTCKFHHPQPNNMVLSMRSSPVYPTVHSPTTPGHQSYATGITNWSSSSYIPSPRWQGPXSSYAPLILPQGMVSVPGWSAYSGQMGSDSPQQTMGNGQSYGTSRQSEPANSGXRGAYSQFRSGSVPVGFYALQRENIFPERPDQPECQFYMKTGDCKFGAVCRFHHPRERMIPAPDCVLSPIGLPLRPGEPLCVFYSRYGICKFGPSCKFDHPMGVFTYNISASPSADAPGRRMLGSSSGTSALNLSSEGLVESGSANPRRLSLSETRQIPSGDDNIDEEG

SEQ ID NO: 2973 - protein, 413 aa, Glycine max
GPPSISTPSRAIDCSFLLRSSLSHSHSYSSFPSPLRSSNSPQTFSLRRFAAASLACPPPPPPPLDAMAQKIGKSTRRPGASSKARVYADVNVVRPKEYWDYESLNVQWGEQDDYEVVRKVGRGKYSEVFEGVHCTDGEKCVIKILKPVKKKKIKREIKILQNLCGGPNIVQLLDIVRDQQSKTPSLIFEYVNNTDFKVLYPTLSDYEIRYYIYELLKALDYCHSQGIMHRDVKPHNVMIDHEQRKLRLIDWGLAEFYHPGKEYNVRVASRYFKGPELLVDLQDYDYSLDLWSLGCMFAGMIFRKEPFFYGHDNYDQLVKIAKVLGTDGLSAYLDKYRIELDPHLAALIGRHSRKPWAKFINVENHHMAVPEAVDFVDKLLRYDHQERPTAKEAMAHPYFNPVRNAESSRTRAH

SEQ ID NO: 2974 - protein, 147 aa, Glycine max
TIFQIRYGSPLFCLPDDVCGDQGKEQTRLAQKADTKASHDIFIARNKGIENMITIDLHGQHVKQAMRMLKLHLLFGSYVPSVQTLRVITGCGSHGVGKSKLKQSVINLLDREAIEWREENQGTVLIKLSGWREYSFLDTSSDSDSND

SEQ ID NO: 2975 - protein, 367 aa, Glycine max
MEVNIEKTLLMCKSFMKEVKIWGCLKQTGVSLRYMMEFGSNPTQKNLLISAQFLHKELPIRIARRAIELHSLPHGLSHMPPVLKVRHWYLDSFREIISFPEIKNMNDEKEFTELIKAIKVRHNNVVPTMALGVQQLKNVFEDPDEIDEFLDRFYMSRIGIRMLIGQHVELHNPNPPPNCVGYIHTNMSPVNVARNASEDARSMCYREYGSAAEVRIYGDPDFTFPYVPAHLHLMVFELVKNSLRAVQERFMDSDEVAPPIRIIIADGIEDVTIKVSDEGGGIPRSGLPRIFTYLYSTAKNSSSVEHEPSDIGTMENVTMAGYGYGLPICRLYARYFGGDLQVISMEGYGTDAYLHLSRLGDSQEPLP

SEQ ID NO: 2976 - protein, 206 aa, Glycine max
  misc_feature (85)..(85): Xaa can be any naturally occurring amino acid
MEVNIEKTLLMCKSFMKEVKIWGCLKQTGVSLRYMMEFGSNPTQKNLLISAQFLHKELPIRIARRAIELHSLPHGLSHMPPVLKXWYLDSFREIISFPEIKNMNDEKEFTELIKAIKVRHNNVVPTMALGVQQLKNVFEDPDEIDEFLDRFYMSRIGIRMLIGQHVELHNPNPPPNCVGYIHTNMSPVNVARNASEDARSMCYREY

SEQ ID NO: 2977 - protein, 369 aa, Glycine max
MEEIEGVNCCSESESRSSSETRPPNPNPPSYRQCKLVRHASLMKTKLSDVSAEPGHVTEDCQSDFFPTLRSGACADIGFRSNMEDVYVCADNFMVDYGLKNHIDGPSAFYGVFDGHGGKHAADFACHHLPKFIVDDEDFPRDIERIVASAFLQTDNAFAEACSLDAALASGTTALATLVIGRLLVVANAGDCRAVLCRRGKAIEMSRDHKPGCNKEKKRIEASGGYVYDGYLNGQLNVARALGDWHMEGMKSKDGGPLTAEPELMTTKLTTEDEFLIIGCDGIWDVFRSQNAVDFARRRLQEHNDPAMCSKDLVDEALKRKSGDNLAAVVVCFQQQPPPNLVAPRSRVQRSFSAEGLKELQSFLDSLGN

SEQ ID NO: 2978 - protein, 236 aa, Glycine max
GFKDLIYNLKKKKKKKKKKKKKKKKPRLVSLSAFKSYVRTRDYCTTSKHIIHMCMSAILVSIEMGQFSHVTSYVSKAKQAPNAPEAVTVAKLQCAAGLANLKAKKYKLAARKFLKTGPELGSHYNDVIASQDVATYGGLCALATFDRAELKSKVIDNSNFRNFLELVPEVRELINDFYSSHYASCLEYLGNLKANLLLDIPLHDHVETLYDQIRHKALFQYTHPFVSVDLNMMANA

SEQ ID NO: 2979 - protein, 477 aa, Glycine max
WSPIQCSVTNVSEEVEQSQSVSSSERHLEPNRLEAKPKLKALHWDKVRATSDRATVWDQIKSSSFQLNEDMMESLFGCKATNFTPKEPPRKKSVLPSVDQENRVLDPKKSQNIAILLRALNVTRDEVSEALLDGNPEGLGTELLETLVKMAPTKEEEIKLKNYDGDLSKLGAAERFLKAVLDIPFAFKRVEAMLYRANFDAEVNYLRKSFQTMEAASEEIKNSRLFLKLLEAVLRTGNRMNVGTNRGDAKAFKLDTLLKLVDIKGTDGKTTLLHFVVQEIIRSEGAGAESANDNVKMDSKFNEDEFKKQGLRVVAGLSRDLSDVKKAAGMDSDVLSSYLSKLETGLDKVRLVLQYEKPDMQGNFFNSTKLFLKYAEDEIVRIKADERKALYLVKEVTEYFHGNATKEEAHPLRIFMIVRDFLNILDLVCKEVEKMHDRIVGGSGRSFRIPPNASLPVLNRYNHPKQDRSSDEESSSP

SEQ ID NO: 2980 - protein, 387 aa, Glycine max
HLQCQGVGGDALPSYMRGAVYWEPNKPLTIEEFNMPRPKAGEVLIKTKACGVCHSDLHVMKGEIPFSSPCVVGHEITGEVVEHGALTDSKTIERLPVGSRVVGAFIMPCGNCSYCSKGHDDLCEAFFAYNRAKGTLYDGETRLFFRNSGKPAFMYSMGGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFDEAGKAFQDLNEGKIVGRAVIEII

SEQ ID NO: 2981 - protein, 146 aa, Glycine max
  misc_feature (92)..(92): Xaa can be any naturally occurring amino acid
EINEASRLFILPNQQNSESSEHLVGLSDDVGAGFISGHSTQPATSSELNVDRSVDLPPQDEIGNLGVSKVIRADQKRFFFDLGSHNRGHFLXRLSEVAGSDRSSIILPLSGLKQFHEIVGHFVEITQDRIEGMAVANVRTIDPPQR

SEQ ID NO: 2982 - protein, 307 aa, Glycine max
VEVMDMVQNVGGGKRSTYDPDELEEEQRERQRKNKINVEFQTFVNRVNDLWGQPQFNGLDLEFDQPLRELGFPGVPHKSSVFIVPTSACLVELIETPFLVVTLSEIEIVNLERVGLGQKNSRADSAREDFKRDVLRIDSIPSTSLDGIKEWLDTTDIKYYESRLNLNWRQILKTITDDPQSFIEGGGWEFLNLEATDSESENSEESDKGYEPSDVEPESDSEDEASDSESLVESEDDDDDDEDSEEDSEEEKGKTWEELEREASNADREKGNESDSEEDRKRRKAKSFGKSRGAGLSSSMTKRPKLR

SEQ ID NO: 2983 - protein, 360 aa, Glycine max
LAVGLEPLLEGITDTLGTELLESLLKMAPSKEEERKLKEHKDDSPTKLGPAEKFLKAVLDVPFAFKRVEAMLYIANFESEVEYLRKSFQTLEAACEELRNSRMFLKLLEAVLKTGNRMNVGTNRGDAHAFKLDTLLKLVDVKGADGKTTLLHFVVQEIIRTEGARPSSTNQTPSTNLNDDAKCRRLGLQVVSSLSSDLASVKKAAAMDSEVLSSEVSKLSKGIAHIAEVVQLDEAAGSDESSQKFRESMNKFMRMAEEEILKVQAQESVALSLVKEITEYFHGNLSKEEAHPFRIFMVVRDFLTVLDRVCKEVGMINERTMVSSAHRFPVPVNPMLPQPLPGLVGKRQYNSSDDDDSSSP

SEQ ID NO: 2984 - protein, 209 aa, Glycine max
ICAGDTVKFNMGLILLPVCRNTITWLRLAKLGYSVPFDDNINFHKTIAGAIVIGIILHAGDHLACDFPRLVSTSEESYEKYLKGVFGDRKPSYVDLVKGVEGVTGVLMVVLMIIAFTLATKWFRRNLIKLPKPFSRLTGFNAFWYSHHLFVIVYVLLIIHGIKLYLVHKWYLKTTWMYVAVPVLLYASERILRLFSTFWHSQIIGLYSS

SEQ ID NO: 2985 - protein, 189 aa, Glycine max
MPSNSDLVRAVESLLGVSLADSVSDSLLLIATTSAALIIGLLVFLWKKSSDRSKELKPVIVPKGLPKDDDDEVDVADGKTKVTIFFGTQTGTAEGFAKALAEEIKARYDKAAVKVVDLDDYAADDDQYEEKLKKETLAFFMLATYGDGEPTDNAARIYKWFTEGKDERGTWLQHLTYGVFGLGYQTLRT

SEQ ID NO: 2986 - protein, 238 aa, Glycine max
  misc_feature (58)..(58): Xaa can be any naturally occurring amino acid
RAASRKNWEIPDLLTPIGEAPNFSAPQRKQWEIPVLSVPIAPSSSVLAPPSSSSSPAXPSPLAVPRQRKQWEMPSPLTPVDQPVSRPPSLTPPSRPFVLQTPNTKVSPVELPPASSQNFEEGSEETSKPKLKPLHWDKVRASSDREMVWDQLRSSSFKLNEEMIETLFVVNTPNPKPKDTTPRSVLAPQNQEDRVLDPKKCQNIAILLRALNVTIEEVCEALLEGVTDTLGTELLESL

SEQ ID NO: 2987 - protein, 159 aa, Glycine max
NFIHSGGFNQPIMCGGEPRAMLRKYRGKADAPIYSIQICIPKHALNLIFSFTNGVDWDGPYRLQFQVPKALQNKPIDFFNKGLAEELSKEGACEQAIFPDTNKVITKCAMIGNLSKEGGDRCDLNFVVGCTDPSSHLYNPLANVDDGTCTIELDSESEE

SEQ ID NO: 2988 - protein, 241 aa, Glycine max
MAAAAAMARRLLSPTTTSHSTTARLLVSRRLASAPCFPRAPAAAAKEMLRPAAVASSSAFFLRGAGGARGMARRPGGGDGYAPARGGDRAPTEMAPLFPGCDYEHWVIGMDKPGGEGASKHQMIDCYIHTLAKVLGSEEEAKRKIYNVSCERYFGFGCEIDEETSNKLEGIPGVLFVLPDSYVDPEHKDYGAELFVNGEIVQRSPERQRRVEPVPQRASDRPRYNDRTRYARRRENQQQQR

SEQ ID NO: 2989 - protein, 127 aa, Glycine max
  misc_feature (25)..(25): Xaa can be any naturally occurring amino acid
  misc_feature (53)..(53): Xaa can be any naturally occurring amino acid
  misc_feature (61)..(61): Xaa can be any naturally occurring amino acid
  misc_feature (71)..(71): Xaa can be any naturally occurring amino acid
  misc_feature (73)..(73): Xaa can be any naturally occurring amino acid
  misc_feature (77)..(77): Xaa can be any naturally occurring amino acid
  misc_feature (87)..(87): Xaa can be any naturally occurring amino acid
  misc_feature (89)..(89): Xaa can be any naturally occurring amino acid
  misc_feature (91)..(91): Xaa can be any naturally occurring amino acid
  misc_feature (93)..(93): Xaa can be any naturally occurring amino acid
  misc_feature (101)..(101): Xaa can be any naturally occurring amino acid
  misc_feature (105)..(106): Xaa can be any naturally occurring amino acid
  misc_feature (108)..(109): Xaa can be any naturally occurring amino acid
LSSILLSAPLPAGADISGLTPCKEXKQFAKREKAPLKKLESSLKLYKAGSAPXLALNASVXKTKRRFDNYXKXGLLXGGDGLPPLIXSXDXSXWGEFITPXILFXXIXXWLRCFFLSLLPPGRRTPP

SEQ ID NO: 2990 - protein, 440 aa, Glycine max
RKWHQIKTGSTQINACIKETGSGNNAGDKNNGQKQKQSSSQDPSPLFIQIIDKKKAQNLLILLRALNVTMEEVCDALYEGHELPPEFLQTLLKMAPTSDEELKLRLFSGDLSQLGPADRFLKAMVDIPFAFKRMEFLLFMGSLKEELATIMESFAILEVACKELRNSRLFLKLLEAVLKTGNRMNDGTFRGGAQAFKLDTLLKLSDVKGTDGKTTLLHFVVLEIIRSEGIKAIRKAKESQSSSSIKSDGLPDSTQETEDHYHEIGLQVVSRLSSELENVKKAAVIDADSLTGTTAKLGYGLIKTRDLVTKTMKNVEEDRGFFETVKSFVQNAEADVTKLLEEEKKIMTLVKSPGDYFHGNAGKDDGIRLFIVVRDFLIMVDKVCKEVRDTRKKLAKTLKQETPRGASSSETRPPPDFRQRLFPAIAERRMDDISSDDESP

SEQ ID NO: 2991 - protein, 125 aa, Glycine max
  misc_feature (66)..(66): Xaa can be any naturally occurring amino acid
  misc_feature (83)..(83): Xaa can be any naturally occurring amino acid
  misc_feature (102)..(102): Xaa can be any naturally occurring amino acid
ATTLPERAPALALTAQIDKTTRSLDHYGKDGLLCGGDALPHLTLNGHHSHWREFITPGHIFLYLPXWILRIVRSYLVAISDDXKPPMNDIIIDVRLHTRLVXRAPLRAVDAYTPLLNVDLLAEEA

SEQ ID NO: 2992 - protein, 174 aa, Glycine max
  misc_feature (11)..(11): Xaa can be any naturally occurring amino acid
  misc_feature (24)..(24): Xaa can be any naturally occurring amino acid
  misc_feature (29)..(29): Xaa can be any naturally occurring amino acid
  misc_feature (57)..(58): Xaa can be any naturally occurring amino acid
MVTKGETSMNXIHGHDIILDVDRXSIIYXGTPDGPTCHTGAETCYYSSVYDALQGQXXNQRGQVTTTLYSLEDTISRRKEEIVTEGSGKPSWTKKLLLDNQLLCSKIREEAGELIQTLLENEEKSRTASEMADLLYHAMVLLSVRDVKMEEVLEVLRKRFSQSGVEEKASRKKS

SEQ ID NO: 2993 - protein, 189 aa, Glycine max
  misc_feature (124)..(124): Xaa can be any naturally occurring amino acid
  misc_feature (140)..(140): Xaa can be any naturally occurring amino acid
  misc_feature (154)..(154): Xaa can be any naturally occurring amino acid
MASSMISSPAVTTVNRAGAGMVAPFTGLKSMAGFPTRKTNNDITSIASNGGRVQCMQVWPPVGKKKWETLSYLPDLGDAQLAKEVEYLLRKGWIPCLEFELEHGFVYREHNRSPGYYDGRYWTXWKLPMFGCTDALRVLXELQEAKTAYPHGFXRISGFDDGVPSAMALIVSGVQPPGLLSERRYAKLW

SEQ ID NO: 2994 - protein, 163 aa, Glycine max
  misc_feature (118)..(118): Xaa can be any naturally occurring amino acid
MGKSTNNNRDWTQMYAIYGMEQWQTLIFLLCQAMLFSVLSVLYLLYFDLVCSFFERIFSGAGGGTARFAAGITGSVTALSALCLFFAAANFFYSSVPLHFDMAQRIVSAVHDWSSVKXALDLGCLRAAKMEGVGEYVTCREGDARVKHNKVGTGGGKGFGPGK

SEQ ID NO: 2995 - protein, 526 aa, Glycine max
  misc_feature (66)..(66): Xaa can be any naturally occurring amino acid
  misc_feature (97)..(97): Xaa can be any naturally occurring amino acid
  misc_feature (300)..(300): Xaa can be any naturally occurring amino acid
  misc_feature (312)..(312): Xaa can be any naturally occurring amino acid
  misc_feature (340)..(340): Xaa can be any naturally occurring amino acid
  misc_feature (372)..(372): Xaa can be any naturally occurring amino acid
  misc_feature (384)..(384): Xaa can be any naturally occurring amino acid
MKFYITNKRIRRVTISNGEGKESAKRTAVAAGAGRRISDRLGFSVMVVLGIVLPFLFVCTSVSLFXCAEACCCVLFAGLWLFWGFESSQELRDELTXALLKANSGNVNEGAGSFNELEKEMTSKQDLKAFAFKTKAMLSQLERKVQLARQQESVYWHLASHGIPKSLHCLCLKLAEEYSVNAMARSRLPPPEFVSRLVDPTFHHLVLLTDNVLAASVVVTSTIESSINPEKLVFHIVTDKKTYAPMHAWFATNSIKSVVEVRGLHQYDWSEEVNAGGKEMLETYYLIWKQYYNKEKDLGXTQENSRYLEALXPSSLSLMNQLRIFLSALFPHLKKLVLLXMMMLYDDVVLQHDISSLWELDPNGISQWLCIXNRCCDGSKYINXLNFSHPLVASNFDGDQCAWLHGMSINDLETLRRTNITETYHQWLKLNLKSGMTMWNPGVLPPALMTFEGQVHPISSSMLVTDLGYRHQSAEISKEKLEAAAVIHFSGPAKPWLEIGFPEVRSLWSRYVNISNKFIGRCRITG

SEQ ID NO: 2996 - protein, 168 aa, Glycine max
MAALPLATAEVCDANSHLITGGELRALQPVFQIYGRRQVFAGPIVTLKVFEDNVLVREFLEEKGQGRVLVVDGGGSLRCAILGGNPVQQAQNNGWAGIVVNGCIRDVDEINGCDIGVRALASHPMKANKKGMGEKHVPVTIAGTRICDGEWLYADTDGILVSRTELIV

SEQ ID NO: 2997 - protein, 120 aa, Glycine max
TDTTVNQDDTGKIAPFTDLKSMAGFPTTKTNNDITSIASNGGRAQCMYVLPPVAKKKFETLSYLPKLDDAQLANEGEYHLRNGWIPCLEFEMEHGFVYREHNRSPGYYYGRYRTMRKQPM

SEQ ID NO: 2998 - protein, 149 aa, Glycine max
MVVSGGKGLKRAAKKRVTADFYDFLTFPTPALAESENFAGGPFRSNVRAFLTKHALLPPPSALFPHLLTWQIVFRVGELTEGPDAPAVCLDVVEEDVARSRSVYCDQCRVFGELTRQYFSRFSFLHESLWFYRFFQLSLRLPVPDHELT

SEQ ID NO: 2999 - protein, 171 aa, Glycine max
MEGLPQGYRPNVGVCLINSDNQIFVTSRLNVPGAWQMPQGGIEDGEEPKSAAIRVLPEETGTVTAEIIAEKWLTYDFPPAVKAKVNRLWGGEWHGQAQKWFLMRLTKDDSEVNLTNGEAEPEFAEWKWADPEEVIEQAVDYKRPTYEEVIRTFKPYFQGSGISAKCKSTKW

SEQ ID NO: 3000 - protein, 342 aa, Glycine max
  misc_feature (126)..(126): Xaa can be any naturally occurring amino acid
PRVRTAARIQSKPTSLLLPQRPQHCVPVLLLRWRQPQTSLASQLYIGLRRPCLKLDSFNSQSFSVFDPNLRLSLSPPTLARALVAMAGTGKFFVGGNWKCNGTKDSIRKLVADLNNAKLEPDVDVXVVAPPFLYIDQVKNSLTERIEISAQNSWVGKGGAFTGEIGPEQLKDLGCKWVVLGHSERRHVIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 3001 - protein, 304 aa, Glycine max
LVSDESDLLRGYRNWLLAEGDGGELLRDEAAETDVELLCKTLQVEHKLFYFDLKENPRGRYLKISEKTSATRSTIIVPFSGISWFLDLFNYYVNSDDQDLFSKELQLDTKVFFFDIGENRRGRFLKVSEASVSRNRSTIIVPAGSSRDEGWAAFRNVLAEINEASRLFILPNQQNSESSERLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMTVANVRTVDPPQR

SEQ ID NO: 3002 - protein, 160 aa, Glycine max
MAEEHRCQAPEGHRLCSNNCGFFGSPATMNLCSKCYRDSLLKEEEQAKTKSTIETALSGSSSATVAVASAVDSLPAPVESLPQPSVVSSPDVAAPVQANRCGACRKRVGLTGFKCRCGTTFCGTHRYPEKHACGFDFKAVGREEIARANPVIKGEKLRRI

SEQ ID NO: 3003 - protein, 313 aa, Glycine max
MNLHHELDQSPTISDVSDRYRHSPLSSLHLSPTLLSSPERELNSQPQPPPSRKHWEIPDLLTPIGEAPNFSVPQRKQWEIPVLSVPIAPSSSGLAPPPPPPPPPPPLAVPRQRKQWEVPSPETPVDQQISRPAPPMTPPSRPFVLQTPNTKVSPVELPPASSQNFEEGSEETSKPKLKPLHWDKVRASSDREMVWDQLRSSSFKLNEEMIETLFVVNTPNPKPKDTTPRSVLAPQNQEDRVLDPKKSQNIAILLRALNVTIEEVCEALLEGVTDTLGTELLESLLKMAPSMEEERILKEHKDDSTTKLVPAEK

SEQ ID NO: 3004 - protein, 113 aa, Glycine max
  misc_feature (48)..(48): Xaa can be any naturally occurring amino acid
SLTIPSNLSKPAALRPKLSPKLRSAATTTIVCSTTNNNNNYNVTSDLXAISVALALFYILLYGHLPAGANFSGLTPCKESNQFLKRERQSINKLDSRYTLSMRATPTHSPLAL

SEQ ID NO: 3005 - protein, 78 aa, Glycine max
GLAEELSKEGACEQAIFPDTNKVITKCAMIGNLSKEGGDRCDLNFVVGCTDPSSHLYNPLANVDDGTCTIELDSESEE

SEQ ID NO: 3006 - protein, 430 aa, Glycine max
MKCFYYFRDKSRSSKQRSAPELKEQEKLEFSGPERVTKSSCSSTSPRGIPELYEEKGHNLRDFSFTELKRATSDFSRLLKIGEGGFGSVFKGTIKPADGNRNSVLVAIKRLNKNALQGHKQWLTEVQFLGVVQHPNLVKLIGYCALDDERGIQRLLVYEYMPNKSLEFHLFNKAYDPLPWKTRLEIATGAAQGLTYLHEELEIQVIYRDFKASNVLLDENFNPKLSDFGLAREGPAAGDTHVSTAVMGTYGYAAPDYIETGHLTAKSDVWSFGVVLYEILTGRRSMEKNRPKTEKKLLEWVKQYPPDSKRFGMIMDPRLQGEYSIKGARKIAKLAQHCLRKSAKDRPSMSQVVERLKQIIQDSDEEQHPADDKSIEVSENDPVEAEEEANQSGSTELWKKRMEHLAKLGESVESASRRRFMILQRANVSS

SEQ ID NO: 3007 - protein, 453 aa, Glycine max
MEHFNNDDLEYVVDEYYDVPDFAVEDTSSDIVPELTSDVDSDFEDEFPTSNAKTDTTASEARNGKDIQGIPWERLNYSRDKYRETRLKQYKNYQNFSRSRHDLRKECLEVQKGETFYDFFFNTRLVKSTIVHFQLRPNIMLRNLLWATSKHDVYFMQNYSVMHWSALLRRGKEVLNVAKPIIPTLKRPGFLAQPVSRVQISTMTVKENLMVAGGFQGELICKNLKHPGVLFCGKITTDDNAITNAVDVYSNPAGSLRVITANNDFQVRVFDAENFASLGCFKYDWSVNNTSVSPDGKLLAVLGDSTECLIADANTGKITGSLKGHLDYSFSSAWHPDGQILATGNQDKTCRLWDIRNLSQSMAVLKGRMGAIRALRFTSDGRFLAMAEPADFVHIFDSHSGYEQGQEIDLFGEIAGISFSPDTEALFVGIADRTYGSLLEFNRKRHYNYLDSF

SEQ ID NO: 3008 - protein, 184 aa, Glycine max
  misc_feature (89)..(89): Xaa can be any naturally occurring amino acid
MEMAQIKARGITALAIAASTSSRKRKKISFNNNFDQFKCLSNATVQAKGEKISGESPRSCCSSNGSVDDENRIIKFSNLEYESQGVVAXACDCGEQQQQIRREMSLTSELRITNSSSQEVDSAEEQITQTKSLPPQKMPTELELDEFFAAAEKDIRKRFSDKYNYDIVKDVSLEGRYEWVKLKP

SEQ ID NO: 3009 - protein, 518 aa, Glycine max
MDTPMTLTGLLRDVAAKFPSRRAISVAGKFDLTHSRLHQLVESAAARLVAAGIKPGDVIALTFPNTVEFVVLFLAVIRVRATAAPLNAAYTAEEFEFYLSDSESKLLLTSAEGNNSAQAAASKLNILHSTASITQAEDKEAELSLSLSHSESESINSVESLGNDPDDVALFLHTSGTTSRPKGVPLTQHNLFSSVNNIKSVYRLTESDSTVIVLPLFHVHGLIAGLLSSLGTGAAVALPAAGRFSASSFWKDMIKYSATWYTAVPTIHQIILDRHSNSPEPVYPRLRFIRSCSASLAPAILGKLEEAFGAPVLEAYAMTEASHLMASNPLPQDGPHKSGSVGKPVGQEMVILDETGRVQDAEVSGEVCIRGPNVTKGYKNNVDANTAAFLFGWFHTGDVGYLDSDGYLHLVGRIKELINRGGEKISPIEVDAVLLSHPDIAQAVAFGVPDPKYGEEIYCAVIPREGSDIDDAELLRYCKKNLASFKVPKKVFITDSLPKTATGKILRRLVAEHFVSQI

SEQ ID NO: 3010 - protein, 345 aa, Glycine max
MAHPTSSGQSNDLTKEDCKETSSVVVCFGEMLIDFVPMVGGVSLAEAPAFKKAPGGAPANVAVGISRLGSSSAFIGKVGADEFGYMLGNILKQNNVETSGMRFDSNARTALAFVTLRADGEREFLFFRNPSADMLLQESELDKDILKQARIFHYGSISLIDEPCKSAHLAAMSIAKNSGCILSYDPNLRLALWPSADSARKGIMDIWDQADVIKISEDEITFLTGGDDPYDDNVVLKKLFHPNLKLLIVTEGSQGCRYYTKAFKGRVAGVKVKPVDTTGAGDAFVSGILYCIASDQTIFQDEKRLRKALYFANVCGALTVTERGAIPALPTKEAILQFLLEAAVI

SEQ ID NO: 3011 - protein, 264 aa, Glycine max
MDIGIYVTANWSIFCSSEHRFCLLGGNNGSHSDNVLISYYLFMTSSLFFQILASCIVKISLSNASAVFVTPLLLLLLIGKKLPIDVRGMVYSITQIVVVPIAAGLLLNRFYPRICNVIRPFLPPLSVLVASICAGAPLAFNVETMKSPLGVAILLLVVAFHLSSFIAGYILSGFVFRDSLDVKALQRTISFETGMQSSLLALALANKFFEDPKVAIPPAISTSIMSLMGFVLVLIWTNVVHQQVCGFSDELIDDKIVLQLFAIL

SEQ ID NO: 3012 - protein, 73 aa, Glycine max
  misc_feature (29)..(29): Xaa can be any naturally occurring amino acid
RFHSFCRAAADIKKDTLPALRDIREQCIXQLEQMRPDHMRRLNPTPYKVSVSAKLYDFIHFLWLNEAPVGELQ

SEQ ID NO: 3013 - protein, 537 aa, Glycine max
  misc_feature (426)..(426): Xaa can be any naturally occurring amino acid
MASAVLANRNEPNWPKHRVGGAGFMGKVPFSNPNPKSKSNPKLANSKRTLSASDDASSINRRSNDFVTFSQYVSFNIASYTNKEINDLKDRLTSELERTQRIRNRIESGDLQPGQSFNGHPKKPSNKKVSGNKRPLPSNSATDLKRSHSEVGSLMKGCSQVLQKLMKHKHGWIFNAPVDVVGLQLTDYYDVIKQPMDLGTVKSNLSMNKYTTPSDFASDVRLTFNNALAYNPKGHDVYTVAELLLTRFEELYRPLHEKFEGSVGHDRESEEELQASSWSHVEPERVKKKENPTPPPPPPPEKLQQEPPQPPASSSNPPLLQSPVRTPSPMRAPPVKPLKQPKPKAKDPNKRDMSLEEKHKLGLGLQSLPPEKMEQVVQIIRRRNGHLKQDGDEIELDIEAVDTETLWELDRLVTNYKKMVSKIKRXQALMGNIYNDNVQANKGNEELPAREKVERAAVEAKKPKKVEAGDEDVDIGDEIPTSMFPPVEIEKDKDVAGGHASSSSCSSGSSSSDSSSSSDSDSGSSSGSDSEADNGQS

SEQ ID NO: 3014 - protein, 124 aa, Glycine max
MGKSTNNNRDWTQMYAIYGMEQWQTLIFLLCQAMLFSVLSVLYLLYFDLVCNFFERIFSGAGGGTARFAAGITGSVTALSALCLFFAAANFFYSSVPLHFDMAQRIVSAVHDWSSVKLALDLGC

SEQ ID NO: 3015 - protein, 295 aa, Glycine max
MGKSTNNNRDWTQMYAIYGMEQWQTLIFLLCQAMLFSVLSVLYLLYFDLVCSFFERIFSGGGGGTARFAAGITGSVTALSALCLFFAAANFFYSSVPLHFDMAQRIVSAVHDWSSVKLALDLGCCGRGILLNAVATQLKKEGSSGRVVGLDRSKRTTLSTLRAAKMEGVGEYVTCREGDARRLPFPDNYFDVVVSGVFVHTVGREYGARTAEAAAERMRAVAELVRVMKPGGVAVVWDLLHVPEYVLRLQELKMEDVRVSERVTAFMVSSHIVSFRKPSQHVHGPAVVRLDWRLC

SEQ ID NO: 3016 - protein, 450 aa, Glycine max
MAVSAITGARLTLGMSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTDAIEKLFEANKGEIAAVFLEPVVGNAGFIVPKPDFHNFLREFRLSYGGAQEYFGITPVITTLGKIIGGGLPVGAYGGRRDIMEKVAPAGPMYQAGTLSGNPLAMTAGIQTLQRIKEPGTYEYLDKITGELLGMGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 3017 - protein, 149 aa, Glycine max
  misc_feature (13)..(13): Xaa can be any naturally occurring amino acid
MDTGGKIKKGAGXRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSERASKEPKSPSKATKSPKKA

SEQ ID NO: 3018 - protein, 208 aa, Glycine max
  misc_feature (197)..(197): Xaa can be any naturally occurring amino acid
MSSPDIVSILENSKEFDRVRKEQEDILSEINKLHKKLQATPEVVEKPGDNSLARLKFLYTQAKDLSESEASISNLLINQIDALLPTGPQGQTRRRIGKEGNEQKRKRVKTESDISRLTPNMRSQLEACASLKGEQVAARVTPRNADKDEWFVVKVIHFDKESKEFEVLDEEPGDDEESIGLSEFKLPMANIIPLPQXNDPSSAPDLPA

SEQ ID NO: 3019 - protein, 173 aa, Glycine max
  misc_feature (123)..(123): Xaa can be any naturally occurring amino acid
MASWDQMGELANVAQLTGVDAVRLIGMIVRAASTARMHKKNCRQFAQHLKLIGNLLEQLKISELKKYPETREPLEQLEDALRRSYILVNSCQDRSYLYLLAMGWNIVYQFRKAQNEIHTYLKXVPLITLVDNARVRVPDTLLCSIICYPIVVNGLFIVDHPLKKKKKKKITPN

SEQ ID NO: 3020 - protein, 653 aa, Glycine max
  misc_feature (51)..(51): Xaa can be any naturally occurring amino acid
  misc_feature (101)..(101): Xaa can be any naturally occurring amino acid
  misc_feature (126)..(126): Xaa can be any naturally occurring amino acid
  misc_feature (172)..(172): Xaa can be any naturally occurring amino acid
  misc_feature (223)..(223): Xaa can be any naturally occurring amino acid
  misc_feature (251)..(251): Xaa can be any naturally occurring amino acid
MKLSLNRGGLWSPPLSSQHIPQPQGAIICWERFLHIRSLKVLLVEIDDSTXRMLSLTLLRNCSYEVIEAAIRIASFRMILEDLTNHIDLVLTEVAMPGLSXGIGLLYKIMGHKTRKNIPVVMMSSXDSMGLVFKCLSKGAVDFLVKPIRKNELKNLWQHVWRRCHRSSGSGXSSSGTQTQKTIKSKSLEKSYKNSGRNAEDYNVNNGLTNVDGNDNALDTQFXWTKRAVEVESHKPVSQWDQIAECPYSTXAKVDPSTAEMGPNNVVPPIAKDCAEQNEQLVKTAGSQHSNAPDVGPSKFSEQINRGQLDLNCENQSSKLRCKGLSLSDAITSTCDSQMHSGEFEALNKKPKSSDIENKGTNNDEELPSLELSLKRLRGVEDADITIQDDRNVLRRSDQSAFSRYNAASNTKKSPTGCVGSNSPYNNSLEVTKKDSSRDIQSHSCGNPPNQNSNGASNNIDMGSTTNNAYAKSAVMSEPAGASTTKCLYQTSAFQPLPPDHDAESIKKMATAAPHCGSSNVEEVLVEGNVGNHSINRSVSGSNNGSNGQNGSSTAVNAGGTNTESNNGLTGNSGSGDASGSGSANRVDQNKTSQREVALTKFRQKRKERRERCFHKKVRYQSRKRLAEQRPRFRGQFVRQTSNENASEATTDS

SEQ ID NO: 3021 - protein, 208 aa, Glycine max
MALHCGTFCFWTVASHPPSSVKLSQPTIKASSFSSPLAPPLVKLNVRGKAFPGDGTPETKESPLVVCFGEMLIDFVPTVNGLSLAEAPAFKKAAGGAPANVAVGISRLGGSSAFIGKVGEDEFGYMLANILKENNVNNEGMRFDPGARTALAFVTLRSDGEREFMFYRNPSADMLLQEDELEFDLIRKVKTKAEFVVVKLKQNVCHTP

SEQ ID NO: 3022 - protein, 542 aa, Glycine max
  misc_feature (173)..(173): Xaa can be any naturally occurring amino acid
  misc_feature (282)..(282): Xaa can be any naturally occurring amino acid
  misc_feature (288)..(288): Xaa can be any naturally occurring amino acid
MELKFVLFLLLLLAVAGYGLASNATLNETCGYFDGSLNRDPKVPCPIGWIMDPNKTKCFLHVGRPQSWNDSETCCSKYAGHLWSLTSLPELQFAQGLCGACGEAINSSLIGGQRLNSIAGYQWMWSNNSPWNNSIFSMVNVPPHCNGTGPSCHRNSTDNLCTVVTNNSNSLLXSLCILDIDTKCDQMHRRREYFIILTVVSALILSTTLAVVVWLLVYKRGKKRRRSRKLSIPGASLPSWPGASLPAWRAFTKSFSEGNRLVGDTKTGGSGRPGLADRARAXLRRQKXSNFQRKKEFYSEIGRVARLRHPNLVAVMGCCYDHGDRYIVYEFVANGPLDKWLHHIPRGGRSLDWAMRMKIATTLAQGIAFLHDKVKPQVVHRDIRTSNVLLDEEFGARLMGVGLSKFVPYEVMHERTVMAGGTYGYLAPEFVYRNELTTKSDVYSFGVLLLEIVSGRRPAQAVDSVGWQSIFEWATPLVQAHRYHELLDLHITSSSSSIIPEASTIQKVVDLVYSCTQHVPSMRPRMSHVFHQLQQITQPHAK

SEQ ID NO: 3023 - protein, 96 aa, Glycine max
  misc_feature (17)..(17): Xaa can be any naturally occurring amino acid
DSSMISYPADTTDNPAXAEMTAPFTDLNALHVLPTIKTNNELTSIASNPGKLLCMQVCTPLVNKKFETLSYLPDLDDATFEDEPEYLLMNGWIPCL

SEQ ID NO: 3024 - protein, 328 aa, Glycine max
MSSNSGKVVCVTGASGFIASWIIKLLLQRGYTVRATVRDPSKPEKVDHLLKLDGAKERLHLFKADLLEEGSFDSAFEGCDGVFHTASPVHFIVTDPQNQLIDPAIKGTLNVVKSCAKSPSVKQVILTSSVAAVLYNGRPRTPQVVVDETWFSDPDICRESEMWYAFAKTLAEDAARKFLSEYDIKLVVINPSMSIGPLLQPELNASSSSILNLINGTPTFSNNSFGWINVKDVANAHIQAYEIASASGRYCLVERVIHFSELAKILRDMYPTLQIPDKCEEDEPFIPTFQVSTEKAKKDLGIEFTPLEVSLRETVESFREKKIVNFNP

SEQ ID NO: 3025 - protein, 518 aa, Glycine max
  misc_feature (160)..(160): Xaa can be any naturally occurring amino acid
MGSTPEVLAQRSCGKLIGTRLLQYLNGGPLSFKTHQAIVLIVTFFAYASYHATRKTTSIVKSVLDPQSAATGLTFFPFRPTNFTESNGSKRLSSNLGDGWAPFNGSDGTSLLGELDVAFLAVYAFGMYFSGHFGDRCNLRIFLTVGMIGTGLFTSLFGPXHWGNIHNFYYYLIVQMIAGLFQSTGWPSVVAVVGNWFGKSKRGLIMGIWNAHTSIGNIAGSLIASAMLSYGWGWSFVVPGLMTAFVGLVVFLILPVTPESVGAREEDEFSCPIKSGEEAAEPLLRQETPVEEKEAVGFIEAWKIPGVAPFALCLFFAKLVAYTFLYWLPFYVSHTAIDGKYLSSGTSGTLSTLFDVGGVLGGILAGHISDHLEARAITAASFMYCAIPALFFYRSYGHVSLIVNGALMFVTGMFVNGPYALITTAVSADLGTHKSLKGNSRALATVTAIIDGTGSIGAAVGPLLTGYISAKSWSAVFTMLMAAALIAGLLLTRLVVSEVATKIEESRYNRAQDCSFNV

SEQ ID NO: 3026 - protein, 75 aa, Glycine max
  misc_feature (12)..(12): Xaa can be any naturally occurring amino acid
  misc_feature (44)..(44): Xaa can be any naturally occurring amino acid
MEADTVAHATLXGPSAVEDIFIAVTLGLVDVGMWNMLHWNKHQXTRSFYDMLDNAQIMVPDHEQIGIAEPEVLHL

SEQ ID NO: 3027 - protein, 387 aa, Glycine max
ALCYSAAGQNEVALNLLRKACGSSEAKHRPHFPSFLFGAKLCSLNPNHAREGIKFSQEVIDLVKHHFVHFLSQGQKFLGICHGAAARISVLDSERIIFQKESLKFLKDAALNGNNNDPEVMLTLGLENAIQRNLNAAYDNIMMYSDMMAGSSRRGWQLLALTVSAQQRFQDAKTIVDFALDEAGDIDQLELLRLKAVLQITQQQPKQAIETYRILLAVIEARKEHWLQAKTFRHEALTEQKLEMEAWQDLATIYADLCSFLDAKACVDKSQSIEFFSPRSWHITGLLFEAQSLHKEAFVSFSVSLSIEPDYIPCIISTAKLFLKLGIPSLPIARSFLMNALRLDPTNHDAWFNLGLVSKMEGSLQQAADCFQAAYELKLSAPVQKFE

SEQ ID NO: 3028 - protein, 377 aa, Glycine max
MKCFFFKEKCKSAPELHKKKTPAVNRAANSTGSVSSPKSVKDLYREKEHSFRVFTLQELRDATNGFNRMLKLGEGGFGSVYKGSITQPDGQGGDPIPVAIKRLNTRGFQGHKEWLAEVQFLGIVNHPNLVKLLGYCSVDAERGIQRLLVYEFMPNRSLEDHLFNKNLPTLPWKTRLEIMLGAAQGLAYLHEGLEIQVIYRDFKSSNVLLDADFHPKLSDFGLAREGPQGDQTHVSTAVVGTQGYAAPEYIETGHLKVQSDMWSFGVVLYEILTGRRSLERNRPTAEQKLLDWVKQYPADTSRFVIIMDARLRNQYSLPAARKIAKLADSCLKKNPEDRPSMSQIVESLKQALQYSDTTSQDIAESSSSSRSKLVRKK

SEQ ID NO: 3029 - protein, 125 aa, Glycine max
IISEHATLDNLLLTDADGQGVLYMNREQLEELRVKPLSASSASKRTLVPALNMRLWYAPHLELPTGVVLKGATLVAIRPSEQSPNTAKKEASDLSWVSTAFEEPYRTAATMLVKRRTYCLEMNSF

SEQ ID NO: 3030 - protein, 560 aa, Glycine max
  misc_feature (464)..(464): Xaa can be any naturally occurring amino acid
  misc_feature (524)..(524): Xaa can be any naturally occurring amino acid
MGNTWRGSLKGKYIQGFSQPEDHSKRSTTHSDPSSTKQQDDNDNNNNNNNNNNNNNNNNNNLPFNAKREAIMRRGLDNQAYYVLGHKTPNIRDLYTLGRKLGQGQFGTTYLCTENSTSIEYACKSISKRKLISKEDVEDVRREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKPGQVFTDVVGSPYYVAPEVLLKHYGPEADVWTAGVILYILLSGVPPFWAETQQGIFDAVLKGHIDFDSDPWPLISDSGKDLIRKMLCSQPSERLTAHQVLCHPWICENGVAPDRSLDPAVLSRLKQFSAMNKLKKMALRVIAESLSEEEIAGLREMFQAMDTDNSGAITFDELKAGLRRYGSTLKDIEIRDLMEAADVDKSGTIDYGEFIAATFHXLEREEHLIAAFQYFDKDGSGYITVDELQQACAEQNMTDAFLEDIISIIKEVDQDNDGRIXDYGEFAAMMQKGNAGIGRRTMRNSLNLSMRDAPSAQ

SEQ ID NO: 3031 - protein, 670 aa, Glycine max
  misc_feature (227)..(227): Xaa can be any naturally occurring amino acid
MELTVFSLFFFFFTFHLPSCFSGQSSSMESVPDLQNTMYASIDGYPCVRLMNLSGTIGCSNPGRDKVVAPILRFENVDKIAEPSAILVSLDEFPTLFTRISDDSSFASKVLGVLVEPTGDVQNKLKGFSPDQKFPQAQFALYHNTSYQWNSIGSGIMWKSYKFPVFLLTESGSKTLQEFVTKNEDKKKSYTSNVAEFDLVMQTVKSGTHDSESCLKEETCLPLGGYXSVWSSLPPINISSLQRSKPILLTVASMDSASFFRDKSLGADSPISGLIALLAAVDALSHLDGLGDLSKQLVFAVFTGEAWGYLGSRRFLVELDMHSDAVHGLNQTLIETVIEIGSVGKGLSQGVKNFFAHTKGDSSATNQTVAALKRAQESLISENIKIASASASNPGIPPSSLMSFLEKNPAISGVVLEDFDSVFVNKFYHSHLDDLSNVNSSAVVAAASLIARTLYMLASETEDVQNSTLAAINVNVSLVEQLLGCLLDCDPGLSCELVKKYISPMSTCPSHYVGVILDEPSSAPYAGYINDVPRFIWNFLADRTSIPRENNISDCQHGCNGRDEVCVKAETDGKGVCVLSTTRYVPAYSTRLKFESGVWNVLPPNSSDKMGVVDPVWTESNWNTIGMRVYTVQNAAYDRLVLFGGITLTVFAYLAIATARAFFNKAMKRD

SEQ ID NO: 3032 - protein, 446 aa, Glycine max
MSRHQGGNADDMADEFEMEDVEDDMDDESIDRERGGVESDIDDYDHSSGKGVDTTAAQARRGQDIQGIPWDSLNITRERYRQTRLEQYKNYENIPGSGDKSGKDCKNTKKGYSFYDFRKNSRSVKSSILHFQLRNLVWATSKHDVYLISQFSIMHWSSLTCKSSEVLNVSGHVAPSERHPESLLEGFTHTQVSTLAVKEKLLVVGGFQGELIFKHLDRPGVSFCTRTTYDDNAITNAIEIYDCPSGAVHFTAANNDSGVRDFDMEKFQLSKHFCFPWPVNHTSLSPNGKLLLIVGDNPECMLVDSQNGKTIVPLSGHFDYSFASSWHPDGVTFATGNQDKTCQIWDLRNLSKSVAVLQSNLGAIRSIKYTSDGRYMAVAEPADFVHVYDVKSGYENEQEIDFFGEISGISFSPDTESLFIGVWDRTYGSLLEYGRRRYYAYLDSLT

SEQ ID NO: 3033 - protein, 169 aa, Glycine max
  misc_feature (65)..(65): Xaa can be any naturally occurring amino acid
MSGTVKKVSDVAFKVGRNIDWDGMAKLLVSDEARREFSNLRRAFDEVNSQLQTKFSQEPEPIDWXDYYRKGIGTRLVDMYKEHYESIEIPKFVDTVTPQYKPKFDALLIELKEAEEKSLKESERLEKEIAEVQELKKKLSTMTADEYFEKHPELRKKFDDEIRNDNWGY

SEQ ID NO: 3034 - protein, 168 aa, Glycine max
MSGTVKKVTDVAFKVGRNIDWDGMAKLLVSDEARREFSNLRRAFDEVNSQLETKFSQEPEPIDWDYYRKGIGTRLVDMYKEHYESIEVPKFVDTVTPQYKTKFDALLIELKEAEEKSLKESERLEKEIVEVQELKKKLSTMTADEYFEKHPELRKKFDDEIRNDNWGY

SEQ ID NO: 3035 - protein, 97 aa, Glycine max
  misc_feature (6)..(7): Xaa can be any naturally occurring amino acid
  misc_feature (11)..(11): Xaa can be any naturally occurring amino acid
  misc_feature (14)..(14): Xaa can be any naturally occurring amino acid
  misc_feature (17)..(17): Xaa can be any naturally occurring amino acid
  misc_feature (20)..(21): Xaa can be any naturally occurring amino acid
  misc_feature (25)..(25): Xaa can be any naturally occurring amino acid
  misc_feature (28)..(29): Xaa can be any naturally occurring amino acid
  misc_feature (32)..(32): Xaa can be any naturally occurring amino acid
  misc_feature (34)..(43): Xaa can be any naturally occurring amino acid
  misc_feature (54)..(54): Xaa can be any naturally occurring amino acid
  misc_feature (87)..(87): Xaa can be any naturally occurring amino acid
MSLTIXXNLSXPAXLRXKLXXKLRXAAXXTIXCXXXXXXXXXXVSSDLKAFSAXLALSSILLSAPLPAGADISGLTPCKESKQFAKXEKQSIKKWSA

SEQ ID NO: 3036 - protein, 133 aa, Glycine max
MAWMVLAWIFSVFAAVASTYWDLVIDWGLLQRRSKNRWLRDKLAVPHKSVYFLAMVLNVLLRFAWLQTVLNFKFSFLHKQAMTTIVACLEIIRRGMWNFFRLENEHLNNVGKYRAFKSVPLPFNYDEDEDKDE

SEQ ID NO: 3037 - protein, 116 aa, Glycine max
  misc_feature (101)..(101): Xaa can be any naturally occurring amino acid
AFSAALALSSILLSAPLPAGADISGLTPCKESKQFAKREKQSIKKLESSLKLYNAGSAPTLAIKASVEKTKRKFYNYTNQGLLYSSNRLPHLIISRYQMHXGKFITPKILFLYISK

SEQ ID NO: 3038 - protein, 218 aa, Glycine max
  misc_feature (59)..(59): Xaa can be any naturally occurring amino acid
EIRVALLLDNRGPPGSGKGTQSPIIKDEYCLCHLATGDMLRAAVAAKTPLGVKAKDSRXKGELVSDDLVVGIIDEAMKKPSCQKGFILDGFPRTVVQAQKLDEMLQNQGVKVDKVLNFAIDDAILEERITGRWIRPSSGRTYHTKFSPPKVLGVDDVTGEPLIQRKDDPAAVLKSRLEAFHKQTEPVIDYYSKKGLVGNLHAEKPPKEVTVEVEKVLS

SEQ ID NO: 3039 - protein, 335 aa, Glycine max
RLEIKWHVSSTSPSPSPDPEKLLLLLNISFIYLTFLFLKTYLHPSSSPNIVHASTKIFNHARMLSDISVDGCTDLHKYSDYDSKCLYVKSNVHCRSKGYINYLQIFYCSFGHSPILGHSLLAMWLVVLFYLLGDTASNYFCNNLEGLSDILRLSPTIAGVTLLSLGNGAPDFFASVVSFTGSSSNGAVGLNSILGGSFFVSCAVLGIISILVGPNQVQVDKASFIRDVLFFLFSLLILLIILYIGKITLLASICYVSIYFLYVCAVSATHLIYGGDKMINERQYQYSDDESSSSSLEASIPLLGYVDEEKTKLAEIVGGLKEKDQNQNQKQDSHS

SEQ ID NO: 3040 - protein, 210 aa, Glycine max
SDEVTKLMDRVEKTFTKHFYNSNRNKAMNILRPKAKRERHRVTFSMGFLAGCTAALVLALILIVRTRKILDESGSTKYMDTLFPLNSLYGYIVLHMLMYAANIYFWRRYRVNHSFIFGFKQGTELGYNQVLLLGFGLAVLALGGVLVNLDMQIDPQTKDYKTLTELIPLILLLVGIAILLGPINIFYRSRQVFFLICFVHCICTPLYKVT

SEQ ID NO: 3041 - protein, 280 aa, Glycine max
  misc_feature (137)..(137): Xaa can be any naturally occurring amino acid
  misc_feature (150)..(150): Xaa can be any naturally occurring amino acid
MSHFDPKLSRSSTLRRRFHHRVSLLQRCLLRVLHRILLCSGSKPTNATYSMLPPALPSPPPPMGSDGELGREEMDLTSSAVFHTHDLDSDLVSLKISLLGDCQIGKTSFLEKYVGDEKDQQQGNQREGLNQMDKTLXLEGARYIVLVSGXVQGDGKSEDQLPMACMDSVAILIMFDLTSRCTLNSVVGWYKEARKWNQTAIPVLIGTKFDDFIQLPIDLQWTIANEARKYAKALNATLFFSSATYNINVNKIFKFITAKLFDLPWTVERNLTVGEPIIDF

SEQ ID NO: 3042 - protein, 97 aa, Glycine max
MSGEEDATVREPLDLIRLSLDERIYVKLRSDRELRGKLHAFDQHLNMILGDVEEVITTVEIDDETYEEIVRTIKRNIQYLFVRGDGVILVSPPLRTT

SEQ ID NO: 3043 - protein, 202 aa, Glycine max
GSSSSRFGSRDVTEVAALYHSEKSHKTVEYSDYSFSDANGDKGHSSNEKIHEKNDTHSTSRSSVSEKDQLSTGGSYHWEDWHTDLLACCSEPCLCIKTCFYPCGTLSKIATVANNRPISSAETCNELMAYSLILSCCCYTCCIRRKLRKMLNIRGGFIDDFLSHLMCCCCALVQERREVEIRGVEGPEKTNTRPAPSQYMES

SEQ ID NO: 3044 - protein, 67 aa, Glycine max
SAKSTSPAGPTDNRAGAGMVAPVTGHKTMEGFPTRKTNNDITPIASNGGREQCMQVRTQDGKKKTET

SEQ ID NO: 3045 - protein, 328 aa, Glycine max
HKEFGESKGRVCVTGGTGFIGSWIIKRLLEDGYSVNTTVRPDPEHRKDVSFLTSLPRASQRLQILSADLSNPESFIASIEGCMGVFHVATPVDFELREPEEVVTKRSIEGALGILKACLNSKTVKRVVYTSSASAVDNNKEEIMDESSWNDVDYLRSSKPFGWSYSVSKTLTEKAVLEFGEQNGLDVVTLIPTLVFGPFICPKLPSSVRNSLDFILGEKGTFGVVLQTDMVHVDDVARAHIFLLEHPNPKGRYICSQCSVTYERISKLVSAKYPEFQPPPVESLNHIEGTKGSYLSSKKLIDAGFVYKYGLEEMVDDAIQCCKEKGYL

SEQ ID NO: 3046 - protein, 365 aa, Glycine max
  misc_feature (216)..(216): Xaa can be any naturally occurring amino acid
  misc_feature (240)..(240): Xaa can be any naturally occurring amino acid
  misc_feature (245)..(245): Xaa can be any naturally occurring amino acid
  misc_feature (263)..(263): Xaa can be any naturally occurring amino acid
  misc_feature (305)..(305): Xaa can be any naturally occurring amino acid
MASPLLTPYKMGKFNLSHRVVLAPLTRQRSYDNVPQPHAILYYSQRTSNGGLLITEATGVSDTAQGYPQTPGIWTKDHVQAWKPIVDAVHAKGGVFFCQIWHVGRVSDSVYQPNGQAPISSTDKPLTPQIRSNGIDQVQFTPPRRLRTDEIPHIVNDFRLAARNAIEAGFDGVEIHGAHGYLLEQFMKDKVNDRTDEYGGSLENRCRFALEVVEAXVVNEIGADRVGIRLSPFAECSDVXDNNPXQLGLYMMDPLNKYHTLYXNTSNPDLGFTDNPFLADVESYSLLIVTRFYFPQEGINAVAEXRFDLGAYGRWFLANPDLPKRFALNAPLNKYHRETFYTSDPVLGYTDYPFLDDEESNAVAS

SEQ ID NO: 3047 - protein, 269 aa, Glycine max
LHSDICSVYQPNGQAPISSTDKLLAPQGRGDGIDEVHYTPPRRLRTDEIPHIVNDFRLAARNAIQAGFDGVEIHGAHGYLIDQFLKDKVNDRTDQYGGSLENRCRFALEVVEALVDEIGAERVGIRLSPFAEYSESGDSNPKELGLYMMNALNKYGILYCHMVEPRMKTVGEKTECPHSLVPMRKAFNGTFIAAGGYDRQDGINAVAENRADLVAYGRWFLANPDLPKRFALNAPLNKYHRETFYTPDPVVGYTDYPFLHAEESNVVAS

SEQ ID NO: 3048 - protein, 561 aa, Glycine max
MKESFKVCFCCVRNFKVKSSEPPEEIKNLFHDYSQDDRMSADEMLRFVIQVQGETHADINYVKDIFHRLKHHGVFHPRGIHLEGFYRYLLSDFNSPLPLTREVWQDMNQPLSHYFLYTGHNSYLTGNQLNSNSSIEPIVKALRNGVRVIELDLWPNSSGKEAEVRHGGTLTSREDLQKCLNVVKENAFQVSAYPVVLTLEDHLTPILQKKVAKMVSKTFGGSLFQCTDETTECFPSPESLKNKILISTKPPKEYLQTQISKGSTTDESTRAKKISDAEEQVQEEDEESVAIEYRDLISIHAGNRKGGLKNCLNGDPNRVIRLSMSEQWLETLAKTRGPDLVKFTQRNLLRIFPKTTRFDSSNYDPLVGWIHGAQMVAFNMQSHGRYLWMMQGMFKANGGCGYVKKPDVLLSNGPEGEIFDPCSQNLPIKTTLKVKIYTGEGWNMDFPLDHFDRYSPPDFYAKVGIAGVPLDTASYRTEIDKDEWFPIWDKEFEFPLRVPELSLLCITVKDYDSNTQNDFAGQTCFPLSEVRPGIRAVRLHDRAGEVYKHVRLLMRFVLEPR

SEQ ID NO: 3049 - protein, 286 aa, Glycine max
  misc_feature (95)..(95): Xaa can be any naturally occurring amino acid
MEGNSGGGGGGGGGNDVELLCKTLQVEHKLFYFDLKENPRGRYLKISEKTSATRSTIIVPFSGISWFLDLFNYYVNSDDQDLFSKELQLDTKVFXSAMGENRRGRFLKVSEASVSRNRSTIIVPAGSSRDEGWAAFRNVLAEINEASRLFILPNQQNSESSERLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMAVANVRTIDPPQR

SEQ ID NO: 3050 - protein, 570 aa, Glycine max
  misc_feature (13)..(13): Xaa can be any naturally occurring amino acid
  misc_feature (234)..(234): Xaa can be any naturally occurring amino acid
  misc_feature (276)..(276): Xaa can be any naturally occurring amino acid
  misc_feature (417)..(417): Xaa can be any naturally occurring amino acid
FQVASSTLICDTXEWKELKAHAEDVEKTHLRDLLSDDERSQSMVVEFDGILLDYSRQQATLETREKLFKLAEVASLKQKINQMYNGEYINSTENRSVLHVALRAPRDAVIQSDGNNVVPDVWNVLDKIQEFSERIRSGSWVGATGKALKDVVAVGIGGSFLGPLFVHTALQTDPEAIESARGRQLRFLANVDPIDVARNITGLNPETTLVVIVSKTFTTAETMMNALTFREWVXNALGPLAVAKHMVAVSTNLTLVEKFGIDPNNAFAFWDWVGRXYSVCSAVGVLPLSLQYGFSVIEKFLKGASSIDQHMYSEPFERNLPVLLGMLSVWNVSFLGYPARAILPYSQALEKFAPHIQQVSMESNGKGVSIDGVPLPFEAGEIDFGEPGTNGQHSFYLLIHQCRVIPYDFIGVVKSQXPVYLSGEVVSNHDELMSNYFAQSDALAYGKTAEQLQKENVSPHLVPHKTFSGNRPSLSLLLPSLNAYNIGQLLAIYEHRVAVEGFIWGINSFDQWGVELGKSLASQVRKQLNASRTKGEPVQGFNFSTTAMLTRYLQASADVPADLPTRLPQI

SEQ ID NO: 3051 - protein, 195 aa, Glycine max
PSSSFIFLPNGIEGKIWRKNTDARHRASAPTIGGFFGSPATQNMCSKCYRDFQLKEQQSSNAKMVLNQSLVPSPPPAVISQPSSSSSAAVDPSSAVVDDAPRESEEVKAPQQNRCMTCRRRVGLTGFKCRVRDDAVRDQPLPGAGRGRVRLHVKEDTATLVTQTLFFCSGFSQEQPLLCYDSAEGFCMQQNHFLV

SEQ ID NO: 3052 - protein, 274 aa, Glycine max
MLPYASIPEAVAALGRNLTFAETLWFNYSAAKSDYFLYCHNILFLFLVFSLVPLPLVFLEFKRFSFVSSHKIQPKVRLSLAETFKCYKDVMRMFFLVVGPLQLISYPSIQMIGIRTGLPLPSWREILSQLLVYFLVEDYTNYWIHRFLHNDWGYEKIHRVHHEYHAPIGFAAPYAHWAEILILGIPSFLGPAMVPGHIITFWLWIALRQIEAIDTHSGYDFPRSITKYIPFYGGAEYHDYHHYVGRQSQSNFASVFTYCDYIYGTDKVISSFWN

SEQ ID NO: 3053 - protein, 178 aa, Glycine max
VNHSFIFGFKKGTDLSYHQVFFFSFVLAALALTSVLANLDMQIDPETKEYKAFTELLPLILVLVLIAILLCPLNIVYRSSRMFFLTCLIHCICAPLYKVTLPDFFMADQFTSQVQALRSFEFYICYYGWGDFKQRETSCKSNRIFIAFSFIVAVIPYWSRFLQVQNFIPFSSDVEIFQ

SEQ ID NO: 3054 - protein, 158 aa, Glycine max
MAEKLAPEKRHSFVHNGQKVFEWGQTLDEVNIYIALPPNVHSKQFYCKIQSKHLELGIKGNPPYLNHDLTSPVKTDSSFWTLEDDIMHITLQKRDKGQTWASPISGQGQLDPYATDLEQKRLMLQRFQEENPGFDFSQAQFSGNCPDPRTFMGGIRSD

SEQ ID NO: 3055 - protein, 147 aa, Glycine max
  misc_feature (96)..(96): Xaa can be any naturally occurring amino acid
MLVYQDLLTGDELLSDSFRYKEIENGMLWEVEGKWVVKGAVDVDIGANPSAEGGGEYVGVDDAAVKVVDIVDTFRLQEQPAFDKKQFVTFMKRFIXTKYLLSKIKDFQFFVGESMGDDACLVFAYYKDGAADPTFLYFAYALQDVQC

SEQ ID NO: 3056 - protein, 172 aa, Glycine max
  misc_feature (14)..(14): Xaa can be any naturally occurring amino acid
  misc_feature (52)..(52): Xaa can be any naturally occurring amino acid
  misc_feature (70)..(70): Xaa can be any naturally occurring amino acid
  misc_feature (122)..(122): Xaa can be any naturally occurring amino acid
TCSLYPDLLTGDEXLLSDSFRYNAIDTGMLGEAEVKWCVKGTDDRDIGADPXAEGGGQYEGVLDAPVKVXVEFVDTFILQEQPEFDKKQYDTFMRRVIKNMTPKLDAEQQELFKKHIAGATXKHLLSKIKDFQLFVGESMADDACLVLAYYKDGAADPTFLYFAYALKEVKC

SEQ ID NO: 3057 - protein, 234 aa, Glycine max
SFASFFLTFSHSPNSFLTKEEEWHLSFRSLCCFSFLNYPFLSLSTNPEANALHALRSRISDPNNVLQSWDPTLVNPCTWFHVTCDSNNHVIRLDLGNSNVSGTLGPELGQLQHLQYLELYRNELTGKIPKELGNLKSLISMDLYDNKLEGKIPKSFGKLKSLKFLRLNNNKLTGSIPRELTRLTNLKIFDVSNNDLCGTIPVEGNFESFPMESFENNRFSGPELKGLVPYDFGC

SEQ ID NO: 3058 - protein, 160 aa, Glycine max
  misc_feature (20)..(20): Xaa can be any naturally occurring amino acid
  misc_feature (28)..(28): Xaa can be any naturally occurring amino acid
  misc_feature (48)..(48): Xaa can be any naturally occurring amino acid
  misc_feature (117)..(117): Xaa can be any naturally occurring amino acid
  misc_feature (136)..(136): Xaa can be any naturally occurring amino acid
MKTFFAAVDVSDILYAAEMXSVADILGXTADEESIHFAKREKRRIKQXTHVLTGLLVKELGSELIAIRVRSSNPGSHSAASMRLLGGAVGVIVMIVNGDQGHRGELISADLVFLYIXGGLEWEVRSGGVAFRDEKXPAMKEIIRDLSLDRRIIKVGYRSL

SEQ ID NO: 3059 - protein, 333 aa, Glycine max
  misc_feature (289)..(289): Xaa can be any naturally occurring amino acid
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILFXEDEPRLREVLKFANACGAITTTQKGAIPALPKEEAALKLIKGGS

SEQ ID NO: 3060 - protein, 274 aa, Glycine max
  misc_feature (146)..(146): Xaa can be any naturally occurring amino acid
MESAALSRIGLAGLAVMGQNLALNIAEKGFPISVYNRTASKVDQTVDRARNEGSLPLTGQYTPRDFVLSLQRPRSVIILVKAGSPVDHTIAALSDHLDPGDCIIDGGNEWYENTERRMNLVADKGLLYLGMGVSGGEDGARHGPSXLMPGGSTKLLLKRRTNPCVTYIDEGGSGNWAAMVGFRGCFIGGRLCEGEGKGCGLVVPDEEEGNVRGEGEMEGHARGRWRGRRRVAGAGRGKEGCWCRKGGGRPPVPGGKGEKGGLVRGRRKGKSEKK

SEQ ID NO: 3061 - protein, 124 aa, Glycine max
CSGTIIELAKLKKVCWLEVRGKFDIRKLLPGILYQVSFLIMLEDSSEGWEVPINVRLVLPGGKRQQHKVNLNEKLRENWMEILVGEFVASEKDGGEMDISMYEYEGGMWKSGLVIQGVVIKPKN

SEQ ID NO: 3062 - protein, 445 aa, Glycine max
MVVNERPSKRMKRRVTADLCDFLTFPEPGVSASTEPFRNCVQRFLSHHARITFPPSLFPSLMTWQILFRVGDLLDAPDLSPAIVTLDIVEEDVTRSRASVYCDQCRVVGWSGHPVCRKRYHFIIRAASDAVEAYQRPRPCSRCGNLLQLSETRCRSCNFAITVDDLEDWVYLQIEDNTHLLHGVVHANGYGHLLTLNGREGGSKLLSGFDIMNFWDRLCAPTSVRKVSVMDLSKKFGLEYRLLHAITNGHSWYGNWGYQFGTGSYALTQNAYKNAVNTLSSMLLSSFSFHGRGPRSRLECVISLYQSLAETELLTIKDLFSFLLTLILECRKPVAMRTSKQTSNLLCAWTGNDVEDVQHALIKVLLASGVCTEAKWVTRRTLKAGIGYVLQFLLGRLARWICPRNLGWNTGCFMQSPTGIPGMAIGVMNLELAAMLLRKMRTRMQ

SEQ ID NO: 3063 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTEGASKEPKSPSKATKSPKKA

SEQ ID NO: 3064 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERAAKEPKSPSKATKSPKKA

SEQ ID NO: 3065 - protein, 142 aa, Glycine max
  misc_feature (26)..(27): Xaa can be any naturally occurring amino acid
  misc_feature (29)..(29): Xaa can be any naturally occurring amino acid
  misc_feature (34)..(34): Xaa can be any naturally occurring amino acid
  misc_feature (49)..(50): Xaa can be any naturally occurring amino acid
  misc_feature (53)..(53): Xaa can be any naturally occurring amino acid
  misc_feature (60)..(60): Xaa can be any naturally occurring amino acid
  misc_feature (73)..(73): Xaa can be any naturally occurring amino acid
  misc_feature (75)..(76): Xaa can be any naturally occurring amino acid
  misc_feature (78)..(78): Xaa can be any naturally occurring amino acid
  misc_feature (80)..(80): Xaa can be any naturally occurring amino acid
  misc_feature (85)..(85): Xaa can be any naturally occurring amino acid
  misc_feature (89)..(89): Xaa can be any naturally occurring amino acid
  misc_feature (91)..(92): Xaa can be any naturally occurring amino acid
  misc_feature (94)..(94): Xaa can be any naturally occurring amino acid
  misc_feature (96)..(96): Xaa can be any naturally occurring amino acid
  misc_feature (98)..(99): Xaa can be any naturally occurring amino acid
  misc_feature (101)..(102): Xaa can be any naturally occurring amino acid
  misc_feature (109)..(109): Xaa can be any naturally occurring amino acid
  misc_feature (111)..(111): Xaa can be any naturally occurring amino acid
LRLLGTAPSSQLPPPPNAPVDVDNSXXFXAINVXPIEYGHVLLIPRIIXXLPXRIDRESXLLALQMAVESDNXYXXLXYXSLGAXATIXHXXFXDXYXXLXXLCTRRPXLXRRSWYRNKISLFRLLFDVYGCCMFEVEDLFD

SEQ ID NO: 3066 - protein, 75 aa, Glycine max
  misc_feature (66)..(66): Xaa can be any naturally occurring amino acid
MAFSMISSPAVTTVNRAGAGMVAPFTGLKFMAGFATRKTNFDFTCIASNGGRVQCTHVRPPVAKKXFATLSYLSD

SEQ ID NO: 3067 - protein, 163 aa, Glycine max
MAEEHRCQAPEGHRLCSNNCGFFGSPATMNLCSKCYRDIRLKEEEQAKTKSTIETALSGSSSATVTTAVVASSVESPSAPVESLPQPPVLISPDVAAPVQANRCGACRKRVGLTGFKCRCGTTFCGTHRYPEKHACGFDFKAVGREEIARANPVIKGEKLRRI

SEQ ID NO: 3068 - protein, 202 aa, Glycine max
MNNPLPTDYRILDLHAVVSHHSITMPSPSADQSQSQPKPNPNLLSLFLKPIIMLLLTSLFFLFLGFAAFLLLNLFLLGGAFHRLRFRPSVTSAPASSIGLPPRDINNLPRFLLAKGSANRPDSHCVVCLDAFRNAQWCRKLAACGHVFHRTCVDTWLLKVAACPTCRTPVRFNAGTTVHDPPQRSDQFHTCGTDCTALTTLL

SEQ ID NO: 3069 - protein, 86 aa, Glycine max
  misc_feature (41)..(41): Xaa can be any naturally occurring amino acid
  misc_feature (58)..(58): Xaa can be any naturally occurring amino acid
FVCSDDKFIDTDQLMKGFSTEFALSCILLSALMARGSNISXLTPCWGYTHYSPMEKSXISKLESSLKIYAPDSVPALALNCLINET

SEQ ID NO: 3070 - protein, 101 aa, Glycine max
  misc_feature (21)..(21): Xaa can be any naturally occurring amino acid
VIDWGLLRRNSKNPWLREKLXVPNKSLYFVAMVLNVILRETPILHRTALTALVTCLEILRRGIWNFFRLENEHLNNVGNYRAFKSVPLPFNYEDEEENTVI

SEQ ID NO: 3071 - protein, 392 aa, Glycine max
  misc_feature (114)..(114): Xaa can be any naturally occurring amino acid
VGLSGALETLCGQGFGAEEYQMLGIYLQASCIISLIFSIIISIIWFYTEPILVLLHQSQDIARTTSLYTKFLIPGLFALSFLQNILRFLQTQSVVKSLVVFSAIPLLVHIFIAXALIFCTDLSFIGAPVAVSISLWISIPLLVMYIMYAERFRQTWTGFSFESFNYIFTDLKLALLSAAMVCFEYWAFEIMVFLAGLLPDPTISTSLIAICTNTELIAYLITYGLSAAASTRVSNELGSGHLDRAKHAMGVSLKLSLLLGLCLFWHLQFGHNIWIQMFSDSSKIKEELASLTPFLSISILLDSVQGVLSGVIRGCGWQHLAAYVNLATFYLIGLPISGLLGFKFNLQVKGLWIGLICGLACQTGTLSFLAWRAKWTKLNVSLDRDEIQPPSA

SEQ ID NO: 3072 - protein, 160 aa, Glycine max
INAVHFVTFYMPLWGAILYNGFTYFQVIRMLNNATRMAVGMSGQTFVSDTRDNMRALNRWGYYPLILIGSWAFGTINHIHDFFEPNHKIFWLTFLDVGTAALMGLFNSIAYGLNSSVRRAICERLDKYWPERLNRWLPNSLKYKNLQQESELVLFKTEDQ

SEQ ID NO: 3073 - protein, 81 aa, Glycine max
  misc_feature (20)..(20): Xaa can be any naturally occurring amino acid
  misc_feature (23)..(23): Xaa can be any naturally occurring amino acid
  misc_feature (51)..(51): Xaa can be any naturally occurring amino acid
TAKNTAPAETTDNRAGAGRXAPXTGRKAKAGHPTRKTNNDSTTRASNGGRXQGMHFLPPVGKKKGETLSYPPDLDDAQLSK

SEQ ID NO: 3074 - protein, 227 aa, Glycine max
  misc_feature (85)..(85): Xaa can be any naturally occurring amino acid
HIYQTTQALHTKASGSGGNICHPEYPFISLIRLNLFVPPSYLSAPASRFVFFFIVLNLSLTEVIKREKRNGPIPLQLKSFNHISXVCASVEKSVDFYVNVLGFSPIKRHFNGAWLFNYGIGIHLLQSEDPEGMPKLVPINPKDNHISFQCESIAAVEKRLQQMKIEYVKNRVEESGIFVDQLFFHDPDGMMIEICNCDNIPVVPLPEDKVWSCSRFNCNIQNRQQQI

SEQ ID NO: 3075 - protein, 581 aa, Glycine max
  misc_feature (206)..(206): Xaa can be any naturally occurring amino acid
  misc_feature (218)..(218): Xaa can be any naturally occurring amino acid
MVLKSMVASASDLSLVSVAGNSPLDFKNRVFGGRLISLGFRFNKGSKCKGNERFNFEVRAAVEVGVERSKSKALEGGFGLDVVSEAELTVKGFAGLRKTKLVCTVGPACSSMEDLENLALGGMSVARLNMCHGTREWHRDVIRKIKKLNEEKGFCVSVMIDTEGSQIHVVDHGAPSSVKVEEGSNWVFTAEHYEGSRPFTVQTNYXSFSEGTEVGDEXYGHMASLVSRTRPNPPIFAFPNDGSTRMALTLQWGVVPLLVDLSDDAESNISKSVQLMKSRGLISQGDDFFALSFVNHADSVKDLKMYLSTKSTKSIKVLAKIESLESLHKLEEIVQASDGIMVARGDLGVEIPLEQIPTVQEDIIYVCRQLNKPVIVASQLLESMVEYPTPTRAEVADVSEAVRQYADALMLSGESAIGSYGRKALAVLDMASSRMESWSREENRQSLVSHHQLGESLPECITEQICNCAVEMANNLGVDAIFVYTKYGHMASLLSRNRPNPPIFAFTNDDSTRMALTLQWGVVPILVDLSDDAESNISKSVQLMKSRGLISQGDVVLVVSDVAPTRASPMAFQSIQVKTII

SEQ ID NO: 3076 - protein, 170 aa, Glycine max
  misc_feature (44)..(44): Xaa can be any naturally occurring amino acid
AHNIVHLDIKPDNLLITCHGTVKIGDFSVSQAFEDDKDELRRSXPGTPVFTAPECILGGVKYGGKAADTWAVGVTLYCMILGEYPFLGDTLQDTYDKIVNNPLVLPNDMNPPLKNLIEGLLSKDPSLRMTLGAVAEDSWVIGDDGPIPDYLCWCKRKSLGIEDNDESNTD

SEQ ID NO: 3077 - protein, 247 aa, Glycine max
  misc_feature (125)..(125): Xaa can be any naturally occurring amino acid
MAGIAFGSFNDSFSLASIKAYIAEFISTLLFVFAGVGSAIAYAKLTSDAALDPTGLVAVAICHGFALFVAVSVGANISGGHVNPAVTFGLALGGHITILTGLFYWIAQLLGSIVACLLLNYVTGXDTPIHSVAAGVGAVEGVVTEIIITFGLVYPVYATAADPKKGSLGTIAPIAIGFIVGANILAAGPFSGGSMNPARSFGPAVVSGDFHDNWIYWVGPLIGGGLAGLIYGNVFIRSDHAPLSSEF

SEQ ID NO: 3078 - protein, 179 aa, Glycine max
GSRRVGVSVSASKSEDRKRINDVLDKHLERSSPSTSRPITSASKNSNLQVEESETESEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVFICS

SEQ ID NO: 3079 - protein, 332 aa, Glycine max
  misc_feature (104)..(104): Xaa can be any naturally occurring amino acid
DDSTRHVVTALLRNCSYEVIEAANGLQAWKILEDLTNHIDLVLTEVAMPGLSGIGLLYKIMGHKTRKNIPLVSKFFQLLIYVWFEAFLFLISCCKRATLFYGFXWDWSAVMSSHDSMGLVFKCLSKGAVDFLVKPIRKNELKNLWQHVWRRCHSSSGSGSESGTQTQKSIKSKSLEKSDNNSGSNDEDDNGSIGLNNGDGSDNGSGTQSSWTKHAVEVDSPKPVSHWDKIAECPDSTCAQVVHSNAEIGENKVVPLAAKECPEQKEQLVKTAGSKHSNAPDVGPSKFNDQINRGQLDLNCENQSSKLRCKGLSLSDAITSTDSQMHSGELKP

SEQ ID NO: 3080 - protein, 92 aa, Glycine max
MGFRFPAIRRASFNANQAASKSVQVPKGYVAVYVGENMRRFVIPISYLNQPSFQDLLSQAEEEFGYDHPMGGLTIPCSEDVFQQTTSRLNEQ

SEQ ID NO: 3081 - protein, 359 aa, Glycine max
MEEALFKTVKKSKGEIMGSSPATYCVTGATGYIGSWLVEALLERGYTVHATVRDPEKSLHLLSLWTRGDRLRIFKADLNEERSFDEAVKGCDGVFHVAASMEFNVVQKENIEACVQANIIDPAIKGTINLLKSCLNSNSVKRVVFTSSISTITAKDSSGKWKPLVDESCQIQSELVLKTQASGWVYALSKLLTEEAAFKFAKENGIDLVSVITATVAGPFFTASVPSSVKVLLSPITGEPEFFKILSSVNARMGSIALVHIEDICSAHIFLMEHSKAEGRYICSSQSCPLDMLANLLAKEYSYSSKKRIAEKNYDNAPSEISSKKLKELGFSYKHGLEDIIHQTIICCLDYGYLPPIRQ

SEQ ID NO: 3082 - protein, 522 aa, Glycine max
GSRPPPPPPAGAKPGSRPPPPPPMSGVAPPRPPPPFGSKVQRPLASGSKATVEAGVEGEADAPKAKLKPFFWDKVQANPDQSMVWNQIKSGSFQFNEEMIETLFGYNAVDKNNGQKQKQSSSQDPSPLFIQIIDKKKAQNLLILLRALNVTMEEVCDALYEGHELPPEFLQTLLKMAPTSDEELKLRLFSGDLSQLGPADRFLKAMVDIPFAFKRMEFLLFMGSLKEELATIMESFAILEVACKELRNSRLFLKLLEAVLKTGNRMNDGTFRGGAQAFKLDTLLKLSDVKGTDGKTTLLHFVVLEIIRSEGIKAIRKAKESQSSSSIKSDGLPDSTQETEDYYHEIGLQVVSRLSSELENVKKAAVIDADSLTGTTAKLGYGLIKTRDLVTKTMKNVEEDRGFFETVKSFVQNAEADVTKLLEEEKKIMTLVKSTGDYFHGNAGKDDGIRLFIVVRDFLIMVDKVCKEVRDTRKKLAKTLKQETPRGASSSETRPPPDFRQRLFPAIAERRMDDISSDDESP

SEQ ID NO: 3083 - protein, 504 aa, Glycine max
MVIIIKYYTYIYIPTIEKSEQNPTKAAMAAMQRPLKRTIAIAKQRACFSSLLPSAAAAAAADTVAPPQLPPFDHQPHPYNGPSADEVFAKRKTFLGPSVFHYYKKPLNIVEGKMQYLYDDSGRRYLDAFAGIVTVSCGHCHPEILNAITEQSKLLQHATTIYLHHTIGDFAEALAAKMPGNLKVVYFVNSGSEANELAMMMARLYTGNLGMISLRNAYHGGSSSTLGLTALNSWKYPIPEGHVHHVMNPDPYHGAFGTDAASYANDVQDHIDYGTSGKVAGFIAESIQGVGGAVELAPGYLKLVYDIIHKAGGVCIADEVQTGFGRTGSHYWGFETQGVIPDIVTMAKGIGNGLPLGAVVTTPEIASVMAQKIQFNTFGGNPVCSAGGLAVLRVLDKEKRQAHCADVGSYLLERLRFLMERHDIIGNVRGRGLMVGLELVTDRTNKTPAKAETAVVFEKLRELGVLVGKGGLHGNVFRIKPPMCFSKDDADFLVDALDYSLSKL

SEQ ID NO: 3084 - protein, 378 aa, Glycine max
  misc_feature (254)..(254): Xaa can be any naturally occurring amino acid
MAVMAVHQFAQCITCHAWSPDQSMVALCPNNNEVHIYRLVEDKWEKLYVLQKHDQVISGIDWSARSNRIVTASHDRNSYVWNHEGSDGGPKWVPPLVNLRVNRAPLCAQGSPKENKFAVGSGAKSDYEQENNWWVSKLISKRLSKCLNTSSWHPDNILLTIIFTDGKCRVFSTFIKGVDARDSKKGTSPDSKFGEQIVQLDLSSSWTFGVKWSPSGNTLAYVGHNSMIYFVDDVGPSPLAQNVVFRDLPLRDVXVLFVSERKVIGVGFDCNPMVFAADERGIWSFVRYLAERKAVSSGSRYGSQFSEAFGKFYGQSKHGVSNDTVETSRTRGTVHENCINCIMPLGDHGTLLRRFSTSGLDGRIVVWDLENEQDLLEL

SEQ ID NO: 3085 - protein, 147 aa, Glycine max
EALEFHITEKRAKVHLELGAAFYDWNFDQVGEDVKLLWTEEEEKKFEDAIRSNPPSPETYFWDHIFRAFPTKSRADLVSYYFNVFILERRGYQNRHTPDDINSDDDDDEAGPLRNVFGHQTPNSGYQAPNPRGSILLTPKKSQTKKK

SEQ ID NO: 3086 - protein, 93 aa, Glycine max
  misc_feature (11)..(11): Xaa can be any naturally occurring amino acid
  misc_feature (51)..(51): Xaa can be any naturally occurring amino acid
  misc_feature (68)..(68): Xaa can be any naturally occurring amino acid
MFFSMISPPAXTTVNRAGSGMFAPFTGLKSMAGFPTRKTNNDITSIASNCXRVQFMQVLPPFGKKKFXLLSYLPDLYDAQLSYDVLIPSYLCM

SEQ ID NO: 3087 - protein, 374 aa, Glycine max
MAISIPSRQLFIDGEWKVPLLNNRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGCTAILKPSELASVTCLELAEICREVGLPPGVLNIVTGLGNEAGAPLSSHPDVDKISFTGSSATGSRIMTAAAQLTKPVSLELGGKSPIIVFEDVDLDKTAEWTIFGCFFTNGQICSATSRLIVHESIATEFVNRLVQWAKNIKISDPFEEGCRLGPIVSEGQYKKVLNCISTAKSEGATILIGGSLQICEVVSVM

SEQ ID NO: 3088 - protein, 139 aa, Glycine max
  misc_feature (137)..(137): Xaa can be any naturally occurring amino acid
MPWVRLSESPRLDVAIDMGNPFLNLTVDGFLKIGAVAATRSAAEDTYHIIQKGNISSHDFEKTLKKMCKEGVYWGTLAGVYLGMEYGVERIRGTRDWKNAMIGGAVTATLLSVATTNNKDKIVPDAITGAAIATAAXFI

SEQ ID NO: 3089 - protein, 93 aa, Glycine max
  misc_feature (33)..(33): Xaa can be any naturally occurring amino acid
NSKKSTVDVELSSLGGGMNISRHHARIFYDYAXRRFALEVLGKNGCLVEGVLHLPGIPPVKLDSQDLLQIGDKDFYLLLLVRSILIRPVGTRH

SEQ ID NO: 3090 - protein, 122 aa, Glycine max
  misc_feature (70)..(70): Xaa can be any naturally occurring amino acid
  misc_feature (84)..(84): Xaa can be any naturally occurring amino acid
MNARRDGRNNRVALFDGIEEGGIRASSLYSSTSSHEIDEHDNEQALDGLQDRVNLLKRLSGDINEEVDSXNRMLDRMGNDMDSXRILSGTMDKFKYTICLIGISSTVQLYVRETGRSREHEC

SEQ ID NO: 3091 - protein, 655 aa, Glycine max
  misc_feature (65)..(65): Xaa can be any naturally occurring amino acid
  misc_feature (123)..(123): Xaa can be any naturally occurring amino acid
  misc_feature (156)..(156): Xaa can be any naturally occurring amino acid
  misc_feature (294)..(294): Xaa can be any naturally occurring amino acid
  misc_feature (388)..(388): Xaa can be any naturally occurring amino acid
MLRACSSGEQFKFEDPPHASESLATGDCSASGLSSRTGEWEPKFDDTQVEEVESTLKDALSLIYXEARALLGKLQYQRGNFDAALQVFIGIDLQHFSPKMIMAIAERTKHRILRSKVDMVAPXSCHWHSFSLVLEAILLKSSSLEEIGQSIDVAKXCRIILDTVEYALPNGMPEGIGEGCKLQEISNKASESFPSLWNMALFLVVAVTAFRFQIAWGSTMPLMMTAVLAMSITTPSTPLIFIMYLSIFLAHPSQCKSTNSTHGEGGLGSYFFSSSVFSSGFSSFFSSSGFSCAXLFLLLLRLGFSLWMYLLQFCFLTQLSYESRLMKCRIVILNLGKKFLDVQKMERIFGRIEGRDYERSIVQRKSLESRNCVALNGNEDLKAIVSLXRENVIQRKLDAVYNNIMMYSDMTVGSSRGWQLLALIISAQQRFKDAETIVDFALDDSGGMGQLELLRLKAVLQISQQQPKEAIETYRILLALIQAKKELLLQDKNIDQEQAFRHEALTERKLEMEAWQDLATIYTDIGSLLDAKICVDKARLIEYFSPRSWHITGMLLEAQSLYKEAFVSFSVSLSIEPDYIPGIISTAELLMKLGMQSLPIARSFLMNALRLEPTNHDAWFNLGLVSKTEGSLQQAAEFFQAAYELKLSAPVQKFK

SEQ ID NO: 3092 - protein, 188 aa, Glycine max
  misc_feature (105)..(105): Xaa can be any naturally occurring amino acid
MQANTELVIDKFGVVYGPFVKCGTLGWITYRDWETTYTSNNISSLESKNSYQQSKFNYLYSLVQVEVETKTAKSSSSCTNGLLWLTRAMDFLVALFQNLIEHAEXGQVSQACTDSYNKTLKKWHGWLASSSFTVAMKLAPDRKKFMEVIQGTGDISADIQKFCTDFSPIFEENHKFLARCGLDDMKAS

SEQ ID NO: 3093 - protein, 530 aa, Glycine max
  misc_feature (182)..(182): Xaa can be any naturally occurring amino acid
  misc_feature (210)..(210): Xaa can be any naturally occurring amino acid
  misc_feature (215)..(215): Xaa can be any naturally occurring amino acid
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVFCMSFVKDAAGYIAVRFLIGFSLATFVSCQYWMSTMFNSXIIGLANGTAAGWGNMFRGATKDIMTFIXSSTKXAGATPFTDWRIALFVPGFMHVIMGILVLTLGQDLPDGNLGALQKKGNVAKDKFSKVLWYAITNYRTWIFALLYGYSMGVELTTDNVIAEYFYDRFNLKLHTAGIIAASFGMANLVARPFGGYASDVAARLFGMRGRLWTLWILQTLGGVFCIWLGRANSLPIAVLAMILFSIGAQAACGATFGIIPFISRRSLGIISGLTGAGGNFGSGLTQLVFFSTSKFSTATGLSLMGVMIVACTLPVSVVHFPQWGSMFLPPSKDVSKSTEEFYYTSEWNEEEKQKGLHQQSLKFAENSRSERGKRVASAPTPPNATPTHV

SEQ ID NO: 3094 - protein, 83 aa, Glycine max
  misc_feature (16)..(16): Xaa can be any naturally occurring amino acid
  misc_feature (21)..(21): Xaa can be any naturally occurring amino acid
  misc_feature (73)..(73): Xaa can be any naturally occurring amino acid
CKESNHFAKREKQTIXKLESXLNLYYAGSAPALAIKASVEKTMMRFDNYTKHGMLSGGYGLPHLIVSGDHMHXGEFITSGILY

SEQ ID NO: 3095 - protein, 204 aa, Glycine max
MALELVIKLDWVDLIMMDWLVQIEMSAVNITNVTVLDNPASFLTPFQFEISYECLTALKDDLEWKLIYVGSAEDETYDQLLESVLVGPADPPDPSKIREEDIIGVTVLLLTCSYLGQEFIRVGYYVNNDYDDEQLREEPPPKVLIDRVQRNILSDKPRVTKFPINFHPENNENEEQLPPSEHPSETGEDPLAVVDRDPPDEKDS

SEQ ID NO: 3096 - protein, 274 aa, Glycine max
MSNSKDVDYAYMATEKDNHASVSLFMDKFGYTKFRTPAILVNPVNHHCFQISPNIEIARLKIDQAEYLYRRFMGSTEFFPNDIGNILRNKLSLGIWVAYFKGDIAWGDFGSDGQVPNSWAMLSVWNSGEIFKLRLGKAPFSCLVCTKSWWLIHKIFPCLKLPTIPDFFNPFGFYFMYGVHHEGPFSGKLVRALCQFVHNMGAESKDESNCRIIVTEVGGRDELNHHIPHWKLLSCPEDLWCIKALKNEGTNNKFHELTTKTPPTRALFVDPREV

SEQ ID NO: 3097 - protein, 161 aa, Glycine max
TREHPHACPSKIDPVRQLDWKNFQQSSEIIDVLSTIHSEIPRGVAAAEAPPPHGDDDSADEFEDFPGDEGNWWTSCILYHAFNNFRSSRNRRRTRVGDQSRVNRHLSSDTSNSDEGSVASVEYGEYRLDEIDDDFVSTIGHLRGGSGFRRSRRRHSRSNDN

SEQ ID NO: 3098 - protein, 208 aa, Glycine max
APLSIVMTSLSTACAVFVTPLLLLLLIGKKLPIDVRGMVYSITQIVVVPIAAGLLLNRFYPRICNVIRPFLPPLSVLVASICAGAPLLVASMTAKSPLGVNVETMISPFGVAFLLPGVAFHLSSFRDGYILSGFVFRDSLDVKALQRTISFETGMQSSLLALALANKFFEDPKVAIPPAISTSIMSLMGFVLVLIWTRRGKSEIKNSS

SEQ ID NO: 3099 - protein, 132 aa, Glycine max
MGKTSSREWTRIYLIYGMDQWQTFVFLLCQAVLFSVLSILYLLYFNDISHTFQSLLSIASVPCSAARFAAGFMGSVTALSALCLFYAAANFFYSAVPLHSEMAQHIVDTVKDWPTVRQVLDLGCCGRGILLN

SEQ ID NO: 3100 - protein, 307 aa, Glycine max
ARGKFQSRCNLELADLDKVEEEEDILALRMLIQQHQRHTNSLLAKEVLDDFENLLPKFIKVFPREYKRVLASMKSEETSKDALVHAAKDDQDDEAQAVEKDAFEELKKLVMASLNEEPSQAESPKRPSRVTGAIKHRGFVAYEREGVQYRDPNVRMTDWKEVMEETKPGPLLKTQSARCMDCGTPFCHQENSGCPLGNKIPEFNELVYQNRWREALERLLETNNFPEFTGRVCPAPCEGSCVLGIIENPVSIIRLELEPKIRRNKDKCSVGKSRGCFGVWCGPRQHVKLQGWLWPLLNKCQRGVCSR

SEQ ID NO: 3101 - protein, 316 aa, Glycine max
MELRELGRTGLKLSTVGFGASPLGNVFGDVSEEQANASVRLAFQSGINFFDTSPYYGGTLSEKVLGKALKALGAPRNSYVVATKCGRYKEGFDFSAERVTRSIEESLERLQLDYVDILQCHDIEFGSLDQVVNETIPALVKLKEAGKARFIGITGLPLGIFSYVLDRVPPGTLDVVLSYCHYCVNDTSLGGLVPYLKTKGVGIINASPLSMGLLTESGPPEWHPASLELKSACQAAATHCKEKGKNISKLALQYSLLNKEITSVLVGMKSVEQVEENVAAARELATSGIDEETLSEVEAILKPVKNQSWPSGIQQS

SEQ ID NO: 3102 - protein, 469 aa, Glycine max
  misc_feature (273)..(273): Xaa can be any naturally occurring amino acid
  misc_feature (304)..(305): Xaa can be any naturally occurring amino acid
MAMAIAMVPQPLLTLFLFLSLLSIVNSSPSQHLQIANAERRIDLTSHIIKVYLTLKVENLGTSPTSEVHIAFSPTEVEHLAIVRAAATSGKRKKKTYVPLDVKSAELPDGPNGTKFFSITLLTPLSKGETTTLEVLYILTHSLEPFPVEISQSESQLVYFRDSAILLSPYHVKQQTTFIKTPSTRVESFTVMDPTKRAGTELKYGPYENHPPYSYSPVLIHFENNNAFAVVEELEREIEISHWGSVQVTERYSLVHAGARHKGVFSRVEYQTXQGVLVVSSLKHPLAKPPPWGHSVYYRDGIGXXSSSHLRTDSLESELEIEPRYPLFGGWKSTFVIGYGLPLQDFLFESPDGRRYLNFTFGCPLVETVVDKLIVKVVLPEGSKDPTVEIPFEVKQHLEIKYSYLDVVGRTVVVLEKRNAVPEHNAPFQVYYSFNPIFMLAEPLMLVSAFFLFFVASVAYLHIDLSIRK

SEQ ID NO: 3103 - protein, 243 aa, Glycine max
MMFDFGPASAPNTLIGLGLGQFLSLLITSTGFTSSQLAKKGINAPTSQSFLNYVFLSLVYGTVLLYRRKALKAKWYYYIILGLVDVEANFLVVKAYQYTSLTSVMLLDCWSIPSVMLLTWLFLKTKYRFKKITGVVVCVAGLVLVVFSDVHSGDRAGGSNPRKGDLLVIAGATLYAISNVSEEFLVKSADRVELMAMLGLSGGIISAIQISILERNELKSIHWSAEAVSSPYHSLTMIEKMIL

SEQ ID NO: 3104 - protein, 212 aa, Glycine max
MASFISLSLLLLFLNYPFLSLSTNPEGNALHALRSRISDPNNVLQSWDPTLVNPCTWFHVTCDSNNHVIRLDLGNSNVSGTLGPELGQLQHLQYLELYRNELTGKIPKELGNLKSLISMDLYDNKLEGKIPKSFGKLKSLKFLRLNNNKLTGSIPRELTRLTNLKIFDVSNNDLCGTIPVEGNFESFPMESFENNRFSGPELKGLVPYDFGC

SEQ ID NO: 3105 - protein, 224 aa, Glycine max
MSFESGMVMEEHDSEKVEIVLKTIGPARPSRLLVPSSIKVCDLRRLIARNENLQIYNLSLILRGSALYDTKNGDDVYIQLNDGDCLIVAVKPMPPVKDGYDNDDEDEDLKFRLPHSSSWWKKRLYSFLHDNLKLPDILLMVIFTLSLKAWLLIILWFILAPVAHRWDLGPLYILATGFCLILFNLGKRQAGDISAYSIFNEDFRELPGTLNADRLDRDIRAGQF

SEQ ID NO: 3106 - protein, 147 aa, Glycine max
MSFESGMVMEEHDSEKVEIVLKTIGPARPSRLLVPSSIKVCDLRRLIARNENLQIYNLSLILRGSALYDTKNGDDVYIQLNDGDCLIVAVKPMPPVKDGYDNDDEDEDLKFRLPHSSSWWKKRLYSFLHDNLKLPDILLMVDIMESK

SEQ ID NO: 3107 - protein, 534 aa, Glycine max
  misc_feature (189)..(189): Xaa can be any naturally occurring amino acid
EASREERREEVREAKAEEEGRGEVVENENIEKEGGREERRTRARGERRRSSKPNPRLSNPPNHVHGEQVAAGWPSWLSKVAGEAINGLTPRRADTFEKIDKIGQGTYSNVYKARDTLTGKIVALKKVRFDNLEPESVKFMAREILILRRLDHPNVIKLEGLVTSRMSCSLYLVFEYMVHDLAGLATNPXSKFTESQVKCYMHQLFSGLEHCHNRHVLHRDIKGSNLLIDNDGILKIGDFGLASFFDPNHKHPMTSRVVTLWYRPPELLLGATEYSVGVDLWSAGCILAELLAGKPIMPGRTEVEQLHKIFKLCGSPSDEYWKKSKLPHATIFKPLKSYKRCIAETYKDFPPSSLPLMDTLLAINPVKRLTATVALHSEFFTTKPYACEPSSLPKYPPSKEMDAKLRDEEARRLRAAGKANADGVKKSRPRERVGRGIAVPEANAELQANIDRRRLITHSNAKSKSEKFPPPHQDGALGYPLGSSHHMDPVFDPPDVPFSSTNFSQPKANIQTWSGPLVDPSGVGVPRRKKKHGK

SEQ ID NO: 3108 - protein, 506 aa, Glycine max
  misc_feature (42)..(42): Xaa can be any naturally occurring amino acid
ERERRRSSKPNPRLSNPPNHVHGEQVAAGWPSWLSKVAEDDXGEAINGLTPRRADTFEKIDKIGQGTYSNVYKARDTLTGKIVALKKVRFDNLEPESVKFMAREILILRRLDHPNVIKLEGLVTSRMSCSLYLVFEYMVHDLAGLATNPAIKFTESQVKCYMHQLFSGLEHCHNRHVLHRDIKGSNLLIDNDGILKIGDFGLASFFDPNHKHPMTSRVVTLWYRPPELLLGATEYSVGVDLWSAGCILAELLAGKPIMPGRTEVEQLHKIFKLCGSPSDEYWKKSKLPHATIFKPRISYKRCIAETYKNFPASSLPLIEILLAIDPAERQTATDALHSEFFTSKPYACEPSSLPKYPPSKEMDTKLRDEEARRLRAAGKANAAGVKKSRPRDRGGRGISVPDSNAELQANIDRWRLVTHANAKSKSEKFPPPHEDGTLGYPLGSSHHMDPIFDPPDVPFSSTNLSYPKANFQTWSGPLVEPSVDAPRRKKNMAGNGHRQSKKDSYR

SEQ ID NO: 3109 - protein, 163 aa, Glycine max
VATQNCCCFQVVSIGLGSRPFSLHLLLNLLNFLFPFLPSKFSLDSSSMLSSAAVVTSPAQATMVAPFTGLKSSSAFPVTRKANNDITSIVSNGGKVSCMKVWPPVGKKKFETLSYLPDLTEVELGKEVDYLLRNKWIPCVEFLLPRGSACPGPAATPGCSGGR

SEQ ID NO: 3110 - protein, 145 aa, Glycine max
MSELLFNDIFKVEKVDPDGKKYDKVSRIVARSEKCDMYMLLDINTEIYPMGEKERFLMALSPSLVLNTKDGSVSIQDKFEYIMHGRLYNITKPQLEEKECSKPQLEVEVYASFGGLQLMLKGHASHCVKFAVDQKLFLLIRKVES

SEQ ID NO: 3111 - protein, 397 aa, Glycine max
MACPAMANGNDSLNLKPSETKGKTITCKAAVAYGPGEPFVVENILVHPPQKMEVRIKILYTSICHTDLSAWRGVSEAQRAYPRILGHEASGIVESVGEGVSEVKEGDIVVPIFNGECGECTLCKCEKTNKCEIYGVNPMKKVMEGDGTSRFSTVHGKPIFHFLNTSTFSEYTVVDSACVVKFVSTDHSLSIKNLTLLSCGVSTGVGAAWNTANVHSGSTVAVFGLGAVGLAVAEGARARGASKIIGVDINPDKFIKAMGVTNFINPKDEEKPVYERIREMTDGGVHYSFECTGNVDVLRDAFLSAHEGWGLTVVLGIHASPTLLPIHPMELFDGRNIVGSVFGGFKGRSHLPHFAKQCGQGVVKLDNFITHELPLEEIDKAFDLLITGKSLRCLLHF

SEQ ID NO: 3112 - protein, 196 aa, Glycine max
MSASRFIKCVTVGDGAVGKTCLLISYTSNTFPTDYVPTVFDNFSANVVVDGSTVNLGLWDTAGQEDYNRLRPLSYRGADVFILAFSLISKASYENIAKKWIPELRHYAPGVPIILVGTKLDLRDDKQFFMDHPGAVPITTAQGEELRKLIGAPAYIECSSKTQQNVKAVFDAAIKVVIQPPKLKKKRKTQKACSIL

SEQ ID NO: 3113 - protein, 306 aa, Glycine max
FNSFSRYGNKIVAIKVLHRGSTSEERASLENRFAREVNMMSRVHHDNLVKFIGACKDPLMVIVTELLPGMSLRKYLTSIRPKLLDLDVAINFALDIARAMDWLHANGIIHRDLKPDNLLLTADQKSVKLADFGLAREETVTEMMTAETGTYRWMAPELYSTVTLRQGEKKHYNNKVDVYSFGIVLWELLTNRMPFEGMSNLQAAYAAAFKQERPGIPDDISPELAFVIQSCWGEDANLRPSFREIMRMLNAKPLTPPPPSPPLPVPPDNEPEVATTSNGTITEFSARNRGKFGFLRQLFSSKRTKN

SEQ ID NO: 3114 - protein, 231 aa, Glycine max
MANPSGNHQEHTHVVSSSAPETSGAALAMKHNPGISLDWTAEEQAILEDGLSKYASESNIVRYAKIALQLQHKTVRDVALRVRWMNKKENSKRRKDDHNLTRKSKDKKERVSDPAVKSSNFTARSNVSPYAPPMITMDNDDGISYTAIGGPTGDLLEQNAQALNQISTNLSAFQVQENINLFCQTRDNILKIMNELNDSPEVMKQMPPLPVKVNEELASSILPRTNLPPQS

SEQ ID NO: 3115 - protein, 519 aa, Glycine max
MPAVGGISNGGGKEYPGSLTPFVTVTCIVAAMGGLIFGYDIGISGGVTSMDPFLLKFFPSVFRKKNSDKTVNQYCQYDSQTLTMFTSSLYLAALLSSLVASTVTRRFGRKLSMLFGGLLFLVGALINGFAQHVWMLIVGRILLGFGIGFANQSVPLYLSEMASYKYRGALNIGFQLPITLVFLVANVLNYFFGKIHGGWGWKIEVWEGAMVPALIITVGSLVLPDTPNSMIERGDREKAKAQLQRIRGIDNVDEEFNDLVAASESSSQVEHPWRNLLQRKYRPHLTMAVLIPFFQQLTGINVIMFYAPVLFSSIGFKDDAALMSAVITGVVNVVATCVSIYGVDKWGRRALFLEGGVQMLICQAVVAAAIGAKFGTDGNPGDLPKWYAIVVVLFICIYVSAFAWSWGPLGWLVPSEIFPLEIRSAAQSINVSVNMLFTFLIAQVFLTMLCHMKFGLFLFFAFFVLIMTFFVYFFLPETKGIPIEEMGQVWQAHPFWSRFVEHDDYGNGVEMGKGAIKEV

SEQ ID NO: 3116 - protein, 519 aa, Glycine max
MPAVGGISNGGGKEYPGSLTPFVTVTCIVAAMGGLIFGYDIGISGGVTSMDPFLLKFFPSVFRKKNSDKTVNQYCQYDSQTLTMFTSSLYLAALLSSLVASTVTRRFGRKLSMLFGGLLFLVGALINGFAQHVWMLIVGRILLGFGIGFANQSVPLYLSEMAPYKYRGALNIGFQLSITVGILVANVLNYFFAKIHGGWGWRLSLGGAMVPALIITIGSLVLPDTPNSMIERGDREKAKAQLRRVRGIDDVEEEFNDLVAASESSRKVEHPWRNLLQRKYRPHLTMAVLIPFFQQLTGINVIMFYAPVLFSSIGFKDDSALMSAVITGVVNVVATCVSIYGVDKWGRRALFLEGGVQMVICQAVVAAAIGAKFGIDGNPGDLPKWYAVVVVLFICIYVSAFAWSWGPLGWLVPSEIFPLEIRSAAQSINVSVNMFFTFLIAQVFLTMLCHMKFGLFIFFAFFVLIMTFFIYFFLPETKGIPIEEMNQVWKAHPFWSRFVENDDYGNGVEMGRGTAIKEV

SEQ ID NO: 3117 - protein, 170 aa, Glycine max
  misc_feature (69)..(69): Xaa can be any naturally occurring amino acid
  misc_feature (85)..(86): Xaa can be any naturally occurring amino acid
  misc_feature (130)..(130): Xaa can be any naturally occurring amino acid
IWIKPGARVLYLGAASGTTVSHVSDVVGPTGVVYAVEFSHRSGRDLVNMAKKGTNVIPIIEDARHPAKXRMLVGMVDVIFSDVAXXDQARILGLNASYYLKAGGHFVISIKANCIDSTVPAEAVFESEVXKLKADQFKPFEQVTLEPFERDHACVVGGYRMPKKKKDAAE

SEQ ID NO: 3118 - protein, 220 aa, Glycine max
  misc_feature (174)..(175): Xaa can be any naturally occurring amino acid
MAHFTSSGKSDDLTKEDCKGQSALVVCFGEILIDFVPTVGGVSLAEAPAFKKAPGGAPANVAVGISRLGGSSAFVGKVGADEFGYMLADILKQNDVETSGMKFDPNARTALAFVTLRADGEREFLFFRNPSADMLLQESELDENLIKKAKIFHYGSISLIDEPCKSAHPAAMRXXKESGCIPFRNDPKFENWHLMGPSGWKAGSGMGNKWSYGGSKAGLF

SEQ ID NO: 3119 - protein, 83 aa, Glycine max
  misc_feature (30)..(30): Xaa can be any naturally occurring amino acid
MPSSTFSGTVGSPKLSVAVDMGNPFLNLTXDGFLKIGAVGVTKSLVEDTYKAIDKGSVSKSTLEHALKMMCKEGFYWGSVAGV

SEQ ID NO: 3120 - protein, 114 aa, Glycine max
SSRFGSGVSAYFNKPHTERNHKTSYSTTVQGVVDHRGVFTDVCIGWPGSMGDDQVLEKSSLFHRANNGGINLSGVWVVGGCGYPLLDWVLVPYTQQNLTWTQHSFNEKIGEVRR

SEQ ID NO: 3121 - protein, 292 aa, Glycine max
  misc_feature (21)..(21): Xaa can be any naturally occurring amino acid
APPPDPDELEEEQRERQRKNXINVEFQTFVNRVNDLWGQPQFNGFDLEFDQPLRELGFPGVPHKSSVFIVPTSACLVELIETPFLVVTLSEIEIVNLERVGLGQKNFDMTVVFKDFKRDVLRIDSIPSTSLDGIKEWLDTTDIKYYESRLNLNWRQILKTITDDPQSFIEGGGWEFLNLEATDSESENSEESDKGYEPSDVEPESDSEDEASDSESLVESEDDDDDEDSEEDSEEEKGKTWEELEREASNADREKGNESDSEEDRKRRKAKGFGKSRGASLSSSMPKRSKLR

SEQ ID NO: 3122 - protein, 320 aa, Glycine max
HASAVIITKDKTEIVTATSSKALKDVAYSFNEDEEEERPSTKPDAKKAEPFMSKTTLRSDNHEVSKEELRRQHQAELARQKNEETARRLAGGGSETGDSRSSARTSAELVAYKNINDLPPPREMMIQIDQKNEAVLLPINGSMVPFHVAFIRTVSSQQDTNRNCYVRIIFNVPGTPFSPHDANSMKFPGSIYLKEASFRSKDSRHISEVVQSIKTLRRQVVARESERAERATLVTQEKLQLANNRFKPIRLSDLWIRPAFGGRGRKIPGTLEAHVNGFRYSTTRQDERVDIMFPNIKHAFFQPAENEMITLLHLHLDNHI

SEQ ID NO: 3123 - protein, 280 aa, Glycine max
MVLTSISIVSSSSSFLSDSPSTSSPTTRIRPFFFHSSNRAPLFVFPRAHLPSATLRASSSSVSAPHENGSPEQFLKSNSIADFMRFKRRVDGGVSAELQTALVSYRKRFPWSLLRPFLQVDLVSTIHIADEEYFLALQKELESYDCVLYEMVASRESLENRRNATNTKRLKSSRTRGFNILGCIQRQMARILTLDFQLDCLNYESSNWYHADLDYETFKLLQLEKGESFFSFAKDMTLKSTKAVLQPASIPEDLDPLRSKLLWASRVLPMSLVRLLIWIR

SEQ ID NO: 3124 - protein, 190 aa, Glycine max
MANTNLDDVPSLDLMTELLRRFKCSSKPDKRLILIGPPGSGKGTQSPIIKDEYCLCHLATGDMLRAAVAAKTPLGVKAKEAMNKGELVSDDLVVGIIDEAMKKPSCQKGFILDGFPRTVVQAQKLDEMLQNQGVKVDKVLNFAIDDAILEERITGRWIHPSSGRTYHTKFAPPKVLGVDDVTGEPQINPA

SEQ ID NO: 3125 - protein, 87 aa, Glycine max
MATTACFIIVSRNDIPIYEAEVGVAAKREDAAQLHQFILHAALDIVQDLAWTTSAMYLKSVDRFNELVVSVYVTAGHILYTWDSFIV

SEQ ID NO: 3126 - protein, 274 aa, Glycine max
DSSLSLLSLSLELRPPSASFFLSCSAIAASSSNKSSLLVNPNTAATRGVRLKLRSAMAAATRTSLRFLLSVSVTLTLAHLAASNSEGDALYTLKRSLSDPDNVLQSWDPTLVSPCTWFHVTCNQDNRVTRVDLGNSNLSGHLVPELGKLEHLQYLELYKNNIQGTIPPELGNLKSLVSLDLYNNNISGTIPPSLGKLKNLVFLRLNDNRLTGPIPKELAAVSSLKVVDVSNNDLCGTIPTSGPFEHIPLNNFENNPRLEGPELLGLVSYDTNCS

SEQ ID NO: 3127 - protein, 159 aa, Glycine max
MASSSWEYFGEIANVAQLTGIDAVKLIGMIVKAANTARMHKKNCRQFAQHLKLIGNLLDQLKISELKKYPETREPLEQLEDALRRSYILVNSCQDRSYLYLLAMGWNILRLEVPMHHTHEMADVNHIHNLSDDCGGFRLRVVPSPLHSSMTRCMFFPSS

SEQ ID NO: 3128 - protein, 209 aa, Glycine max
TIVVTAESDSCTDCIGTSIRHGCSSIVNLELLPQPPQTMAPGNPWPQRPRIYRVESGHQEGAAKFGKDPRSYEVLTKRFVGDENGVVKGLEVIRVLWEKDETGRFQFKEIEGSEEILEADLVLLAMGFLGPEPTIAEKLGIERDNRSNFKAEYGRFSTSLKGVFAAGDCRRGQSLVVWAISEGRQAAAQVDSFLTNEDIEHKFAVPNKQ

SEQ ID NO: 3129 - protein, 92 aa, Glycine max
MGFRLPGIRKGIFAANQASSKTVDAPKGYLAVYVGEKMKRFVIPVSYLNQPSFQDLLSRAEEEFGYDHPMGGLTIPCSEDVFQHITSCLNGQ

SEQ ID NO: 3130 - protein, 174 aa, Glycine max
MFSYGCLQTIAAAVMIGVILHAGNHLACDFPRLVSSSAKDYKTYLDGVFGDHRPSYGDLVKGVEGVTGILMVILMAIAFTLATKWFRRNLIKLPKPFNRLTGFNAFWYSHHLFVIVYVLLIIHGVSLYLERRWHRQTTWMYLAVPILLYAGERTLRFFRSGFYTVRLIKVSRAA

SEQ ID NO: 3131 - protein, 103 aa, Glycine max
FSSLNNEQTATGVLPRRPPPKRGPSPPSSDQIKKKRRETPTTILSLDPDIVTTIFAFLDMFDLVRCSLVCKLWNAIVESRSLREFCERKMHKSFAEFTKKPLR

SEQ ID NO: 3132 - protein, 165 aa, Glycine max
MPRSRINENFIDKTFSIVANILLRIIPTTSGEKRAFTYYRDAQSEGNYAEALQNYYEAMRLEIDPYDRSYILYNIGLIHTSNGEHTKALEYYFRALERNPFLPQAFNNMAVICHYRGEQAIRQGDSEVAESWFNQAAEYWKQAIALTPGNYIEAQNWLKITGRFE

SEQ ID NO: 3133 - protein, 167 aa, Glycine max
  misc_feature (140)..(140): Xaa can be any naturally occurring amino acid
MLVYQDLLTGDELLSDSFRYNEIENGMLWEVEGKWVVKGAVDVDIGANPSAEGGEDEGVDDAAVKVVDIVDTFRLQEQPAFDKKQFVTFMKRFIKNLTPKLDAEKQELFKKHIEGATKYLLSKIKDFQFFVGESMNDDAXLVFAYYKDGAADPTFLYFAYALKEVKC

SEQ ID NO: 3134 - protein, 167 aa, Glycine max
MLVYQDLLTGDELLSDSFRYNEIENGMLWEVEGKWVVKGAVDVDIGANPSAEGGEDEGVDDAAVKVVDIVDTFRLQEQPAFDKKQFVTFMKRFIKNLTPKLDAEKQELFKKHIEGATKYLLSKIKDFQFFVGESMNDDACLVFAYYKDGAADPTFLYFAYALKEVKC

SEQ ID NO: 3135 - protein, 178 aa, Glycine max
  misc_feature (79)..(79): Xaa can be any naturally occurring amino acid
  misc_feature (109)..(109): Xaa can be any naturally occurring amino acid
  misc_feature (136)..(136): Xaa can be any naturally occurring amino acid
GVAPHQFHRTTILLFGAIREKLCRHVAYYHDLLTRDELHSESFRYKESENGMLWEVEGKWVVKRAVDVDIGANPSAEGXGQDDGLDDAAAKVDDIDGTVRAKERHVCRXKHVVSFMKRLVKNWTSQLDAGRQELFXKHIEGTTKYLLSRINDVPVFVGESMGDDAWLVLAYYKDGAAD

SEQ ID NO: 3136 - protein, 83 aa, Glycine max
LFLVYCVLCCETGSKQALISLSDKKGLAFVGNGLQELGYSIVSTGGTASALESAGVAVTKVEQLTKFPEMVCVCSLSSPSKIS

SEQ ID NO: 3137 - protein, 440 aa, Glycine max
MSVTAGVSDTVIAIRDKLRGKIGQTKVKRYWPGKVPEWADDENEEDAAPADIRPSREAALEKAFPRHEEDAAIVRKDDRRLRRLAESRIDNREEVRADHRRIRQAEIVSTIEEEARRQEWLEFEEEDENALAERRRLIKEKLLQREQEEALPEEEEEEEEEEEEEEESEYETDSDEEYTGVAMVKPVFVPKSERDTIAERERLEAEELAFEEKRKRRLEERRIETKQIVVEEIRKDEEIQKNLEMEANIADVDTDDEVNEADEYEAWKVREIGRIKRDREDREAMLKEKEEIEKVRNMTEEERREWERRNPKLAPPPKQKWRFMQKYYHKGAFFQNESDDRAATVGSDGIFARDFSAPTGEDKMDKTILPKVMQVKHFGRSGRTKWTHLVNEDTTDWNNPWTYNDPLRAKYNDKMAAMNAPIVKPKGSKKLKDWESRESG

SEQ ID NO: 3138 - protein, 485 aa, Glycine max
  misc_feature (43)..(43): Xaa can be any naturally occurring amino acid
  misc_feature (259)..(259): Xaa can be any naturally occurring amino acid
  misc_feature (376)..(376): Xaa can be any naturally occurring amino acid
GLQFPIGKTDIKLTLNLKERGVLRCHEHTSMLDQWKLTPKQIXWVGKAGFGHLRLLPAMSLDNALIAALVERWRRETNSFHLAVGELTITLEDVSLLLGLAIDGEPVIGPISAPSSVCEKLLGRVPEDLNGGMVKLTWLKEFFSECPEDASQEEIERCTCAFLLYLVGSTIFSTTTGNKVPVIYLSLFEDFDKAGKFAWGPGALAFLYRALGNASLKSQSTISGCLTLVQCWCYSRLNVGLPKFNQEPDNNCFPFLLKXKGKSGAWMKCNVVSYRKALDSLNPCDVQWLPYNDMDCSSIPEDIKASLILWESRTMLLCFDKVERHLPDRCLRQFGMHQTIPKYVERWERKSCIVDHGVDLMEKMEFGSQSGQNLGXYVVEGGDIADEGEYMQWYQKITRKYIRRVTSSLESEYQRTVTAMREIANIADIVSAEGLDSYNRELLDEVINIVHKCLTGQFEEIPNEKVKKKGKRKGRQKDHLSMEYE

SEQ ID NO: 3139 - protein, 291 aa, Glycine max
KNGASFNFNSLFFIFIPLRCLLPLLPLPARIRPFFFPSSNRAPLFVFPRAPLPSATLRASSSSVSAPQENGSPEQFLKSNSIADFLRFKRRVDGGASAELQTALVSYRKRFPWSLLRPFLQVDLVSTIHIADEEYFLALQKELESYDCVLYEMVASRESLENRRNATNTKRLKSSRTRGFNILGCIQRQMARILTLDFQLDCLNYESSNWYHADLDYETFKLLQLEKGESFFSFAKDMTLKSTKAVLQPASIPEDLDPLRSKLLWASRVLPMPLVRLLIFRVLDSVVVRSN

SEQ ID NO: 3140 - protein, 213 aa, Glycine max
MMNASKFIKCVTVGDGAVGKTCMLICYTSNKFPTTHTDYIPTVFDNFSANVAVDGSIVNLGLWDTAGQEDYSRLRPLSYRGADIFVLAFSLISRASYENVLKKWMPELRRFAPNVPIVLVGTKLDLREDRGYVADHMGSSVITSAEGEELRKQIGAAAYIECSSKTQQNVKAVFDTAIKVVLQPPRRKEMARKKRHRRSGCSFVSIMCGGCAA

SEQ ID NO: 3141 - protein, 290 aa, Glycine max
  misc_feature (99)..(99): Xaa can be any naturally occurring amino acid
MIADDGPGSLRDACRRKEPLWIVFEVSGTIQLSSYLNVSSHKTIDGRGQRIKLSGKGLRLKECEHVIICNLEFEGGRGHDVDAIQIKPNSKHIWIDRCXLSDFDDGLIDITRESTDITISRCHFSQHDKAMLIGADPTHVGDRCMRVTIHHCFFNGTRQRQPRVRFAKVHLYNNYIRNWGIYAVCASVESQIFSQHNIYEAGQKKVAFKYLTEKAADKEVGATGTIRSEGDIFLNGAQKGLMTEDVGCNMFHPSEHYPSWTVEAPTDDLKQILHHCTGWQSLAKPADQTL

SEQ ID NO: 3142 - protein, 204 aa, Glycine max
  misc_feature (80)..(80): Xaa can be any naturally occurring amino acid
  misc_feature (116)..(116): Xaa can be any naturally occurring amino acid
  misc_feature (148)..(148): Xaa can be any naturally occurring amino acid
MQKLGILGARRWLCRSISSSPLRVCVVGSGPAGFYTAEKMLKAHQQAQVDIIDRLPTPFGLVRSGVAPDHPETKKTCNRXVINQFSRVAQHERCSFLGNVTLGSSISLSELRELYXRVVLAYGAERIRSLGIPGENLKGIHSAREFVXWYNGHPDGRNLEPDLKSTDTAVILGQGNVALDVARILLRPTTELATTDIASHALAT

SEQ ID NO: 3143 - protein, 220 aa, Glycine max
MAEIEGSPGSSMHGVTGREQTFVASIASPIVPTDTTAKFALPVDSEHKAKIFKLFSMANPHMRTFHLSWISFFTCFVSTFAAAPLVPIIRDNLNLTKSDIGNAGVASVSGSIFSRLAMGAVCDLLGPRYGCAFLIMLSAPTVFCMSFVKDAAGLVRFLIGFSLATFVSCQYWMSTMFNSKIIGLAMLRAAHPRYGCAFLIMLSAPTVFCMSFVKDAAYIM

SEQ ID NO: 3144 - protein, 164 aa, Glycine max
LARSMPTSGALDHSSEITKDGPGIQVPTGWKFFGNLMDAGNLSVCGEESFGTGSDHIREKDGIWAVLAWLSIIAHRNKDKNPGEKLISVSDVVMEHWATYGRNFFSRYYYEECESECANKMIEYLRDILSKSKPGDQYGSYVLQLADDGTYADPGDGSVGSLQG

SEQ ID NO: 3145 - protein, 329 aa, Glycine max
MATNIGIMDAAYFVGRSEILSWINSTLQLNLSKVEEACSGALPSDGCEKTTEGIVPMHKVNFDAKSEYEMIQNYKVLQDVFNKLKITKHIEVSKLVKGRPLDNLEFMQWMKRYCDSVDSGLQYNYNPLERREVCKGGRETSKKSANSQASTKGSTAQRPHSSHNARRNEVSNANPTNQAAKVARAAPSAGNPAPVYEEKITELKLSIDSLENERDFYFAKLRDIEILCQTPEIEHSPIVAAIQKILYATDDNGMAVVEAQAMISVGRKEIEGLSPIAEVSEQKSSSETHKRKNIANIDFDVAGLATLSPRQRLSDVSDVHCSESPLMTC

SEQ ID NO: 3146 - protein, 118 aa, Glycine max
MATNIGIMDAAYFVGRSEILSWINSTLQLNLSKVEEACSGAVHCQLLDAAHPGIVPMHKVNFDAKSEYEMIQNYKVLQDVFNKLKITKHIEVSKLVKGRPLDNLQFMQWMKRYCDSVN

SEQ ID NO: 3147 - protein, 307 aa, Glycine max
  misc_feature (191)..(191): Xaa can be any naturally occurring amino acid
MAPPRGGGFRGGRGDRGRGRGGGGGRGGDRGTPFKARGGGRGGGRGGGGRGGGRGGGRGGMKGGSKVVVQPHRHDGIFIAKGKEDALVTKNLVPGEAVYNEKRITVQNEDGSKDEYRVWNPFRSKLAAAILGGVDNIWIKPGARVLYLGAASGTTVSHVSDVVGPTGVVYAVEFSHRSGRDLVNMAKKRTXMVIPIIEDARHPAKYRMLVGMVDVIFSDVAQPDQARILGLNASYYLKAGGHFVISIKANCIDSTVPAEAVFESEVNKLKADQFKPFEQVTLEPFERDHACVVGGYRMPKKKKDAAE

SEQ ID NO: 3148 - protein, 381 aa, Glycine max
IVISALAYSQMLGIYLQASCIISLIFSIIISIIWFYTEPILVLLHQSPDIARTAALYMKFLIPGVFAYSFLQNILRFLQTQSVVIPLVVLSALPMLVHIGVAYGLVQWSGLSFTGAPVAASISLWISLLLLALYVMYAKKFKQTWKGFSTHSFRYVFTNMRLALPSAAMVCLEYWAFEVLVFLAGLMPDSQITTSLIAICINTEFIAYMITYGLSAAASTRVSNELGAGNPERAKHAMSVTLKLSLLLGLCFVLALGFGHNIWIQFFSDSSTIKKEFASVTPLLAISILLDAIQGVLSGVSRGCGWQHLAAYINLATFYLIGLPISCFLGFKTNLQYKGLWIGLICGLLCQSGTLFLFIRRAKWTKLDLSRDNDKERPLVV

SEQ ID NO: 3149 - protein, 377 aa, Glycine max
  misc_feature (172)..(172): Xaa can be any naturally occurring amino acid
  misc_feature (174)..(174): Xaa can be any naturally occurring amino acid
  misc_feature (195)..(195): Xaa can be any naturally occurring amino acid
MEEDYGYRRTAKIALVAIMVLASVAVFALLVVFAYYCYILNKVSNRRKSLKKVEDANLNEKSDFANLQVVAEKGLQVFTFKQLHSATGGFSKSNVIGHGGFGLVYRGVLNDGRKVAIKFMDQAGKQGEEEFKVEVELLTRLHSPYLLALLGYCSDSNHKLLVYEFMANGGLXEXLENHWRADMLMKIFLTISTFXVIHRDFKSSNILLGKKFHAKVSDFGLAKLGPDRAGGHVSTRVLGTQGYVAPEYALTGHLTTKSDVYSYGVVLLELLTGRVPVDMKRPPGEGVLVSWALPLLTDREKVVKIMDPSLEGQYSMKEVVQVAAIAAMCVQPEADYRPLMADVVQSLVPLVKTQRSPSKVGSCSSFNSPKLSPGPTF

SEQ ID NO: 3150 - protein, 141 aa, Glycine max
  misc_feature (134)..(135): Xaa can be any naturally occurring amino acid
PKLGEPLEQLENALKRSYILVNSCQDRSYLYLLAMGWNIVYQFRKAQNEIDRDLRLVPLITLVDNARVRERLEVIEMDQREYPLDDEDQKAQTVIFKPEPDKDDTAVLKKTLSWSYPNCSFTEARKKKKKKKKXXRPLHRI

SEQ ID NO: 3151 - protein, 158 aa, Glycine max
GVFFFFFWGGKEFFTKGYKNNVAANTASFLFDWFHTGDIGYFDSDGYLHLVGRIKELINRGGEKISPIEVDAVLLSHPEIAQAVAFGVPDAKYGEEIYCAVIPREGSNVDEAEVLRFSKTNLASFKVPKKVFITDSLPKTATGKILRRLVAEHFVSQI

SEQ ID NO: 3152 - protein, 330 aa, Glycine max
  misc_feature (126)..(126): Xaa can be any naturally occurring amino acid
MSESVANICLHVMRVSYIPIFYDTGHLVSIYTDRHHWKCPRSGPFGDEVSRVFGGGLVPGSLTLIGGDPGVGKSTLLLQIAAIIAKGDSDGEACPVVYVSGEESVEQIGNRADRLRIESDIYLYSXDILKKVQYLSPGALIVDSIQTVYLKGIMGSPGGIMQVKECTSALLRFAKKTNIPVLLIGHVTKSGDIAGPRVLEHIVDVVLYMEGEKYSPHRMLRGVLRAVKNRFGSTDELAVLEMSQSGLQVVSNASEMFLTQQHSDSNVLAGLAIAVIMDGSRTFLIEIQALCLTHCPVSSSLSNGINANKANIIKCVLIKQTGLHLQDNVS

SEQ ID NO: 3153 - protein, 208 aa, Glycine max
  misc_feature (142)..(142): Xaa can be any naturally occurring amino acid
ALAKEIREFRSPTDGETRMFYEIVVAPSYTEKGLEILCGKSKTLRILEAKKNEAGKLSLRQVGGGWLAQDSDDLTPHDIKFNVVSEKAPQDDELRDAEFAWLCVKHVKSNAIVIAKNNCMLGMGSGQPNRVESLRIAMRKAXDDVKGAALVSDAFFPFAWKDAGEEACESGIGVIAEPGGSIRDQDAIDCCNKYGVSLLFTNVRHFRH

SEQ ID NO: 3154 - protein, 204 aa, Glycine max
KVCFNSMDGKYILTGGEDDLVQVWSMEDRKVVAWGEGHNSWVSGVAFDSYWSSPNSNDNEETVRYRFGSVGQDTQLLLWDLEMDEIVVPLRRPPGGSPTYSTGSQSSHWDNVVPLGTLQPAPSMLDVPKISPLVAHRVHTEPLSGLIFTQESVLTACREGHIKIWMRPGVAESQSSTSENLLATNLKEKPSLSSKISSNSSYKQ

SEQ ID NO: 3155 - protein, 206 aa, Glycine max
MMEKGSVVEAAVTRSPMQMKMGDHELEGNTTSALRTAETFLRLFPVGLCVSALVLMLKSSQQNEYGSVDYSDLGAFRYLVHANGICAGYSLFSAVIAAMPRPSTMPRAWTFFLLDQVLTYIILAAGAVSTEVRTRAEKGDAATTWSSACGSFGRFCHKVTASVAITFVAVFCYVLLSLISSYKLFTNYDAPASRPTAAIEVAAFPG

SEQ ID NO: 3156 - protein, 376 aa, Glycine max
  misc_feature (25)..(25): Xaa can be any naturally occurring amino acid
  misc_feature (131)..(131): Xaa can be any naturally occurring amino acid
  misc_feature (278)..(278): Xaa can be any naturally occurring amino acid
CPPPGSSQKVVEEYRGSTPCSWLLXASKICCENSTLAEEGVSFAKRVLQNLDGRCNQLENHANFFLGVSLSAHSKLAASDSERLKRQSEALHALETAGRMRNPLVLYHLSLEYAEQRKLDAAFYYAKCFLXLEGGSNVKGWLLLARILSALKQFLDAESIINTALDQTGKWDQGDLLRTKAKLQIAQGQLRNAIETYTQLLAVLQIQSKGFGSGKKLYKENRDRARNLEVEIWHDIAYVYISLLQWHDAEVCLSKSKAIKPLSASRCHAIGIVYEAKXNTKRALKAFGDALDVDPGHVPSIISTAVVLKRCSNKSNPAVKSFLVDALRHDRFNASAWYNLGLLHKAEGTASSLVEAAECFQAAHFLEESAPVEPFR

SEQ ID NO: 3157 - protein, 233 aa, Glycine max
MLTVCFNAQGEKYSSHRMLRAVKNRFGSADELGVFEMSHSGLQAVSNASEMFLSEQLLDSEILAGLAVAVIMDGSRTFLIEIQALCLSGSTGSRQVNGIQQKRADMIISVLIKQAGLRLQEHAVFLNVVSGLALTETAGDLAIAAAICSSCLEIPIPNDIAFIGEIGLGGELRMVPRMEKRVYTVAKLGYRMCIVPKVAEKALGTEGLEKMEVVGCRNLKEVINTVFLNIMRR

SEQ ID NO: 3158 - protein, 84 aa, Glycine max
MKLLAIYEHRIAVEGFIWGINSFDQWGVELGKSLATQVRKQLNASRTKGEPIQGFNFSTTTMLTRYLQASSDVPADLSTVLPKI

SEQ ID NO: 3159 - protein, 343 aa, Glycine max
PRVRIWTPNTLIGLGLGQFLSLLITSTGFTSSQLAKKGINAPTSQSFLNYVFLSLVYGTILLYRRKALKAKWYYYIILGLVDVEANFLVVKAYQYTSLTSVMLLDCWSIPSVMLLTWLFLKTKYRFKKITGVVVCVAGLVLVVFSDVHSGDRAGGSNPRKGDLLVIAGATLYAISNVSEEFLVKNADRVELMAMLGLSGGIISAIQISILERNELKSIHWSAEAALPFVGFAVAMFMFYSLVPVLLKINGSTMLNLSLLTSDMWAVLIRIFAYHEKVDWMYFVSFGAVTIGLIIYSGGDIDEDQHPPNAAIVDLGPAVKQDEEANSGNHSKGTAAGSSKTWVA

SEQ ID NO: 3160 - protein, 363 aa, Glycine max
RKLFIGAKIIKMYRKQKSLRKKLFPWSYDWHREETCVDQKLVESSGPIRICKSGVNHNAVPRVPARPLERTEEECLKMVENNMDKNPELALMGSCVLVMLMKDQDVYVMNLGDSRAILAQERPNDRHSNPCLAPDDMRHRNRSRELLVGMELDRISEESPVHNINKHVNMINKNREISVCRLKMRAVQLSTDHSTSIEEEVSRIRAEHPDDNQAIFNDRVKGQLKVTRAFGAGFLKRPSFNEPLLKMFRVDYVGNAPYLSCASSVLHHRLSSSDRFLVLSSDGLYQFFSNEEVVAHVTWFMENVPEGDPAQYLIAELLFRAAKKNGMDFHELLDIPHGDRRKYHDDVSVMVVSLEGRIWRSSG

SEQ ID NO: 3161 - protein, 470 aa, Glycine max
MGSMHIETPETFADGSKNFDDDGRAKRTGTWITASAHIITAVIGSGVLSLAWAIAQMGWVAGPAVLFVFSLITYFTSTLLADCYRSPDPVHGKRNYTYSEVVKANLGGRKFQLCGLAQYINLVGVTIGYTITASLSMGAVKKSNCLHKHGHQDECKVKDNAFMIAFACIQILLSQIPNFHKLSWLSIVAAVMSFAYSSIGLGLSIAKIIGGGHVRTTLTGVEVSGTEKVWKMFQAIGDIAFAYAFSNVLIEIQDTLKSSPPENKVMKRASLIGIMTTTLFYVLCGCLGYAAFGNDAPSNFLTGFGFYEPFWLIDFANVCIAVHLVGAYQVFVQPIFGFVEKWSKENWTESQFINGEHTLNIPLCGSYNVNFFRVVWRTAYVIITAVVAMLLPFFNDFLALIGALSFWPLTVYFPIEMYIKKSNMQRFSFTWTWLKILSWVCLIISIISLVGSIQGLSVSIKKYKPFQAEQ

SEQ ID NO: 3162 - protein, 137 aa, Glycine max
  misc_feature (44)..(44): Xaa can be any naturally occurring amino acid
LASVVPVLEDSWGIRAMAKSKELIKGKMVLSIFVFFHPWGFFCXIRVLFKVMVVDGWRVSSVDKTAYGVLCFLLLSCLFLFGLVLQTVLYFVCKSYHHENIDKSALADHLEGYRGEYVPLTAKDVQLEPIPSLINNL

SEQ ID NO: 3163 - protein, 281 aa, Glycine max
NQVQGLTSVGSQLCNILLGSESLLLKACRAFPTQIIWIKSKQFATKEEKWHLSFPSLCCFSFSTTPSFPSQPTLKLASRLKLGLNSFDLIQIICVGNALHALRSRLSDPNNMLQSWDPTLVNPCTWFHVTCDSNNHVIRLDLGNSNVSGTLGPELGQLQHLQYLELYRNEITGKIPKELGNLKSLISMDLYDNKLEGKIPKSFGKLKSLKFLRLNNNKLTGSIPRELTRLTDLKIFDVSNNDLCGTIPVEGNFESFPMESFKNNRFSGPELKGLVPYDFGC

SEQ ID NO: 3164 - protein, 143 aa, Glycine max
MPWARLSGSPRLDVAIDMGNPFLNLTVDGFLKIGAVAATRSAAEDTYHIIQKGNISSRDFEKTLKKMCKEGVYWGTIAGVYVGMEYGVERIRGTRDWKNAMIGGAVTGALVSAASNNKKDKIAIDAITGAAIATAAEFINYLT

SEQ ID NO: 3165 - protein, 469 aa, Glycine max
  misc_feature (358)..(358): Xaa can be any naturally occurring amino acid
MAATRPVQCLLRRVCRGSRTIGVATEVNASGSTSSRIGSGKEYEHSAHNYHPLPIVFAQAKGTSVWDPEGNKYLDFLSGYSAVNQGHCHPKILKALQEQAQRLTVSSRAFYNDRFPVFAEYVTNMFGYDMVLPMNTGAEGVETALKLARKWGYEKKRIPKDEAIIVSCCGCFHGRTLGVISLSCDNEATRGFGPLLPGNLKVDFGDAEALERIFKEKGEHIAAFILEPVQGEAGVIFPPDGYLKAVRDLCSKYNVLMIADEIQTGLARTGKMLACEWEEVRPDVLILGKALGGGVIPVSAVLADKDVMLCIQPGQHGSTFGGNPLASAVAIASLDVIKYVRLVERSAQMGEELTGQLXRFQQQYPDYVKEVRGRGLFIGVEFNSKKLFPVSGYELCKKLKYRGVLAKPTHDAIIRFTPPLCISVDEIQQGSKALADVLEIDLPKLQKTKPIDAAPVATSACDRCGRVLY

SEQ ID NO: 3166 - protein, 217 aa, Glycine max
  misc_feature (176)..(176): Xaa can be any naturally occurring amino acid
  misc_feature (189)..(189): Xaa can be any naturally occurring amino acid
  misc_feature (214)..(214): Xaa can be any naturally occurring amino acid
MALTVFSLFFFFLSFTFHLPSCFSGQSSSMESVPDLQNTMYASIDGYPCVRLMNLSGTIGCSNPGRDKVVAPIVRFENVDRIAEPSAVLVSLDEFPTLFTRISDDSSFASKVGGVLVEPSTDFQKKLKGFSPDQKFPQAQFALYHNTSYEWNPIGSGIMWKSYNFPVFLLTESGSXTLQEFVTKNEDTXKIYTSNVAEFDLVMQTVKSGTHDSXSCL

SEQ ID NO: 3167 - protein, 275 aa, Glycine max
PMAGDDVIVVHSEERARMLSSGRQRKYEENRLRNKMIQDKPTTSDDSKEVPQWVEMPVIVKADVQGTVQAVTDALKTLNSAQVFVNVVHVGAGPISQSDLDLAQACGACIVGFNVKSPPTALSQEAARAGIKIVLHRVIYHLLEDIGNLIIERAPGTSETHVAGQAEVLNIFEIKGSKSKGPDVKIAGCRVIDGSVTRSATLRLLRSGEVVFEGLCTSLKREKQDVDSVKKGTECGVVINNWCDFQIGDVIQCLEQVIRKPKFIKSESGAVRIEC

SEQ ID NO: 3168 - protein, 148 aa, Glycine max
YYESRLNLNWRQILKTITDDPQSFIEGGGWEFLNLEATDSESENSEESDKGYEPSDVEPESDSEDEASDSESLVESEDDDDDEDSEEDSEEEKGKTWEELEREASNADREKGNESDSEEDRKRRKAKSFGKSRGASLSSSMPKRFKLR

SEQ ID NO: 3169 - protein, 785 aa, Glycine max
  misc_feature (57)..(57): Xaa can be any naturally occurring amino acid
  misc_feature (131)..(131): Xaa can be any naturally occurring amino acid
  misc_feature (147)..(147): Xaa can be any naturally occurring amino acid
  misc_feature (238)..(238): Xaa can be any naturally occurring amino acid
  misc_feature (735)..(735): Xaa can be any naturally occurring amino acid
  misc_feature (755)..(755): Xaa can be any naturally occurring amino acid
  misc_feature (766)..(766): Xaa can be any naturally occurring amino acid
PISQCAALIMDKKSRRKEESNVEMRRNPSMLRKLQENKLREALEEASEDGSLSKSQXIDQPDSAANQDDGIGRSRSLTRLHAQREFLRATALAADRIFESEEEIPSPQEEFAKFLTMYPKYQSSETDVWWXSDEYSHLSLKVCLDYXGFGLFSFDQSIHYGESSTVILCVVNAHLCTHALYGCAERGTVEYDIKARIMDYLNIPENEYGLVFTVSRGSAFKLLADSYPFHTNKKLLTXFDHESQSIAWMAQSAREKGAKVHSAWFKWPTLKLCSTDLRKQISNKKKRKKDSATGLFVFPVQSRVTGAKYSYQWMALAQQNNWHVLLDAGSLGPKDMDSLGLSLFRPDFIVTSFYRVFGYDPTGFGCLLIKKSVMQSLQNQSGCTGSGMVKITPEFPMYLSDSVDGLDKFVGIEDDDEITGIGDKTSETRQGTQLPAFSGAFTSAQVRDVFETEMDQDSSERDGTSTIFEETESISVGEVIKSPVFSEDESSDNSFWIDLGQSPLGSDSAGQSNKHKTASPLLHFWFNGRRNQKQHSPKPTSKMYGSPMYDDREVNLGAHEDRRVLSFDAAVLMSQELDRVKEVPEEEHVEEVDHYSRNGNGSDHLHVDEIVEEPGTSEAVNNGSWLNSTSLARHQSLENGSTSEICPDVKESAIRRETEGEFRLLGRREGNRYGGDRFFGLEENEATSRGRRVSFNMEDNRKEYLSQTLEPGDISATSFDDEEITSDGEYGDGQXLGRREPEIICRHIDHVNMLXGLNKTTLRLRXFLINWLGTSLLQLKLAGSD

SEQ ID NO: 3170 - protein, 180 aa, Glycine max
  misc_feature (68)..(68): Xaa can be any naturally occurring amino acid
MNFRTLNRKLTMAQPASLTRIGLAGLAVMGQNLALNIAEKGFPISVYNRTASKVDETVERAKQEGNLXPVYGYHDPKFFVQSIHKPRGIIMLVKAGAPVDQTIKTLSAHLEKGDCIIDGGNEWYENTERREKAMSELGLLYLGMGVSGGEEGARHGPSLIPGGTFEAYLYIDYIILKVFR

SEQ ID NO: 3171 - protein, 441 aa, Glycine max
  misc_feature (87)..(87): Xaa can be any naturally occurring amino acid
  misc_feature (324)..(324): Xaa can be any naturally occurring amino acid
MMLKIKRVPTVVSNFQKDDAADSPRPVGGCGRNCLKACCIPDAKLPLYGFKKANIGKDLALHACAGEPPLAFLDSLLLGEWEDRMQXRGLFRYDVTACETKVIPGEYGFVAQLNEGRHLKKRPTEFRVDKVLQPFDENKFNFTKVGQEEVLFQFEASEDGQVQFFPNAPVDVDNSPSFVAINVSPIEYGHVLLIPRIFECLPQRIDRESFLLALQMAVEADNPYFRLGYNSLGAFATINHLHFQAYYLALPFPIEKAPTKRIASVNGGVKISELLKYPVRGFVFEGGEMLEDLSNVVSDACICLQNNNIPFNVLISDCGKQVYXLLPQCYAEKQALGEVNAELLDTQVNPAVWEISGHMVLKRRKDYDEASEGNAWRLLAEVSLSQERFQEVNDLVFEAIGCGELEDVNVQSVKKEVDAVSTSEHPTVVVVAGSQECVVLQ

SEQ ID NO: 3172 - protein, 350 aa, Glycine max
MAICKLKSLLSLSKCNSALVSSSIRAFSSAQVPPNHLRNVGFIGLGNMGSRMANNLIKAGFRLTVHDLNSDVLEMFSQMGVPTKKTPYEVSEASDVVITMLPTSAHVIDVYTGPNGLLHGGKLLRPWLLLDSSTIDPQTSRNLSATVTNYILREKKGEWEKPFKLDAPVSGSVTAAEAGTLTFMVGGSEEAFLAAKPLLFSMGKSAIYCGGAGSGSAAKICNNLALAVSMLGISEALALGQSLGVSARTLTNIFNCSSARCWSSDAYNPVPGLMEGVPSSRDYNGGFASKLMAKDLNLAVESAKLAGCKYPLTSQAQKIYTELCSVGHEAKDFSCAFHHYYSGMDEPHDK

SEQ ID NO: 3173 - protein, 505 aa, Glycine max
  misc_feature (69)..(69): Xaa can be any naturally occurring amino acid
  misc_feature (170)..(170): Xaa can be any naturally occurring amino acid
  misc_feature (332)..(332): Xaa can be any naturally occurring amino acid
  misc_feature (440)..(440): Xaa can be any naturally occurring amino acid
MDFTPPPIEDGFTAEKLFTQGFSYTYDDVIFLPHYIDFAADVVDLSTRLTRRLPLAVPFVASPMDTVSXESAMASAMASLGGIAVVHSNVPAAVQAAILRKAKSRRVPILSDPAFAAPSAVVEHDDAFGASPFLLVTDTGTSAGKLLGYVAKSDWTNHTDKGLRVGDYMXAPPPKPVPWNADLNKINEIFESEKSGAVALEKDGEVVDLVVREEVERVKGYPKLVAPATVGADGEFMVGAAVGTREDDKERLEHLVKAGLNVVVLDSSQGNSIYQLEMVKYVKRVYPELDVIGGNVVTMYQAENLIQAGVDGLRVGMGSGSICTTQEVCAVXGRGQATAVYKVSSIAYKSGVPVIADGGISNSGHIVKALSLGASTVMMGSFLAGSLEAPGAYVYQNGQRVKKYRGMGSLEAMTKGSDARYLGDTAKLKIAQGVVGAVKXKGSVLNFIPYTLQAVRQGFQDIGANSLQSAHDLLRSRVLRLEVRSGAAQVEGGIHGLVSYEKKYF

SEQ ID NO: 3174 - protein, 494 aa, Glycine max
MLVLFETPAGFALFKVLDEGKLSKVEDLWKNFSSADTARQVVKLKAFSKFENTSEALEAATLLIDGKASKGLRKFLRVHCENETLGVADSKLGNVIKEKLKIDCIHNNAVMELMRGVRNQLTELISGLAVQDMAPMSLGLSHSLSRYKLKFSAEKVDTMIVQAIGLLDDLDKELNTYAMRVREWYGWHFPELTKIIQDNILYARAVKLMGDRVNAASLDFSEILPEEVEAELKEASVISMGTEIGELDLANIRELCDQVLSLSEYRAQLYDYLKSRMNTIAPNLTAMVGELVGARLIAHGGSLLNLAKQPGSTVQILGAEKALFRALKTKHATPKYGLIYHASLIGQAAPKFKGKISRSLAAKTALAIRCDALGDGQDNTMGLENRAKLEARLRNLEGKELGRFAGSAKGKPKIEAYDKDRKKGAGGLITPAKTYNPSADSVIGQMVDSAIDEDAQEPSVADKKKEKKDKKKKKKKKKKKKKKKKKKKKKKGRP

SEQ ID NO: 3175 - protein, 332 aa, Glycine max
  misc_feature (32)..(35): Xaa can be any naturally occurring amino acid
RVLPRVRTAARRRQKGGSEMGDVDLARGGELXXXXLSLSEYRAQLYDYLKSRMNTIAPNLTAMGGELVGARLIAHGGSLLNLAKQPGRAGQILGAEKALFRALKTKHATPKYGLIYHASLVGQAAPKFKGKISRSLAAKTALAIRCDALGDSQDNTMGLENRAKLEARLRNLEGKELGRFAGSAKGKPKIEAYDKDRKKGAGGLITPAKTYNPSADSVIGQMVNSAMDEDAQEPSVADKKKEKKEKKEKKKKEKNEGDETVQADGDVGEEPEPEVVKKEKKKKRKETESAELQNGNDDNAGEKKKKRKKHAEKEESPEMPSKKKGKKKKSGD

SEQ ID NO: 3176 - protein, 131 aa, Glycine max
MNARRDNRNNRVSLFDGIEEGGIRASSVYSSSHEIDEHDNEQALDGLQDRVNLLKRLSGDINEEVDSHNRMLDRMGNDMDSSRGVLSGTMDKFKMVFETKSNQRMFTLVASFVVLFLIIYYLTRFDVLNRY

SEQ ID NO: 3177 - protein, 178 aa, Glycine max
MWIRNMYERGRISVEVIWVKIFLHESMILEASLYMSKNPRNCISSCSLSMMEISNLLFRKILINEIVMDETRRNTPQYNKLDRMISSELITLVLFKIAYFTLLLIFSLLSTSAVVYTIASIYTAKEVTFKRVMSVVPKVWKRLMLTFLCAFAAFFIYNIVTMLVMFLSIVTIGISSGV

SEQ ID NO: 3178 - protein, 448 aa, Glycine max
  misc_feature (39)..(39): Xaa can be any naturally occurring amino acid
  misc_feature (53)..(53): Xaa can be any naturally occurring amino acid
  misc_feature (81)..(81): Xaa can be any naturally occurring amino acid
  misc_feature (153)..(153): Xaa can be any naturally occurring amino acid
  misc_feature (343)..(343): Xaa can be any naturally occurring amino acid
  misc_feature (414)..(414): Xaa can be any naturally occurring amino acid
  misc_feature (419)..(419): Xaa can be any naturally occurring amino acid
MSQHHGDEMEYAADDNEMAEVEEDMYFRGRAFGESDSEXDDDYEYDPLENRIXDTTAAEARRGKDIQGIPWDSLSISRENXRQTILEQYKNYENIAQSGEMSEKECKATDRGGKYYDFWQNTRSVKSTILHFQLRNLVWSTSKHDVYLVSRYXIVHWSSLTSKRSEILNVSGHVAPCEKHPGSLLEGFTQTQISTLAVRDNLLIAGGFQGELICKYLDRPGVSFCSRTTYDDNAITNAVEIYEHPSGAVHFMASNNDSGVRDFDMERFQLSKHFCFPWPVNHTSLSPDGKLLAVVGDNPKGLLVDSQTGKTITPLRGHLDFSFASAWHPDGRIFATGNQDKTXCRVWDVRNLSKSVAVLKGNLGAIRSIRFTSDGQFMAMAEPADFVHVYDAKHGFEKEQEIDFFGEISGVSFXSPDTXSLFIGVWDRTYGSLLQFNRRRNYMYLDCL

SEQ ID NO: 3179 - protein, 169 aa, Glycine max
MMEKGSVVEAAVTRSPMQMKMGDHELEGNTTSALRTAETFLRLFPVGLCVSALVLMLKSSQQNEYGSVDYSDLGAFRYLVHANGICAGYSLFSAVIAAMPCPSTIPRAWTFFLLDQVPPYIVLVCKGDKMDNLASLIIDVGCGLCMLNKKRLNQFRLLKRCQNPVQGAF

SEQ ID NO: 3180 - protein, 214 aa, Glycine max
  misc_feature (210)..(210): Xaa can be any naturally occurring amino acid
MMNTANGTMISPSSSSGTAAQSPGLKTYFKTPEGRYKLQYEKTHPSGLLHYAHGKTVTQVTLAHLKDKPAPSTPTASSSSSFSASSGVRSAAARLLGGSNGSRALSFVGGNGGSKSNGGNTRISSIGASSTSSAMANPNFDGKGTYLIFNVGDAIFISDLNSQDKDPIKSIHFSNSNPVCHTFDQDAKDGHDLLIGLNSGDVYSVSLRQXLQGC

SEQ ID NO: 3181 - protein, 110 aa, Glycine max
MMNTANGTMMSPSSSSVTAQSPGLKTYFKTPEGRYKLHYEKTHPSGLLHYAHGKTVTQVTLAHLKDKPAPSTPTASSSSSSFSASSGVRSAAARLLGGSNGSRALSFVGG

SEQ ID NO: 3182 - protein, 374 aa, Glycine max
  misc_feature (185)..(185): Xaa can be any naturally occurring amino acid
MEEIEGVNCCSESESRSSSETRPPNPNPPSYRQCKLVRHASQKMNTKLSDVSAEPEHVTEDCQSDFFPMLRSGACTDIGFRSNMEDAYVCVDNFMEDYGLKNHIDGPSAFYGVFDGHGGKHAADFACLHLPKFIVDDKDFPRDIERIVASAFLQADNAFAEACSLDAALASGTTALATLVIGSFXGRLLVVANAGDCRAVLCRRGKAIEMSRDHKPGCNKEKKRIEASGGYVYDGYLNGQLNVARALGDWHMEGMKSKDGGPLTAEPELMTTKLTAEDEFLIIGCDGIWDVFRSQNAVDFARRRLQEHNDPAMCSKDLVDEALKRKSGDNLAAVVVCFQQQPPPNLVAPRSRVQRSFSAEGLKELQSFLDSLGN

SEQ ID NO: 3183 - protein, 282 aa, Glycine max
  misc_feature (111)..(111): Xaa can be any naturally occurring amino acid
FIFALQVLIAILLCPLNIVYRSSRMFFLTCLIHCICAPLYKVTLPDFFMADQFTSQVQALRSFEFYICYYGWGDFKQRETSCKSNRIFIAFSFIVAVIPYWSRFLPSFSCXCLRRLFEEKDKMQGYNALKYFLTIAAVCLRTAYTLHQGMGLKVMAWIFSISTAIFSTYWDLVLDWGLLQRHSKNRWLRDKLLVPQKSVYFAAMVLNVLLRFAWLQTILNLNFSSLHRQAMVSIVANLEIIRRGIWNFFRIENEHLNNVGKYRAFKFVPLPFNYEEEEDKDE

SEQ ID NO: 3184 - protein, 347 aa, Glycine max
SARVRLREDDRRVEIEEKINKIKWCQTANGALFLLSTNDKTIKFWKVTSHETSLMARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRVSTGSYSNLFRVFGCVPGSTEATTLEASKNPMRRQVPTPSRPSRSLGNSITRVVRRGAESAGVDANGNSFDFTTKLLHLAWHPTENSIACAAANSLYMYYA

SEQ ID NO: 3185 - protein, 260 aa, Glycine max
  misc_feature (85)..(85): Xaa can be any naturally occurring amino acid
  misc_feature (118)..(118): Xaa can be any naturally occurring amino acid
TRHCNTLAYSSSKGSIRLVDLRQPPLCDSHAKLFEEQESPPLGVPQGFHFFFHQKEFNPAFQISEQLKFGKDGRYILSRDYTGPXLWDITMASGPVATFQVHEYLRPKVRFPCLDEQXISAALSSYSTGSFFFGQLCDLYENDSIFDKFECCLSGDGLRVSTGSYSNLFRVFGCVPGSTEATTLEASKNPMRRQVPTPSRPSRSLGNSITRGVRRGAESAGVDANGNSFDFTTKLLHLAWHPTENSIACAAANSLYMYYA

SEQ ID NO: 3186 - protein, 576 aa, Glycine max
  misc_feature (322)..(322): Xaa can be any naturally occurring amino acid
  misc_feature (333)..(333): Xaa can be any naturally occurring amino acid
LVKGDPARKSDTQKVTHVHHHHVSTPTIAVSDSALKFTHVLYNLSPAELYEQAIKYEKGSFISSTGALATLSGAKTGRSPRDKRVVKDDLTKNDLWWGKGSPNIEMDEHSFMVNRERAVDYLNSLDKVFVNDQFLNWDTENRIKVRIVSARAYHSLFMHNMCIRPTPEELENFGTPDFTIYNAGQFPCNRYTHYMTSSTSIDLNLARREMVILGTQYAGEMKKGLFSVMHYLMPKRQILSLHSGCNMGKDGDVALFFGLSGTGKTTLSTDHNRYLIGDDEHCWGDNGVSNIEGGCYAKCIDLSREKEPDIWNAIRFGTDSFXDFLFFFQLIAXVLENVVFDEHDREVDYSDKSVTENTRAAYPIEYIPNAKLPCVGPHPKNVILLACDAFGVLPPVSKLNLAQTMYHFISGYTALVAGTEEGIKEPQATFSACFGAAFIMLHPTKYAAMLAEKMQKHGATGWLVNTGWSAGSYGNGSRIKLQYTRKIIDAIHSGSLLNAEYKKTEIFGLEIPTEVEGVPSEILDPMNTWSNKKAYKETLLKLAGLFKNNFETFTNYKIGKGNNNLTEEILAAGPIF

SEQ ID NO: 3187 - protein, 300 aa, Glycine max
TRRDKRVVKDDLTKNDLWWGKGSPNIEMDEHSFMVNRERAVDYLNSLDKVFVNDQFLNWDTENRIKVRIVSLPELTIHCSCTTCTGKTTLSTDHNRYLIGDDEHCWGDNGVSNIEGGCYAKCIDLSREKEPDIWNAISVLENVVFDEHDREVDYSDKSVTENTRAAYPIEYIPNAKLPCVGPHPKNVILLACDAFGVLPPVSKLNLAQTMYHFISGYTALVAGTEEGIKEPQATLSACFGAAFIMLHPTKDSAVLCDHMQKHCSTRSLGSTGMSARSYANVALLCYITLEYDGSMSTKVC

SEQ ID NO: 3188 - protein, 246 aa, Glycine max
  misc_feature (59)..(59): Xaa can be any naturally occurring amino acid
EQFLCSMLGDDSDINLAVVRDVLCQCGNDIERASDILLDLAASTNEKPNTARHPNYGCXSDNIDDERFFADPNDSLIDRRLECTSLSWEGYLSNNPWPFGRKYVEVLNSSKADSAISPGCTKSEIPQKVLESLFNIPKSTEHDKDTMNWRNVVKKIQSLGPGFNVSPHVAESQQHTCAKGDEYHVFREDSKQQWDSVKSYYTKAATAYTKRERAYAAYLSDQGKEQTKLAQKADTKASHDIFVARN

SEQ ID NO: 3189 - protein, 364 aa, Glycine max
  misc_feature (203)..(203): Xaa can be any naturally occurring amino acid
NSRVDPASVSRSNRKPLPSSSSSSSVATEAEQKEILETLVSNLPLEKSSKAATATRFLFGLLRTTNILNAAEACRDALEKKIGLQLEEATLDDLLVPSYSYLNETLYDVDCVERILSHFLEGMEARTATETTEDAAATRSPALMLVGKLIDGYLSEIASDANLKPEKFYNFAISLPDEARLFDDGLYRAVDVYLKAHPWVSEXDREKICGLLDCQKLTLEACSHAAQNERLPLRAVVRVLFFEQLQLRRAIAGKLGAAEEPSRHSAAMAEEEEVEDDNNTWQVTVRENQVLRLDMDSMRTRVHELERECSSMKRAIEKMDKMGPRGGGPWRASLALGRKFGCKFKTQVCDSHEPATREGRPHRR

SEQ ID NO: 3190 - protein, 296 aa, Glycine max
  misc_feature (28)..(28): Xaa can be any naturally occurring amino acid
GLGLRLGCLKTWLTYGKVALYRSSVDGXHYAIKSFHKSHLQKLRVAPSETAMTDVLREVLIMKMVEHPNIVNLIEVIDDPESDDFYMVLEYVECKWVCEGTGHPCALGEETARKYLRDIVSGLTYLHAHNIVHGDIKPDNLLITRHGTVKIGDFSVSQAFEDGNDELRRSPGTPVFTAPECCLGLTYHGKASDTWAVGVTLYCMILGEYPFLGDTLQDTYDKIVNDPLVLPDDINPQLKNLIEGLLCKDPELRMTLGDVAEHIWVIGDDGPIPGYLCWCKRKSMVTEDSDGSDILD

SEQ ID NO: 3191 - protein, 245 aa, Glycine max
IRALTPRMIRAIAERTKQRKSRSKVDNVLPNVMSMHSVSLILEAILLKSKSSEELGRYTEAAKECRIVVDTVESALPNGMPEGIGEDCKLQEMFHEALELLPNLWMKAGLLDEVVTAYRRALVKPWNLEPQRLACVQKDLATTLLYGGVEVNLPPQLQVNGITTPMSGTEEAILLLLILSGKMALQEIDWDPEIMDHLTFSLSVTGMFESLADHVEKILPGVHDRAEQWYFLALCYSAAGQNEVA

SEQ ID NO: 3192 - protein, 89 aa, Glycine max
MSGVKKVTDVAAKAGKAIDWDGLAKMLVSDEARKEFANLRRTFEDVNHQLQTKFSQEPKPIDWEYYKKGIGSKVVDMYKEAESQIARKA

SEQ ID NO: 3193 - protein, 776 aa, Glycine max
ANKHTAVVSDLGEVFTWGCNREGQLGYGTSNSASNYTPRVVESLKGKTLTRVSAAKYHTIVLGSDGEVFTWGHRLVTPKRVVVSRNLKRSGSTLLKFHRKERLSVVSIAAGMVHSMALTDDGALFYWVSSDPDLRCQQLYAMCGRNMVSISAGKYWTAAVTATGDVYMWDGKKGKDKPLVATRLHGVKKATSVSVGETHLLIVASLYHPVYPPNMIENSQKSKLNNKDDVEELNEDILFEDIDSSNIISNVQNDTLSQRSIPSLKSLCEKVAAECLVEPRNAVQLLEIADSLGADDLKKYCEEIVMRNLDFIFAVSSHTVASASLDILANLERLFDQRSSEPWSHRRLPTPTATFPAIINSEEDDSEIEFQRTRDKPMKLEKVLRLDSFLQPKDDPNKEISKVVRAIRKKLQQIEMLEDKQSNGHLLDDQQIAKLQSKSALESSLAELGVPVETSRYKESSSMLPEGKGSKKGKLSKKQRRKSGNSNIEQTEIESVYSKSEAIPKSEDLLDIDIMGVPDSKVEEDAVCEQISADEGGKDLAFVVQKKDALELLKAKGPSPKASKKKRSKKGGLSMFLSGALDEAPKEVAPPPPTPTPKHEGPAWGGAKFTKGSASLREIQDEQSKIKVNKPAGSKDKVEDLPDFGSGGKIKLSSFLPSSPIPVTSSRSSQVSDGETSTPPWAASGTPPQPSRPSLRDIQMQQGKKQQSLSHSPKTTTAGFSIPTCQGSPSETTGVSRWFKPEVETPSSIRSIQIEEKAMKDLKRFYSSVKIVRKQS

SEQ ID NO: 3194 - protein, 388 aa, Glycine max
  misc_feature (159)..(159): Xaa can be any naturally occurring amino acid
HLQCQGVGGDALPSYMRGAVYWEPNKPLTIEEFNMPRPKAGEVLIKTKACGVCHSDLHVMKGEIPFSSPCVVGHEITGEVVEHGALTDSKTIERLPVGSRVVGAFIMPCGNCSYCSKGHDDLCEAFFAYNRAKGTLYDGETRLFFRNSGKPAFMYSMGXGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFDEAGKAFQDLNEGKIVGRAVIEII

SEQ ID NO: 3195 - protein, 505 aa, Glycine max
MRLMFDTMNETADEAAIGAKKYATKQANISGFQTLYCLVQCTPDLSTQGCRSCLSDAIGLLPWCCEGKQGGRILNPSCNVRYDLYPFYRTNVSAPPASVPPTDSSNSGGGGSEISPGTIVAIVVPITVAVLLFIVGIWLLSKRAAKKRNSAQDPKTETEISAVESLRFDFSTIEAATDKFSDANKLGEGGFGEVYKGLLPSGQEVAVKRLSKNSGQGGTEFKNEVEVVAKLQHKNLVRLLGFCLEGEEKILVYEFVANKSLDYILFDPEKQKSLDWTRRYKIVEGIARGIQYLHEDSRLKIIHRDLKASNVLLDGDMNPKISDFGMARIFGVDQTQANTNRIVGTYGYMSPEYAMHGEYSAKSDVYSFGVLILEIISGKRNSSFYETDVAEDLLSYAWKLWKDEAPLELMDQSLRESYTRNEVIRCIHIGLLCVQEDPIDRPTMASVVLMLDSYSVTLQVPNQPAFYINSRTEPNMPKGLKIDQSTTNSTSKSVNDMSVSEVDPR

SEQ ID NO: 3196 - protein, 513 aa, Glycine max
MADVRGRDTWTEELPSLIEDSGVLYGGDPTTTTTTTTTTSFEVYAPHSESGESFKEQALGFVMAWCEILMELGRGFRDILRQNLMNEDSYVVRKFGGPCSKVSKRLRFLNDFLPEDRDPVHAWSVVFFVFILALAAISVDPSREAVAPAVKVRQHPPCASRVLLPDGRYMAYHEQGVPADTARFSLVAPHSFLSSRLAGLPGVKASLLEEYGIRLVTYDLPGFGESDPHPNRNLNSSAMDVLHLVNAVNVTDKFWLLCHSSGCIHAWASLRYIPEKIAGAAMLAPMINPYDTDMTKEETKRTWEKWLQRRKMMYSLARRFPKLLTFFYRKSFLPEKHDEIDKLLSFSLGKKDKLMIEEPEFEEFWQRDVEESVRQGNIRPFIEEAVLQVSNWGFDLKELHVQKKCQTRGILLWLKSMYSQADCELAGFLGLTHIWQGLDDRVVPPSVMEYIERVLPEAVIHKLPNEGHFSYFYFCDQCHRQIFATLFGTPQGPVERQEETATVLEEEVSQVPV

SEQ ID NO: 3197 - protein, 175 aa, Glycine max
  misc_feature (125)..(125): Xaa can be any naturally occurring amino acid
MASSSWDYMGEIANVAQLTGIDAVKLIGMIVKAANTARMHKKNCRQFAQHLKLIGNLLEQLKISELKKYPETREPLEQLEDALRRSYILVNSCQDRSYLYLLAMGWNIVYQFRKAQNEIHTYLKXVPLITLVDNARVRVPDTLLCSIICYPIVVNGLFIVDHPLKKKKKKKITPN

SEQ ID NO: 3198 - protein, 200 aa, Glycine max
MVSSDKDPREEVLQAWYMDDSDEDQRLPHHKEPKEFVSLDQLAELGVLSWKLDADNHENDPELKKIREERGYTYMDVCEVCPEKLPNYEQKIKSFFEEHLHTDEEIRFCAAGSGYFDVRDCNDAWIRVWVKKGGMIILPAGIYHRFTLDESNYIKALRFFVGEPVWTPHNRPNDHLPARQQYVKDFVEKDVGNHAVDAAA

SEQ ID NO: 3199 - protein, 116 aa, Glycine max
  misc_feature (53)..(53): Xaa can be any naturally occurring amino acid
  misc_feature (82)..(82): Xaa can be any naturally occurring amino acid
MAVHSDSASSEKKSSNGVNELLTFNAENMQSNMKIIYYSRTFLSIIGGVVAGXLGFTGLKGFVFYLLLMAFTSLGLVAKAKXSTHTYFDSWNRVLLDGFLGGLMSFVLFWTYPSLL

SEQ ID NO: 3200 - protein, 145 aa, Glycine max
MVENNLFEDIFRVEKLNPDDKKLFDKVTRIDACCEKFDMFMHLDINSEIYPLKVGQKFALVLVSTLNPDGTPDTGYYTQISRQSLANNFEYVMYGKLYRITEGSGRGKAEMNISFGGLLMMLKGDTSHCNKFELDQRLYLLIRKV

SEQ ID NO: 3201 - protein, 158 aa, Glycine max
MAEKLAPEKRHSFVHNGQKVFEWDQTLDEVNIYIALPPNVHSKQFYCKIQSKHLELGIKGNPPYLNHDLTSPVKTDSSFWTLEDDIMHITLQKRDKGQTWASPISGQGQLDPYATDLEQKRLMLQRFQEENPGFDFSQAQFSGNCPDPRTFMGGIRSD

SEQ ID NO: 3202 - protein, 158 aa, Glycine max
MAEKLAPEKRHSFVHNGQKVFEWDQTLDEVNIYIALPPNVHSKQFYCKIQSKHLELGIKGNPPYLNHDLTSPVKTDSSFWTLEDDIMHITLQKRDKGQTWASPILGQGQLDPYATDLEQKRLMLQRFQEENPGFDFSQAQFSGNCPDPRTFMGGIRSD

SEQ ID NO: 3203 - protein, 264 aa, Glycine max
MAQVVASRSIQSTPLCPTSGSARDRTQNLLKPPSFASKVFPLGENNNKRSKLRLRSLQISARKSAPSEVIPMSPEDDPKIEEHLQHLRGVQPFGENSVGMWSKPTFRRKTKIVCTIGPSTNTREMIWKLAEAGMNVARLNMSHGDHASHQKVIDLVKEYNASHEDNVIAIMLDTKGPEVRSGDLPQPITLMPGQEFTFTIQRGVGTADCVSVNYDDFVNDVEMGDMLLVDGGMMSMVVKSKTEDSVKCEVVDGRELKSRRHFDV

SEQ ID NO: 3204 - protein, 321 aa, Glycine max
MYIIECQLTASGPREFTYLERDRQEKREGQNALAPPWWTFFHFKLLRPLVDDVDSSIFGAIYEFRPPSSQYNDTLYRSPHYVIAFRGTLTKSHSVSRDIELDIHFIKQGLHQTSRSEIAIQAVQNTVATVGDSNVWLAGHSLGSAIAMLTGYTMAKNGMFIGSFLFHPPLGFAPIERIKDERVKHGIRFAGSVITAGLTIAMQAKQPKDLSADPFAALAAWVPGLFVNPSDHICSEYIGYFEHRRKMDEIGAGVIERLATQNSLGGLLMSAFGKESEPLHLIPSASLTVNVTPSRDFKEAHGIHQWWKPDLQLERKLYNYK

SEQ ID NO: 3205 - protein, 501 aa, Glycine max
  misc_feature (202)..(202): Xaa can be any naturally occurring amino acid
MAMASLARRKGYAVVLSSRSSFCLTSWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKFVSPSEVSVDTTEGGNTVVKGKHIIIATGSDVKSLPGVTIDEKKVVSSTGALXALTEIPKRLVVIGAGYIGLEMGSVWGRLGTEITVVEFASEIVPTMDAEVRKQFQRSLEKQGLKFKLKTKVVGVDTSGDGVKLTLEPAAGGDQTTLEADVVLVSAGRTPFTAGLGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFMANSRAKAIDNAEGLVKILAEKETDKILGVHIMAPNAGELIHEAAIALQYDASSEDIARVCHAHSTMSEAVKEAVMVSYDKPIHI

SEQ ID NO: 3206 - protein, 587 aa, Glycine max
MGVLQEKLSSFYKSRWLVFVAAMWLQSWAGIGYLFGSISPVIKSSLGYNQKQLAMLGVAKDLGDAVGFMTGLLCEILPIWGALLVGAALNVVGYGWVWLVVTSQVPVLPVWAMCALIFVGTNGETYFNTVSLVSCVQNFPKSRGPVVGILKGFAGLSGAILTQIYALFHSPNQASLIFMVAVGPSLVGIGLMFIVRPVGGHKQVRPSDGKCFTLIYGVCLLLAAYLLGVMVVQDLVEVSETVISIFTGVLLLILLVPIVIPITLTFGPEQRHPEEEALLPPPQNKEAGKSQLDSDEVILSELEDEKPKEVDMLPASERQKRIAHLQQRLLQAAAEGAVRVKRRRGPHRGEDFTLTQALIKADFWLLFISMIMGSGSGLTVIDNLGQMSQSLGFDNAHIFVSMISIWNFLGRVGGGYISELVVRDHAYPRPVALAVFQLIMTLGHVFLGMGWPGSMYVGTLLVGLGYGAHWAIVPATASELFGLRNFGALYNFITIANPAGTLVFSSLIASTIYDAEAEKQHRQNMILQVLNASEPLKCEGSVCFFLTSMIMAGLCVVGAGLCMVLVLRTRIVYANLYGKASSSRLRL

SEQ ID NO: 3207 - protein, 277 aa, Glycine max
  misc_feature (22)..(22): Xaa can be any naturally occurring amino acid
MATSIGIMDSAYIAGRNEILRXINDRPKLSFSRIEEAASGAVQCLKMDMTYPGVVPMHKVNFDAKTEYDMIQNYKVLQDVFNKLKIEKHIEVGRLVKGRPLDNLEFLQWLKRYCDSVNGGIMNENYNPVERRIKGGKDRNVKSLKSSKSLQTNTMNHSGSGDSLRSKQLRSSGGADGVNSSAEIQALSKQVSDLKLSVDHLEKERDFYFAKLRDIEILCQASELENDPMSLAIKKILYAADAKGSALDEAQEYLNDVINGGEDEAEAEAEAEVETEA

SEQ ID NO: 3208 - protein, 735 aa, Glycine max
  misc_feature (573)..(573): Xaa can be any naturally occurring amino acid
  misc_feature (592)..(592): Xaa can be any naturally occurring amino acid
RFDELAIDAKLPKTRFSQCIGMNESKEFAGELFDALARRRGITSASITKDQLREFWEQITDQSFDSRLQTFFDMVDKDADGRITQEEVKEIIALSASANKLSKIQNRAEEYAALIMEELDPDNLGYIELYNLEMLLLQAPAQSTHITTDSRVLSQMLSQKLVPTKEYNPIKRGFRSLAYFVEDNWKRIWVIALWLSICAGLFTWKFIQYKHRAVFDVMGYCVTSAKGAAETLKFNMALILLPVCRNTITWLRSKTKLGMAVPFDDNINFHKVIAFGIAIGVGIHAISHLTCDFPRLLHATDEEYEPMKQFFGDERPNNYWWFVKGTEGWTGIAIVVLMAIAYTLAQPWFRRNRLKLPKPLKRLTGFNAFWYSHHLFVIVYGLFIIHGYFLYLSKKWYKKTTWMYLAIPMILYGCERLLRAFRSGYKSVKILKVAVYPGNVLALHVSKPQGFKYSSGQYIYVNCSDVSPFEWHPFSITSAPGDDYLSVHIRTLGDWTSQLKGVFAKACQPASDGQSGLLRADMLQGNNKPRMPRLLIDGPYGAPAQDYKNYDVILLVGLGIGATPLISILKDVXLNNIKQHKDVEEGEGGKGXKRKPFAPKRAYFYWVTREEGSFEWFKGVMNEVEENAKEGVIELHNYCPSVYEEGDARSALITMLQSLHHAKNGVDIVSGTRVKTHFARPNWRNVFKHAAIKHPDQRVGVFYCGAHGLVGELKRLSLDFSRKTSTKFDFHKENF

SEQ ID NO: 3209 - protein, 358 aa, Glycine max
  misc_feature (348)..(349): Xaa can be any naturally occurring amino acid
  misc_feature (352)..(352): Xaa can be any naturally occurring amino acid
MEWVKMKGYAREFMVGVAEMTVEFGKGCRDIVKQSLVNDDSYIVKNFGRDSYIGKTVTEPFANLFQKLSFFNEYLPEDKDPLHAWSVIFFVSILARPARPANFERDPYAAAAPVKHVFVHPPSATRVVLPDGRYMAYKEQGVSSHKARFSVIAPHSFLSSRLAGIPGVKDSLLQEFGIRLLTYDLPGFGESDPHPNRNLESSATDMAFLANALGVDKFWVVGYSSGSMHAWAALRYIPDRLAGAAMFAPMVNPYDPIMTKEERRRTWNKWTRRRKFMYFLARRFPRLLAFFYQQSFLSGKHGQIDRWLSLSLGNRDKALMEDPMYEEFWQRDVEESIRQRNVKPFMEXXACXRKWGSA

SEQ ID NO: 3210 - protein, 146 aa, Glycine max
  misc_feature (69)..(69): Xaa can be any naturally occurring amino acid
QQWDSVKSYYTKAATAYTKRERAYAAYLSDQGEEHTRLAQIADTMASHDIFIARNKGIDNMITIDLHGXQHVEQAMRMLKLHLLFGSYVPSVQTLRVITGCGSHGVGKSKLKQSVINLLDREAIEWREENQGTVLIKLSGWREYSF

SEQ ID NO: 3211 - protein, 225 aa, Glycine max
MTRKIMGTLTSNINLSPQYNVPKDYPPHGSVVEEIQGLIRVHKHGYVERPQVVPCVTASSKMSPELNVTSRDMAIDSATNTWARFYVPISQHKKMPFLVYFHGGGFCVGSAAWSCYHDFLARLSAKVECVIMSVNYRLAPENPLPAPYDDGLKAIMWVKQQMLHQQHNKGGSEWWTSKCNFSSVFLGGDSAGANIAYNVATRLCACDGAALRPLNLKGLILIQPF

SEQ ID NO: 3212 - protein, 558 aa, Glycine max
  misc_feature (373)..(373): Xaa can be any naturally occurring amino acid
MASTSLFNFRLPLFNFNPLHHRRIKRPKSLLSSPRNSPRLVSSINDHLALTRVTYPLLQSHSAPKRRFHVGVQKEYSDGESSESIVSDATYQEEFSWSSVVLPFLFPALGGLLFGYDIGATSGATISLQSPELSGISWFNLSAIQLGLSLSGSLYGSLLVWLFAFAVAGVLGLNIRLFNATLLWLFGVIVTAYAPELVILLTVCLFYGLGIYLGLQWAPLYIAETCPSQIRGTLVSLKELFIVLGILLGYFVGSFLIETVGGWRFMYGFSAPVAVLMGLGMWTLPNSPRWLLLRAVQGKGSFQDLKEQAIASLSKLRGRPPGDKESEKQIEETLVSLKSVYADQESEGNFLEVFQGPNLKAFIIGGGLVLFQXGQPSVLYYAGPILQSAGFSAASDATKVSVVIGLFKLLMTWIAVLKVDDLGRRPLLIGGVSGIALSLVLLSAYYKFLGGFPLVAVGALLLYVGCYQISFGPISWLMVSEVFPLRTRGKGISLAVLTNFASNAVVTFAFSPLKEFLGAENLFLLFGAIATLSLLFIIFSVPETKGMSLEDIESKILK

SEQ ID NO: 3213 - protein, 242 aa, Glycine max
MANTNLEDVPSLDLMTELLRRLKCSSKPDKRLILIGPPGSGKGTQSPIIKDEYCLCHLATGDMLRAAVAAKTPLGVKAKEAMDKGELVSDDLVVGIIDEAMKKPSCQKGFILDGFPRTVVQAQKLDEMLQKQGVKVDKVLNFAIDDAILEERITGRWIHPSSGRTYHTKFSPPKVLGVDDVTGEPLIQRKDDTAAVLKLRLEAFHKQTEPVIDYYSKKGLVANLHAEKPPKEVTVEVEKVLS

SEQ ID NO: 3214 - protein, 150 aa, Glycine max
  misc_feature (71)..(71): Xaa can be any naturally occurring amino acid
  misc_feature (73)..(73): Xaa can be any naturally occurring amino acid
  misc_feature (76)..(76): Xaa can be any naturally occurring amino acid
  misc_feature (83)..(83): Xaa can be any naturally occurring amino acid
  misc_feature (90)..(90): Xaa can be any naturally occurring amino acid
  misc_feature (93)..(94): Xaa can be any naturally occurring amino acid
  misc_feature (103)..(103): Xaa can be any naturally occurring amino acid
  misc_feature (105)..(107): Xaa can be any naturally occurring amino acid
  misc_feature (109)..(109): Xaa can be any naturally occurring amino acid
  misc_feature (111)..(111): Xaa can be any naturally occurring amino acid
  misc_feature (113)..(113): Xaa can be any naturally occurring amino acid
  misc_feature (115)..(115): Xaa can be any naturally occurring amino acid
  misc_feature (118)..(119): Xaa can be any naturally occurring amino acid
  misc_feature (122)..(122): Xaa can be any naturally occurring amino acid
  misc_feature (124)..(125): Xaa can be any naturally occurring amino acid
MANTNLEDVPSLDLMTEVLRRLKCSSKPDKRLILIGPPGSGKGTQSPIIKDEYCLCHLATGDMLRASVVAXTXLGXKAKEAMXKGDFAFXDLXXGIIDDVLKXSXXXKXFXFXGXLRXXALXHXXSFMLLVVFFALLRCYSLLAFIVFLR

SEQ ID NO: 3215 - protein, 81 aa, Glycine max
MKNANGLISTTSSNTAQSQSTGLKTYFKTHEGRYKLYYDKTYPSTLLHYAHGKTVSQVALLVFFSPLSYSAFAILFCIAIM

SEQ ID NO: 3216 - protein, 118 aa, Glycine max
MATSSTTLLLSSLIPASIPSFNSGNHSVFLLQNRSLNRPKKRVSFVVQAAKPPIGVEIPKVQPQFKPPFLGFTKTAEVWNSRACMIGIIGVFIVEFIINKGILQVIGVDVGKGLNIPL

SEQ ID NO: 3217 - protein, 63 aa, Glycine max
MEVLKVQVFVMSIVALALAYVAPSINAQVLPPAPAPTSDGIAVDQGIAYVLMLLALVLTYIIH

SEQ ID NO: 3218 - protein, 444 aa, Glycine max
MATIVSIKARQIFDSRGNPTVEVDLTCSDGTFARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQKISGDALKDLYKSFVTEYPIVSIEDPFDQDDWEHYAKLTAEVGTNVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 3219 - protein, 332 aa, Glycine max
MAQLLSPVYTEPLKSNLSSISSWRILPKTATPSNFVTHNGKRRGCGRVRVAAEEKSFSTSDTVADDYYAVLGLLPDATPAQIKKAYYNCMKACHPDLSDNDPEATNFCTFINEVYGVLSDPIQRMIYDDIHGYSLTSINPFLDDSSPKDHVFVDEFSCIGCKNCANVACDVFGIEEEFGRARVYSQCGKPELVQQAIDSCPVDCIHWTSAAQLSLLEDEMRRVERVNVALMLSGMGSAGTDVFRMASSRWEKRQAKVLEQAKLRMMKEKGSDKTDMFWNNLWGKPKDLSSEEEIKERAKRAAAAARRWREYSRRGVDKPPTFKLPETASTKD

SEQ ID NO: 3220 - protein, 432 aa, Glycine max
MERIICAKYKLGRKIGSGSFGEIYLATNIDTFEIVAVKIENGKTKHPQLLYEAKLYNILQGGSGIPNIKWCGVDGEDNVLVMDLLGPSLEDLFVYCGRKFSLKSVLMLADQMMTRIEYVHSKGFLHRDIKPDNFLMGLGRKANQVYIIDFGLAKRYRDSSTNRHIPYRENKNLTGTARYASCNTHLGIEQSRRDDLESLGYVLLYFLRGSLPWQNLKAAAATKKQKYDKICEKKVSTPIEVLCKSHPVEFASYFHYCHSLTFDQRPDYGFLKRLFRDLFAREGYDFDYVFDWTILKYQQSQKNVMLPPLSPVPGASNSRATPIDVDSHQGLNAYSGHVKERIRAGDATGSGVKIQFKSPVGKNLSYENPLDKNIFGEANIPSTSFSPASTSKRNSLKQSLSAEASNPGHAQGSKMGPSSSWMSSLQRMSSAK

SEQ ID NO: 3221 - protein, 513 aa, Glycine max
  misc_feature (60)..(60): Xaa can be any naturally occurring amino acid
  misc_feature (185)..(185): Xaa can be any naturally occurring amino acid
MANIDIEGILKQQQPYDGRVPKTKIVCTLGPASRSVEMTEKLLRAGMNVARFNFSHGTHXDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGXVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATERALCKPGDAVVALHRIGAASVIKICIVK

SEQ ID NO: 3222 - protein, 332 aa, Glycine max
MGSTPEVLAQRSCGKLIGTRLLQYLNGGPLSFKTHQAIVLIVTFFAYASYHATRKTTSIVKSVLDPQSAATGLTFFPFRPTNFTESNGSKRLSSNLGDGWAPFNGSDGTSLLGQLDVAFLAVYAFGMYFSGHFGDRCNLRIFLTVGMLGTGLFTSLFGVGYWGNIHNFYYYLIVQMIAGLFQSTGWPSVVAVVGNWFGKSKRGLIMGIWNAHTSIGNIAGSLIASAMLSYGWGWSFVVPGLMTAFVGLVVFLILPVTPESVGAREEDEFSCPIKSGEEAAEPLLRQETPVEEKEAVGFIEAWKIPGVAPFALCLFFAKLVAYTFLYWLPFYV

SEQ ID NO: 3223 - protein, 418 aa, Glycine max
LDQGSSIAMDIGGGVEEPVRELRQYFKTGKTKSVTWRKNQLTSLIDLVHENEDAIFKALHKDLGKHPVEAYRDEVGGVEKSASKALSCVEKWMAPKKICLTHFFLFQLRRPPPPQKWDKIFFTGSPRVASVVMSAAAKNLTPVTLELGGKCPAILDSLPNPLESKLAVKRIVGGKWGPCSGQACIAIDYLLVEKKFPYALIELLKKIIRRFYGENPVESKVISRILNKQHFERLCNLLKDPLVAASIVHGGSVDEENLFIEPTILLDPPLDSQIMSEEIFGPLLPIITMDKIQESIEFINAKPKPLAIYAFTKDETFKRNILSETSSGSVVFNDTMVQFLCDTLPFGGVGQSGFGRYHGKYSFDTFSHEKAVMHRKLFLEIEPRYPPWSKFKLEFIRLAYRLNYFGLLLHMLGLKRYK

SEQ ID NO: 3224 - protein, 72 aa, Glycine max
IDPRSEFPSLFKQPSPLLVEIPKVQPQFKPPFLGLTKTAEIWNSRACMIGIIGVFIVEFVSILYCILVSRIQ

SEQ ID NO: 3225 - protein, 661 aa, Glycine max
  misc_feature (53)..(53): Xaa can be any naturally occurring amino acid
  misc_feature (64)..(64): Xaa can be any naturally occurring amino acid
SKHPRGGTKPKYPGRPTRPRFSAALIMNKLDPERLGYIELWQLETILLQKDTXSLKKEGPKLHXSQALSQNLQGLRARSPIRRMSRRMLYYLQENWRRLWVLALWISAMIGLFTWKFIEYKRKNAYHIMGNCLLAAKGAAETLKFNMALILLPVCRNTITWLRSTKLAYVAPFDDNINFHKTIAAAVMIGVILHAGNHLACDFPRLVSSSEKDYKTYLDGVFGDHRPSYGDLVKGVEGVTGILMVILMAIAFTLATKWFRRNLIKLPKPFNRLTGFNAFWYSHHLFVIVYVLLIIHGVSLYLERRWHRQTTWMYLAVPILLYAGERTLRFFRSGFYTVRLIKVAIYPGNVLTLQISKPSQFRYKSGQYMFVQCPAVSPFEWHPFSITSAPDDDYLSVHIRQLGDWTQELKRVFSAACEPPVAGKSGLLRADETTKKCLPKLRIDGPYGAPAQDYRNYDVLLLVGLGIGATPFISILKDLLNNIIKMEELADSVSDSSRGSDLSTGSADSISSNKISPKRKKTLKTTNAYFYWVTREQGSFDWFKGVMNEVAELDQRGVIEMHNYLTSVYEEGDARSALITMVQALNHAKNGVDIVSGTRVRTHFARPNWKKVFSRICSKHCNGRIGVFYCGAPVLAKELSKLCFEFNEKGQTKFEFHKEHF

SEQ ID NO: 3226 - protein, 78 aa, Glycine max
PIKPNYVRAWANMGISYANQGMYDESIRYYVRALAMNPKAENAWQYLRISLSCASRNDMLEACDSRNLDLLQKEFPLQ

SEQ ID NO: 3227 - protein, 349 aa, Glycine max
IIEHVSSANTAKLLNDARYISETMKMGASLPAYRTFALEELKEATNNFDESSFISEGPRGQIYKGVLSDGMQIAIRGLKMRKKHGPQTYMHHVEMISKLRHSHLVSALGHAFESNQDDSSVNNVFLIFEFVPNKSLRSCVSGSSGEKLSWTQRITAAIGGVKGIQFLHTGIVPGLYSNNLKITDILLDNNHNVKISSYNLPLSAENKRMISKGTSPGLKGKVQARIQDADKNDVYDIGVVLLETILGRPIMFHNEVGTLKDLLQVSIKTDDIARRSIVDPAVHKECSDESLMTTMEICVRCLSGDPTERPSVENILWNLQFAAQVQNSWRRDSSDHDHSYSPAPSSRET

SEQ ID NO: 3228 - protein, 337 aa, Glycine max
  misc_feature (106)..(106): Xaa can be any naturally occurring amino acid
MVSDSIAAVPIPSAANTRNPGKKKRTNRSAKLKQYKIDARREQWLSQGAVKSKGYKDGLDDDGHAPPSPAEVKHSVEPLNTRRRGEEDDGLIHHDSDSESPTNCPXGVLCGTDSGTNFTGSSSGGSSSSSSSSSSSSGGCCSGNVTEVEEEEEGDDDDDDDDGCLDDWEAMADALAADDKRENPCPDSPPVVSPSEGSNLGSPNSKPESGRLFPWGSGNSRAWRADDAFRPQSLPNLSKQHSMPNPDRRGVPWGRAPTPSSCPICCEDLDLTDTSFMPCLCGFRLCLFCHKRILEEDGRCPGCRKPYECEPVETEASVLGDSLTLRLARSCSMIERS

SEQ ID NO: 3229 - protein, 338 aa, Glycine max
QIIPWNFPLVMFAWKVGPALACGNTIVLKTAEQTPLTALFVAKLFHEAGLPDGVLNVVSGYGPTAGAALASHMDVDKLAFTGSTDTGKVVLELAARSNLKPVTLELGGKSPFIICEDADVDKAVELAHFALFFNQGQCCCAGSRTFVHERVYDEFLEKSKKRALRRVVGDPFKKGVEQGPQIDVEQFEKVLRYIRSGIESHATLECGGDRLGSKGFFVQPTVFSNVQDDMLIAQDEIFGPVQSILKFKDIDEVIRRANKTRYGLAAGVFTKNVSTANTLMRALRAGTVWINCFDVFDAAIPFGGYKMSGIGREKGIYSLHNYLQVKAVVSPVKNPAWL

SEQ ID NO: 3230 - protein, 479 aa, Glycine max
  misc_feature (50)..(50): Xaa can be any naturally occurring amino acid
MASFIFTPVLFLLIISAVLLFLHRRSRCRRFRLPPGTLGLPFVGETLQLXSAYKSDNPEPFMDQRVKRYGPIFTTHVFGEPTVFSADPETNRFILLNEGKLFECSYPGSISNLLGKHSLLLMKGSLHKRMHSLTMSFANSSIIKDHLLVDIDRLIRLNLDSWSDRVLLMEEAKKITFELTVKQLMSFDPGEWTETLRKEYVLVIEGFFSVPLPLFSSTYRRAIKARTKVAEALTLVVRDRRKESVTEEKKNDMLGALLASGYHFSDEEIVDFMLALLVAGYETTSTIMTLAIKFLTETPLALAQLKEEHDQIRAKKSCPEAPLEWTDYKSMAFTQCVVNETLRVANIIGAIFRRAMTDINIKGYTIPKGWRVVASFRAVHLNPDHFKDARTFNPWRWQSNSEASSPGNVYTPFGGGPRLCPGYELARVVLSVFLHRIVTRYSWFPAEEDKLVFFPTTRTQKRYPIIVKRREESKLSKSP

SEQ ID NO: 3231 - protein, 257 aa, Glycine max
MAEIEGSPGSSMHGVTGREQTFVASIASPIVPTDTTAKFALPVDSEHKAKIFKLFSMANPHMRTFHLSWISFFTCFVSTFAAAPLVPIIRDNLNLTKSDIGNAGVASVSGSIFSRLAMGAVCDLLGIPFISRGSLGIISGLTGAGGNFGSGLTQLIFFSTSRFSTSTGLSLMGVMIVCCTLPVTLVHFPQWGSMFLPPSKDVNKSTEEYYYTAEWNEEEKQKGLHQNSLKFAENSRSERGKRVASAPTPPNTTPTHA

SEQ ID NO: 3232 - protein, 173 aa, Glycine max
MAAGVYNQPIVAFQSHSHINNLNHQQKFNNLVRLVTKDFIGSNFLSRRDCRVIQSLASQTSVVDTVSSPSKSKTSDRDTHKKSNEASLILIRHGESLWNEKNLFTGCVDVPLSKRGIDEAIEAGKRISSIPVDLIFTSALIRAQMTAMLAMTQHRRRKVPIIMHNESEQARGW

SEQ ID NO: 3233 - protein, 506 aa, Glycine max
  misc_feature (149)..(149): Xaa can be any naturally occurring amino acid
MASLSCSANDLAPLFNDTAAANYLCAQFDSISRKLNVTTYAVDNTYLLFSAYLVFAMQLGFAMLCAGSVRAKNTMNIMLTNVLDAAAGGLSYYLFGFAFAFGGPSNGFIGRHFFGLRKFPKDSPPSGDYSFFLYHWAFAIAAAGITSGXSIAERTQFVAYLIYSSFLTGFVYPIVSHWFWSSDGWASATRSHGNVLFGSGVIDFAGSGVVHMVGGIAVLWGALIEGPRIGRFDRSGRSVALRGHSASLVVLGSFLLWFGWYGFNPGSFLTIAKGYGSGGYYGQWSAIGRTAVTTTLAGSTAALTTLFSKWLLAGHWNVIDVCNGLLGGFAAITSGCAVVEPWAAIVCGFVAAWVLIWLNKLAAKVEYDDPLEAAQLHGGCGAWGVFFTGLFAKKVYVEEIYGVGRPFGALMGGGGRLLAAQVIQILVVCGWVTATMAPLFYGLHKMKLLRISRDDETAGMDLTRHGGFAYAYHDDEDGSSRGVGFMLRRIEPAASTTPSPPAAPQV

SEQ ID NO: 3234 - protein, 154 aa, Glycine max
MSFRHSIMNALPILLFFLFVSALVSAKKTGDVTELQIGVKHKPVSCEVQAHKGDRVKVHYRGKLTDGTVFDSSFERNNPIEFELGTGQVIKGWDQGLLGMCLGEKRKLKIPAKLGYGDQGSPPTIPGGATLIFDTELVGVNDKSLGEEKENSEL

SEQ ID NO: 3235 - protein, 247 aa, Glycine max
MAGIAFGSFNDSVSFASIKAYIAEFISTLLFVFAGVGSAIAYAKLTSDAALDPTGLVAVAICHGFALFVAVSVGANISGGHVNPAVTFGLALGGHITILTGLFYWIAQLLGSIVASLLLKFVTGYDTPIHSVAAGIGAGEGVVTEIIITFGLVYTVYATAADPKKGSLGTIAPIAIGFIVGANILAAGPFSGGSMNPARSFGPAVVSGDFHDNWIYWVGPLIGGGLAGLIYTYAFIPTNHAPLATEF

SEQ ID NO: 3236 - protein, 248 aa, Glycine max
MANKEFKVPPVAFPSAGNPAAAGPNLQQRRMPTPPFQPNSGIPFMSFDIGSAAASTSSGPIYTGPAVGPGGSANFDDEEPLLDELGIHPDQIWSKIRSVLNPFRVNHTVHKDSDLSGPILLYMSFCLFQLLAGKIQFGVILGWIVVSSIFLYVVFNMLAGRTGNLDLHTCTSVVGYCLLPVVIFSALSLFLPVDGVIRLSVASVFVLWATRASAGLVVSLADGGDEHRGLIAYASFLIYTLFSLLVIF

SEQ ID NO: 3237 - protein, 326 aa, Glycine max
MSILEILKQSNSYLPHVLIASILLALIYPPSLTWFTSRYYAPALGFLMFAVGVNSNENDFLEAFKRPAEIVTGYFGQFAVKPLLGYLFCMIAVTVLSLPTTVGAGIVLVACVSGAQLSSYATFLTDPQMAPLSIVMTSLSTASAVFVTPLLLLLLIGKKLPIDVRGMVYSITQIVVVPIAAGLLLNRFYPRICNVIRPFLPPLSVLVASICAGAPLALNVETMKSPLGVAILLLVVAFHLSSFIAGYILSGFVFRDSLDVKALQRTISFETGMQSSLLALALANKFFEDPKVAIPPAISTSIMSLMGFVLVLIWTRRGKSEIKNSS

SEQ ID NO: 3238 - protein, 236 aa, Glycine max
MATLDERPSAKRWLPLEANPEVMNQFLWGLGLPLDEAECCDVFGLDEELLEMVPKPVLAVLFLYPITAKSEEERLQQENEKKDYSSKVYFMKQTVGNACGTIGLLHALGNITSEVKLVEGSFFDKFFKSTASMDPLQRAVFLENDREMEVAHSVAATAGDTVASDNVDTHFICFACVDGELYELDGRKSGPISHGPSSPSTLLRDAAKVIQSMIQKNPGSLNFNVIAISKKSKDGH

SEQ ID NO: 3239 - protein, 326 aa, Glycine max
EFGTSKGRVCVTGGTGFIGSWIIKRLLEDGYSVNTTVRPDPEHRKDVSFLTSLPRASQRLQILSADLSNPESFIASIEGCMGVFHVATPVDFELREPEEVVTKRSIEGALGILKACLNSKTVKRVVYTSSASAVDNNKEEIMDESSWNDVDYLRSSKPFGWSYSVSKTLTEKAVLEFGEQNGLDVVTLIPTLVFGPFICPKLPSSVRNSLDFILGEKGTFGVVLQTDMVHVDDVARAHIFLLEHPNPKGRYICSQCSVTYERISKLVSAKYPEFQPPPVESLNHIEGTKGSYLSSKKLIDAGFVYKYGLEEMVDDAIQCCKEKGYL

SEQ ID NO: 3240 - protein, 139 aa, Glycine max
MPSAEASSETICVTGAGGFIASWMVKLLLEKGYTVRGTLRNPDDPKNGHLKEFEGASERLTLHKADLLHLDSVRSVINGCHGVFHTASPVTDNPEEMVEPAVSGAKNVIIAAAEAKVRRVVFTSSIGAVYMDPSRSIDL

SEQ ID NO: 3241 - protein, 64 aa, Glycine max
MAGPRIAHATLKGPSVVKEIIIGITLGLAAGGVWKMHHWNEQRKTRTFYDLLEKGEITVVAEEQ

SEQ ID NO: 3242 - protein, 160 aa, Glycine max
  misc_feature (138)..(138): Xaa can be any naturally occurring amino acid
  misc_feature (145)..(145): Xaa can be any naturally occurring amino acid
MKAIVITRPGGPEVLQLEEVEDPQVGDDELLIGVPATSLTRADTFQRKGSYPPPKGASPYLGLECSGTVLSLGKNVSSWKIGDQVCALLAGGGYAEKVAVPVGQVLPVPAGVSLTDAASFPEVACTVWSTVFMMSRLXQGETLLXHGGSSGIGTFAIQIA

SEQ ID NO: 3243 - protein, 139 aa, Glycine max
  misc_feature (5)..(6): Xaa can be any naturally occurring amino acid
  misc_feature (58)..(58): Xaa can be any naturally occurring amino acid
SIHRXXTNLDESSFNSQAEHTGRNLLQAKKSCPVNFEFLNYTIITCKCKGAQYPPSNXCGIERVVACPYANVLNDLTNDCATIMFSFINLYGKYPPGFFASMCNEGKKGITINCLPAAAASPPSVSADDTGMKTHQMRV

SEQ ID NO: 3244 - protein, 781 aa, Glycine max
MANRHHPSVFLVLVTVLLSIHCSEQLQSSHSQTLLRIQQLLNFPAALSNWNSNTDFCNTDSNSSLTVVCYEDTITQLHIIGERRDTPLPRNFSIDSFVTTLVRLPSLKVLTLVSLGIWGPLPSKIARLSSLEIVNMSSNFLYGSIPQELSSLSSLQTLIFDNNMLADTFPHWLDSLQALTVLSLKNNKFNGSLPKSLGNVENLRTLSLSHNHFYGAVPDLSRLTNLQVLELDDNAFGPQFPQLGNKLVILVLRKNSFRSGIPAELSSYYQLERLDISSNSFVGPFQPGLLSLPSITYLNISGNKLTGMLFENLSCNSELDVVDLSSNLLTGSLPRCLVSNSSDSTVLYARNCLDTTNQNQQPQPFCHTEALAVGILPETKKHKQVSKVVLSLGIVGGTLGGVALVLLVFFIVRRGNDRSKTKNPPTRLISENAASGYTSKLFSDARYISQTKKLGAVGLPTYRSFSLEEIESATNYFDTASLMGEDSYGKMYRGQLKNGSLVAIRCVEMKKRHSTQNFVQHIELISKLRHRHLVSAIGHCFECSLDDSSVSKVFLVFEYVPNGTLRNWISDEHARKSLSWTQHIGAAIGVAKGIQFLHTGIVPGVYSNDLKIEDVLLDQNLVAKISSYHLPLLSNMGKVRRGNSSSGLRNSSNSKSVKQEDKSDIYNFGVILLELILGRQIKTVNDADAFRDLLQASLGGDEEGRRGVVDPAFRKACLDQSLKTMMEICVRCLVKEPADRPSIEDVLWNLQFASQVQDAWRGDSQSSEGSPGSESRGLPFH

SEQ ID NO: 3245 - protein, 345 aa, Glycine max
  misc_feature (145)..(145): Xaa can be any naturally occurring amino acid
  misc_feature (164)..(164): Xaa can be any naturally occurring amino acid
MTQAQIQPVKLGTQGFEVSKLGFGCMGLTGAYNDPLQEQDGISVIKYAFSKGITFFDTADVYGANANELLVGKALKQLPREKIQIATKFGIASRGFPDMKIKGSPEYVRSCCEASLKRLDVEYIDLYYQHRVDTSVPIEETVGEXLKKLVEEGKVKYIGLSEAXPDTIRRAHAIHPITAVQIEWSLWTRDIEEEIVPLCRELGIGIVPYSPLGRGFFGGKGVVENVPTNSSLKAHPRFQAENLDKNKNIYERIEGLAKKHQATPAQLALAWVLQQGEDVVPIPGTTKIKNLDQNIGALAVKLSEKDLREISEAVPIGDVAGGRYYNGLDHFSWKDANTPPKDPRV

SEQ ID NO: 3246 - protein, 176 aa, Glycine max
  misc_feature (94)..(94): Xaa can be any naturally occurring amino acid
YCENLWSEDQISRRVFELAAEISDDFGGHSPAPVVVGVATGAFLFLADLVRKIDLSIAVDFVRVESYGSGTVSNGAPTISFDLKVDVNSRHVIXDTGHTLSKVIEHLKSKGASSVSVCTFLDKPARRKVHFQLVGEGKYYRGFECPNYFVVGYGLDFAELYRNLPYIGVLKPELYK

SEQ ID NO: 3247 - protein, 295 aa, Glycine max
MGKSTNNNRDWTQMYAIYGMEQWQTLIFLLCQAMLFSVLSVLYLLYFDLVCSFFERIFSGGGGGTARFAAGITGSVTALSALCLFFAAANFFYSSVPLHFDMAQRIVSAVHDWSSVKLALDLGCCGRGILLNAVATQLKKEGSSGRVVGLDRSKRTTLSTLRAAKMEGVGEYVTCREGDARRLPFPDNYFDVVVSGVFVHTVGREYGARTAEAAAERMRAVAELVRVMKPGGVAVVWDLLHVPEYVLRLQELKMEDVRVSERVTAFMVSSHIVSFRKPSQHVHGPAEVRLDWRLC

SEQ ID NO: 3248 - protein, 145 aa, Glycine max
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGKAPKSPRR

SEQ ID NO: 3249 - protein, 45 aa, Glycine max
RSSIILPLSGLKQFHEIVGHFVEITKDRIEGMTVANVRTVDPPQR

SEQ ID NO: 3250 - protein, 156 aa, Glycine max
VSLRGRPSSEFTLVTADVEEKSVIIGERNRVAIEALRAAMDKGHNKIAILYGGGHMPDLGRRLREDFDLVPSNVQWITAWSITKKDLNTDSFPFLKTIAKASGWPLNRYQTLALLIFSSVLALDLWFWELFFGTAVNWVSELGSELLRYVDNSPMI

SEQ ID NO: 3251 - protein, 201 aa, Glycine max
  misc_feature (68)..(68): Xaa can be any naturally occurring amino acid
RTEGARPSSTNPTPSANSNDDAKCRRLGLQVVSSLRRDRANVKKAAAMGSGVLSREVSKLSKGIAHIXEVVQLDEAGGSDESSQKFRESMNKFMRMAEEEILKVQAQESVALSLVKEITEYFHGNLSKEEAHPFRIFMVVRDFLTVLDRVCKEVGMINERTMVSSAHRFPVPVNPMLPQPLPGLVGKRQYNSSDDDDSSSP

SEQ ID NO: 3252 - protein, 356 aa, Glycine max
MVCSSCVRSLVVQAGTFVNRVRINEFGRSLLAVQSFSHWPIREYKTITGMMVDTGSMSSAGPLVDMMPEKDDDGRFASGGWKSEDGRLSCGYSSFRGKRVTMEDFYDIKTLKIGGQSICLFGIFDGHGGSRAAEYLKEHLFDNLLKHPNFLTDAKLAISETYQQTDANFLDSEKDTFRDDGSTASTAILVDSHLYVANVGDSRTIISKAGKAIALSEDHKPNRSDERKRIENAGGVVMWAGTWRVGGVLAMSRAFGNRMLKQFVVAEPEIQDQEIDEQIELLILASDGLWDVVQNDDAVSLARTEEEPEAAARKLTEAAFSRGSADNITCIVVRFHHEKAEVANPDKAESTSTQHE

SEQ ID NO: 3253 - protein, 218 aa, Glycine max
MATQSYLLNLNTFHVHAGIRGRQCKPLIFKPTNFGFGVWKSSKYHTKRNVNDNSGVMQCCSCYTEVGASAGITISSLVDAATTQISLNSDVDLNTLKLSMPETSHASSDFMTRLVLADLDPATAKLAIGFLGPFLSVFGFLFIVRIVMSWYPKLPVGKFPYVIAYAPTEPLLIPTRKVIAPLAGVDVTPVVWFGLISFLNEILVGPQGLLVLLSQQVN

SEQ ID NO: 3254 - protein, 662 aa, Glycine max
MEGENASNKVIELMNEIASISDYRPPVKKQYCNLARRLKLLIPMFEEIRDMNKDALPDNTSNAVLAFKEALESAMELLRFGSEGSKLYLVLERDEIMNKFYKVTAQLEQSLGGISYDKLDISDEVKEQVELVLAQFRRAKGRVDEPDVRLYEDMLSVYNNSSDAATDPSVLSQLAEKLKLMGIADLTQESLALHEMVASSGGDPGARIEKMSMLLKKIKDFVQIENLVKDDNLGGKGIFSKVYGLGTNEKSHQAPVIPDDFRCPISLELMKDPVIVSTGQTYERTCIEKWLQAGHGTCPKTQQTLTSTVLTPNYVLRSLIAQWCEANGIEPPKRPSDSQPSKSASAYSPAEQSKIGSLLQKLISVSPEDQRSAAGEIRLLAKRNADNRVAIAEAGAIPLLVSLLSVPDSRTQEHAVTALLNLSIYENNKGSIVSSGAVPGIVHVLKKGSMEARENAAATLFSLSVIDENKVTIGSLGAIPPLVTLLSEGNQRGKKDAATALFNLCIYQGNKGKAVRAGVIPTLMRLLTEPSGGMVDEALAILAILASHPEGKATIRASEAVPVLVEFIGNGSPRNKENAAAVLVHLCSGDQQYLAQAQELGVMGPLLELAQNGTDRGKRKAGQLLERMSRLVEQQQEVPIQTETQAQNEDTQPPLITNPDDS

SEQ ID NO: 3255 - protein, 202 aa, Glycine max
  misc_feature (94)..(94): Xaa can be any naturally occurring amino acid
  misc_feature (101)..(101): Xaa can be any naturally occurring amino acid
MASLSCQVHSTNLLNSKNVNSRRKRLIFCSAQPTQNNIKVVINGAAKEIGKAAVVAVTKARGMEVAGAVDTCHIGEDIGKICGMEELLEIPIIXMNPTIDXLGSISQSKAAGVVVDFTDPSSVYDNVKQATAFGMKSIVYVPRIKLDTVAALSAFCEKASMGVLVAPTLSIGSILLQQAAISASFHYSNVEIVESRANANDL

SEQ ID NO: 3256 - protein, 161 aa, Glycine max
TREHPHACPSKIDPVRQLDWKNFQQSSEIIDVLSTIHSEIPRGVVLGDYVIEYGDDDSADEFEDFPGDEGNWWTSCILYHAFNNFRSSRNRRRTRVGDQSRVNRHLSSDTSNSDEGSVASVEYGEYRLDEIDDDFVSTIGHLRGESGFRRSRRRHSRSNDN

SEQ ID NO: 3257 - protein, 270 aa, Glycine max
DEVHWGSLGRDLENVRKYYGSGKTKEASWRESQLKGLHNFLVEKEEEILRALKHDLGKHYVEAFRDEVGTLMKTLNLASKSLKNWMAGKEAKLPRIALLSSAEIVPEPLGLVLIISSWNFPFGLSLEPLIGAIAAGNSVVLKPSELSPTCSSLLATFLPTYLDNNAIKVIQGGPEVGELLLQQRWDKIFFTGSARVGRIVMSAAAVHLTPVTLELGGKCPAIIDSLSSSWDKEVAVKRILVAKFGACGGQACIAIDYVLVEKSFSSTLGH

SEQ ID NO: 3258 - protein, 338 aa, Glycine max
TSINNVTEVVFLGQLRHPHLVKLIGYCCEEEHRLLVYEYLPRGSLENQLFRRYTASLPWSTRMKIAAGAAKGLAFLHEAKKPVIYRDFKASNILLDSDYNAKLSDFGLAKDGPEGDDTHVSTRVMGTQGYAAPEYIMTGHLTAMSDVYSFGVVLLELLTGRRSVDKGRPQREQNLVEWARSALNDSRKLSRIMDPRLEGQYSEVGARKAAALAYQCLSHRPRSRPLMSTVVNVLEPLQDFDDVPIGPFVYTVPAEQQQYNEVAKESETPKERKRENGHHHNRRHHHHRHNGHRHHPLKSPKTPMPSDQSQNDEHRNGRKSGSNSPDTFNASEAQRSMG

SEQ ID NO: 3259 - protein, 252 aa, Glycine max
HFEQEFSDPRDADDARYSLDGRDVEGSRIIVEFAKGGPRGSRENLGRGLPPGSGRCFNCGIDGHWARDCKAGDWKNKCYRCGERGHIEKNCKNSPKKSSRHGRSLSRSPVRSHSPRRGRSRDRSYSRDRNYSRSRSPVRRERSPVSEDRSQSPEPSKIRKHSTSPDQSSPRKRGDPAPGNDRLATLQDGSDYSDGPRGKSRSPASPARDHDEGNYDSPKASGRSHSPSRSPREDDRSPIDEDDDNNRRSGSP

SEQ ID NO: 3260 - protein, 559 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIASGGGRMNVTMDRYENDWSVVKRGWDAQVLGEAPYKFTNALEAVKKLRAEPKANDQYLPPFVIVDESGKPVGPIVDGDAVVTFNFRADRMTMIAKALEYENFDKFDRVRYPKIRYAGMLEYDGELKLPSHYLVSPPEIDRTSGEYLVYNGIRTFACSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNNVPTGGLANVAATVMNLHGFEAPSDYETTLIEVVDN

SEQ ID NO: 3261 - protein, 260 aa, Glycine max
  misc_feature (217)..(217): Xaa can be any naturally occurring amino acid
ENFDKFDRVRYPKIRYAGMLEYDGELKLPSHYLVSPPEIDRTSGEYLVYNGIRTFACSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTPDHGNAEDMVNMGLSGKPTSGNGWRLHILCLPSLGPWAIAIGGPGLXPGVRFRNNVPPGGLATVTATVMNLHGFEAPSDYESTLIEVVDN

SEQ ID NO: 3262 - protein, 327 aa, Glycine max
MAEGKGRVCVTGGTGFLGSWIIKRLLEDGYAVNTTIRSDPGRKRDVSFLTNLPGASEKLKIFNADLSDPESFGPAVEGCVGIFHTATPIDFAVNEPEEVVTKRAIDGALGIMKAGLKAKTVKRVVYTSSASTVSFSSLEEKDVVDESVWSDVDLLRSVKPFSWSYAVSKVLSEKAVLEFGEQNGLEVTTLVLPFVVGRFVCPKLPDSVERALLLVLGKKEEIGVIRYHMVHVDDVARAHIFLLEHPNPKGRYNCSPFIVPIEEIAEIISAKYPEYQIPALEEVKEIKGAKLPHLTSQKLVDAGFEFKYSVEDIFTDAIECCKEKGYL

SEQ ID NO: 3263 - protein, 164 aa, Glycine max
MAEEHRCQAPEGHRLCSNNCGFFGSPATMNLCSKCYRDIRLKEEEQAKTKSTIETALSGSSSATVAVASAVDSLPAPVESLPQPSVVSSPDVAAPVQANRCGACRKRVGLTGFKCRCGTTFCGTHRYPEKHASKHACGFDFKAVGRKKIARANPVIKGEKLRRI

SEQ ID NO: 3264 - protein, 160 aa, Glycine max
MAEEHRCQAPEGHRLCSNNCGFFGSPATMNLCSKCYRDIRLKEEEQAKTKSTIETALSGSSSATVAVASAVDSLPAPVESLPQPSVVSSPDVAAPVQANRCGACRKRVGLTGFKCRCGTTFCGTHRYPEKHACGFDFKAVGREEIARANPVIKGEKLRRI

SEQ ID NO: 3265 - protein, 160 aa, Glycine max
MAEEHRCQAPEGHRLCSNNCGFFGSPATMNLCSKCYRDIRLKEEEQAKTKSTIETALSGSSSATVAVASAVDSLPAPVESLPQPSVVSSPDVAAPVQANRCGACRKRVGLTGFKCRCGTTFCGTHRYPEKHACGFDFKAVGREEIAPANPVIKGEKLRRI

SEQ ID NO: 3266 - protein, 135 aa, Glycine max
MATTACFIIVSRNDIPIYEAEVGVAAKREDSAQLHQFILHAALDIVQDLAWTTSAMYLKSVDRFNELVVSVYVTAGHTRFMLLHDSRNDDGIKSFFQEVHELYIKTLLNPLYLPGSRITSSHFDTKVRALARKYL

SEQ ID NO: 3267 - protein, 126 aa, Glycine max
CTKVDNWVGDRCIRPTPEELENFGTPDFTIYNAGQFPCNRYTHYMTSSTSIDLNLARREMVILGTQYAGEMKKGLFSVMHYLMPKRQILSLHSGCNMGKDGDVSLFIGLSGARKTTLSANHNRVFM

SEQ ID NO: 3268 - protein, 315 aa, Glycine max
MWWLGRKGPSGFSASSTAEEVTQGIDGSDLTAIVTGATSGIGVETARALALRGVHVVMGIRNMTAGGEIKETILRYNPIAKIDMMELDLSSMESVRTFASQFNSRGLPLNILVNNAGIMATPFKLSKDKIELQFATNHIGHFLLTNLLLETMKRTAIEQRKEGRVVNVSSRRHKLSYPEGIRFDKINDKSGYNSLSAYGQSKLANVLHTNELARRLKQEEGTNITANSVSPGPIATNLFRYHSLMEVFVGILGKYAMKNIQQGAATTCYVALHPQVKGLTGCYFADSNLAEASSQASDPEVARKLWEYSSDLVKF

SEQ ID NO: 3269 - protein, 317 aa, Glycine max
  misc_feature (105)..(107): Xaa can be any naturally occurring amino acid
  misc_feature (163)..(170): Xaa can be any naturally occurring amino acid
  misc_feature (215)..(216): Xaa can be any naturally occurring amino acid
PFRFGIKLHLVFSKLEIDDLRRNEVFARESIPIWLACTGYILFSIVSIIVIPLMFPQLKWYYVVFAYLFAPSLGFCNAYGAGLTDMNMAYNYGKVALFVLSALAXXXDGVVAGLVGCGLIKSIVSISSDLMHDFKTGHLTFTSPRSMLLSQAIGTAIGCVVAXXXXXXXXKAFDVGNPDGDYKAPYAIIYRNMAILGVEGFSALPHHCLQLCYGXXTFAIAANLVRDLGPKNIGKWIPLPMAMAVPFLVGGYFAIDMCMGSLVVYAWQTLKSKEASLMVPPPASGLICGDGFWILPSSILALFKVHPPICMRFLPTK

SEQ ID NO: 3270 - protein, 155 aa, Glycine max
  misc_feature (49)..(51): Xaa can be any naturally occurring amino acid
  misc_feature (63)..(63): Xaa can be any naturally occurring amino acid
  misc_feature (99)..(101): Xaa can be any naturally occurring amino acid
TNIYTCSVSMHDDLRRNEVFARESIPIWLACTGYILFSIVSIIVIPLMXXXLKWYYVVFAYLXAPSLSFCNAYGAGLTDMNMAYNYGKVALFVLAALAXXXDGVVAGLVGCGLIKSIVSISSDLMHDFKTGHLTFTSPRSMLLSQAIGTAIGCVV

SEQ ID NO: 3271 - protein, 168 aa, Glycine max
  misc_feature (139)..(139): Xaa can be any naturally occurring amino acid
MSGTVKKVSDVAFKVGRNIDWDGMAKLLVSDEARREFSNLRRAFDEVNSQLQTKFSQEPEPIDWDYYRKGIGTRLVDMYKEHYESIEIPKFVDTVTPQYKPKFDALLIELKEAEEKSLKESERLEKEIAEVQELKKKLXTMTADEYFEKHPELRKKFDDEIRNDNWGY

SEQ ID NO: 3272 - protein, 178 aa, Glycine max
  misc_feature (93)..(93): Xaa can be any naturally occurring amino acid
  misc_feature (122)..(122): Xaa can be any naturally occurring amino acid
  misc_feature (125)..(125): Xaa can be any naturally occurring amino acid
  misc_feature (144)..(144): Xaa can be any naturally occurring amino acid
  misc_feature (165)..(165): Xaa can be any naturally occurring amino acid
  misc_feature (174)..(174): Xaa can be any naturally occurring amino acid
  misc_feature (177)..(177): Xaa can be any naturally occurring amino acid
MASSMISSPAVTTVNRAGAGMVAPFTGLKSMAGFPTKKTNNDITSIASNGGRVQCMQVWPPIGKKKFNTLSYLPDLNNTQLAKEVEYLLKKRXIPYLQFDLNHNFIYHNHNESPRYYNKLYXTIXNLPIFNYTNTSHVCKDLQXTKTTYPSNCIPIIRFYNSHQXQYINFISYXPAXF

SEQ ID NO: 3273 - protein, 178 aa, Glycine max
  misc_feature (115)..(115): Xaa can be any naturally occurring amino acid
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPXYYDGRYWTMWKLPMFGCTDASQVLKELQEAKTAYPNGFIRIIGFDNVRQVQCISFIAYKPPGF

SEQ ID NO: 3274 - protein, 183 aa, Glycine max
  misc_feature (64)..(64): Xaa can be any naturally occurring amino acid
  misc_feature (124)..(124): Xaa can be any naturally occurring amino acid
  misc_feature (141)..(141): Xaa can be any naturally occurring amino acid
MEESVLTKRPREEEPLENKDSTYELLESLSKRHRSYNHILSLLESEEDDSTQDLSSLITSLQKXITNWASDSDTLLNQHRLTNTTTTTTTNSDLEDCSSSTTKYSSDMMEEHDDKEGVMRHLLXITENRVGIPNKEDVFSXLGEDGFKFNGGDMFSSICDGLLWELEDEAANYYDLLQSQLFL

SEQ ID NO: 3275 - protein, 510 aa, Glycine max
MAEVRGRDTWTEELASLIEDSGVRYGGDSPPTSFEVHAPQSESGESLKEQALGFVMAWCEILMELGRGFRDILRQNLINEDSYVVRKFGGPCSKVSKRLRFLNDFLPEDRDPFHAWSVVFFVFILALAAISVDPNREAVAPVVKVRQHPPSASRVLLPDGRYMAYHEQGVLADTARFSLVAPHSFLSSRLAGLPGVKASLLEEYGIRLVTYDLPGFGESDPHPNRNLNSSAMDVLHLVNAVNVTDKFWILCHSSGCIHAWASLRYIPEKIAGAAMLAPMINPYDPHMTKEEMKRTWEKWLPRRKMMYSLARRFPKLLSFFYRKSFLPEQHDEIDKLLSVSPGKKDKLVTEEPEFEEFWQRDVEESVRQGNIRPFIEEAVLQVSNWGFDIKELHVQKKCQTRGILLWLKSMYSQAGCELAGFLGLKHIWQGLDDRVVPPSMMEYIERVLPEAVIHKLPNEGHFSYFYLCDQCHRQIFTTLFGTPQGPVERQEETATAFEEEDKEEVLQVPV

SEQ ID NO: 3276 - protein, 205 aa, Glycine max
TCALVYGPTPTGRIHKGVCSTWMKNAIPLEKSPDCSWAPIFIRPSNFKLPVDHSIPIIMVGPGTGLAPFRGFLQERFALKEAGVQQGPAILFFGCRNRRLDFIYEEELKNFVEQGSLSELIVAFSREGAEKEYVQHKMMDQAAQLWSLISQGGYLYVCGDAKGMARDVHRTLHTIVQQQENVDSTKAEAIVKKLQMDGRYLRDVW

SEQ ID NO: 3277 - protein, 146 aa, Glycine max
FGSSLDVESSHGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 3278 - protein, 227 aa, Glycine max
MASAKRWLPLEANPDVMNQFLWGLGLREDEAECCDVYGLDEELLEMVPKPVLAVLFLYPITTQSEEERLQQENEKKEYNSRVYFMKQTVGNACGTIGLLHALGNLTSEVKLVEGSFFDNFFKSTASLDPLQRATFLENDKEMEVAHLVAATAGDTEASDNATAHFICFACVDDELYELDGRKSVPISHGPSSPSTLLRDAAKAIQSMIQKNPDSFNFNVIALCKKSG

SEQ ID NO: 3279 - protein, 499 aa, Glycine max
MSKEEFLKIQKCVLKVNIHCDGCKHKVKKILQKIDGVFTTEIDAEQGKVTVSGNVDPNVLIKKLTNVRKHAKLWGAPKPNNNNNHNHNNQNHLADQFKNMHINHHKDAGGNHNNKGQHQIQNQPKGGGGNNQPKGGSGGGGGQQQGPTPQQQLQLQLQQQQRLQQQLEQLHRMKGLQDLNLPQFKDLKLTPHNPNLNPNAKAVKFDIPEEDDDFTDDELDDFDDDFDDFDDDFDDDEMDDLPPSKMKLPPMMMNAPPKGASNGGDGKKGGGPVPVPVQVHGIPGNGGGKKGGGGGGNNQNQGGGNKNNGGKNGGGAPEGKHGGGGGGGNKNGNGNNGAATRPRTRGKKGNPMGGVGVQPMNGGFQNMGGDGGPQVMMSGRNVGPMSMPMPNIPAVQGLPAGPVNGGGYFQGAGPEAMPGNPFHQQQQQQQQQQQLQQQQQYMAAMMNQQRAIGNDRFQPMMYARPPPAVNYMYPPYPYPPPDPYTHFFSDENTSSCNVM

SEQ ID NO: 3280 - protein, 391 aa, Glycine max
LCSALISFIFISMATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPVAPLEKVCLLGCGVSTGLGAVWNTAKVESGSIVAIFGLGTVGLAVAEGAKTAGASRVIGIDIDSKKFDVAKNFGVTEFINPNEHDKPIQQVIIDRTDGGVDYSFECIGNVSVMRAALECCHKGWGTSVIVGVAASGQEISTRPFQLVSGRVWKGTAFGGFKSRSQVPWLVDKYLKKEIKVDEYITHTLTLSEINKAFDLLHEGGCLRCVLSTQE

SEQ ID NO: 3281 - protein, 54 aa, Glycine max
  misc_feature (36)..(37): Xaa can be any naturally occurring amino acid
SPLAQNVVFRDLPLRDVLFVSERKVIGVGFDCNPMXXAADERGIWYVQIHILVF

SEQ ID NO: 3282 - protein, 421 aa, Glycine max
  misc_feature (39)..(39): Xaa can be any naturally occurring amino acid
SQSKGRQRSRKSKKPRWKKKRLKKRKTDHVGLSGALETXCGQGFGAKEYQMLGIYLQASCIISLIFSIIISIIWFYTEPILVLLHQSPDIARTAALYMKFLIPGVFAYSFLQNILRFLQTQSVVIPLVVLSALPMLVHIGVAYGLVQWSGLSFTGAPVAASISLWISLLLLALYVMYAKKFKQTWKGFSTHSFRYVFTNMRLALPSAAMVCLEYWAFEVLVFLAGLMPDSQITTSLIAICINTEFIAYMITYGLSAAASTRVSNELGAGNPERAKHAMSVTLKLSLLLGLCFVLALGFGHNIWIQFFSDSSTIKKEFASVTPLLAISILLDAIQGVLSGVSRGCGWQHLAAYINLATFYLIGLPISCFLGFKTNLQYKGLWIGLICGLLCQSGTLFLFIRRAKWTKLDLSRDNDKERPLVV

SEQ ID NO: 3283 - protein, 149 aa, Glycine max
MASNPETYKPYGKQPVKGQWTTGLYDCWDDPSHCCFTWFCPCITFGQIAEIVDGGTISKNAACCIYVDSHGTKWLYGATYRSKLRRLFSLSQEPYSDPFLHGCCCICALTQEYKELKNRGIDPSIGWEGNVEKWKREGVDPPIVPTMSR

SEQ ID NO: 3284 - protein, 379 aa, Glycine max
MSTAGQVIKCRAAVAWEAGKPLSIETIEVAPPQKGEVRLKILFNSLCRTDVYWWDAKGQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 3285 - protein, 487 aa, Glycine max
  misc_feature (193)..(193): Xaa can be any naturally occurring amino acid
  misc_feature (227)..(227): Xaa can be any naturally occurring amino acid
MASAAAPTTFSLLHSATPASSSSATSASPSPSRVQLSSSLRARPLRRLGFAAADPLLAANVAARVAAVRGGGKGARGVVSMAKKSVGELSAADLKGKKVFVRADLNVPLDDNQNITDDTRIRAAIPTIKHLIQNGAKVILSSHLGRPKGVTPKYSLAPLVPRLSELIGIQIVKAEDSIGPEVEKLVASLPDGXGVLLLENVRVLKRYEEKNEPEHAKKLASLADLYXNDAFGTAHRAHASTEGVTKYLKPSVAGFLLQKELDYLVGAVSNPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 3286 - protein, 485 aa, Glycine max
MASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQVVKAEDSIGPEVEKLVASLPDGGVLLLENVRFYKEEEKNDPEHAKKLASLADLFVNDAFGTAHRAHASTEGVTKYLKPSVAGFLLQKELDYLVGAVSSPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 3287 - protein, 342 aa, Glycine max
MNEPTRKYRKKNEEGSRSTQKNNKKKELKSILTSLLFVDAGEKNEEQHKKKEDLMDGYYSEVEESNYPKKRKKLAGGDSGSLRRVWVKERSGAWWEECNKPEFPEQEFKKAFRMRRLTFEAICEELNSVIAKEDTTLRTAIPVKQRVAVCLWRLATGDPLSVVSRRFGLGISTCHKLVLEVCTAIKTVLMPKYLQWPNVVALRDIKGEFENISGIPNVVGSMLTSHVPIIAPKMNVSAYFNKRQTERNHKTSYSVTVQGVVDHRGVFTDVCIGWPGSMGDDQVLEKSSLFHRANNAGLNLSGVWVVGGCGYPLLDWVLVPYTQQNLTWTQHSFNEKIGEVRR

SEQ ID NO: 3288 - protein, 152 aa, Glycine max
MSQLLEKAKNYVAEKVTNMPKPEASVTDVDFKRVSRDSVEYLAKVSVQNPYSTSIPICEIKYSLKSAGREIAAGTIPDPGSLKASDTTMLDVPVKVPHSILLSLAKDIGADWDIDYQLDIGLVIDLPVIGNFTIPLSQKGEIKLPTLTDMFA

SEQ ID NO: 3289 - protein, 176 aa, Glycine max
MRVGLGVKVSLGVIGVSLIFAVLKMSQLLEKAKNYVAEKVTNMPKPEASVTDVDFKRVSRDSVEYLAKVSVQNPYSTSIPICEIKYSLKSAGREIAAGTIPDPGSLKASDTTMLDVPVKVPHSILLSLAKDIGADWDIDYQLDIGLVIDLPVIGNFTIPLSQKGEIKLPTLSDMFA

SEQ ID NO: 3290 - protein, 162 aa, Glycine max
  misc_feature (20)..(20): Xaa can be any naturally occurring amino acid
  misc_feature (85)..(85): Xaa can be any naturally occurring amino acid
MPSPSDHHRPQPKPNPNLLXLFLKPIIMLLLTSLFFLFFGFAAFLLLNLFLLGGAFHRLRFRPSVTTAPTSSNGLPPREINKLPXFVCLDAFHNAQWCRKLAACGHVFHRRCVDTWLLKVAACPTCRTPVGFNAGATVHDPPQRSDHLHTCGTDSNALTTLL

SEQ ID NO: 3291 - protein, 426 aa, Glycine max
  misc_feature (362)..(362): Xaa can be any naturally occurring amino acid
  misc_feature (399)..(400): Xaa can be any naturally occurring amino acid
  misc_feature (409)..(409): Xaa can be any naturally occurring amino acid
  misc_feature (412)..(412): Xaa can be any naturally occurring amino acid
MSSNSSRTEPIAQNIIKLISNLCFSVFVFSVLIFTVIAITYHPPDPWLESTPALTNLFTQSQNATFRIDSSVLKTGEDLAPSPQDPPLPSPPPSASAVTEAVIEKSEQQIANSTANSTADSTDSTDAALPSPPACDGTINCSNPRVRIAIQRFNLRAFKSIAFFDYQPPVNGSVAGECDVAWRFRNKRERSWRKYRDFRRSRIAVTDDCRYKVVHAGGWHSGANARRNMTRSGAARGGKTLPPRASARDDEINDTIPTLGSETNFRNGKYLYYSRGGDYCKGMNHYLWSFLCGLGEAMFLNRTFVMDLSVCLASTYNPSNKDEEGKDFRYYFDFEHLKETASFVEEGEFLRDWKNWDKTHLXEQKIPVRKVVNHKVTPMQLKKDKSTIIWRQFDAPEPXXYWYRVCEGXAAXNIQRPWHAVWKSRG

SEQ ID NO: 3292 - protein, 175 aa, Glycine max
  misc_feature (10)..(10): Xaa can be any naturally occurring amino acid
PIAQNIIKLXGNLSFSAFAPPALIFTVIAITYHPPDPWLESTPALTNLFTQSQNATFRIDSSPPLTEAVIEKSEQQIANSTANSTADSTDSTDAALPSTPACDGTINCSNPRVRIAIQRFNLRAFKSIAFFDYQPPVNGSVAGECDVPWRFRNMRERSWRKYRDFRRFKTQSPTT

SEQ ID NO: 3293 - protein, 588 aa, Glycine max
  misc_feature (17)..(17): Xaa can be any naturally occurring amino acid
  misc_feature (134)..(134): Xaa can be any naturally occurring amino acid
  misc_feature (152)..(152): Xaa can be any naturally occurring amino acid
  misc_feature (227)..(227): Xaa can be any naturally occurring amino acid
  misc_feature (237)..(237): Xaa can be any naturally occurring amino acid
  misc_feature (280)..(280): Xaa can be any naturally occurring amino acid
  misc_feature (413)..(413): Xaa can be any naturally occurring amino acid
  misc_feature (564)..(564): Xaa can be any naturally occurring amino acid
MVLFNVSRVETTPFDGXQKPGTSGLRKKVKVFVQPHYLHNFVQSTFNALTVEKVRGATLVVSGDGRYFSKEAIQIITKMSAANGVRRVWIGQNGLLSTPAVSAVIREKLGADGSRATGAFILTASHNPGGPNEXDFGIKYNMENGGPAPEGXITDKIYENTTTINEYLIASDLPDVDITSTGVTSFTGPGGPFDVEVFDSASDYIKLMKSIFDFESIRKLLSSPKFXFCYDALHGVXAGAYAKSIFVDELGAQESSLLNCTPKEDFGGGHPDPNLTYAKXLVARMGLGKSEPQEEPPEFGAASDGDADRNMVLGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAXWLSILAYKNKDKLEDKLVTVEDIVRQHWATYGRHYYTRYDYENVDAGAAKELMAYLVKLQSSLSEVNQIVKGIRSDVSNVVHGDEFEYNDPVDGSISSHQGIRYLFEDGSRLIFRLSGTGSEGATIRLYIEQYEKDPSKIGRLSNEALAPXLVEVALKLSKMEEFTGRSAPTVIT

SEQ ID NO: 3294 - protein, 142 aa, Glycine max
TRFSSLVFNLGIRLLGEGLNLWLHHKSNEFIRCLFRIIKGIRSDVSNVVHGDEFEYNDPVDGSISSHQGIRYLFEDGSRLIFRLSGTGSEGATIRLYIEQYEKDPSKIGRLSNEALAPLVEVALKLSKMEEFTGRSAPTVIT

SEQ ID NO: 3295 - protein, 273 aa, Glycine max
  misc_feature (192)..(192): Xaa can be any naturally occurring amino acid
  misc_feature (211)..(211): Xaa can be any naturally occurring amino acid
GGSGITPSYVGPPPPIFKANTEGSKTPRVLLVCAFKKSIDLTTIDLILPVSATCTAFDISRLQLQIEAYVTREKQPDMNDKKLIQTLWFKPNALDEPVSAVLGQNSWLYLSIIISSSFMLFLLLIAILTRYYIYPIDHNTDMIYPYFSRSSLSMLFICISIAFVATSAFLWNKKQNKDLGQIKNIYTSNSSXSGSGYYNADRDRSSPPIPXLVQTAKVHYGERPNIKKILSGCNGSSIGVLVSGPRKMRHEVGSLCTSCSTDDLHFESLSFSW

SEQ ID NO: 3296 - protein, 166 aa, Glycine max
MAFVTTAEVCDANPQLILSGELRALQPVFQIYGRRQVFSGPIVTLKVFEDNVLVREFLEEKGNGRVLVVDGGASLRCAILGGNPVVQAQNNGWAGIIVNGCIRDVDEINGCDIGVRALASHPMKANKKGMGEKQVPINIAGTRISDGEWLYADTDGILISRTELSV

SEQ ID NO: 3297 - protein, 615 aa, Glycine max
MASLSGICSSSPTLKKFPNQSPSLTDPLRKDHVSFPARLADRTLSLAPLRAVAREVSDGALAAAVKKGLEKDPRALWRRYVGWLYQHKELGIYLDVSRVGFSDEFVKEMEPRFQAAFRAMEELEKGAIANPDESRMVGHYWLRDPKRAPNSFLKTQIENTLDAVCKFANDVVSGKIKPPSSPEGRFTQILSVGIGGSALGPQFVAEALAPDNPPLKIRFVDNTDPAGIDHQIAQLGPELASTLVIVISKSGGTPETRNGLLEVQKAFREAGLDFPKQGVAITQENSLLDNTARIEGWLARFPMFDWVGGRTSEMSAVGLLPAALQGIDIREMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKAAGEVLALQKRVLAVLNEASCKEPVEPLTLEEVADRCHAPEDIEMIYKIIAHMAANDRALIVEGSCGSPRSIKVFLGECNIDGLYA

SEQ ID NO: 3298 - protein, 512 aa, Glycine max
HASEKEKENNQYDNFAILVVDQGRSIAMDIGGEVEETVRELRQYFKTGKTKSVTWRKNQLTALLDLVHENEDAIFKALHQDLGKHPVEAYRDEVGGVEKSASNALSCVEKWMAPKKSDIPFLFFPAKGEVLSEPLGVVLIFSSWNFPIILTLDPIIGAISAGNVVVIKPSEQSPASSSFLATTIPRYLDSNAIKVIEGGPDVCEQLLLQKWDKIFFTGSPRVASVVMSAAAKNLTPVTLELGGKCPAILDSLPNPLESKLAVKRIVGGKWGPCSGQACIAIDYLLVEKKFPYALIELLKKIIRRFYGENPVESKVISRILNKQHFERLCNLLKDPLVAASIVHGGSVDEENLFIEPTILLDPPLDSQIMSEEIFGPLLPIITMDKIQESIEFINAKPKPLAIYAFTKDETFKRNILSETSSGSVVFNDTMVQFLCDTLPFGGVGQSGFGRYHGKYSFDTFSHEKAVMHRKLFLEIEPRYPPWSKFKLEFIRLAYRLNYFGLLLHMLGLKRYK

SEQ ID NO: 3299 - protein, 179 aa, Glycine max
  misc_feature (122)..(122): Xaa can be any naturally occurring amino acid
  misc_feature (125)..(125): Xaa can be any naturally occurring amino acid
  misc_feature (162)..(162): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELKHSFIYHKHNKSPKYYDRRYXNHXKLPIFNYTNTSQVLKELQQAKTTYPNHFIHIIKFDNXVRQVHYIIFITYKPPSF

SEQ ID NO: 3300 - protein, 401 aa, Glycine max
MATKRSVGTLKEGDLKGKRVFVRVDLNVPLDDNLNITDDTRVRAAVPTIKYLTGYGAKVILSSHLGRPKGVTPKYSLKPLVPRLSQLLGIEVTMANDSIGEEVEKLVTQLPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLEKVNVLLLGGGMIFTFYKAQGYSVGSSLVEEDKLSLATTLLEKAKAKGVSLLLPTDVVIADKFAADANSKTVPASSIPDGWMGLDIGPDSIKTFGEALDTTQTIIWNGPMGVFEFDKFATGTEAIAKKLAELSGKGVTTIIGGGDSVAAVEKVGLADKMSHISTGGGASLELLEGKQLPGVLALDDA

SEQ ID NO: 3301 - protein, 138 aa, Glycine max
ERARVRKECHSWRLSNEDPRLSHRRNPNESVSLDQLAELGVLYWKLNPTIYENDQELTKIRQDRGYNYMDLLDLCPEKVENYEQKLKNFYTEHIHQDEEIRYCLEGSGYFDVRDKDDRWIRILIKAGDLIILPAGNYH

SEQ ID NO: 3302 - protein, 277 aa, Glycine max
DGPVVAVKRLKDVTVSEKEFKEKIDVVGVMDHENLVPLRAYYYSRDEKLLVHDYMPMGSLSAILHGNKGAGRTPLNWEMRSSIALGAARGIEYLHSQGPSVSHGNIKSSNILLTKSYDARVSDFGLTHLVGSSSTPNRVAGYRAPEVTDPRKVSQKADVYSFGVLLLELLTGKAPTHALLNEEGVDLPRWVQSGVREGWSSEVFDIELLRYQNSEEEMGQLLQLAVDCVVPYPDNRPSMSQVRQRIEELRRPSMKEGTQDQIQQPDLINDIDDVSSR

SEQ ID NO: 3303 - protein, 490 aa, Glycine max
MSKEEFLKIQKCVLKVNIHCDGCKHKVKKILQKIDGVFTTEIDAEQGKVTVSGNVDPNVLIKKLAKSGKHAELWGAPKPNNNNNNHNHNNQNHLADQLKNMQINNHPKSGGGGGNHNNKGQNQNQPKGGGGGGNSQAKGGGGGGQQQGPTPQQQLQLQLQQQQRLQQQLQQLQQVKGLQDLNLPQFKDLKLPPHNPNPNAKAVKFDIPEEDDDYTDDELDDFDDDDDDFDDEFDDDEMDDLPPSKMKPPPMMMDAPPKAANNGGGGGNNGRKGGGPVPVQVHGIPGNGGGKKGGGGGGGNNQNQGGGNKNNVGKSGGGAPEGKHGGGGNKNGNGNNNNNNGGKKVNPMGGVGVQPMNGGFQNMGGGPHVMSGPNVGPMSMPMPNIPAVQGLPAGPVNGGGFFQGAGPDAMPGNPFQQQQQQQQQQQLQQQYMAAAMMNQQRAMGNDRFQPMMYARPPPAVNYMYPPYPYPPPDPYTHFFSDENTSSCNVM

SEQ ID NO: 3304 - protein, 556 aa, Glycine max
  misc_feature (101)..(101): Xaa can be any naturally occurring amino acid
MASHNYKVFSCFNRKFTVTEPGPPPDVQKAFSEFADGASSLSGDHLLRFLAKHQGEVDCTAVDSERILQQSRKEDRESGLDLHDFFRFLLHDDFNIPLRKXVHHDMTAPLSHYFIYTGHNSYLTGNQLSSDCSDVPIIKALQRGVRVIELDLWPNSDEDDIEVVHGRTLTTPVSLIQCLKSIKEYAFVKSHYPLIITLEDHLTPDLQAKAAEMATQVFGELLYYPQTDSLMEFPSPESLKGRILISTKPPKEFLESKEYDDKDNEKESADELSSLPDQTSEQETDDKSAPEYKRLITINSARAKGDIQDELKAAGAVRRLSLSEQALEKASESYGADIVRFTQNNILRVYPKGTRLNSSNYKPHIGWTYGAQMVAFNMQGYGKSLRYMQGMFRANGGCGYVKKPEFLIEKGPYNEVFDPKRTLPVKKILKVKVYMGTGWSLDFSQTDFDTYSPPDFYVKVCIVGVPADMAKKKTCVISNNWFPVWDEQFDFPLTVPELALLRIEVRENDKSQKDDFGGQTCLPVSELKSGFRSVPLYDEKGDKLKSVKLLMRFQFR

SEQ ID NO: 3305 - protein, 477 aa, Glycine max
  misc_feature (81)..(81): Xaa can be any naturally occurring amino acid
FGSLDNTNDILFQVHHDMTAPLSHYFIYTGHNSYLTGNQLSSDCSDVPIIKALQRGVRVIELDLWPNSDEDDIEVVHGRCXLILSSISTLTTPVSLIQCLKSIKEYAFVKSHYPLIITLEDHLTPDLQAKAAAMATQVFGELLYYPQTDSLMEFPSPESLKGRILISTKPPKEFLESKECDDKDNEKESADEVLSLPDQTSERETDDKSAPEYKRLITIHAGKPKGDIQDELKAAGAVRRLSLSEQALEKASESYGADIVRFTQNNILRVYPKGTRLNSSNYKPHIGWTYGAQMVAFNMQGYGKSLRYMQGMFRANGGCGYVKKPEFLIEKGPYNEVFDPKRTLPVKKTLKVKVYMGTGWSLDFSQTDCDTYSPPDCYVKVCIVGVPADMAKKKTCVISNNWFPVWDEQFDFPLTVPELALLRIEVRENDKSQKDDFGGQTCLPVSELKSGFRSVPLYDEKGDKLKSVKLLMRFQFR

SEQ ID NO: 3306 - protein, 116 aa, Glycine max
MAGPFELGSSKKKPGDGVNDLLTFNAENMQSNMKIIYYSRTFLSIIGGVVAGILGFTSLKGFVFYFLLMMVTSLGLVAKARFSIHSYFDSSNRVLLDGFLGGLMSFVLFWTYPSLL

SEQ ID NO: 3307 - protein, 115 aa, Glycine max
MAVHSESASSEKKSSNGVNELLTFNAENMQSNMKIIYYSRTFLSIIGGVVAGILGFTGLKGFVFYLLLMALTSLGLVAKAKFSTHTYFDSWNRVLLDGFQGGLMSFVLFWTYPSL

SEQ ID NO: 3308 - protein, 399 aa, Glycine max
  misc_feature (86)..(86): Xaa can be any naturally occurring amino acid
EKGNSLRTTIAIVVPTVLVVVALLIFISIYFRRRKLARKNLLADEDDDEIELAESLQFNLDTIKVATNNFSDSNKLGEGGFGAVYXRLSNGQVVAVKRLSSDSGQGGVEFKNEVLILAKLQHRNLVRLLGFSLEGKEKLLIYEYVPNKSLDYFIFDPTKKARLNWDRRYKIIPGIARGLLYLHEDSHLRIIHRDLKASNILLNEEMNPKIADFGMARLVLMDQTQANTNRIVGTYGYMAPEYAMHGQFSMKSDVFSFGVLVLEIISGHKNSGIRHGENVEDRLREEGRQWREGTAVKIVDPSLNNNSRNEMLRCIHIGLLCVQENLADRPTMTTIMLMLNSYSLSLPIPSKPAFYVSSRTGSISATQSWGYSSGESRSRELTIKSAQEAENEFTDPYPR

SEQ ID NO: 3309 - protein, 158 aa, Glycine max
MAEEHRCQAPRFCANNCGFFGSPATHNMCSKCYRDFQLKEQQSSNAKMVLNQSLVPPPPPSVISQPSSSSAPAADPASAVVVDAPRAAEELKAPQQNRCMTCRRRVGLTGFKCRCGMMLCGTHRYPEQHACEFDFTHASGEQIAKANPVVKGEKLEKI

SEQ ID NO: 3310 - protein, 565 aa, Glycine max
MQSSISLSSSYAPTISGPRHSFPLSGRTLAPSNLRFCGLRRQAFTSTPLNHHFRLRRRRLPHSAAVSAALSANGTSPKSFDYDLLIIGAGVGGHGAALHAVEKGLKTAIVEGDVVGGTCVNRGCVPSKALLAVSGRMRELRNDHHLKSFGLQVSAAGYDRQGVADHANNLASKIRNNLTNSMKALGVDILTGFGTILGPQKVKVGSSDKIVTAKDIIIATGSVPFVPKGIEIDGKTVITSDHALKLESVPDWIAIVGSGYIGLEFSDVYTALGSEVTFIEALDQLMPGFDPEISKLAQRVLINPRNIDYHTGVFATKITPARDGKPVLIELIDAKTKEPKDTLEVDAALIATGRAPFTQGLGLENIDVVTQRGFVPVDEHMRVIDANGKLVPHLYCIGDANGKMMLYEKTTEGGISVVEQVTGRDLVLNHLSIPAACFTHPEISMVGLTEPQAREKGEKEGFEVSVAKTSFKANTKALAENEGEGLAKLIYRPDTGEILGVHIFGLHAADLIHEASNAIALGTRIQDIKFAVHAHPTLSEVLDELFKSAKVKAEASEPIKEAVAV

SEQ ID NO: 3311 - protein, 286 aa, Glycine max
REMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRSVGALVALYERAVGIYASLVNINAYHQPGVEAGKKAAGEVLALQKRVLAVLNEASCKEPVEPLTLEEVADRCHAPEDIEMIYKIIAHMAANDRALIAEGNCGSPRSIKVFLGECNLDELYA

SEQ ID NO: 3312 - protein, 330 aa, Glycine max
  misc_feature (275)..(275): Xaa can be any naturally occurring amino acid
MPEFCVTGGTGFIASYLVKALLEKGHTVRTTVRNPGDVEKVGFLTELSGAKERLKILKADLLVEGSFDEAVRGVDGVFHMASPVLIPYDENVQQNLIDPCIKGTLNVLNSCVKATVKHFVLTSSCSSIRYRDDVQEVCPLNESHWTDLEYCKRYKLWYAYAKTIAEREAWRIAKENGMDLVVVNPSFVVGPLLAPQPTSTLLLILSIVKGKEGENIANTTVGFVHINDVVAAHLLAMEDPKASGRLICSSTVAHWSQIIEMLRAKYPSYPYENEXVKPCQSITLCSSQEGDNNPHSMDTTKITQLGFPPFKTLEQMFDDCIKSFQDKGFL

SEQ ID NO: 3313 - protein, 193 aa, Glycine max
  misc_feature (116)..(116): Xaa can be any naturally occurring amino acid
MRKRSIYAWLVALVCFLLLMIVTPAIPQSQEYHDFADHRTFLGIPNALNVISNFPFLVIGLVGLVLCHHGNYFRLSLQGELWGWTCFYVGVAAVAVGSSYYHLKPDDARLVWDRLXPFFDDLRPYALVQFVPCIVIPLMAILLPPMYTHSTYWLWAAGSYLLAKVLEATDDVIYEWAQHIVSGHTLKHLVAAM

SEQ ID NO: 3314 - protein, 309 aa, Glycine max
  misc_feature (172)..(172): Xaa can be any naturally occurring amino acid
  misc_feature (226)..(226): Xaa can be any naturally occurring amino acid
  misc_feature (247)..(247): Xaa can be any naturally occurring amino acid
  misc_feature (259)..(259): Xaa can be any naturally occurring amino acid
  misc_feature (268)..(268): Xaa can be any naturally occurring amino acid
  misc_feature (282)..(282): Xaa can be any naturally occurring amino acid
  misc_feature (285)..(285): Xaa can be any naturally occurring amino acid
  misc_feature (287)..(287): Xaa can be any naturally occurring amino acid
MTMTTIQSTPGSSGYLDLFPERKMSFFKNPYILGLSAVAGIGGMLFGYDTGVISGALLYIKDDFEGVRESELVQETIVSMAIAGAIVGAAGGGWMNDAYGRKKATLIADVIFIMGAIGMAAAPDPYLLILGRFLVGMGVGVASVTSPVYIAEASPSEIRGSLVSTNVLMITXAGQFLSYIVNLAFTRVPGTWRWIASVSLPSPPIVQVSFSCLFLPESPRWLFIKXRKNEAVHVLSNIYDFARLKEXVDFLTTQSDQEXQRKNSIKFXDVFKSKKSNLHYLXEAXLXAFQQFTGINTVMYYSPTIVQMA

SEQ ID NO: 3315 - protein, 131 aa, Glycine max
  misc_feature (50)..(50): Xaa can be any naturally occurring amino acid
EASVSRNRSTIIVPAGSSRDEGWAAFRNVLAEINEASRLFILPNQQNSEXQSVSKVIRADQKRFFFDLGSNNRGHFLRISEVAGSDRSSIILPLSGLKQFHEIVGHFVEITKDRIEGMTVANVRTVDPPQR

SEQ ID NO: 3316 - protein, 673 aa, Glycine max
  misc_feature (359)..(359): Xaa can be any naturally occurring amino acid
TRPHSQRTIYNVYSFWYCSFFFLCCLYLIIVICEASFGPSYEYSKYCNNSNGNYTANSIYQTNLNTLLSTLTSHTEIDYGFYNFSHGQNSDKVYAIGLCRGDVKPDECRSCLNNSRVSLTRLCPKQLEAINWEEKCMLRYSNRAIFHTMDASFSYHMNNVNNATDAEEFNKVLGELLRNLSDKAASGDSRRKYAADTAVFANLQTIYGLVQCTPDLSRQDCGKCLHWSLADFGNVFKNKVGAVVLRPSCNVRYEIYPFYDEPTPSASVPLSLKEKGNSLRTTIAIVVPTVLVVVALLIFISIYFRRRKLARKNLLADEDDDEIELAESLQFNFDTIKVATNNFSDSNKLGEGGFGAVYXRLSNGQVIAVKRLSSDSGQGGVEFKNEVLLLAKLQHRNLVRLLGFSLEGKEKLLVYEYVPNKSLDYFIFDPTKKERLDWDRRYKIIQGIARGLLYLHEDSRLRIIHRDLKASNVLLDEEMIPKISDFGMARLIVAGQTQENTSRVVGTYGYMAPEYAMHGQFSMKSDVFSFGVLVLEIVSGQKNSGIRHGENVEDLLSFAWRSWKEGTAINIVDPSLNNNSRNEMMRCIHIGLLCVQENLADRPTMATIMLMLNSYSLSLPIPSKPAFYMNSRTTSLPNMSWEVNSGTTRSNQSTTKSAHDSVSETSISELYPR

SEQ ID NO: 3317 - protein, 559 aa, Glycine max
  misc_feature (247)..(247): Xaa can be any naturally occurring amino acid
TKQYKTLTRLCPKQLEAINWEEKCMLRYSNRAIFHTMDASFSYHMNNVNNATDAEEFNKVLGELLRNLSDKAASGDSRRKYAADTAVFANLQTIYGLVQCTPDLSRQDCGDCLHWSLADFGNVFKNKVGAVVLRPSCNVRYEIYPFYDEPTPSASVPLSLKEKGNSLRTTIAIVVPTVLVVVALLIFISIYFRRRKLARKNLLADEDDDEIELAESLQFNLDTIKVATNNFSDSNKLGEGGFGAVYXLSNGQVIAVKRLSSDPGQGGVEFKNEVLLLAKLQHRNLVRLLGFSLEGKEKLLVYEFVPNKSLDYFIFDPTKKARLDWDRRYKIIRGIARGLLYLHEDSRLRIIHRDLKASNVLLDEEMIPKISDFGMARLVLVDQTQANTSRIVGTYGYMAPEYAMHGQFSMKSDVFSFGVLVLEIVSGQKNHGIRHGENVEDLLNFAWRSWQEGTVTNIIDPILNNSSQNEMIRCTHIGLLCVQENLANRPTMANVALMLNRGPPSPLRRPPPLFMDSATTSLPNMSWEVNSGTTRSNQSTTKSAHDSVSEASISELYPR

SEQ ID NO: 3318 - protein, 54 aa, Glycine max
AARARGNCKRLWLYQSIRIRKDFLGFFANFLGVFIFVLVIAYHFVMADPKFEGN

SEQ ID NO: 3319 - protein, 76 aa, Glycine max
  misc_feature (20)..(20): Xaa can be any naturally occurring amino acid
YDDQGYLILCRLSSKRRVTXTEFKGRSLVSIREFYVKDGKEMPSAKGISMTLEQWEAFCNAVPAIEDAIKKLEDSD

SEQ ID NO: 3320 - protein, 162 aa, Glycine max
MRSHTFLRITSLLVFIGWLTVWILLPTKVYKNTWTPKLKTKLNSTYFREQGTNLLLFTFPVMLIGALSCIYLHLHEKGTEKLPSKSGGVVNRWLCFLRRPFLVMSPIGIVTSMEIIFALMFVALLIWSLSNYLHTSFGHLHMHKEGEKVWQAKFRSVSLRLG

SEQ ID NO: 3321 - protein, 432 aa, Glycine max
MVLSWTRRNVFRRAKKEKEQSQLLEVEVVIPNHFRCPVSLELMTDPVTLSTGITYDRVSIEKWIEGENRTCPVTNQVLTTFDLIPNHAIRMMIQDWCVENSSYGIERIPTPRIPISAYEVSDTCTRILSACQRGDDKRCQELVGKIKVWSRESERNKRCIVGAGAGAVLAYAFDCFSSNSIEKHVVLLEEVLEVMTWMIPFGEEGVSKLSSRASLNSLVWFLEGKDLASRQSAALLLKEVCVQELAKVGNVVEALVKMVREPIGSTSTKACLATIFNLVSLAANREGIAQRFVELGLVSLLLEAIVDGEKGVCEKALGVLDCICDCEKGKEVVKSNALALPLVVRKLLRVSPLASGFAVSILRKICDKREEGILIEALQVGLFQKLLVLLQVGCDESTKENATGLLKLLNGYRNKAECTDSSLNFEHLKKPF

SEQ ID NO: 3322 - protein, 341 aa, Glycine max
MASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQIVKAEDSIGPEVEKLVASLPDGGVLLLENVRFYKEEEKNDPEHAKKLASLADLFVNDAFGTAHRAHASTEGVTKYLKPSVAGFLLQKVVPASAIPDGWMGLDIGPDSVKSFSEALDTTQTIIWNGPMGVFEFDKFAVGTEAIAKKLADLSGKGVTTIIGGGDSVAAVEKVG

SEQ ID NO: 3323 - protein, 483 aa, Glycine max
MASAAAPTTFSLLHSTTPASSSSATSASPSRVQLSSSLRSRPLARRLGFAAADPLLAANVAARVAAVRGGKGARGVVSMAKKSVGELSAADLKGKKVFVRADLNVPLDDNQNITDDTRIRAAIPTIKHLIQNGAKVILSSHLGRPKGVTPKYSLAPLVPRLSELIGIQVVKAEDSIGPEVEKLVASLPDGGVLLLENVRFYKEEEKNDPEHAKKLASLADLFVNDAFGTAHRAHASTEGVTKYLKPSVAGFLLQKELDYLVGAVSSPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 3324 - protein, 160 aa, Glycine max
MVLTSISIVSSSSSFLSDSPSTSSPTTRIRPFFFHSSNRAPLFVFPRAHLPSATLRASSSSVSTPHENGSPEQFLKSNSIADFMRFKRRADGGVSAELQTALVSYKKRFPWSLMRPFLQVDLVSTIHIADEEYFLALQKELESYDCVLYEMVASRGVCLS

SEQ ID NO: 3325 - protein, 252 aa, Glycine max
  misc_feature (172)..(172): Xaa can be any naturally occurring amino acid
GLVSVSSMEDIQLDISWDDVACPICLDFPHNSVLLHCSSYDKGCRAFVCDTNQLHSNCLDRFKNSCGMPSSPVSNATSTETTENSDDHEVSNGQCNLTCPLCRGEVSGWVIVDKARIHLDEKKRCCDEVRCTFMGSYLELQEHAQLEHPHARPSKIDPARQLDWENFQQSSXSITLVALRIRSRTRVGDQSRVNRHLSSDTSNSDEGSVASVEYGEYRLDEIDDDFVSTIGHLKGESGFRRSRRRHSRSNDN

SEQ ID NO: 3326 - protein, 119 aa, Glycine max
  misc_feature (80)..(80): Xaa can be any naturally occurring amino acid
MVCEKCEKKLSKVIVPDKWKEGASNTTEGGGRKINENKLLSKKNRWTPYGNTKCTICKQLVHHNAKYCHTRAYFKGVCAXCGKQVSYTMFYMLCMCDLMDCFFFHSFLFFSFISIILFS

SEQ ID NO: 3327 - protein, 79 aa, Glycine max
KHSPSRYSVAQKDLASTGGSYQQEDWHTDLLACCSEPSLCMKTFFYPCGTFSKIASVARNRPICKLAIMHCVSIKVMNF

SEQ ID NO: 3328 - protein, 112 aa, Glycine max
MILLLGGSQLPNCSASAIITYSSSPSMSGFYIVMQTASSIISFSAVVAVFRAAPGMVTPFSDIKTMVGFPSKKTNNDITSIPSTGGRVQCMQVWPPVGKKKFETLSYLPDLM

SEQ ID NO: 3329 - protein, 146 aa, Glycine max
MEVYGKSMVAGPANVIFLSSILGQEGPIPGHKCDWKCQNEHVCGNMYRCKLTGLTHICDKNCNQRILYDNHSSLCRASGQIFPLTPAEEQAVRGVRRKLDAENLPSESCGFKRRRGDAQFHPSPFERSFSAVSPICSQVGDGMDMS

SEQ ID NO: 3330 - protein, 57 aa, Glycine max
  misc_feature (23)..(23): Xaa can be any naturally occurring amino acid
  misc_feature (37)..(37): Xaa can be any naturally occurring amino acid
QKRFFFDLGSHNRAHFLRISEGXKQFHEIVGHFVEIXKDRIEGMAVANVRTIDPPQR

SEQ ID NO: 3331 - protein, 299 aa, Glycine max
  misc_feature (239)..(239): Xaa can be any naturally occurring amino acid
  misc_feature (248)..(248): Xaa can be any naturally occurring amino acid
  misc_feature (258)..(258): Xaa can be any naturally occurring amino acid
MATEADAPVIPLLTPYKMGNFNLSHRVVLAPLTRMRSYNNVPQPHAVLYYSQRTSPGGLLISEATGVSDTAQGLVHTPGIWTKEQVEAWKPIVNAVHAKGGVFFCQIWHVGRVSSPVFQPNGQAPISSTDKPLKQNGIEEAQVTPPRRLRTDEIPHIVNDFRVAARNAIKAGFDGVEIHGAHGYLLEQFIKDKVNDRSDGYGGSLENRCRFALEVVDAVVKEIGAEKVGVRLFHLTEQXSVEIQNPNXLAPFFANALXKDNILYCHMVEPRMKNALEVVECPHSLMPMRKAFNGTFISA

SEQ ID NO: 3332 - protein, 280 aa, Glycine max
MAATSSLCSSTLQSQINGFFLHKTSLSHTPSLTFSRRKISTTVKATSRVDKFSKSDIIVSPSILSANFSKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAKAGVVLNPGTPLSAIEYILDVVDLVLIMSVNPGFGGQSFIESQVKKISDLRRLCAEKGVNPWIEVDGGVGPANAYKVIEAGANALVAGSAVFGAKDYAEAIRGIKTSKRPEVVAV

SEQ ID NO: 3333 - protein, 196 aa, Glycine max
  misc_feature (45)..(49): Xaa can be any naturally occurring amino acid
LISFPISFSLFSSFTLFFAFLSSVICFIVSSLSFLSLLFSSAVFXXXXXIKAGADIVSVHCEQSSTIHLHRTVNQVKSLGAKAGVVLNPATPLSAIEYVLDVVDLVLIMSVNPGFGGQSFIESQVKKISDLRRLCAEKGVNPWIEVDGGVGPANAYKVIEAGANALVAGSAVFGAKDYAEAIRGIKTSKRPEVVAV

SEQ ID NO: 3334 - protein, 218 aa, Glycine max
MATQSYLLNLNTFRVHAGISGRQCKPSIFKPSNFGFRVWKSSKYHTKRNVNGNSGVMQCCSCYTEVGASAGITISSLVNAATTHISLNSDVDLNTLKLSIQETSPASTDLMTRLVLADLDPDTAKLAIGFLGPFLSVFGFLFILRIVMSWYPKLPVGKFPYVIAYAPTEPLLIPTRKVIPPLAGVDVTPVVWFGLISFLNEILVGPQGLLVLLSQQVN

SEQ ID NO: 3335 - protein, 149 aa, Glycine max
MDADGKIKKGAGGRKGGGPKKKPVSRSVKAGLQFPVGRIGRYLKKGRYAQRVGTGAPVYLAAVLEYLAAEVLELAGNAARDYKKNRIIPRHVLLAVRNDEELGKLLAGVTIAHGGVLPNINPVLLPKKSERASKEPKSPSKATKSPKKA

SEQ ID NO: 3336 - protein, 370 aa, Glycine max
MAALSNGHGSSFFKMPPIKFTKLFINGEFVDSLSGREFETRDPRTGEVITRIAEGAKEDVDVAVKAARAAFDYGPWPRMPGAERAKIMMKWADLVDQNIEEIAALDAIDAGKLYHWCKAVDIPAAASTIRYYAGAADKIHGEVLKASREFHAYTLLEPIGVVGHIIPWNFPSTMFVAKVSPSLAAGCTMVLKPAEQTPLSALFYAHLAKLAGIPDGVLNVVPGFGQTAGVAISLHMDIDKVSFTGSTEVGREVMRAAANSNLKPVSLELGGKSPVIVFDDADVDKAAELALLGILFNKGEICVAGSRVLVQEGIYDEFEKKLVEKAKAWVVGDPFDPKVQQGPQVDKFSSKSASAYKKTQTNGVTLFWTP

SEQ ID NO: 3337 - protein, 78 aa, Glycine max
FLSSTFPSYTDPNPLSSPNFPSFPSPYGEVAPLVQARLNVVVLDSSPGNSIYQLAMVNYVKRVYPELDVIGGNVVTMY

SEQ ID NO: 3338 - protein, 258 aa, Glycine max
SSPSTTWLSRLPSQRSFSLNPNLHTLPLFDPSLQPWRSTLPRIQALTEPDYGSDASALKTTATKVEGGWILEGQKRWIGNSTFADVLVVFARNASTNQINGFIIKKDAPGLTVTKIENKIGLRIVQNGDIVMRKVFVPDEDRIAGVNSFQDTNKVLAVSRVMVAWQPIGISMGIYDMCHRYLKERKQFGAPLAAFQISQQKLVQMLGNIQAMILVGWRLCKLYESGKMTPGQASLGKSWITLRARETAALGRELLGGN

SEQ ID NO: 3339 - protein, 93 aa, Glycine max
MGFRIAGIIRRVSFSTTQAASKGIEVPKGYLAVYVGDKMRRFVIPVSYLNQPSFQELLSQAKEEFGYDHPTGGLTIPCQEDVFLNVTSRLNEL

SEQ ID NO: 3340 - protein, 336 aa, Glycine max
MWWPFSRKEKEGSGFSSSSTAEEVTEGIDGTALTAIVTGASSGIGAETTRVLAMRGVHVIMGVKNMNAAKNIKETILKGIPSAKVDAMELDLSSMTSVRKFASEFISSSLPLNILINNAGIFGTPFKLSEDNIELQFATNHMGHFLLTNLLLDTIKRTTHESKKEGRIVNISSSGHQWLNYRGGILFDKINDESSYQKFCAHGQSKLANILHANELARRLKEEGVNITANSLHPGAIATNIHRYNRILTGIPGVVKRLLNLVIKNVQQGAATTCYVALHPEVRGISGEYFADNKIAKANSLGRDIDLAKKLWDFSMNLIKVEYLVPIVDADGILRE

SEQ ID NO: 3341 - protein, 559 aa, Glycine max
SGITGSTTRPLGKPADAGDRLRHNTATTSGGNNAVKVREKQKPPDAGELSGTLPAAERRKPRLDPCAVTQQGWPSWLMAVAGEAIGDWTPRRANTFEKLAKIGQGTYSNVYKARDLVTGKIVALKKVRFDNLEPESVKFMAREILVLRRLDHPNVVKLEGLVTSRMSCSLYLVFEYMEHDLAGLAAGQGVKFTEPQVKCFMKQLLSGLEHCHSRGVLHRDIKGSNLLIDNEGILKIADFGLATFYDPKIKQAMTSRVVTLWYRPPELLLGATVYGVGIDLWSAGCILAELLAGKPIMPGRTEVEQLHKIFKLCGSPSEEYWRKYRLPNATIFKPQQPYKRCILETYKDFPPSSLPLIETLLAIDPDDRCTASAALNSEFFTTEPYACEPSSLPKYPPSKELDVKLRDEEARRQKALNGKASAVDGAKKVRVRERGRAVPAPEANAEIQTNLDRWRVVTHANAKSKSEKFPPPHQDGAVGYPQDASNKGPVSFGAPDTSFSSGIFNSKPSGTVRNHGAAGLHRGRKTKKDESQMASSWKFMRPFKPSTVGLSMDLLFRSK

SEQ ID NO: 3342 - protein, 411 aa, Glycine max
  misc_feature (59)..(59): Xaa can be any naturally occurring amino acid
VFALKQDLKAFAFKTKAMLSQMEREVQSARKKESLNWHIASHGVPQSLHCLCLKLAEEXAVNAIARSRLPLPEHVSRLVDPTFHHIVLLTDNVLAASVVVTSTVENSANPERLVFHVVTDKKTFTPMHTWFAINSINSAVVEVRGLHHYDWSKEVNAGVKDMQETNNLIWKHYYSNYKQKELDHSEDHNRYLEALRPSSLSLLNHLRIYIPELFPDLNKVVLLDDDVVVQHDLSSLWELDLNGKVSGSVFKSWCENSCCPGNKYVNFLNFSHPIISSNFDGDKCAWLFGVDIFDLEAWRRSDITKTYHQWLKLNVQSGLTLWNPGVLPPALIAFAGQVHPIDSSWFVTDLGYRHRSEEIGNSIERVETAAVVHFNGPAKPWLEIGLPEVRTLWTRYVNFSDKFISKCRIIV

SEQ ID NO: 3343 - protein, 165 aa, Glycine max
  misc_feature (48)..(48): Xaa can be any naturally occurring amino acid
  misc_feature (74)..(74): Xaa can be any naturally occurring amino acid
KQGTATLGGQIKDLVILSYEDRLVLFSRYLQQLVMESLGKVFDLDGNXYIQQLREGVHNFFVTFIEVLRDRPPXHDWELEPGVTCGDYLFGMLQGTRSALYANNRESITVTVQEVTPRTVGALIGLYERAVGIYASLVNINAYHQPGLGNMACGRGMLNCIQMKT

SEQ ID NO: 3344 - protein, 209 aa, Glycine max
  misc_feature (155)..(155): Xaa can be any naturally occurring amino acid
  misc_feature (185)..(185): Xaa can be any naturally occurring amino acid
  misc_feature (200)..(200): Xaa can be any naturally occurring amino acid
MATTQGQVITCKAAVAWEPNKPLSIEDVQVAPPQNGEVRIQILYTALCHTDAYTWSGKDPEGLFPCILGHEAAGIVESVGEGVTAVQPGDHVIPCYQAECGECKFCKSGKTNLCGKVRAATGVGVMLSDRKSRFSVNGKPLYHFMGTSTFSQYTXVVHGFRVAKIDPQAPLDKVCLLGCGGSTGXLGAVWNTTKGEPRSXVAFFGLGTV

SEQ ID NO: 3345 - protein, 130 aa, Glycine max
LASRSRLRTCREGDARRLPFPDNYFDVVVSGVFVHTVGREYGARTAEAAAERMRAVAELVRVMKPGGVAVVWDLLHVPEYVLRLQELKMEDVRVSERVTAFMVSSHIVSFRKPSQHVHGPAEVRLDWRLC

SEQ ID NO: 3346 - protein, 552 aa, Glycine max
MMNNSNGMISKTSSSSNTAQSQQSQSTGLKMHFKTPEGRYKLHCDKTYPSTLLHYAHGKTVSQVTLAHLKDKPVPLTPTGQSSTFSATSGVRSAAARLLGGSNGSRALSFVGGNGGSKSNGGNTRIGSIGASSTSSAMANPNFDGKGTYLIFNVGDAIFISDLNSQDKDPIKSIHFSNSNPVCHAFDQDAKDGHDLLIGLNSGDVYSVSLRQQLQDVGKKPVGAQHYNKDGSVNNSRCTCIAWVPGGDASFVVSHADGNLYVYEKNKDGAGDSSFPVVKDQTQFSVAHARYSKSNPIARWHICQGSINSISFSMDGAYLATVGRDGYLRVFDYSKEQLICGGKSYYGALLCCAWSMDGKYILTGGEDDLVQVWSMEDRKVVAWGEGHNSWVSGVAFDSYWSSPNSNDNGETVRYRFGSVGQDTQLLLWDLEMDEIVVPLRRPSGGSPTYSAGSQSSQWDSVVPLGTLQPAPSMLDVLKISPLVTHRVHTEPLSGLIFTQESVLTACREGHIKIWIRPAAAESQSSNAETLLSTSLKEKPSILSKVGNSSHRQ

SEQ ID NO: 3347 - protein, 371 aa, Glycine max
MATATTNSSPSAQRHVGFSRRTQAPRQLDDDSPPVNKYRLLSEIMARAPYAVLERETYSDLLCDQCGSGELPEELLLCDKCDKGFHMKCVRPIVVRIPIGSWLCPNCQGGKRVRTFSQKKIIDFFGIRRSSDDANDKHAKKRKKCSRPLVLHKKKRRLLPFVPTKDLNRRLKQMGSLASALTALNMEFSDHLTYLPGMAPRCANQALLENGGMQTLSKEDMETLEQCIALSKRGEFPPFMVVYDSREGYTVEADDLIKDMTIIAEYTGDVDYLDTRERDDCDSMMTLLLGAESSQSLVICADKRGNIARFISGINNHTQEGRKKQNCKCVRYNVNGECRVFLVAIRDISKGERLYYDYNGHEYQYPTHHFV

SEQ ID NO: 3348 - protein, 558 aa, Glycine max
MFGLIGRKASLLGGSGRRRRWLSFAAAAAATTTTNGGAMEELLSQLQSHVQKALAGGGPEAVKRNTSRNKFLPRERIDRLLDPGSSFLELSQLAGHYLYEEPLPSGGVVTGIGPVHGRLCMFVANDPTVKGGTYYPITVKKHLRAQEIAAQCKLPCIYLVDSGGAFLPKQAEVFPDRENFGRIFYNQAVMSAQGIPQIALVLGSCTAGGAYIPAMADESVMVKGNGTIFLAGPPLVKAATGEEVSAEDLGGATVHCKTSGVSDYFAQDELHALALGRNIIKNLHMAGKDVLANGLQNINYEYKEPLYDINELRSIAPTDLRQQFDIRSVIDRIVDGSEFDEFKKLYGTTLVTGFARIFGQPVGIIGNNGILFNESALKGAHFIELCTQRNIPLVFLQNITGFMVGSRSEANGIAKSGAKMVMAVSCAKVPKVTIMVGGSFGAGNYAMCGRAYSPNFLFLWPNARISVMGGAQAAGVLAQIEKGNKKRQGIQWSKEEEDKFKGKVVEAYEREASPYYSTARLWDDGIIDPADTRKVIGLCISASLNRAIENTKYGVFRM

SEQ ID NO: 3349 - protein, 262 aa, Glycine max
  misc_feature (135)..(135): Xaa can be any naturally occurring amino acid
  misc_feature (147)..(147): Xaa can be any naturally occurring amino acid
MARAVSSSCARLTMRLFSTTTTTTAAFAVTLPKPSSLSVSTRRFLFPLSHAIVPPSTRVAGIRCRVNRAGDSAYSPLNSASSSSSSFSDRPPTEMAPLFPGCDYNHWLIVMDHPGGEGATKQQMIDCYIQTLAKXVLGSEEEAKKKXYNVSCERYFGFGCEIDEETSNKLEGMFSEVEVFEISFLCSLFFICVGLPGVLFVLPDSYVDPENKDYGAELFVNGEIVQRSPERQRRVEPQPQRHQDRPRYNDRTRYVRRRENTQ

SEQ ID NO: 3350 - protein, 453 aa, Glycine max
  misc_feature (206)..(206): Xaa can be any naturally occurring amino acid
APPPRALLCSNLKDKDDDRLVKSKSIKKKKNADLVNHKNGNNLLDTNDQNNKSKDVQRIEGDNDEKSANGIKGNPATLGAEGAEKEFNPRKRKRDVLFGMLNWMKHIAKHPLDPLTQPIPKPSKWKEYNGQDFFGQFLRAREALSLRQHEEPNSGSSSLQKQKMHPAMYEDHVALGRPATGKLRCSERLPSFVKSRSCSCCNPCSXTEIDWQAHTIWRQENVLWRNTETPDVSTTITIAKPSGDESLEKQVSVGPRFQAEVPEWTGVFSESDSKWLGTHVWSLKNDTEPATATDVGRGRQEMCSCEFHGSVECVRLHIAENRMKLKLELGSEFYRLGFDRIGEEVSLQWTTEEEQRFKDIMKSNISSKNKYFWNNPSKYFPKKTRRNLVNYYFNVFLIQLRTYQNRVTPESVDSDDDEVEFGSFSDGFGMEAVKGPGDDFLECSLNKQCTDFE

SEQ ID NO: 3351 - protein, 91 aa, Glycine max
MGFRLPGIRKASLNQASSKAMDVPKGYLAVYVGEKMKRFVIPLSYLKQTSFQDLLSLAEEEFGYKHPMGGLTIPCGEDVFLDITSRLNNRC

SEQ ID NO: 3352 - protein, 491 aa, Glycine max
MASAYRNEPNWPRHRSGGAGFMGKVPFSNPNPNPNSNPKLANGKKTQSASDDASSINRRSNDAATHSQYVTFNVASCTKKELNDFKNRLVSELEQIQKLRNQIGSSEFQPGQSLNGHPKKPSGKKISGNKRPLPSNSAKDLKRSHSEVGNLMKCCSQVLQKLMKHKHGWVFNAPVDVVGLKLNDYCDIIKQPMDLGTVKSNLSKNVYATPADFASDVRLTFNNALAYNPKGHDVYTVAELLLTRFEELYRPVHEKFEGSIGHDRESEEELQASSWSHVEPERVKKKENPTPPPPPPPAKLQQEPPQPPASSSNPPLLQSPVRTPSPMRAPPVKPLKQPKPKAKDPNKRDMSLEEKHKLGLGLQSLPPEKMEQVVQIIRRRNGHLKQDGDEIELDIEAVDTETLWELDRLVTNYKKMVSKIKRQALMGNTNNNNNDVQSNKGNGELPSSEKVDGGPVEVKKPKKVEAGDEDIDIGDEMPTSMFPPVEKKKKK

SEQ ID NO: 3353 - protein, 232 aa, Glycine max
VMNVGDSRAVLAQKVEPDYWLGKIRQDLERINEETMNDLESWDVDTSNLVPSLSAIQLTKDHSTSVEEEIQKIKKDHPDDPFAVVNDRVKGSLKVTRAFGAGFLKQPKWNNALLEMFRIDYVGNSPYISCLPYLKHHRLGPKDKFLILCSDGLYQYLSNEEAVAEVELFITLQPEGDPAQHLVEEVLFRAAKKAGLDFHELLEIPQGDRRRYHDDVSIIVISLEGRIWRSCV

SEQ ID NO: 3354 - protein, 380 aa, Glycine max
MGGVTSLMAAKFAFFPPNPPSYKVVTDDMTGLLLLTPFPHRENVEIQKLPTRRGTEIVALYIRHPMATSTVLYSHGNAADLGQMYELFIQLSIHLRVNLMGYDYSGYGQSSGKPSEHNTYADIEAAYKYLEENYGVKQEDIILYGQSVGSGPTLDLASRLPRLRAVVLHSPILSGLRVMYPVKRTYWFDIYKNIDKIPLVKCPVLVIHGTADEVVDCSHGKQLWELCQQKYEPLWLKGGNHCNLELYPEYLRHLRKFISSVEKPPSQRVSFRRSIDRVEQSRGSTDCFETPRKSTDQRDKPRKSTDRTDKLKFHEFKFNNTEKLEKIRVQFDQMERSRRSVEYNDKSRSIEFQDKSRRSVDVQFERPRKSIDWLDRIRAS

SEQ ID NO: 3355 - protein, 141 aa, Glycine max
  misc_feature (39)..(39): Xaa can be any naturally occurring amino acid
  misc_feature (53)..(53): Xaa can be any naturally occurring amino acid
  misc_feature (55)..(56): Xaa can be any naturally occurring amino acid
  misc_feature (65)..(65): Xaa can be any naturally occurring amino acid
  misc_feature (75)..(75): Xaa can be any naturally occurring amino acid
  misc_feature (81)..(81): Xaa can be any naturally occurring amino acid
  misc_feature (110)..(110): Xaa can be any naturally occurring amino acid
  misc_feature (119)..(119): Xaa can be any naturally occurring amino acid
MATLDERPSAKRWLPLEANPDVMNQFLWGLGLPVDEAEXRDVFCLNEELLKMXPXXSLAVLFSYXITAKSEEERXAQENVXKDYSSKVYFMKQTGGNAWGTIGLASAFGXLTSEVSFGXGSSFGKSFKSPGSLIPWRGLFS

SEQ ID NO: 3356 - protein, 213 aa, Glycine max
  misc_feature (53)..(53): Xaa can be any naturally occurring amino acid
  misc_feature (87)..(87): Xaa can be any naturally occurring amino acid
MGMTPKIAPSMLSSDFANLASEAQRMLHFGADWLHMDIMDGHFVPNLTIGAPXIESLRKHTKAYLDCHLMVTNPLDYVEPLAKAGAXGFTFHVETSRENWEELIQRIKSHGMTPGVALKPGTPVGEVYPLVRVEAENPVEMVLVMTVEPGFGGQKFMAETMDKVSSLFLMLCLMWLTTLINYESCIYFFIFFPLILNFQTRYVYLGRSIHHLT

SEQ ID NO: 3357 - protein, 167 aa, Glycine max
MIKSTRPVAFDSYWTSPNSNDNGETVTYRFGSVGQDTQLLLWDLEMDEIVVPLRRPPGGSPTYSTGSQSSHWDNVVPLGTLQPAPSMLDVPKISPLVAHRVHTEPLSGLIFTQESVLTACREGHIKIWMRPGVAESQSSTSENLLATNLKEKPSLSSKISSNSSYKQ

SEQ ID NO: 3358 - protein, 681 aa, Glycine max
  misc_feature (263)..(263): Xaa can be any naturally occurring amino acid
PRVRTAFRVECFTVELTRRVDEGGVKDVLIDGGHVKGSLIERKAKARGQLYGDHHDVKKKLEKPGLTVVDHIGPGRVPKAIEGEQVAAGWPAWLSSVAGEAIKGWIPRSANTFERLHKIGQGTYSTVYKARDVINQKFVALKKVRFDNLDPESVKFMAREIHVLRRLDHPNIIKLEGLITSRMSRSLYLVFEYMEHDLTGLASNPDIKFSEPQLKCYMQQLLSGLDHCHSHGVLHRDIKGSNLLIDNNGVLKIADFGLASSYXDPHHKVPLTSRVVTLWYRPPELLLGASNYGVAVDLWSTGCILGELYCGRPILPGKTEVEQLHRIFKLCGSPSEDYWRKLRTPHSTVFRPPHHYRKCVADTFKDYPSTAVKLIETLLSVEPAHRGTAAAALKSEFFTSEPLPCDPSSLPKYAPSKEIDAKLRDEARRQRAVGGREQKFRPGGRQEKEPQTFILSKDNADSCISMQQGQRLPNSRSRNEFFNPHREPVSGHLVFPQKQSEDHKETLNYFSGPLYQRPLHSGPLVPGYGCEMVGREAGERRPHVSNKVNLPKLSGLVASRTSSLSGDQKENPVPSRPRETIEVQISLESTNGSESRRRHDTKHHSQRIDPRKIENGKVSTETLIQDGHGSMGNNIYHLSGPLLVSSNNIDQMLKERDRKIQEYSRRARMYKSGEIAHAKQN

SEQ ID NO: 3359 - protein, 355 aa, Glycine max
MIDLYIFNLPTNNNKNNNMNNIESYPPVLRHLDHHQLPPPPNPDPDKDPTQQDSDPIPIIDFSCLNHDKSKLDEACKDWGFFRLVNHGIPMTLLKKLQEVAKELFSLSFEAKEGACSGSPVSYFWGTPALTPSGTTTRGPQNMNWVEGFDVPLSQLPHFNPHQLPTLESIRLPIKDYKTHLSRIATTLFEAMAKNLDLSLKPSEPYLAENTGMVRVYRYPNCSDANVGWGMEAHTDSSVLSILNQDDEVSGLQVLKDDQWLTVKPIPNTLIVNLGDMMQAISDDRYKSVTHRVSINKHKERISICYFVFPGEDVAIESYKYKPFTYNEFRAQVQQDIKALGYKVGLSRFQHHEEC

SEQ ID NO: 3360 - protein, 655 aa, Glycine max
  misc_feature (246)..(246): Xaa can be any naturally occurring amino acid
ATAVTLCLVLPERGSIDALDGGMIEMVLDPDLNKTGDIWHICIEDLPRSNVLYGYRIDGPRDWGKGHRFDSSIVLVDPYAKLVEGSSLGPDPPMKLSKFLGTYDFDSLPFDWGENYKLPNISEKDLVIYEMNVRAFTSDESSGLDSNIRGSYLGMIEKIPHLLELGINAVELLPVFEFDELEFQRRPNPRDHMINTWGYSTINFFAPMSRYASAGGGSVNASREFKQMVKSLHSAGIEVILDVVYXNHTNEADDAFPYTTSFRGIDNKVYYMLDNNGQLLNFSGCGNTLNCNHPVVMELILDSLRHWVTEYHVDGFRFDLASVLCRGIDGSPINAPPLIRAIAKDAVLSRCKIIAEPWDCGGLYLVGSFPNWDRWAEWNGKYRDDVRKFIKGDSGVKGSFATRVAGSSDLYRVNNRRPYHSINFVIAHDGFTLRDLVSYNFKHNKANGEGGKDGSNDNFSWNCGFEGETDDASIRALRSRQMKNFHLALMISQGTPMMLMGDEYGHTRYGNNNSYGHDTAINNFLWDQLDARKSDHFRFFSNMIKYRHAHEVFNHESFLSKNDITWHEDNWDNHDSKFLAFTLHDRSGGDIYLAFNAHDYFVKVLLPAPPKKRNWFRVVDTNLKSPDDFVLDGVPNVGNTYNIAPYSSILLEAKF

SEQ ID NO: 3361 - protein, 246 aa, Glycine max
  misc_feature (101)..(101): Xaa can be any naturally occurring amino acid
FFLKSYTKQAHSALFPRSIKVLAKIESLESLHKLEEIVQASDGIMVARGDLGVEIPLEQIPTVQEDIIYVCRQLNKPVIVASQLLESMVEYPTPTFASMQXVADVSEAVRQYADALMLSGESAIGSYAQKALAVLDMASSRMESWSREENRQSLVNYHQLGASLPECITEQICNCAVEMANNLGVDAIFVYTKYGHMASLLSRNRPNPPIFAFTNDDSTRMALTLQWGVVPLLVDLSDDAESNISK

SEQ ID NO: 3362 - protein, 221 aa, Glycine max
  misc_feature (164)..(164): Xaa can be any naturally occurring amino acid
  misc_feature (179)..(179): Xaa can be any naturally occurring amino acid
PTGTATAVLINGFHTPKGDEMAKKQVHGFLKFFSFSFLWSFFQWFYAGDGDQCGFSQFPTFGLKAWKNSFYFDFSMNYVGAGMICSHLVNLSLLLGAVLSWGVMWPLIRGLKGQWFPESLSESSMKSLNGYKVFISIALILGDGLYNFAKILLFTATNIHASMXRRNHKSLSISDIQKXQQPLDLKRNEVFVRERIPIWLAFTGYILVSAISIIIIPLIFP

SEQ ID NO: 3363 - protein, 371 aa, Glycine max
MATTNPFDLLGDDAEDPSQLIAAEQLKAAAAASAATAAPKKAPAQQNKPAQLPTKPPPPAQAVRDARNEPVRGGRGGGRGGGRGFGRGRGFSRDSSNDENSFPTSGAPYNQVSFEGDAGKSSERRGYGGPRGPYRGGGGRRGGFSNGETGEAEEGRPRRAFDRRSGTGRGNEFKREGSGRGNWGAQTDELAQVTDEVANETEKNLGDEKPAVEEDVADGNKDSPTNETEEKEPEDKEMTLEEYEKVLEERRKAFQALKTEERKVDTKEFESMQALSSKKDNHDIFIKLGSDKDKRKEAFEKEEKSKKSVSITEFLKPAEGEAYYNPGRGRGRGRGSRGGGGGGGVYRGSSTNNAPAPSIEDPGHFPNLGAK

SEQ ID NO: 3364 - protein, 278 aa, Glycine max
MSKEVSQEGLQRKDYVDPPPAPLFDLAEIKLWSFYRALIAEFIASLLFLYVTVATIIGHKKQTGPCDGVGLLGIAWSFGGMIFVLVYCTAGISGGHINPAVTFGLFLARKVSLIRAVFYMVAQCLGAICGVGLVKAFMKHSYNSLGGGANSVSAGYNKGSALGAEIIGTFVLVYTVFSATDPKRSARDSHVPVLAPLPIGFAVFMVHLATIPITGTGINPARSLGAAVIYNNGKVWDEHWIFWVGPLVGALAAAAYHQYILRAGAIKALGSFRSNPTN

SEQ ID NO: 3365 - protein, 619 aa, Glycine max
MNKSSDAAASPYCRGRSKKPNLRSSKSQPPSHVEFSSKTPEKPPQRIRNRGVALSVADIRKAACKRLQDQKQCTETTSSSLSSSSSLSKSVRRQISLGPSSPSKPMATEDESSNLPEKYEILDEFFNRLDTLVSLHRLKRWTPTFTSISSRIESLTDRRFTHSHLAQLKFILRKAIVLRKHLVLDERTSCMKPDIHISLDPDAVEADAAKLPPQGGRVSLKKVFRARLKEFWESHPEGDEIPEGTLPEPFNRQKKDSVVDMLETPLPTKLPPCMRYSDIVNNADLDEKLYVPVNATVEFPNEHLAAPSHMAPSFRADDVQQNPLLDSLQPLAFPVSESSQKENPPLVDTESHLKTSPAKFSSEASSSESCLTICASLESSSPHPATPSKTIEYTEKKDGSLKSIDAMSTPTSRTNKYTENKDGSLESIDATSTPAKLVSTPIRLMSATPALRSPKRRYMSPDDHSISSLNKLARHPSRSRSLKFDTPVKNKDDISDTLQEEFIQSIREKERLAMEERDPAITQAKKRKKNIASLPKLFDMIRGLLRQRNCITKAELVSKIISTRCDIADRSEVEEQLNLLQELAPEWIYEKHVYSGDLLLFINKMLSPETVRASLEEAT

SEQ ID NO: 3366 - protein, 143 aa, Glycine max
  misc_feature (28)..(29): Xaa can be any naturally occurring amino acid
  misc_feature (73)..(74): Xaa can be any naturally occurring amino acid
VGNPDGDYKAPYAIIYRNMAILGVEGFXXLPHHCLQLCCGFFAFAVATNLVRDLNPKNIGRWIPLPMAMAVPXXVGGYFAIDMCMGSLVVYAWQTLKSKEASLMVPAAASGLICGDGFWILPSSILALFKVHPPICMRFLPTK

SEQ ID NO: 3367 - protein, 530 aa, Glycine max
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVFCMSFVKDAAGYIAVRFLIGFSLATFVSCQYWMSTMFNSKIIGLANGTAAGWGNMGGGATQLIMPLVYELIRRAGATPFTAWRIAFFVPGFMHVIMGILVLTLGQDLPDGNLGALRKKGDVAKDKFSKVLWYAITNYRTWIFALLYGYSMGVELTTDNVIAEYFYDRFNLKLHTAGIIAASFGMANFLARPFGGYASDVAARLFGMRGRLWTLWILQTLGGVFCIWLGRANSLPIAVLAMILFSIGAQAACGATFGIIPFISRRSLGIISGLTGAGGNFGSGLTQLVFFSTSKFSTSTGLSLMGVMIVCCTLPVTLVHFPQWGSMFLPPSKDVNKSTEEYYYTSEWNEEEKQKGLHQQSLKFAENSRSERGKRVASAPTPPNTTPTHV

SEQ ID NO: 3368 - protein, 444 aa, Glycine max
MDGDDETSGPMIDEIYANGGGDDGDKRSRRAIMSGDQVDIEAYAALYSGRTKIMRLLFIADKMNNAASQLEALRMAYDEIKKGENTQLFREVVQKIDGRLGPNYGMDAAWCDAIDRRAEQKKEKLENELNAYRTNLIKESIRMGYNDFGEFYYAHGQLGDAFKSYVRTRDYCTTSKHIVHMCMSAILVSIEMGQFPHVTSYVSKAEQSPDALEAVTVAKLRCAAGLANLEAKKYKLAARKFLETGPELGSHYNDVIAPQDVATYGGLCALATFDRAELKSKVIDNSNFRNFLELVPEVRELINDFYSSHYASCLEYLGNLKANLLLDIHLHDHVETLYDQIRHKALIQYTLPFVSVDLNMMANAFKTTVAGLEKELEALITDNQIQARIDSHNKILYARHADQRNATFQRVLETGREFDRDVRSMLLRSNLIKHEFNLRALRKL

SEQ ID NO: 3369 - protein, 484 aa, Glycine max
  misc_feature (109)..(109): Xaa can be any naturally occurring amino acid
MFKKIMKGGHKKPSKSDASDPAPQPYAAANFSAPAAPSANVVVNFVSLTPLTLSSGGSVEPVPPFRDAPVAERQNLFLRKLHVCCYILDFSDTLKNVREKEIKRQALMXLADFIQSGSGKISENCQEEMIRMISVNIFRCLPPASHENTGQEPTDPEEEEPSLDPSWPHLQLVYELLLRYVVSSDTDTKIAKRYIDHSFVLKLLDLFDSEDPREREYLKTILHRIYGKFMVHRPFIRKAINNIFYFRFIYETERHSGIGELLEILGSIINGFALPMKEEHKLFLARALLPLHKPKPVGVYHQQLSYCIAQFVEKDYKLADTVIRGLLKYWPVTNCQKEVLFLGELEEVLEATQTAEFQRCMVPLFRQVARCLNSSHFQVAERALFLWNNEHIVSLIAQNRTVVLPIIFEALEKNIKSHWNQAVHGLTVNVRKMFIEMDAELFEECQRQYEEREAKAKELEEQRELNWKRLADAAAQNGVDMVTA

SEQ ID NO: 3370 - protein, 287 aa, Glycine max
  misc_feature (185)..(185): Xaa can be any naturally occurring amino acid
  misc_feature (200)..(200): Xaa can be any naturally occurring amino acid
TNDKPNTDRHPNYRVDNIDDERFFADPNDSLIDRRSECTSLSSEGYLSDNPWPFGRKYVEVLNISKADSAISPGCTKSEIPQKVLESLFNIPKSTEHDKDTMNWRNVVKKIQSLGPGFNVSPHVAESQQHTCAKGDEYHVFREDSKQQWDSVKSYYTKAATAYTKRERAYAAYLSDQGKEQTKLXQKADTKASHDIFVAXHVKQAMRMLKLHLLFGSYVPSVQTLRVITGCGSHGVGKSKLKQSVINLLDREAIEWREENRGTVLIKLSRWREYSFLDTSSDSDSND

SEQ ID NO: 3371 - protein, 434 aa, Glycine max
  misc_feature (292)..(292): Xaa can be any naturally occurring amino acid
MKNPRKKKRPKPAQKKVLEENNKGVVVAGNENEEEEKRKRSVLEALVEAFSLSSIREASMAYEIAGGDPDRASEILRKGSSDRFEDSFSCFSYGSSSSGGSSGGGGSSSCSGLELGSKGGRQQKKKVVASTGTVSTVLGKEYVRRNNIRNKGFSSNGVFEMEEAEQFLCSMLGDDSDINLAVVRDVLCQCGYDIERASDILLDLAASTNEKPNTARHPNYGVDNIDDERFFADPNDSLIDRRLECTSLSWEGYLSNNPWSVGSFGRKYAEVLNNSKANSAVSPRCTKSEIPXVWVESLLYHAEDDRRDQGKEQTRLAQKADTKASHDIFIARNKGIENMITIDLHGQHVKQAMRMLKLHLLFGSYVPSVQTLRVITGCGSHGVGKSKLKQSVINLLDREAIEWREENQGTVLIKLSGWREYSFLDTSSDSDSND

SEQ ID NO: 3372 - protein, 348 aa, Glycine max
MKNPRKKKRPKPQKKLEKNKGVVAAAAVVAENENENEEEKRKRSVLEALVEAFSLSSIREASMAYEIAGGDPDRASEILRKGSSDRFEDSFSCFSYGSSSSGGSSGGGGSSSCSGLELGSKGGRQQKKKVVASTGTVSTVLGKEYVRRNNIRNKGFSSNGVFEMEEAEQFLCSMLGDDSDINLAVVRDVLCQCGYDIETASDVLLDLAASTNDKPNTDRHPNYRVDNIDDERFFADPNDSLIDRRSECTSLSSEGYLSDNPWPFGRKYVEVLNSSKADSAISPGCTKSEIPQKVLESLFNIPKSTEHDKDTMNWRNVVKKIQSLGPGFNVSPHVAESQQHTCAKGVTI

SEQ ID NO: 3373 - protein, 235 aa, Glycine max
SARVPLLGGLLSVWYSDFFQAQTHLVAPFDQYLHRFPAYLQQLSMESNGKTITSDGSSAKYTTGPILFGEPCTNAQHSFFQLVHQGTKLIPTDFILAAKSHNPVSDNLHQKMLASNYFAQAEALMVGKTDDQVRAEGTPEELVPHKRFLGNRPTTSILVGGAIGPAELGALIVYYEHLTFTEGAIWDINSFDQWGVELGKVLAKKILKELDEAGNGEGHDASTGGLIGAFKKYGN

SEQ ID NO: 3374 - protein, 158 aa, Glycine max
MRRNLLLGLRNGLAQLQLLLLCQILSLKKICFSAGFHPFFMSFILAPLATNAREATSAIKEASHKKPRTTSLAISEIYGGVFMNNILGFFAISVLIFVREVTWQFSAELLVVAIVCAITGITASFHSIFPIWSSFIAILLYPLSLVLVFILDHVLNYN

SEQ ID NO: 3375 - protein, 115 aa, Glycine max
VKDAEVVHELKNYLKSCGADIHVIVKIESADSIPNLHSIITASDGAMVARGDLGAELPIEEVPLLQEEIINLCRSMGKAVIVATNMLESMIVHPTPTRAEAGFVSRSLSHIHGIL

SEQ ID NO: 3376 - protein, 187 aa, Glycine max
  misc_feature (10)..(10): Xaa can be any naturally occurring amino acid
  misc_feature (55)..(55): Xaa can be any naturally occurring amino acid
  misc_feature (157)..(157): Xaa can be any naturally occurring amino acid
LLGAIISWGXLWPFVSEHAGDWYPADLGSNDFKGLYGYKVFISIALILGDGIYNXLIKIILITITEMWRASSKQLPVVTEVQDDESSQLQSEEKRRDEVFLKDRIPTWFAASGYVGLAAISIATIPIIFPPLKWYLVLCSYILAPALAFCNSYGTGXFTDWSLASTYGKIGLFIIAAAVGQNGGVIA

SEQ ID NO: 3377 - protein, 93 aa, Glycine max
MGFRIAGIIRRASCSTTQAASKRVEVPKGYLAVYVGDKMRRFMIPVSYLNPPSFQELLNQAEEEFGYDHPTGGLTIPCQEDEFLNVTSRLNEL

SEQ ID NO: 3378 - protein, 158 aa, Glycine max
  misc_feature (123)..(123): Xaa can be any naturally occurring amino acid
HVTCALVYGPTPTGRIHKGVCSTWMKNAIPLEKSPDCCWAPIFIRPSNFKLPVDHSIPIIMVGPGTGLAPFRGFLQERFALKEDGVQHGPAILFFGCRNRRLDYIYEEELTNFVEQGSSCQNXIVAFYREGAEKEYGQHKMMDQAAHVSVVAAKAAGV

SEQ ID NO: 3379 - protein, 115 aa, Glycine max
  misc_feature (31)..(31): Xaa can be any naturally occurring amino acid
SRQVHGIQLKRADMIISVLIKQAGLPLQEHXLEIPILNDIAFIGEIDLGGELRMVPRMEKKVYTVTKLGFRMCIVPKVAEKALGTEGFEKMEVVGCRNLKDIINTVFPNLMRRSQ

SEQ ID NO: 3380 - protein, 101 aa, Glycine max
TRETSGTGDHQVEEPLDLIRLSLDERIYVKMRHGRELRGHLHAYYQHLNIVLGDVEEIITNVEIDEETYEEVYKITKRNVPMLFVRGDGVILVSPPIRAGN

SEQ ID NO: 3381 - protein, 150 aa, Glycine max
MQGFANREAIATTISSRKATFYSRSRSTLWTKGETSNNFINVHDVFIDCDRDSIIYLGKPDGPTCHTGAETCYYTSVFDLLKQQEAEENKLALTSLYALESTISQRKTELIGENEKPSWTKRLLLNDKLLCSKIRLCISVMLLCCFGIRG

SEQ ID NO: 3382 - protein, 77 aa, Glycine max
  misc_feature (16)..(16): Xaa can be any naturally occurring amino acid
LYLSTCREEANELCQXLENNEGESRTASEMADVLYHSMALLAKKGVKIEDVLQVLRLRFSQSGIEEKKSRVFQKSMD

SEQ ID NO: 3383 - protein, 90 aa, Glycine max
MGFRLPGIRKSLFAANQASSKAVDAPKGYLAVYVGEKMKRFVIPVSYLNQPLFQDLLSEAEEEFGYDHPMGGLTIPCSEDTFQHITSFLN

SEQ ID NO: 3384 - protein, 71 aa, Glycine max
MIQVPRMEKRVYTVTKLGFRMCIVPKVAEKALGTEGFEKMEVVGCRNLKDIINTVFPNLMRRSLVTDNIFV

SEQ ID NO: 3385 - protein, 153 aa, Glycine max
  misc_feature (62)..(62): Xaa can be any naturally occurring amino acid
  misc_feature (112)..(112): Xaa can be any naturally occurring amino acid
  misc_feature (126)..(126): Xaa can be any naturally occurring amino acid
  misc_feature (137)..(137): Xaa can be any naturally occurring amino acid
  misc_feature (150)..(150): Xaa can be any naturally occurring amino acid
GPEFRADCSSSVGGETPCNNNDARLVFDQSAFCDALALCCLRDLRRLPGGADIIGLTSCNEXKHFARREKRAIKKLESSLQLYEAGRATRLAIKASVEKTKRRFDNYAKHGXLCGGDGMPHLIVSXDQMHCGEFITXPGLLFLYIYGWIXWVG

SEQ ID NO: 3386 - protein, 121 aa, Glycine max
MASSMLSSAAVGTSPAQATMVAPFTGLKTSAAFPATRKANNDITSIASNGGRVSCMKVCPPDGKKKFETLSYLPDLTEVELGKEVDYLLRNKCTPCAEFQLEHEFVYRDHRSKPGYYDARY

SEQ ID NO: 3387 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSERASKEPKSPSKATKSPKKA

SEQ ID NO: 3388 - protein, 149 aa, Glycine max
MDTGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKS

SEQ ID NO: 3389 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKA

SEQ ID NO: 3390 - protein, 386 aa, Glycine max
MEGEEGSQQPQLVLADKLFLLRQPDVQDIDKVRYKEDVFTHIKENDMVPLYETLVADSVLDLDRALLDSMRAKIDDELTKLDEKIADAEENLGESEVREAHLAKSLFFIRIMDKEKALEHLKVTETKTVAVGQKMDLVFYTLQLGFFDMDFDLISKSIDKAKNLFEEGGDWERKNRLKVYEGLYCMSTRNFKKAAKLFLDSISTFTTYELFPYDTFIFYTVLTSIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTEDFIDVELSRFIAAGKLHCKIDKVEGVLETNRPDAKNALYQATIKQGDFLLNRIQKLSRVIDL

SEQ ID NO: 3391 - protein, 174 aa, Glycine max
MPTSSKPPKLSSENLKRTVSDISFELAKEEIDDHLKLPAISEVENANCECCGMCEECTPEYIDRVREKFNGKWVCGLCAEAVKEELEKNGGKKEEAVSAHMSACVKFNKYGRAFPVLFQAQAMKEMLKKNTLDGRRAKSISPRDKGGAKKGGISRSSSCIPAITREINDIKIAN

SEQ ID NO: 3392 - protein, 271 aa, Glycine max
  misc_feature (132)..(132): Xaa can be any naturally occurring amino acid
KRHDVHSSLTSEFSSSQIVGLIGSHLCIWRRNGKRSIFPSLEGKFVKGSCMRYFDPEAVVGCDDGAVRVFDMYSRKCSQIIRMHYAPITCLCLSEDQLIMIGSTSGSITMSDPSSVQQVATLRSSDARDNQXARSAVGYAYCWDLRTRKLLWSNRVSPNVIYSLQHMHSDTSTLAVGGIDGILRLLNQNDGSVVSSCVMGDKLLSTFQSPSGSIQRRKGSRLPENIYINIDLIPKTARPSITCLAVGMKKIVTTHNTNDIRLWKFKSKISL

SEQ ID NO: 3393 - protein, 212 aa, Glycine max
MMNASKFIKCVTVGDGAVGKTCMLICYTSNKFPTDYIPTVFDNFSANVAVDGSIVNLGLWDTAGQEDYSRLRPLSYRGADIFVLAFSLISRASYENVLKKWMPELRRFAPNVPIVLVGTKLDLREDRGYVADHMGSNVITSAEGEELRKQIGAAAYIECSSKTQQNVKAVFDTAIKVVLQPQPPRRKEMARKKRHRRSGCSFVSIMCGGCAA

SEQ ID NO: 3394 - protein, 172 aa, Glycine max
  misc_feature (87)..(87): Xaa can be any naturally occurring amino acid
MKNANGLISTTSSNTAQSQSTGLKTYFKTHEGRYKLYYDKTYPSTLLHYAHGKTVSQVTLAHLKDKPVPSTPTGQSSTFSATSGVRXAAVRLWGGSNGGRSLSFVGGNGTSKNLGGNSRIGSIGASSSSNATSNSNFDGKGTYLIFIFSALLVFFSPLSYSAFAILFCIAIM

SEQ ID NO: 3395 - protein, 345 aa, Glycine max
AHVSSVLGSRGSVEAAERNKLVFMEGGVYGFGLEDLLRASAEVLGKGSMGTSYKAILEDGTTVVVKRLKDVAAAKREFEARMEVVGNVKHENVVPLRAFYYSKDEKLLVYDYMAAGSLSALLHGSRGSGRTPLDWDTRMKIALGAARGLACLHVSGKLVHGNIKSSNILLHPTHEACVSDFGLNPIFANPVPSNRVAGYRAPEVQETKKITFKSDVYSFGVLMLELLTGKAPNQASLSEEGIDLPRWVQSVVREEWTAEVFDAELMRYHNIEEEMVQLLQIAMTCVSLVPDQRPNMDEVVHMIQDISRSETTDDGLRQSSDDPSKGSDGHTPPQDARTTPRSDTS

SEQ ID NO: 3396 - protein, 228 aa, Glycine max
  misc_feature (163)..(163): Xaa can be any naturally occurring amino acid
MASLSCQVHSTNLLNSKNVNSRRKRFISCSAQPTQNNIKVVINGATKEIGKAAVVAVTKARGMEVAGAVDTCHIGEDIGKICGMEEPLEIPIINDLTMILGSISQSKAAGVVVDFTDPSSVYDNVKQATAFGMKSIVYVPRIKLDTVAALSAFCEKASMVSMXGVLVAPTLSIGSILLQQAAISASFHYSNVEIVESRANANVRILFYVYCCINVFGSSFLYVGGKTK

SEQ ID NO: 3397 - protein, 160 aa, Glycine max
  misc_feature (97)..(97): Xaa can be any naturally occurring amino acid
MSDREDNAPEEFTTEQGIQQDEEIRRIQRENKARVVREGKERRRRWAQKITPRPSKAGKKSEDVEDSEPQQESNTAAGFLPDNIVQMLAAREKQVSXSDNNEEKDEIKPTTSRKRKSRKSGLKPVILSEIGPPPCLNSALDFLKKKQMSVQRSSSVLNNS

SEQ ID NO: 3398 - protein, 473 aa, Glycine max
MEFLTLLYGAMALYLCFLIWKLFDQRRDQESYILDYQLYKPSDERKLGTELCGKIIGRNKQLGLNEYKFLLKAIVNSGIGEETYAPRNVIEGRETNPTLDDSVTEMEEFFHDSIAKLLERSGISPSQIDVLVVNVSMFAVVPSLTSRIINHYKMREDIKAYNLTGMGCSASLISLDIIRNIFKSQKNKIALLVTSESLSPNWYNGNDRSMILANCLFRTGGCVILLTNKRSLKQRAMFKLKCLVRTHHGAKEDAYSCCNQKEDEQGNLGFYLAKNLPKAATRAFVENLRMLSPKVLPTRELLRFMIVSLIKKLSQTSSLKSSSGGSSKSSKSPLNFKTGVEHFCLHTGGKAVIDGIGKSLDLCEYDLEPARMTLHRFGNTSASSLWYVLGYMEAKKRLKKGDRVLMISFGAGFKCNSCLWEVMKDLGDHTNVWSYCIDDYPPESLANPFMETFGWINNVEDATNFKLPDLFLK

SEQ ID NO: 3399 - protein, 653 aa, Glycine max
  misc_feature (52)..(52): Xaa can be any naturally occurring amino acid
LERDEDLEEQVPAAAEVEPQPWTEQITVRGLFVSMIIGITFSIIVMKLNLTXGMVPNCNVSAALLAFVFIRTWTKLLHKAGFVAKPFSRQENTIIQTCAVACYSIAVGGGFASYLLGLNRTTYELSGVENEGNNPGAIKEPGFGWMTGFLFVVCFVGLFVLIPLRKIMIVDLKLTYPSGLATAVLINGFHTQGDKMAKKQVRGFTKYFCTSFLWGLFKWFFSGIEDCGFEQFPTFGLQAWKQTFYFDFSMTFVGAGMICSHLVNCSLLLGAVLSFGVMYPLIDRLKGDWFPDNLEETNMKGLYGYKVFVSIALILGDGIYNFTKILISTVLNVNERMRSKNNKNVAADRHENPTEDLKQTDEFLRETIPLRIGVIGYVVFTMISIIIIPQMFPQLKWFYVVVAYIFAPSLAFCNAFGTGLTDMNMAHNYGKVALFVIAAMSGRDNGVVAGLVGCGLVKSVVSVACTLMHDFKTAHYTRTSPRAMFICQVIGIAMGCVTAPLSFFLYYKAFDVGNPHGEFKAPYALIYRNMAIIGVQGFSALPLHCLQLCFGFFAFAIGVNMIRDFAPQKIGKWMPLPMVMAVPFLVGAYFAIDMFIGTVVVFAWQKLDSKKAELMVPAAASGLICGEGLWTLPAAILALARIKPPICMKFVPT

SEQ ID NO: 3400 - protein, 133 aa, Glycine max
MNARRDGRNNRVALFDGIEEGGIRASSLYSSTSSHEIDEHDNEQALDGLQDRVNLLKRLSGDINEEVDSHNRMLDRMGNDMDSSRGVLSGTMDKFKMVFETKSNRRMFTLVASFVVLFLIIYYLTRFDVLNRY

SEQ ID NO: 3401 - protein, 342 aa, Glycine max
  misc_feature (187)..(187): Xaa can be any naturally occurring amino acid
QLRRPPPPLKFSIVFFFFRFSIFYSMGIGGSALGPHFVAEALAPDNPPLKIRFVDNTDPAGVDHQIAQLGLELASTLVIVISKSGGTPETRNGLLEVQKAFREAGLDLPKQGVAITQENSLLDNTARIEGWLARLPMFDWVGGRTSEMSAVGLLPAALQGIDIIEMLAGASLMDEANRSTADMAILXPYKDSLLLFSRYLQQLVMESLGLEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASPLSTINGLIIKQWWEKPG

SEQ ID NO: 3402 - protein, 519 aa, Glycine max
  misc_feature (186)..(186): Xaa can be any naturally occurring amino acid
MDLPLLSKSLQFSLRNKNYLLLIALFGASGYAAYNSPYVAQKRRRIAKLLRAFVSLAELISNSADIVAVISNDLNRFLASESDEIPNSLKQLAKIAKSNDFSTSLARLSEAVTLGIFLGYKSHAGNDYNGNKDNIPSEITAEASRFSDRVLERLFSKAGTGFVSVVVGSFARNLVLGFYDARIRRXRSQSDVPGWVNVICDERCGKLIGDCVQTFVSTAVAVFLDKTKDVNTYDEMLAGLSNPKHQENVKGILVSMCNGAVETFVRTSHQVLTNRSVRSNSGLSVSPVVVPVSEEGCLKQEALLQQLKIGSSVNGVQDVGWLEQIKSTLLVPVNQRFVLDVTGRVTIETVRSFVAFLLWRISDGFKSSVSKVHEEVLGKGLEVVRYVGAKSSVILTLCLALYLHIMGGSRILLPAWRAPYRPPKGGRRSPRAAPGRERRCTRGHAQRAAPEGSETGATGWGAPKGSREAKKRTGRWAGSPRPRTRSNDLSHLAQIYIASMLDAYNTTPENCDNYFIPLS

SEQ ID NO: 3403 - protein, 137 aa, Glycine max
YRFAYFSSPPSSIFRFPKYPSKHVKFSLLPLSFATMEAPPEGYRRNVGICLMSNHKKIFAASRLDIPNSWQMPQGGIDEGEDPRNAAIRELREETGVNSAEVIAEVPYWLTYDFPPKVREKLNIQWGSDWKGQAQKW

SEQ ID NO: 3404 - protein, 144 aa, Glycine max
MQMDVYTHISLPSFISHRFSSSRFQCSSLSSYSPFKLVCSNRDSKESQRNDDNNNKGDKSSTDWDKAWSKFKKQGGKKPFSKFSDKYVSWNPKRSEFPLSEEVDPIKRTERSNLSFWNSPTFTLGGAIIIVLFLLLYTILAPIK

SEQ ID NO: 3405 - protein, 252 aa, Glycine max
  misc_feature (129)..(129): Xaa can be any naturally occurring amino acid
MAATNASIFASSTQSCLPVSPTISNTLVSPFLNVSSPRSYLVKKKHVKFSKHISAAAVATTTTTEEIQEYKLPSWAKFEIGRAAVYWKTMNGLPPSSGEKLKLFYNPAATQLVPNEEFGIAFNVKFHPXGGFNQPIMCGGEPRAMLRKYRGKADAPIYSIQICIPKHALNLIFSFTNGVDWDGPYRLQFQVPKALQNKPIDFFNKGLAEELSKEGACEQAIFPDTNKIITKCAMIGNLSKEGVSKFFNFFTL

SEQ ID NO: 3406 - protein, 168 aa, Glycine max
MSGTVKKVSDVAFKVGRNIDWDGMAKLLVSDEARREFSNLRRAFDEVNSQLQTKFSQEPEPIDWDYYRKGIGTRLVDMYKEHYESIEIPKFVDTVTPQYKPKFDALLIELKEAEEKSLKESERLEKEIAEVQELKKKLSTMTADEYFEKHPELRKKFDDEIRNDNWGY

SEQ ID NO: 3407 - protein, 486 aa, Glycine max
  misc_feature (35)..(35): Xaa can be any naturally occurring amino acid
  misc_feature (94)..(94): Xaa can be any naturally occurring amino acid
MFKKIMKGGHKKPAKSDASDPVPPPYAAATVALRXAPSANAVSNHASRISSTPLTLSSGGSIEPVPLFRDAPVAERQNLFLRKLHVCCYVLDFXDTLKNGSRKEIKRQALMDLVDFIQSGSGKISENCQEEMIRMISVNIFRCLPPASHENTGQEPTDPEEEEPSLDPSWPHLQLVYELLLRYVVSSDTDTKIAKRYIDHSFVLKLLDLFDSEDPREREYLKTILHRIYGKFMVHRPFIRKAINNIFYRFIYETERHTGIGELLEILGSIINGFALPMKEEHKLFLARALLPLHKPKPVGVYHQQLSYCIAQFVEKDYKLADTVIRGLLKYWPVTNCQKEVLFLGELEEVLEATQTAEFQRCMVPLFRQVARCLNSSHFQVAERALFLWNNEHIVSLIAQNRTVVLPIIFEALEKNIKSHWNQAVHGLTVNVRKMFIEMDAELFEECQRQYEEREAKAKELEEQRELNWKRLADAAAQNGVDMVTA

SEQ ID NO: 3408 - protein, 575 aa, Glycine max
MNPLRRSHNSQSSSSNSSPSSSVATSSSSSSSWIHLRSVLFGVTSSSPASCSSSERPHIANYIVWIFPLLFFGDGAVNIMISGLKSPWSQRKRKHALSPQQWKSMFAEDGRFCDGGNKFLKRVRSGGVDPSIRAEVWPFLLGVYDLDSTKEERDAKRTQNRKQYEKLRRQCQKLLKQSNERNKLNEVGEISYEEDSGSLSQDSGSASSDDATSARESLSCEDRSPDVEYSDNPSSALLEGDDVPNANNTDVSTLDTDFSDSDSSEGPEVIQTVPSDDVQEHNDLDKASEEVSSPSKAKIPSKLPTSEDFSTWQRIIRLDAVRANAEWMPYSPSQAIVPDSRAYRSAEAVGLKDYSHLDASRIFHAARLVAILEAYALYDPEIGYCQGMSDLLSPIVSVIPEDHEAFWCFVGFMKKARQNFRLDEVGIRRQLDIVAKIIKFKDAHLFRHLEKLQAEDCFFVYRMVVVMFRRELTFEQTLCLWEVMWADQAAIRAGIGKSAWSRIRQRAPPTEDLLLYAISASVLQKRKLIIEKYSSMDEIIKECNSMSGHLDVWKLLDDAHNLVVTLHDKIETSLS

SEQ ID NO: 3409 - protein, 213 aa, Glycine max
MASASGNGVSNGSGSPCGACKFLRRRCASDCIFAPYFCSEQGPARFAAIHKVFGASNVSKLLLHIPAHDRCEAVVTITYEAQARIRDPVYGCVSHIFALQQQVAPWQAQLMQVKAQLAQNLVESRNIESNHQWPGNNNSVSGPPMNHPFCPPYMNPISPPSSLESIDHSTINDGMSMPDIQSREDFQIQAKERPYNNNDLGELQELALRMMRN

SEQ ID NO: 3410 - protein, 1248 aa, Glycine max
TICHASALASHELNKACNLRGLLKFKEAAVKVSLDEVEPASEIVKRFCTGAMSYGSISLEAHTALATAMNKIGGKSNTGEGGEQPSRMEPLSDGSKNPKRSAIKQVASGRFGVTSYYLTNADELQIKMAQGAKPGEGGELPGHKVVGDIAVTRNSTPGVGLISPPPHHDIYSIEDLAQLIHDLKNANPAARVSVKLVSEAGVGVVASGVVKGHADHVLISGHDGGTGASRWTGIKNAGLPWELGLAEPHQTLVANDLRGRTVLQTDGQIKTGRDVAIATLLGAEEFGFSTRADSARGCIMMRKCHKNTCPVGIATQDPVLREKFAGEPEHVINFFFMIAEEMREIMSQLGFRTVNEMVGRSDMLEVDKEVIKSNEKLENIDLSLLLRPAAELRPEAAQYCVQKQDHGLDMALDNKLIGLSNAALEKGLPVYIESPIHNVNRAVGTMLSHAVTKKYHLNGLPTDTIHIRFNGSAGQSFGAFLCPGITLELEGDGNDYVGKGLSGGKIVVFPPKGSTFDPKQNIVIGNVALYGATSGEAYFNGMAAERFCVRNSGAKAVVEGVGDHGCEYMTGGIVVVLGNTGRNFAAGMSGGIAYVLDMDGKFLSRCNHELVDLDKVEEEEDITTLRMLIQQHQRHTNSVLAKEVLADFENLVPKFIKVFPKEYKRVLASIKSKEASKDAAESASKHGEEQDEIELVEKDAFEELKKLATASVNGKPIEAESFKRPSQVIDPVKHRGFVAYEREGVQYRDPNARINDWNEVMKETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPARRTGKRVAVVGSGPSGLAAADQLNKMGHTVTVYERADRIGGLMMYGVPNMKADKVDIVQRRVNLMAEEGINFVVNANIGHDPLHSLDRLREENNAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVRWEKDETGRFQFKEIEGSEEIIEADLVLLAMGFLGPESTIAEKLGIERDNRSNFKAEYGRFSTSLKGVFAAGDCRRGQSLVVWAISEGRQAAAQVDSFLTNEDLEHNVAGSPDELIKKKQQPRDTVAVANKQ

SEQ ID NO: 3411 - protein, 170 aa, Glycine max
  misc_feature (39)..(39): Xaa can be any naturally occurring amino acid
MVCSLVSSLRVSPPLRMSAAIDSYYLTPNFPSDTVFDSXPTHTGRNFLHAKKGCSVNFEFLNYTVIVRKCKGPRYPPKECCGAFKEFACPYADVLNDLTNECASTMFSYINLYGKYPPGLFSSECREGKFGLACPAVPPSAVSADDTANQAVHCPSLLLMLIACFLILLF

SEQ ID NO: 3412 - protein, 415 aa, Glycine max
MASWDQMGELANVAQLTGVDAVRLIGMIVRAASTARMHKKNCRQFAQHLKLIGNLLEQLKISELKKYPETREPLEQLEDALRRSYILVNSCQDRSYLYLLAMGWNIVYQFRKAQNEIDRYLRLVPLITLVDNSRVRERLEVIEMDQREYTLDDEDQKAQTVIFKPEPDKDDTAVLKKTLSCSYPNCSFTEALKKENEKLKLELQRSQANLDMNQCEVIQRLLDVTEVAAYSVPAKCSPEKSHKKEEYNYSDANSDKDHSSDEKYHAKIDKHSPSRYSVAQKDLASTGGSYQQEDWHTDLLACCSEPSLCMKTFFYPCGTFSKIASVARNRPISSGEACNDLMAYSLILSCCCYTCCVRRKLRKMLNITGGFIDDFLSHLMCCCCALVQEWREVEIRGLSGSKTKTSPPPSQYMES

SEQ ID NO: 3413 - protein, 175 aa, Glycine max
  misc_feature (62)..(62): Xaa can be any naturally occurring amino acid
  misc_feature (116)..(116): Xaa can be any naturally occurring amino acid
SILQCIWVAFCNAYGCGLTDWSLASTYGKLAIFTIGAWAGASQGGVIAGLAACGVMMNIVSXASDLTQDFKTGYMTLASPRSMFLSQVLGTAMGCVISPCVFWLFYKAFGNLGIPXSAYPAPYALVYRNMAILGVDGFSALPQYCLTLCCVFFVAAIGINLVRDLVGEKWAKFIP

SEQ ID NO: 3414 - protein, 108 aa, Glycine max
  misc_feature (23)..(23): Xaa can be any naturally occurring amino acid
MQWRIQLFCCRRWFRADEFEFKXSPVDDSVCKQQGIRYLWRDGSRLVLRLSGTGSVGATIRIYIEQYEKDSSKTGRESSDALSPLVDVALKLSKIQEFTGRFAATVIT

SEQ ID NO: 3415 - protein, 92 aa, Glycine max
RGNISSHDFEKTLKKMCKEGVYWGTIAGVYVGMEYGVERIRGTRDWKNAMIGGAVTGALVSAASNNKKDKIAIDAITGAAIATAAEFINYLT

SEQ ID NO: 3416 - protein, 183 aa, Glycine max
  misc_feature (54)..(54): Xaa can be any naturally occurring amino acid
MPWARLSGSPRLDVAIDMGNPFLNLTVDGFLKIGAVAATRSAAEDTYHIIQKGXASISQILHPIYFSCYFPFFSEPKEVKFDSYDTFYFYQKGINSSHDFEKTLKKMCKEGVYWGTIAGVYVGMEYGVERIRGTRDWKNAMIGGAVTGALVSAASNNKKDKIAIDAITGAAIATAAEFINYLT

SEQ ID NO: 3417 - protein, 186 aa, Glycine max
GKRGEKDGKSYIIDVKKGRMRIRLKVALALGVVVICTGVGVGVMHFVEKLGWLDSFYLSVMSVTTVGYGDHAFKTMHGRIFAAIWLLVSTLAVARAFLYLAEARVDKRHRRMAKWILGQDMTVSEFLAADIDNNGFVSKSEYVIYKLKEMGKVSEKDIMQVSEKFDRLDAGNCGKITLADLMGNHN

SEQ ID NO: 3418 - protein, 127 aa, Glycine max
  misc_feature (6)..(6): Xaa can be any naturally occurring amino acid
  misc_feature (32)..(32): Xaa can be any naturally occurring amino acid
AWGNSXMGDLMSNISLALNGEDGVQIALSGCXAGPMFNTLIGLGISLLLGAWSKNPSLYVVPEDSSLFYTMGFLITGLLWALVVLPRNNMHPNRILGMGLIALYLIFLSFRMCSAMGFITIAGLSLS

SEQ ID NO: 3419 - protein, 148 aa, Glycine max
LVALLVAFGVIFGINPSILGLTVLAWGNSMGDLMSNISLALDGEDGVQIALSGCYAGPMFNTLIGLGISLLLGAWSKKPSLYVVPEDTSLFYTMGFLITGLLWALIVLPRNNMHPNRILGMGLISLYVIFLSFRMCTAMRFITIAGLS

SEQ ID NO: 3420 - protein, 170 aa, Glycine max
MQFRLGKRVVRVAKCVFRRIRVRTRPGYYHRLGGSTTHSKNPITTRLLTWGQKLKRGAKTLCGKNGSGYLPIGSDPLCDRAPAVPKGHLAVYVGEEDGGFRRVLIPVIYCNHPLFSDLLREAEKEFGFEHPGGITIPCRLTEFERVKTRIASGSGQRGRTRRLGWPLQHY

SEQ ID NO: 3421 - protein, 229 aa, Glycine max
SNVLFAAHTVGFFIYWGITHQMKETLEWSKTYVSNVAGVIAILIALVMWVTSFPGFRRKMYEVFFYTHHLYTLYILFYAMHVGVEWMCMISPGIFLFLIDRHLRFLQSRQCAPLLSARLLPCGALELNFSKNPSLYYNPTSMVFINVPKISKLQWHSFTVISSCNMETDILSVAVKTGGSWSNKLYQELSSSALDHLNVSVEGPYGPTTTSQFLRYKQLGLVSGGSGIT

SEQ ID NO: 3422 - protein, 380 aa, Glycine max
MGGVTSSMAANWTFFPPSPASYKVLKEEATGLLLMEPFPHRENVEILRFPNRRGTEIVAMYVRHPMAKSTLLYSHGNAADIGQMYELFVQLSIHLRVNLIGYDYSGYGQSSGKPSEQNTYADIEAAYKCLEESYGAKQEDIILYGQSVGSGPTLDLAARLPRLRAVVLHSPILSGLRVMYPVKRTYWFDIYKNVDKIPLVKCPVLVIHGTADEVVDCSHGKQLGELCQQKYEPLWLKGGNHCNLELYPEYLRHLRKFISSVEKPPSQRVSFRRSIDRVEQSRGSTDCFETPRKSTDQRDKPRKSTDRTDKLKFHEFKFNNTEKLEKIRVQFDQMERSRRSVEYNDKSRSIEFQDKSRRSVDVQFERPRKSIDWLDRIRAS

SEQ ID NO: 3423 - protein, 200 aa, Glycine max
LGIRLEAKLKISQSRPMDAIETYQYLLALVQAQKKSFGSLQISSKVEYDKVNEFDIWHGLANLYASLSHWKDAEICLQKARELKEYSAALMHTEGVLFEGRGQNEEALCATINAILLEPNYVPCKILMGALIQKLGTKHLAIARSLLSDALRIEPTNRKAWYNLGLLHKHEGRISDAADCFQAASMLEESDPIESFSSLP

SEQ ID NO: 3424 - protein, 203 aa, Glycine max
  misc_feature (117)..(117): Xaa can be any naturally occurring amino acid
  misc_feature (154)..(154): Xaa can be any naturally occurring amino acid
  misc_feature (167)..(167): Xaa can be any naturally occurring amino acid
  misc_feature (181)..(181): Xaa can be any naturally occurring amino acid
  misc_feature (187)..(187): Xaa can be any naturally occurring amino acid
  misc_feature (193)..(193): Xaa can be any naturally occurring amino acid
MVVNERPSKRMKRRVTADLRDFLTFPEPGVTASGQPFRNCVQRFLSDHARITFPPSLFPSLMTWQILFRVGDIVSGPDLSPAMVTLDIVEEDVTRCRTSVYCDQCRVVGEHIRRVCXLSDCRLHAFSITSNKIFSRPCSRCGNLLQFSETRCRXCNFAITVDDLEEXWVYLQIENNHHLLXHGVVHXNGYGHXLLTLNGRKRW

SEQ ID NO: 3425 - protein, 158 aa, Glycine max
CGKLANPSMKDFEYIEELKQLIEKEEIPAPAPIEQRWTASSRSSLSPASSPSEDDIFSWVGIIMYLPTMDARQRKDITEEFFHYRHLTQAKLWDCYSAYEHWAKIEVPKDKKELAALQERLRKRFPVDAYNKARKELDPNRILSNNMLEKLFPQSDTI

SEQ ID NO: 3426 - protein, 276 aa, Glycine max
EFGSRWKGPPKFKPQYTKDEAIQHVRDLYRESLKKYGAEGSRGKSAEDGEQNIDELSFTELRDKLIALDPLNKKHIISINKAEAEFWRKSEGYRVGWSDEILGFDCGGQQWVSEACFPAGKLANPSMKDLEYIEELKLLIEKEDIPAPAPIEQRWTASSRSSLSPASSPSGDDIFSWVGIIMYLPTMDGRQRKDITEEFFHYRHLTQAKLWDRYSAYEHWAKIEVPKDKEELAALQARLRKRFPVDAYNKARKELDPNRILSNNMLEKLFPQSDTI

SEQ ID NO: 3427 - protein, 343 aa, Glycine max
MESERESFDLSGPLHLTYVLWDNAYHRMSVAASLVQGVYILERDRQEKREGQNALAPPWWTFFHFKLLRPLVDDVDSSIFGAIYEFRPPSSQYNDTLYRSPHYVIAFRGTLTKSHSVSRDIELDIHFIKQGLHQTSRSEIAIQAVQNTVATVGDSNVWLAGHSLGSAMAMLTGKTMAKNGMFIESFLFNPPFVSAPIERLRMRRVKHGIRFAGSVITAGLTIAMQAKQPKDLSADPFAALAAWVPGLFVNPSDHICSEYIGYFEHRRKMDEIGAGVIERLATQNSLGGLLMSAFGKESEPLHLIPSASLTVNVTPSRDFKEAHGIHQWWKPDLQLEHKLYNYK

SEQ ID NO: 3428 - protein, 446 aa, Glycine max
  misc_feature (99)..(99): Xaa can be any naturally occurring amino acid
  misc_feature (124)..(124): Xaa can be any naturally occurring amino acid
  misc_feature (192)..(192): Xaa can be any naturally occurring amino acid
LPQIMIVDLKLTYPSGLATAVLINGFHTQGDKMAKFYFDFSMTFVGAGMICSHLVNCSLLLGAVLSFGVMYPLIDRLKGDWFPDNLEETNMKGLYGYKXVFVSIALILGDGIYNFTKILISTVXNGYERMRSKNNKNAADRHENPTEDLKQTDEFLRETIPLRIGVIGYVVFTMISIIIIPRMFPQLKWYYXVVVAYIFAPSLAFCNAFGAGLTDINMAYNYGKVALFTLAAATGKENGVVAGLVGCGLIKSVISVSCILMQDFKTAHYTRTSPRAMFICQVIGIAMGCVTAPLSFFLYYKAFDVGNPHGEFKAPYALIYRNMAIIGVQGFSALPQHCLQLCFGFFAFAIGVNMIRDFAPQKIGKWMPLPMVMAVPFLVGAYFAIDMFIGTVVVFAWQKLDSKKAELMVPAAASGLICGEGLWTLPAAILALARIKPPICMKFVPT

SEQ ID NO: 3429 - protein, 423 aa, Glycine max
  misc_feature (221)..(221): Xaa can be any naturally occurring amino acid
MWRGARVVSGYLRRFSTAVRRRMEDEGDWLYSSEWWGSDSDDGHSVLRSTSGKGNGVVAVVAYPSSRPSKMHWSGMERWLQQRCEEVHPGYKDGGKLRILGYQWRVLRFNEVTRQSTAKVMAAYRENTPGVVYLMQQPHCLAVPYVKSMVSAGLTTIASCSFDIISALQGKKNMHILCIGHGGGSLPLFLASRIQGAIVHVVEIDPLVISASIRAMGFPGXSLMTKSGDRAVTKPDIIDEVMWKGVHERIFLYEADAEEFIVNNTNVYDMIFVDAYDGEDIFPHKLWDPDSPFLKALSNQLHPKHGTVVVNLHSDSDVLNHDGSVPSELEQILPMGKYVSQVCRAYKDVLVGKGGSGLAFTVAVPWVCNMSLIVCRGFGRDSKYFNRDFAINTLISKSLELEHVMGLPFSCLEYIKRGFIVVG

SEQ ID NO: 3430 - protein, 167 aa, Glycine max
LPPVRGNCSSSDSTQLATAKLLLQDGRLQEFSYPVKVSFLLHNYPACFICNSDEMEFHDVVSPIHEDQVLQPGQLYFALPLSLLRHSLQPHEMAALAVKASSALMKTAHKCGSRRKQILFSNEYDSNPKRVSPTLAADAGTVHRRGRATGASGGKGRFAALLSSIPE

SEQ ID NO: 3431 - protein, 171 aa, Glycine max
  misc_feature (21)..(21): Xaa can be any naturally occurring amino acid
  misc_feature (44)..(45): Xaa can be any naturally occurring amino acid
SSLSSELANVRKAAAMDSEVXSSDVLKLPKGIASLAEAVQLNQXXASDESSQKFTESMNKFIRMAEEEIPKIQAQESVASSHVKEITEYFLGNLTKEEAHPFRIFMVVRDFLAVLDRVCKEVGMINERTMVSSAHKFPVPVNPMLPQPLPGLHERQQYNDSSDDDSSSSSP

SEQ ID NO: 3432 - protein, 319 aa, Glycine max
  misc_feature (316)..(316): Xaa can be any naturally occurring amino acid
MATINLSSATTSLFQSKHRTKRIPRLPTIARITNHIEGTHLNSPNGSPILGNANNSLEVPSNNYISLHSSDVRRKTKIVCTIGPSTSSRDMIWNLAQAGMNVARLNMSHGDHASHLQTIDLVKEYNSQFQDKVVAIMLDTKGPEVRSGDVAQPILLKEGQEFCFTTMRGVSTHDTVSVNYDGFVNDVEFGDVLLVDGGMMSLAVKSKTKDLVKCEVIDGGELKSRRHLNVRGKSATLPSITDKDWEDIKFGVDNQVDFFAVSFVKDARVVHELKHYLKSHNADIHVMVKIESADSIPNLHSILSASDGAMVARGDXGAE

SEQ ID NO: 3433 - protein, 196 aa, Glycine max
KQEKMKMEIEEVGNCEALPLLSLNHVSLLCRSVWESMRFYEDVLGFVPIKRPSSFKFTGAWFYNYGIGIHLIENPNIDEFDTCVVEERPINPKDNHISFQCTDVELVKKRLEERGMRYVTAVVEEGGIQVDQVFFHDPDGYMIELCNCENIPIIPISSCSFKPRGHSFKKAAPNKCGFMENVMMESLSTDMINFSF

SEQ ID NO: 3434 - protein, 183 aa, Glycine max
RNTASLSSGQNEPSEVNMQIGIMREKLKETLPVSVQEFPWKKAEHILLDRLLNLAQETVKWSLVLFFIFSSVSDVVYTFSINRELVIPVGLFVGCLAADFLKEISQELFHKSEEKDLKRHLLGMYCLFVFVKFMSTWFAALPQVFLLHVANGGLMQVLWHLRIFMEDGKNKQETSSSSSLEAS

SEQ ID NO: 3435 - protein, 448 aa, Glycine max
MKCFYFSNGGEDEDSVAGAAPPSSRGGGSTSRVSWARSLSLMDTRSTSRSHFDSESTEFSDTVDFHHFLAQRRANDLRLFSFSDLKSATRAFSRALLVGEGGFGSVYRGFLDQNDVAIKQLNRNGHQGHKEWINEVNLLGVMKHPNLVKLVGYCAEDDERGIQRLLVYEFMPNKSLEDHLLARVPSTIIPWGTRLRIAQDAARGLAYLHEEMDFQLIFRDFKTSNILLDENFNAKLSDFGLARQGPSEGSGYVSTAVVGTIGYAAPEYVQTGKLTAKSDVWSFGVVLYELITGRRAVERNLPKNEQKLLEWVRPYVSDPRKFYRIVDPRLEGQYCIKSAHKLAILANKCIMKQPKSRPKMSEVVESLGSIINEIVPQDEQIPQAAVVAIGEEKEEKLSVENTKPEPSAKQGNYYLKKVFELKDIVSLRNKSIGRLDWKSWAPGLVRTW

SEQ ID NO: 3436 - protein, 268 aa, Glycine max
RGSLERSSSPRSSTCATPNAFSHYSSEANKGNQQQLEHVRKRLRPPSCAAVTKIKGKGKVKTQWVCCNCGHSTGKWWGQCPECQIVGTMNEFRESKLTGTKSSGGLAVSEDPVGSWLPQRPQELRPLKLEEINRRFNYQQWRIPLSGSFGNEVSTVLGGGLVPGSLTLVGGDPGIGKSTLLLQLNWKIAAMIAKECSDDEEPPVVYVSGEEVPRIDKRVNTLAKLGYRMCVVPKQAEKLLETEGLGKMKVLGCEVLKEVINAVFSRDN

SEQ ID NO: 3437 - protein, 219 aa, Glycine max
MGNALKTPCFQLNTNSSSSSKSVKLIFWEGTSRSLKGKHIAGEIMFEFPEMMVCHADSFFIGQPIPVLSIDDKLMPGQTYFVLPIDLFACNNLTVASISALGSCPNKSPIKFGACPFQYLKGSDGRVAIKVMPEFITRLISGGDHNKNNGVGATPGSPSSFLCSTPELQKHYEQLVKSKDQVWSPKLETISEYKIRFSPCRFIGLEWKEKEKPVEMFTM

SEQ ID NO: 3438 - protein, 366 aa, Glycine max
MFSFLLLFSAMEDEPFLTTTSQPIADCLLPSSKSFNDVTTTRARDVAAAAAEEIQSEQQQPPKKKKLSRCKTAPAMVTMRDLKPKTPQLPKPQSSSIIRQGMWLLAVYLSIGVVIYSFNRDRFSGIETHPVVDALYFCIVTMCTIGYGDIAPLTPFTKIFACAFVLVGFGFIDILLSGLVNFVLDLQENMILTGLQMGASEREGFSARNYIVDVAKGRMRIRLKVGLALGVVVMCIGIGSLVLYFVEGLDWVDSIYLSVMSVTTVGYGDRAFKTLPGRLFAAIWLLFSTLMVARAFLYLAEARIDRRHRRMAKKVLHREITVQDLLAADINNTGFIRYQYHHHFSSNLFLLLLLCFKLRLRFHRHV

SEQ ID NO: 3439 - protein, 93 aa, Glycine max
  misc_feature (80)..(80): Xaa can be any naturally occurring amino acid
RNCSVIRSLASQTSVADPVLSSSRSNAGDTYKKSTLILIRHGESLWNEKNLFTGCVDVLLSKKGIDEAIEAGKRISSIPXEAGIYAYTRVCCL

SEQ ID NO: 3440 - protein, 126 aa, Glycine max
  misc_feature (117)..(117): Xaa can be any naturally occurring amino acid
MDLELPAHAATVNESQQQKFALPVDSENKATVFRLFSFAKPHMRAFHLSWVSFFACFVSSFAAPPLLPIIRDNLNLTATDIGNAGVASVSGAVFARIAMGTACDLVGPRLASASLIXLTAPFVYFT

SEQ ID NO: 3441 - protein, 178 aa, Glycine max
MPSPSDHHRPQPKPNPNLLSLFLKPNHHALSHLPLLPLPRLRCLPPPQPLPPRRRLPPPSLPPLRYHRTHLPPTALPPREINKLPRFRVANGSETRPDSNCVVCLDAFHNAQWCRKLAACGHVFHRRCVDTWLLKVAACPTCRTPVGFNAGATVHDPPQRSDHLHTCGTDSNALTTLL

SEQ ID NO: 3442 - protein, 539 aa, Glycine max
MEQNACEELSKIASDFKCEKKVLETVDESIVCPTPQKNEEPLIVKFREGQTNLPEKYSALVDLFGHTSCSLRLLRLCKKSPTFQNVCRQVEVLSKREFSHAHLAQMKYILPKSVCIDKVLVHDKKSLCMVPDMKITLRFEVVKDCSGESDDLALRRYFKSKLIDFFDMHPEVADIPEAPLPEPFGKKTCRLNFEEFTGQSPHVNSSTELLSISNQTEMLPEQLQLYPSFRRHFSRKNNTDQAEKAQCFLPTKTSPSSHASDCLDNEESEKTLQKECVPLFDGVANPITERGHQKESFSMSLQPSFINTPVQMIRPPYSVTCSNSESPDMKNISCVADSFIAETPAQSAPARLLPISDVKLQDMPTQKSTSSHKPAKRVLDFSLMGDNDGLGIGVDKLESSRALHEFDSFPESSRGCYEDCNSFGSVSAPQEAEESLKQADLDTQHKKSSPLLDLVNVIHSIFQSVQRIPITKEELLHKILVNTLDFVEIRAVEEQIESLEKLVPDWICKKLVATGDTMYCINKVSDLDSVRSRLSTNVV

SEQ ID NO: 3443 - protein, 246 aa, Glycine max
  misc_feature (97)..(97): Xaa can be any naturally occurring amino acid
MVSAAIARNVVGVIGNIISFGLFFSPAPTFYGIVKKKTVEEFKPDPYIATVLNCAFWVFYGMPFVHPNSILVVTINSGRLAFEFVYLTIYYVYAPTXRPSPLLIFLLIEVVFFAAVALITMLALHGTRQRSLVVGVLSDIFNVMMYVSPLTIMAKVIKTKSVKYMPFWLSLANFLNGACWTTYALIHPFDLYVLISNGIGAISGLIQLILYACYCSCKSKNDEDGDQDLKPSGFQLSNLNGRAAVV

SEQ ID NO: 3444 - protein, 623 aa, Glycine max
  misc_feature (388)..(388): Xaa can be any naturally occurring amino acid
  misc_feature (517)..(518): Xaa can be any naturally occurring amino acid
LEILLTASTNKLSVTHDEAEDYASLIMKFLDKKNKGYIEISQMGSLFKATNLSNSKAHSPMKQVSSVGSSTHNVLHNTSGDFCEEQQEPMSRTEVLFRTYWRRAWIVLVWLLACLGLFVWKFVQYRHRSGFEVMGYCLPTAKGAAETLKLNMALVLLPVCRNTITWLRKHRPINSVVPFNDNINFHKLIAGGIVVGVILHGGTHLACDFPRISESAGSIFRQTIAAGFGYHRPTYTQILATTEVASGIGMVVLMGIAFALAAKWPRRRSPVLPVSLRRVTGYNTFWYSHHLFVLVYALLIIHSMFLFLTDKLMEKTTWMYIASPQYVGPPPPLFRAIRSGSYEVDILKASICPGKVLYLKMQKPEGFKFHSGMYIFIQCPQISPFEWXQDDYLSVHIRTLGDWSYQIYDLFQEAVLSRSKGCPKLYIDGPYGSAAQDHVKYDILVLIGLGIGATPFISILKDVVKGVQTTQNDHRGLRQCSLTKGPLKAYLYWVTREPNSFDWFRDVMKEISNSTKXXSVVEMHNFLTSVHPEGDIRSALLSVIQALHVAKNGTDIVSRTQIHTHFARPNWFNIFSRLARKHGGAKIGVFYCGPSKLARELKKLCTKFSTKTTTRFVFHKENY

SEQ ID NO: 3445 - protein, 508 aa, Glycine max
  misc_feature (341)..(341): Xaa can be any naturally occurring amino acid
LNDVVSKSFVGRYFKLEARKSCFTRELRAAMATFLTMVYIITVNATIIAVSGGTCSVEDCSSPTRPDCKVKPDVGYESCLAKTKSDLVVATAVSGLIGSVAMGLFANLPLGLAPGMGPNAYFAFNLVGFHGTGPLSYQTALAVICVEGIVFLLVSAVGLRGKLAKLIPHSVRLGCAAGIGLFIAFTGLQVGLGVGLIGPDAANLVTITACKVVDPETGACLGGKLQSPKFWLGLVGFLITSYGLMKNVKGSMIYGILFVTLVSWFRHTEVTYFPDTPLGDANYNYFKKVVDFHNMDSTAGVLSFRGFNKREVWVALATLLYVDVLAITGTMYTMAEMGMWXEKGHFEGEYVAYLVDAGSTIVGSALGVSTTATFVESSAGMREGGRTGLTAVFIGFFFFLSLFFTPLLASVPPWAIGPSLVMVGVMMMKVVKDIDWTNTKDAVTAFATMLLMPLTYSIANGIIGGVGLYIALSLYDYAASIVNWSRKMRRMVAKEQNQVSVDSAVEMI

SEQ ID NO: 3446 - protein, 338 aa, Glycine max
AVAWRAGEALVMEEVEVSPPQPMEIRIKVVSTSLCRSDLSAWESHAIFPRIFGHEASGIVESVGQGVTEFKEGDHVLTVFIGECMSCRQCTSGKSNTCQILGLERRGLMHSDQKTRFSLKGKPVYHYCAVSSFSEYTVVHSGCAVKVSPLAPLEKICLLSCGVAAGLGAAWNVADVSKGSTVVIFGLGTVGLSVAQASKLRGASRIIGVDNNPQKCENAKAFGVTEVVDPNSYKEPIAQVIKRITDGGADFSFECVGDTDTITTALQSCCDGWGLTVTLGVPKVKPEMSAHYGLLLMGRTLKGSLFGGWKPKSDLPSLVEKYLNKEGECLRCVIHMPR

SEQ ID NO: 3447 - protein, 412 aa, Glycine max
LRVLTDSTYHNHRNHQLPFRVLFHSFLFHFAILLSLINMSSPQVITCKAAVAWRAGEALVMEEVEVSPPQPMEIRIKVVSTSLCRSDLSAWESHAIFPRIFGHEASGIVESVGQGVTEFKEGDHVLTVFIGECMSCRQCTSGKSNTCQILGLERRGLMHSDQKTRFSLKGKPVYHYCAVSSFSEYTVVHSGCAVKVSPLAPLEKICLLSCGVAAGLGAAWNVADVSKGSTVVIFGLGTVGLSVAQASKLRGASRIIGVDNNPQKCENAKAFGVTEVVDPNSYKEPIAQVIKRITDGGADFSFECVGDTDMITTALQSCCDGWGLTVTLGVPKVKPEMSAHYGLLLMGRTLKGSLFGGWKPKSDLPSLVEKYLNKEIQIDDYITHNLSFDDINKAFNLMKEGECLRCVIHMPR

SEQ ID NO: 3448 - protein, 173 aa, Glycine max
MKENVGNPLHLKSVNHISLICTSVKESINFYQNLLGFFPIRRPGSFDFDGAWLFGYGIGIHLLQAEDPDNVPRKTKINPKDNHISFQCESMGAVEKKLGEMEIEYVHATVEEGGIKVDQLFFHDPDGFMIEICNCDSLPVIPLAASGNNNGMVRSCSRLNLQILQQIHQFLNQ

SEQ ID NO: 3449 - protein, 291 aa, Glycine max
  misc_feature (187)..(187): Xaa can be any naturally occurring amino acid
  misc_feature (224)..(224): Xaa can be any naturally occurring amino acid
MLPYHTLEGAQVALGRGLTLAETIWFKYSANKPDFVLHCHNTLFLCLFYSIAPIPFVLMELSGYEKLNKHKIQPSVKRSFKEMFKCYKDVMETFVIAVSPLQIISYPTIKWIGIRTGLSLPSGWELFWQLFIYFVIEDFSNYWIHRMLHCKWAFEKIHKVHHEYVAPIGLSAPYAHWAEIIILGIPXFLGPALVPGHITTYWLWFILRQLEAIETHSGYDFSWXPTKYIPFYGGPAYHDYHHYVGGKSQSNFASVFTYCDYIYGTHKGYQYRKQMRKKNSTDTFIAQNYKM

SEQ ID NO: 3450 - protein, 528 aa, Glycine max
MAEVAAPKKENPNLLLGRFELGKLLGHGTFAKVHHARNIKTGEGVAIKIINKEKILKGGLVSHIKREISILRRVRHPNIVQLFEVMATKTKIYFVMEFVRGGELFNKVAKGRLKEEVARKYFQQLVSAVEFCHARGVFHRDLKPENLLLDEDGNLKVSDFGLSAVSDQIRHDGLFHTFCGTPAYVAPEVLARKGYDGAKVDIWSCGVVLFVLMAGYLPFHDRNVMAMYKKIYKGEFRCPRWFSSELTRLFSRLLDTNPQTRISIPEIMENRWFKKGFKQIKFYVEDDRVCSFDEKQLQHHDGDDYLATSDSEVEIRRKNSNCNSTSNGNSLPRPASLNAFDIISFSQGFDLSGLFEEKGDEARFVSSAPVSKIISKLEEVAQLVSFTVRKKDCRVSLEGCREGVKGPLTIAAEIFELTPSLVVVEVKKKGGDKAEYEKFCNSELKPALENLGMEDSASSSSSCHQSTHTQSEFQQQHRTFSDSALNRHSDNNECLYDQELGLAEETSIPQLGEPKFEFQQENVPMFTI

SEQ ID NO: 3451 - protein, 219 aa, Glycine max
  misc_feature (204)..(204): Xaa can be any naturally occurring amino acid
  misc_feature (216)..(216): Xaa can be any naturally occurring amino acid
MESSEDGSMSYREFHANGSRMVTSEVEAKLDEGNIQEAEDALREGLSLNFEEARALLGKLEYQRGNVEGALRVFDGIDLQAAIQRLQPSFSEKTPVKKGRTRTESPSSVSQHAASLVLEAIYLKSKSLQKLGKFTEAANDCKRILDAVEKIFYLGVPDIQVDNRLQEIVSHAVELLPELWKQAGCYDEAISAYRRALLSQWNLXYDCCARIQKSLXFFC

SEQ ID NO: 3452 - protein, 498 aa, Glycine max
  misc_feature (272)..(272): Xaa can be any naturally occurring amino acid
  misc_feature (389)..(389): Xaa can be any naturally occurring amino acid
MELNEDPGPIDNYVLYDQDNHVSSAVWDGHERGVLRCHEHTSMLDQWKLTPKQIKLVEKAGFGHLRLLPAMSLDNALIAALVERWRRETNSFHLTVGELTITLEQNVSLLLGLAIDGEPVIGPISAPSSVCEKLLGRVPEDLNGGMVKLTWLKEFFSECPEDASQEEIERCTCAFLLYLVGSTIFSTTTGNKVPVIYLSLFEDFDKAGKFAWGPGALAFLYRALGNASLKSQSTISGCLTLVQCWCYSRLNVGLPKFNQEPDNNCFPFLLKXKGKSGAWMKCNVVSYRKALDSLNPCDVQWLPYNDMDCSSIPEDIKASLILWESRTMLLCFDKVERHLPDRCLRQFGMHQTIPKYVERWERKSCIVDHGVDLMEKMEFGSQSGQNLGXYVVEGGDIADEGEYMQWYQKITRKYIRRVTSSLESEYQRTVTAMREIANIADIVSAEGLDSYNRELLDEVINIVHKCLTGQFEEIPNEKVKKKGNRKRRQKDHLSMEYE

SEQ ID NO: 3453 - protein, 577 aa, Glycine max
VSARNSSCSLLHLPPLELRTLNMDAAKEEFLRDFGEHYGYPNGPKSVDQIRATEFKRLQLQDLVYLDHAGATLYSDLQMESVFNDLTTNLYANPHSQSDSSSATLDIVKNARQQVLDYCNASPKEYKCIFTSGATAALKLVGEAFPWSCNSSFMYTMENHNSVLGIREYALGQGAAAIAVDIEGELHPEISGETITTKISPHQVQRRKVAGSLKEEPTGDVYNLFAFPSECNFSGLRFDLDLVKIIKEDSSKILGISSVCHGQWMVLIDAAKGCATMPPDLSKYPADFVAISFYKLFGYPTGLGALIVRNDAAKLLKKTYFSGGTVSASIADIDFIKRREGIEELFEDGTVSFLSIVSIRHGFKILNSLTVSAISRHIASLALYTRKMLLAMRHGNGSSVCILYGHHNSMKLCHEMGPIISFNLKRPDGSWYGYREVEKLASLSGIQLRTGCFCNPGACAKYLGLSHLDLISNTEAGHVCWDDLDIINGKPVGAVRISFGYMSTYEDVKKFVDFVASSFMSPQIHIDHGNQMKGPPPFLTSIYSLYLMNSSPNCLCPLNDKDLLFYCICIFAPLLPI

SEQ ID NO: 3454 - protein, 350 aa, Glycine max
  misc_feature (114)..(114): Xaa can be any naturally occurring amino acid
  misc_feature (255)..(255): Xaa can be any naturally occurring amino acid
MSSTVGQTIKCKAAIAWEAGKPLVIEEVEVAPPQAGEVRLKILYTSLCHTDVYFWDAKGQTPLFPRIFGHEASGIVESVGEGVTHLKPGDHALPVFTGECGDCAHCKSEEKNWXEIVRQLASAGIKVLLTARNEKKGLQALETLKDSGLSHLVLFHQVDVADATNVASLADFVKSKFGKLDILINNAGIGGVVIDDTDLITTAIMNRGAIPEDNGTKGITHTYELAEECLQINYYGAKKTTESLMPLLQLSDSLXVFDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 3455 - protein, 568 aa, Glycine max
MASSTLICDTQQWKELKAHAEDVEKTHLRDLLSDDERSQSMVVEFDGILLDYSRQQATLETREKLFKLAEVASLKQKINQMYNGEYINSTENRSVLHVALRAPRDAVIQSDGNNVVPDVWNVLDKIQEFSERVRSGSWVGATGKALKDVVAIGIGGSFLGPLFVHTALQTDPEAVESARGRQLRFLANVDPIDVARNITGLNPETTLVVVVSKTFTTAETMLNARTLREWISSALGPSAVAKHMVAVSTNLTLVEKFGIDPKNAFAFWDWVGGRYSVCSAVGILPLSLQYGFSVIEKFLRGASSIDQHFYSQPFESNIPVLLGLLSIWNVTFLGYPARAILPYSQALEKFAPHIQQVSMESNGKGVSIDGVPLPFEAGEIDFGEPGTNGQHSFYQLIHQGRVIPCDFIGVVKSQQPVFLKGEVVSNHDELMSNYFAQSDALAYGKTAEQLQKENVPPHLVPHKTFSGNRPSLSLLLPSLNAYNIGQLLAIYEHRVAVEGFIWGINSFDQWGVELGKSLASQVRKQLNASRTKGEPVQGFNFSTTAMLTRYLQASADVPADLPTRLPQI

SEQ ID NO: 3456 - protein, 155 aa, Glycine max
  misc_feature (150)..(150): Xaa can be any naturally occurring amino acid
MEERVVPKRPREEETLEHKDASLDSYELLESSSKRHMPYNHILSLLESEEEDSTQDLSPLITALQQEITNCANDSDTLLSQHNLTNTTTTTNNNLESCSSSTTQYSSNMVEEHDDKEGVMRHLLEASDDELGIPNKEDESLDHGEDGFNXNGDMF

SEQ ID NO: 3457 - protein, 748 aa, Glycine max
MEAAAVDPYTTNPGPIDGSVLYDQDKHVSAAVWDGQERGALRCHEHTSKLDQWTLTHKQVELVDKAGFGYLRSIPAISLDNPLISALVERWRRETNTFHLNVGEMTVTLKDVALLLGLAIDGEPVIGITYTACSSVCEKYLGRSPESGYTSGGMVKLSWLKEFFSRCPEDAPLEVIEQHTRAYLLYLVGSTIFSTTTGNKVPVMYLPLFENFDRCGQYAWGAAALSFLYRALGNASLKTQSTISGCLTLLQCWSYFHLNIGRPKLNLELMHDRFPFVLRWKGKQSGPTANRDVVFYRKSLDSLKPCDVEWLPYRNMDSMVIPEYIKSTLILGRSKTMLICFDKAERHLPNRCLRQYGMLQSIPDDVERWERKSRGVDGGVDLSGKMESELNEWMDRQVSIVDGDEGADESEYMEWYMRITRKFIGRPISLSSEFHRTNAGLRDIAHIADTFSTKGLDPQQIESISRIRYIAHECLRDQFGGLVMASGSPQVELGKRVRGKERVRRKGGAGKRLRKDGVVQYNAVSEDEQPQYYGTAIEVGQLHLSHIERELSHAQLCSVDNEVSVAQLIHANADGENMQLCDPHIEVDESDLGYAAGEENNEDPDDAAAEFSPEELKHRVGEEIKQELNHVPGEENIEELNAANEIHFVEPSDNMVIDNSQLCDVSPDDSTLPDAAAAEVNHSQLADSSGVINPQQSSPTDNLVNSQLSHINLESEFLSAKGAMEVSQHSSIETREDISQNGDCSVAV

SEQ ID NO: 3458 - protein, 320 aa, Glycine max
MEKVVCVTGGSGCIGSWLVHLLLDRGYTVHATVQNLNDEAETKHLQSLDGASTRLRLFQMDLLRHDTVLAAVRGCAGVFHLASPCIVDQVHDPQKELLDPAIKGTMNVLTAAKEAGVRRVVLTSSISAVTPSPNWPGDVAKTEECWTDVEYCKQKGLWYPLSKTLAEKAAWDFAKENDLDVVVVNPGTVMGPVIPPRLNASMVMLVRLLQGCAETYEDFFMGSVHFKDVALAHILVYENKSAAGRHLCVEAISHYGDFVAKVAELYPEYNVPKMQRDTQPGLLRTKDGAKKLMDLGLQFIPMEKIIKDAVEDLKSKGFLS

SEQ ID NO: 3459 - protein, 224 aa, Glycine max
TRESGGGADVESSGECIVEENLAPDEGAVVLGNEGPAQERRLVALQLSADHSTSIEEEVVRIKNEHPDDNRCIVNDRVKGRLKVTRAFGAGFLKQPKWNDVVLEMFRNEYIGTAPYISCCPSLRHHRLCPRDQFLILSSDGLYQYLSNQEVVSEVESFVEKFPDGDPAQHLIEELLLRAAKKAGMDFHELLDIPQGDRRKYHDDVTVMVVSLEGRIWKSSGKYP

SEQ ID NO: 3460 - protein, 293 aa, Glycine max
  misc_feature (213)..(213): Xaa can be any naturally occurring amino acid
  misc_feature (225)..(225): Xaa can be any naturally occurring amino acid
  misc_feature (257)..(257): Xaa can be any naturally occurring amino acid
MQSEALSALKAAEGMMRESDPYIVLHLCLEYADQRKLSIALDHAKKLIKLEDGSSVSGYILLARILSAQQKFVDAELVIDAALDQSGKWDQGELLRTKAKLRIAQGKLKNAVETYTFLLAVLQVQNKSLGTASKVVKNKGNRDRRLEMEIWLDLANVYTALSQWQDAEVCLAKSEAINPYSAYRWHTKGLLSEARGFHQEALKSFRKALDIEXNHVPSLISTACXVSQLGGQSSSIVRSLLIDALRLDRTNPSGWYXLGLLHKADLGPPPMEAVECFEAAAVFGESSPIEPFR

SEQ ID NO: 3461 - protein, 426 aa, Glycine max
  misc_feature (133)..(133): Xaa can be any naturally occurring amino acid
SSRGSRKPPRGKLPLPIIITTICVLLFIAVLYAERLSFLNSSSIFKSKTCPRKHNKSKSNDKKSEEVFANASWIDDRFDFDPEECNVANGKWVFNSSLKPLYSDTSCPYIDRQFSCVKNGRNDSDYLHWEWQXPEDCTLPRFNPELALRKLQGKRLLFVGDSLQRNQWESFVCLVEWVIPHKHKSMQLGRVHSVFTAKAYNATIEFYWAPYLVESNSDIDIIDIKKRIIKVDAIAERAKDWTGVDILVFNTYVWWMSGIRIKTIWGSFANGQEGYEEFDTPVAYKLALKTWANWIDSTINPNKTRVFFTTMSPTHTRSQDWGNMEGVKCFNETKPVRKKKHWGTGSDKRIMSVVAKVTKKMKVPVTFINITQISEYRIDGHCSVYTETGGKLLTEEERANPQNADCIHWCLPGVPDTWNQILLAML

SEQ ID NO: 3462 - protein, 234 aa, Glycine max
MSIKRHEGLDFEYPPRDPGMPHYQMHDWDNTGGRFSDASTNNSHGEARLHNLIPEDGKRDPHDTVHNDHPDMEANEKNQSPIRWKQKPLVDQQQNKSISDLAMNYENRKTLDEHIIEFLEPEIPINYPLGKVYTNSYSSTSNHRNERETERYFKKRVIIHFLSKERTTSQEQHGKLIILPDSIEELLHTAGEKFGDTKPTKVISTENAEIDDISVIRDGDHLFFLCSDSENLSS

SEQ ID NO: 3463 - protein, 377 aa, Glycine max
  misc_feature (182)..(182): Xaa can be any naturally occurring amino acid
MMSLCSSKGTCSGDTNAHVSSSTVGNYSSDKKRHNNKFITFLRKTMWEYALACVGVVPCGGNNDLNGQRKATLKHNKAWLLADSGAELASADPRSVHSSFRFSFCSQVEVESFNMSYSASAAAAATFLMVNLDYESQVKELKWRRIQSPEKSLSPVANTLIRFSYDEILSATHNFSKERVLXGRGALSCVFRGRVGIWRTSVAIKRLDKEDKECVKAFCRELMIASSLHNTNVVPLVGFCIDSEEGLFLVYKYVSGGSLEHHLHGRKKGSSSPLPWSVRYKVAIGIAEAVAYLHHGTERCVVHRDIKPSNILLSSKKIPKLCDFGLASWTSAPSVPFLCKTVKGTFGYELNPFILIQKFNLWDLFGYLPYFFSYYDH

SEQ ID NO: 3464 - protein, 61 aa, Glycine max
MVVSKVVVFLGLILAALMSVACSQSAAPAPAPAPTSDGTSIDQAVAYVLMLVALVLTYIMH

SEQ ID NO: 3465 - protein, 187 aa, Glycine max
  misc_feature (172)..(172): Xaa can be any naturally occurring amino acid
IDIGVVTPKIKIALSRSRERRKRHSQNHAEPQMSIHSVGLLLEAVFLKAKSLQVLERFKEAAQSCKVILDIVESSLPEGMPDNFGAECKLQETLNKAVELLPELWKLADCPREAILSYRRALLHHWNLDAETIAKIQKEFVVFLLYSGGEATPPNLRSQMDGSFVPRNNIEXEAILLLMILLRKVSL

SEQ ID NO: 3466 - protein, 307 aa, Glycine max
  misc_feature (183)..(183): Xaa can be any naturally occurring amino acid
KVKVFDLEDLLRASAEVLGKGTFGTTYKAVMEDGPVVAVKRLKDVTVSEKEFKEKIDVVGVMDHENLVPLRAYYYSRDEKLLVHDYMPMGSLSAILHGNKGAGRTPLNWEMRSSIALGAARGIEYLHSQGPSVSHGNIKSSNILLTKSYDARVSDFGLTHLVGSSSTPNRVAGYRAPEVTDPXRPRTDVYSFGVLLLELLTGKAPTHALLNEEGVDLPRWVQSVVREEWSSEVFDIELLRYQNSEEEMVQLLQLAVDCVVPYPDNRPSMSQVIQRIQELRRPSMKEATQDQIQQLDLINDIDDASSR

SEQ ID NO: 3467 - protein, 365 aa, Glycine max
  misc_feature (85)..(85): Xaa can be any naturally occurring amino acid
MEVNIEKTLLMCKSFMKEVKIWGCLKQTGVSLRYMMEFGSNPTQKNLLISAQFLHKELPIRIARRAIELHSLPHGLSHMPPVLKXWYLDSFREIISFPEIKNMNDEKEFTELIKAIKVRHNNVVPTMALGVQQLKNVFEDPDEIDEFLDRFYMSRIGIRMLIGQHVELHNPNPPPNCVGYIHTNMSPVNVARNASEDARSMCYRAARGAAEVRIYGDPDFTFPYVPAHLHLMVFELVKNSLRAVQERFMDSDEVAPPIRIIIADGIEDVTIKVSDEGGGIPRSGLPRIFTYLYSTAKNSSSVEHEPSDIGTMENVTMAGYGYGLPICRLYARYFGGDLQVISMEGYGTDAYLHLSRLGDSQEPLP

SEQ ID NO: 3468 - protein, 468 aa, Glycine max
SACDLRPCYCVGPDQIKLLEPNRLEAKPKLKALHWDKVRATSDRATVWDQIKSSSFQLNEDMMESLFGCKATNFTPKEPPRKKSVLPSVDQENRVLDPKKSQNIAILLRALNVTRDEVSEALLDGNPEGLGTELLETLVKMAPTKEEEIKLKNYDGDLSKLGAAERFLKAVLDIPFAFKRVEAMLYRANFDAEVNYLRQSFQTMEAASEEIKNSRLFLKLLEAVLRTGNRMNVGTNRGDAKAFKLDTLLKLVDIKGTDGKTTLLHFVVQEIIKSEGAGAESANDNVKMDSKFNEDEFKKQGLRVVAGLSRDLSDVKKAAGMDSDVLSSYLSKLETGLDKVRLVLQYEKPDMQGNFFNSTKLFLKYAEDEIVRIKADERKALYLVKEVTEYFHGNATKEEAHPLRIFMIVRDFLNILDLVCKEVEKMHDRIVGGSGRSFRIPPNASLPVLNRYNHPKQDRSSDEESSSP

SEQ ID NO: 3469 - protein, 105 aa, Glycine max
MLCACSSGEQFKFEEPPHSPESLATRDFSASGLSSRTGEWEPKFDDTQVEEAESTLKDALSLNYEEATALLGRLEYQRGNFDAALQVFQGMDITGLTPRMIKAIA

SEQ ID NO: 3470 - protein, 321 aa, Glycine max
  misc_feature (237)..(237): Xaa can be any naturally occurring amino acid
MSATFKYQPTGLHGWGAPRSSSRNLARFFSMRFACNSRHHKILHASVSHPSSLSISHDSSTETESTLILIRHGESLWNEKNLFTGCCDVPLTKRGVEEAIEAGKRISYIPVDMIFTSALIRAQMTAMLAMTQHHQEKVPIIIHNESERATAWTQVYSEKTTKQSIPVITAWQLNERMYGELQGLNKQETAERYGKEKVHEWRRSFDIPPPKGESLEMCSQRAVAYFKDFKAIEPQLXSGKHVMGAAHGNSLRAIIMYLDRLTSQEVTSLELSTGIPLLYIYKDEKFNSRGSPVGPTEAGVYAYTQNLAIYRQQLDETSNCY

SEQ ID NO: 3471 - protein, 281 aa, Glycine max
MAVSYVHMLQCNRGFHKGNLSYPNCSYKARRSHRLVFASMHTPEPKVDSLLDSVKWDTKGLVVAIAQNVDTGAILMQGFANREAIATTISSRKATFYSRSRSTLWTKGETSNNFINVHDVFIDCDRDSIIYLGKPDGPTCHTGAETCYYTSVFDLLKQQEAEENKLALTSLYALESTISQRKTELIGENEKPSWTKRLLLNDKLLCSKIREEANELCQTLENNEDEKRTASEMADVLYHAMVLLAKKGVKIEDVLQVLRLRFSQSGIEEKKSRVSQKSVDD

SEQ ID NO: 3472 - protein, 187 aa, Glycine max
MPISASPTEERATLSWRKIPHFKYDAVQPRLRRNTTTTLTFATATGGSKFASVSVAEPKLHHDFMPTPSQLFKNPLAAFAIVPRDAALFSAGAIAGAAAKTVTAPLDRIKLLMQTHGVRLGQDSAKKAISFIEAIAVIGKEEGIQGYWKGNLPQVIFFNIYSDSRLCADDSYKKICKGENGELSVAG

SEQ ID NO: 3473 - protein, 182 aa, Glycine max
MKFTVGDSRVRKMGGSRLSKPKSGSASGSTNCFMLYARALSITWGDTPEYWIWVQQKETSGTIVELAKLKRVCWLEVHGKFDTRKLSLGILYQVSFLIMLEESSQGWEVPINVRFVLPGGKRQQHKVNLNEKLRESWMEILVGEFVASEKDAGEMEISMYEYEGGMWKTGLVIQGVVIKPKN

SEQ ID NO: 3474 - protein, 144 aa, Glycine max
MGNTCAPTQYASKGGNHSWQSTVNIVHLDGKLQQLKESIKAWKVLSENPNCYICCSESMYVGSPMPPLAPSEELQLGLIYFLVPIPKSRIPLSLQDLGALAIKANAALAAAATPNNNYPILKPSSQKKFRTHPTFSNVSMGYSH

SEQ ID NO: 3475 - protein, 561 aa, Glycine max
  misc_feature (379)..(379): Xaa can be any naturally occurring amino acid
MASTSLFNFRLPLFNFNPLHHRRIKRPKSLLSSPRNSPRLVSSINDHLALTRVTYPLLQSHSAPKRRFHVGVQKEYSDGESSESIVSDATYQEEFSWSSVVLPFLFPALGGLLFGYDIGATSGATISLQSPELSGISWFNLSAIQLGLAVSGSLYGALLGSLVAFAIADFLGRKKQLITAALLYLFGGVITAYAPELGVLLAGRLIYGLRTGGARLGAPLYIAETCPSQIRGTLVSLKELFIVLGILLGYFVGSFLIETVGGWRFMYGFSAPVAVLMGLGMWTLPNSPRWLLLRAVQGKGSFQDLKEQAIASLSKLRGRPPGDKESEKQIEETLVSLKSVYADQESEGNFLEVFQGPNLKAFIIGGGLVLFQQITGQPXSVLYYAGPILQSAGFSAASDATKVSVVIGLFKLLMTWIAVLKGDDLGRRPLLIGGVSGIALSLVLLSAYYKFLGGFPLVAVGALLLYVGCYQISFGPISWLMVSEVFPLRTRGKGISLAVLTNFASNAVVTFAFSPLKEFLGAENLFLLFGAIATLSLLFIIFSVPETKGMSLEDIESKILK

SEQ ID NO: 3476 - protein, 250 aa, Glycine max
MEAERPPLPQHNSHTKPLSRLNEYVAKTRVGKWFKLSQRNSTFTTELRAGTATFLTMAYILAVNASILSDSGGTCSVSDCVPLCSDPSTPLSACSGPSLRVIQPDVSCKFSPVNPGYAACLENTRKDLIVATIASSLIGCFIMGTFANLPLGLAPGMGSNAYFAYTVVGFHGSGNVSYQSALAAVFIEGAIFLLVSAIGLRAKLAKLVPKPVRISSSAGIGFFLALIGLQNNQGIGLIGYSPSTLVTLGA

SEQ ID NO: 3477 - protein, 204 aa, Glycine max
MNGGSASSNLRAALSHCVQQVRSYDYHHYLCLLELPPSMRKAAFALRALNVETARAMDVASDPRIGLMRLVWWQEAIDKMFANKLIEHPTAQALSSVIAETKLSKIWLKRSVDARINDARREVTDMPKTIGELEKYAEDTVSTMLYLTLQAGGIKSTAADHAASHIGKASGILLLLKSLPYHASHNRHFSYIPTAIASKHGLIV

SEQ ID NO: 3478 - protein, 276 aa, Glycine max
LERFRGRIKLPENGDGDHPEREDGGRFRNRLPSGRLPATHHLSPREGRVHDRIRGGLQDDERRNSKDRLMGRELPGDRSDFAAPKSLSELKNGRNTENREQQSLGRRRSLRDDHPQSDDDFLFEGPKPLSEILKEKRGAGADSDSGNGKSSDNKNVEVTHGSDPMSVANTQNGVLSETKEDDKNLLLNNEESKLEVTDAAGGDNDGEYEEGIVYNESGEDQYYEGDDQRDADYEYEQGEEGYYEYEQGEEGENQEEDYMEEEDGDDFAKKIGVVHS

SEQ ID NO: 3479 - protein, 438 aa, Glycine max
MVLGWRRRKGSNKNRRKGGKSIAELVTPNHFRCPISLDLMKDPVTLSTGITYDRESVEMWFDEGNITCPVTNQVVRNFDMIPNHSLRVMIQDWCVENRQHGVERIPTPRIPIGSIEVAELLMLVKASSTDLDQYGCLELVQKLKRWGGESERNKRCIVDNGAPVALASSFDAFANDSIERNVVLLEEILSALNWMFPLQLEAHKSLGSLASLRCMVWFLKHQDLSGKEKSIVALKELLKFGDVKHLEALSQIEGVNELLVEFINKRISPTITKASLSVVWYLVSSSSNSSDKMRLKFVELGLVSSLLDILIDSDKSMCEKAVTILDSLCSSEEGRNKACGNDLTIPLLVKKILRVSPLTTDYSVSAIWKLCKFGEKDEGRTLVEALQVGAFQKLLLVLQVGCGDETKEKATELLKLLNPYRAELECIDSDYKNVKRSF

SEQ ID NO: 3480 - protein, 213 aa, Glycine max
IRLEGENNEANVFLIYEYVSNGTFQTYLSGDSPGKVFNWSERLSVLINVAKAVHFLHTGMIPGFFKNRLKTNNILLNENWMAKLSDYGLSIISEETDACGVKGESSDSWQMKMLEDDVYSFGFILLEALVGPSLSAKSEVNVLNVMASFNSQDGWKQIVDPVVQATCSKESLLVVISITNKCISSESWSRPSIEDVLWNLQYASQIQGTADGG

SEQ ID NO: 3481 - protein, 374 aa, Glycine max
  misc_feature (198)..(198): Xaa can be any naturally occurring amino acid
MNHSYANQSAQEVNIVTEDTRRSANYKPNIWKYDFLQSLDSKYDEEEFVMQLNKRVTEVKGLFVQEASVLQKLELADWIQKLGLANYFQKDINEFLESILVYVKNSNINPSIEHSLHVSALCFRLLRQHGYPVLPDTLSNFLDEKGKVIRKSSYVCYGKDVVELLEASHLSLEGEKILDEAKNCAINSLKFGFSPSSXTSTDHSNLVVEKMVHALELPSHWRVQWFEVKWHVEQYKQQKNVDPILLELTKLNFNMIQAKLQIEVKDLSRWWENLGIKKELSFARNRLVESFMCAAGVAFEPKYKAVRKWLTKVIIFVLIIDDVYDIHASFEELKPFTLAFERWDDKELEELPQYMKICVHALKDVTNEIAYEIA

SEQ ID NO: 3482 - protein, 485 aa, Glycine max
  misc_feature (466)..(466): Xaa can be any naturally occurring amino acid
MERCDKVMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLVSGRIYVVDTRSNPRSPSLHKVVEPEDIISKTGLAYAHTSHCLASGDVMISFLGDKDGNAAGSGFLLLDHEFNLKGRWEKPGHSPSFGYDFWYQPQHKTMISSSWGAPAASTKGFNLQHVSDGLYGRHLTCIQLAWGELRQTLDLGESGVLPLEVRFLHDPSKDTGFVGCALSSNMVRFFKTEDESWSHEVAISVKPLKVQNWILPEMPGLITDFLISLDDRFLYFVNWLHGDIRQYNIEDPKNPVRTGQVWVGGLLQKGSPIVAITEDGNTWHSDVPDILGNKLRAGPQMIQLSLDGKRVYVTNSLFSAWDKQFYPELVEKGSHMLQIDVDTENGGLKINPNFFVDFGAEPGGPXALAHEMRYPGGDCTSDIWI

SEQ ID NO: 3483 - protein, 515 aa, Glycine max
  misc_feature (95)..(95): Xaa can be any naturally occurring amino acid
MGLVSNLRGSRTEAAPQQEALPVSAVSGGAAKRKWTNLMPLVVALVVVAEIAFLGRLDMAKNAEMVDTLAVFFYRPRAVVEGDDLGLGTVGWWRXGDGNSESESCEKWLEREDAVTYSRDFAEEPVFVSGADQEWKSCSVGCKFGFSGDKKPDAAFGLPQPGETASVLRSMESAQYYAENNLAMARRRGYDIVMTTSLSSDVPVGYFSWAEYDIMAPMKPKTEAALAAAFISNCGARNFRLQALEALEKSNIKIDSYGGCHRNRDGRVDKVEALKHYKFSLAFENSNEEDYVTEKFFQSLVAGTIPVVVGAPNIQDFAPSPGSILHIKEIEDVESVAKSMRYLAENPEAYNQSLRWKYEGPSDSFKALVDMAAVHSSCRLCIHLATVSREKEENSPGFNKRPCKCTRGPKTVYHIYVRERGRFEMESIYLRSSNLTLEALKSAVVSKFTSLNHVPIWKTERPEILRGGNDLKLYKIYPVGLTQRQALYTFSFKGDADFRSHLESHPCAKFEVIFV

SEQ ID NO: 3484 - protein, 142 aa, Glycine max
MRPPRKRVDFSRGDKVEICSNEEGFLGSYYPATVVSRLDNGLYVVRYDTLLEDDASFQPLTETLFPKELRPHPPRVPRTHFALHQCVDAFDNDGWWLGQITGKKDGEHYYVYFSTTNEEIAYHVSGIRVHHEWSHGEWVLSN

SEQ ID NO: 3485 - protein, 346 aa, Glycine max
MMFDFARIWTRNTLIGLGLGQFLSLLITSTGFTSSELAKKGINAPTSQSFLNYVFLTLVYGTVLLYRRKALKAKWYYYIILGLVDVEANFLVVKAYQYTSLTSVMLLDCWSIPSVMLLTWLFLKTKYRFKKITGVVVCVAGLVLVVFSDVHSGDRAGGSNPRKGDLLVIAGATLYAISNVSEEFLVKSADRVELMAMLGLSGGIISAIQISILERNELKSIHWSAEAALPFVGFAVAMFMFYSLVPVLLKINGSTMLNLSLLTSDMWAVLIRIFAYHEKVDWMYFVSFGAVTIGLIIYSGGDRDDDQHPPNAAIDDHRPAVKQDEEANSGNHSKGAAAGSSKTWVA

SEQ ID NO: 3486 - protein, 669 aa, Glycine max
  misc_feature (525)..(525): Xaa can be any naturally occurring amino acid
MGTETSSVDISEPLLVDSHGNEEKEEYLREEVPEWKEQITIRGLVVSAVLGTLFCIITHKLNLTVGIIPSLNVAAGLLGFFFVRTWTGFLTKMGFFTKPFTRQENTVIQTCVVACYGLAFSGGFGSSLIAMDQRTYELIGPDYPGNRAEDVKNPGLGWMMGFMFVVSFLGLFSLVPLRKVMVLDYKLTYPSGTATAMLINSFHTKTGAELAGNQVRQLGKYLSISFCWSCFKWFFSGIGDSCGFDNFPSFGLTLFKNTFYFDFSPTYVGCGLICPHLVNCSVLLGAIISWGFLWPFVSEHAGDWYPADLGSNDFKGLYGYNVFISIALIVGDGIYHLIKIILTTITEMWRTSSKQLPVVTEVQDDESSQLQSEEKRRDEVFLKDRIPTWFAASGYVGLAAISIATIPIIFPPLKWYLVLCSYILAPALAFCNSYGTGLTDWSLASTYGKIGLFIIAAAVGQNGGVIAGVASCAVMMSIVATAADLMQDFKTGYLTLSSAKSMFVSQLIGTAMGCVIAPLTFWMFXVDIGCPYKAPYAVIFREMAILGVQGFSELPKYCLEMCGGFFLAALVINLLRDVTPKKFSQYIPIPMAMAVPFYIGAYFAVDMFVGTVILFVWERLNRKDAEDYAGAVASGLICGDGIWTIPSAILSILRIDPPICMYFGPSTSS

SEQ ID NO: 3487 - protein, 314 aa, Glycine max
  misc_feature (197)..(197): Xaa can be any naturally occurring amino acid
MWPFSRKGASGFSSSSTAEQVTEGIDGTGLTAIVTGASSGIGTETTRVLSLRGVHVIMGVRNMLAAKDVKETLLKEIPSAKVDAMELDLSSLESVKKFASEFKSSGLPLNMLINNAGIMACPFKLSKDKIELQFATNHLGHFLLTNLLLDTMKKTSRETKKEGRIVNVSSEAHRFAYSEGIRFNKINDESSYNNWRXAYGQSKLANILHANELTRRLKEDGVDISANSLHPGTITTNLFRHNSAVNGLINVIGKLVLKNVQQGAATTCYVALHPQVKGISGKYFSDSNVANTTAQGTDADLAKKLWDFSMNLTK

SEQ ID NO: 3488 - protein, 784 aa, Glycine max
  misc_feature (215)..(215): Xaa can be any naturally occurring amino acid
  misc_feature (228)..(228): Xaa can be any naturally occurring amino acid
  misc_feature (249)..(249): Xaa can be any naturally occurring amino acid
MANRHHPSVFLVLVTVLLSIHCSEQLQSSHSQTLLRIQQLLNFPAALSNWNSSTDFCNTDSNSTSLTVVCYEDTITQLHIIGERRDTPLPRNFSIDSFVTTLVRLPSLKVLTLVSLGIWGPLPSKIARLSSLEIVNMSSNFLYGSIPQELSSLSSLQTLIFDNNMLADTFPHWLDSLQALTVLSLKNNKFNGSLPKSLGNVENLRTLSLSHNHFXGAVPDLSRLTNLXQVLELDDNAFGPQFPQLGHKXWLPLVLRKNSFRSGIPAELSSYYQLERLDISSNSFVGPFQPGLLSLPSITYLNISGNKLTGMLFENLSCNSELDVVDLSSNLLTGSLPRCLVSNSSDSTVLYARNCLDTTNQNQQPQPFCHTEALAVGILPETKKHKQVSKVVLSLGIVGGTLGGVALVLLVFFIVRRGNDRSKTKNPPTRLISENAASGYTSKLFSDARYISQTKKLGAVGLPTYRSFSLEEIESATNYFDTASLMGEDSYGKMYRGQLKNGSLVAIRCVEMKKRHSTQNFVQHIELISKLRHRHLVSAVGHCFECSLDDSSVSKVFLVFEYVPNGTLRNWISDEHARKSLSWTQHIGAAIGVAKGIQFLHTGIVPGVYSNDLKIEDVLLDQNLVAKISSYHLPLLSNMGKVRCGNSSSGLRNSSNSKSVKHEDKADIYDFGVILLELILGRQIKTVNDADAFRDLLQASLGGDEEGRRGVVDPAFRKACLDQSLKTMMEICVRCLVKEPADRPSIEDVLWNLQFASQVQDAWRGDSQSSEGSPGSESRGLPFH

SEQ ID NO: 3489 - protein, 373 aa, Glycine max
MPSACRKGDGSLHIPANRTYKRQHILSTLLRSVNDLCDRNTQRKTLNRRAMARTPKPKGGPSAAASAATAFFKPGTAVEVSSEDDGFRGSWFTGTVIRRLASERFLVEYDNLLADDKTTKKLREVLGLRHLRPLPPTETDREFKFGDEVDAFHNDGWWEGHITQELENERFAVYFRVSKEQLVFSKEQLRLHREWLNHDWVPPLQQKQQRQQGNGESKKVLLTPNVKSVETVKGKGIGVGAIVEVSSDEDGFSGAWFAATVVEALGKDKFLVEYHDLLADDDSQLREEIDALHIRPHPLDTDVDGQFSILDEVDAFYNDGWWVGVISKALADSRYVVYFRSSNEELEFENSQLRLHQDWIGGKWVMPCKALKL

SEQ ID NO: 3490 - protein, 471 aa, Glycine max
MELIYLLYLVPTLYACFLIWKMLDERRDRECYILNYQCYKPPNDRMLGTEFCGKLIRRTENLGPSEYRFLLKAIVSSGIGEQTYAPRNIFEGREATPTLRDSIGEMEEFFHDSIGKLLAKSNVSPSEIDVLVVNISMLATVPSLSSRIINHYKMRHDVKVYNLTGMGCSASLISMDIVKCIFKTQRNKLALLITSESLSPNWYTGSDRSMILANCLFRSGGCAILLTNKRSLKDKAMLRLKCLVRTHHGAREEAYGCCTQQEDDQGRLGFHLGKTLPKAATRAFVDNLRVIAPKILPIRELLRFLFVSTIKKINKSSNAPKSVASTGATKSPLNFRTGVDHFCLHTGGKAVIDGIGMSLDLSEYDLEPARMTLHRFGNTSASSLWYVLSYMEAKKRLKKGDTVFMISFGAGFKCNSCLWEVMKDLGEANVWDDCIDEYPPESLANPFMEAYGWINEVDDPYTYEHLPEFLK

SEQ ID NO: 3491 - protein, 96 aa, Glycine max
  misc_feature (15)..(15): Xaa can be any naturally occurring amino acid
WSFVRYLGERKAASXGPRYGSQFSEAFGKFYGQSKHGVSNDAVETSRARGTVHENCINCIMPLGDHGTLIRRFSTSGLDGRIVVWDLENEQDLLEL

SEQ ID NO: 3492 - protein, 246 aa, Glycine max
  misc_feature (70)..(70): Xaa can be any naturally occurring amino acid
MANPSGNHEEEQTTHVASSFNGNLAPDTSPTALAMKHNPGIALDWTLQEQTILEEGLSLSKSNIVSSCIXFDAFASEPNLTRYAKIAQNLNNKTVRDVALRVRWMNKKENCKRRKDDFPGKSKDKKGSDPAVRSSHFTAQPNVSPYALAMTMMDNDDGISHIAIGGPTGELLEQNAQALNIISTNLAALQFQGNVNLFSQTRDNIVKILNDMNDMQEAMKQMPPLPFKINETIFNSILSKTNQHMQ

SEQ ID NO: 3493 - protein, 378 aa, Glycine max
MIIKMNCFFFKNKSKSDPELPKRRKKRNQVGNNGASKSSPSSPLPSPRSIKELYKEKEHNFRIFTLQEMVNATHGFNRMLKIGEGGFGKVYRGTIKPDPEDGADPILVAIKKLNTRGLQGHKEWLAEVQFLSVVNHPNLVKLLGYCSVDGEKGIQRLLVYEFMSNRSLEDHLFSLSLPHLTWKTRLQIMLGAAQGLHYLHNGLEVKVIYRDFKSSNVLLDKKFHPKLSDFGLAREGPTGDQTHVLHQLLPHQVVGTQGYAAPEYVETGHLKIQSDIWSFGVVLYEILTGRRALNRNRPIGEQKLIEWVKNYPANSSRFSKIIDPRLKNQYSLGAARKVAKLADNCLKKNPEDRPSMSQIVESLKQALQDSETNTLSSI

SEQ ID NO: 3494 - protein, 228 aa, Glycine max
MTGCCFPVTFHRSGSRRVSFRLVRSSSSGSSKHRGRESHKGPLVVCFGEMMINLVPTVARVSLADATAYKKFPSGATANVAVGICRLGGSAAFIGKVGNDEFGHLLSDILKQNGVDNSGLLFDDHARTALGFYALKSNGEPEFMFYRNPSSDVLLRPDEIDMDLIKKATIFHYGSVSLIKEPCRSAHLAAMNAAKVSGCFLSYAPNLALPLWPSKEAARQGIMSVWNY

SEQ ID NO: 3495 - protein, 246 aa, Glycine max
MGASQSQEELQSQQQFQQHQHPNELTRRESLLLSPAASNNTKQFSNSTKVVDNVTAANSTNTNCFMLNARALSITWAENPDYWTWVQDKDESGTMIELPNLKMVCWLEVHGKFDTRKLSLGILYQVSFIVMLKDSAQGWEVPINVRLVLPGGKKQQHKENLNEKLRECWIEIPVGEFVASEKDVGNLEISMYEYEGGKWKTGLIIQGIAIKPKNETNQSQHHQQPHELTRRESWLMSPAGNSNTSR

SEQ ID NO: 3496 - protein, 653 aa, Glycine max
MQSLGQNEASLACPHGCCPTSLLFNPPPPPPLQTQNTTTKPRNSSAECRHSFAATTASSIFPNTKFTNHESLPSLHESFSEFKKVYPQYSETDQVDHVRDKEYYHLSFSNQSCLDYIGIGLFSYYQRQHHHDTSKTQLASSSTPPSPPQYSDNIPFFSISYKTGNLKTLLLHGGQESEFESAMRRRIMKFLNISENDYFMVFTANRTSAFKLVADSYPFQSSKKLLTVYDYESEAVEAMISCSERRGAKAMSAEFSWPRLRIQSTKLRKMIVSKRKKKKKRGLFVFPLHSRVTGARYPYLWMSIAQENGWHVLIDACALGPKDMDSFGLSLFQPDFLICSFYKVFGENPSGFGCLFVKKSAITTLESSSCAGIVNLVPDRLLLHPSEDKDSSKQKPLSILQEQDLSSLSSFSGRIQTSQAIKVEQELSELQIIAAPAKPKQGSGRVEAKGPVESLQSKKAQDGSENGGFNIDCRCLDQVDSLGLIMITNRTRYLINWLVNSMMKLKHPNAEGVPLVKIYGPKVKFDRGPALAFNVFDWKGEKVEPVLVQKLADRNNISLSYGFLHHIWFADKYAEDKGKVLQTKEGRVQGVITNKKKDRDKLGVTVVTAALSFLANFEDVYKLWTFVARFLDADFVEKERWRYTALNQKTIEV

SEQ ID NO: 3497 - protein, 690 aa, Glycine max
  misc_feature (89)..(89): Xaa can be any naturally occurring amino acid
MKSLCYLLGLIAATTDREIMISPSSGLNMEEEKKEEIVERDEDLEEQVPAAAEVEPQPWTDPIPVRGLFVSMIIGITFSIIAMKLSLTXGMVPNCNVSAALLAFVFIRTWTKLLHKAGFVAKPFSRQENTIIQTCAVACYSIAVGGGFASYLLGLNRTTYELSGVENEGNNPGAIKEPGFGWMTGFLFVVCFVGLLALIPLRKIIIVDLKLTYPSGLATAVLINGFHTQGDKLAKKQVRGFTKYFCTRASGGFFKWFFSGTQDCGFAQFPTFGLQAWKQTFYFDFSMTFVGAGMICSHLVNCSLLLGAVLSFGVMYPLIDRLKGDWFPDNLEETNMKGLYGYKVFVSIALILGDGIYNFTKILISTVLNVNERMRSKNNKNVAADRHENPTEDLKQTDEFLRETIPLRIGVIGYVVFTMISIIIIPRMFPQLKWFYVVVAYIFAPSLAFCNAFGAGLTDMNMAHNYGKVALFVIAAMSGRDNGVVAGLVGCGLVKSVVSVACTLMLDFKTAYYTCTSPKAMFICQLVGTALGCVIAPLSFFLFYKAFDVGNPHGEFKAPYALIYRNMAIIGVQGFSALPLHCLKLCFGFFAFAIGVNMIRDFAPQKIGKWMPLPMVMAVPFLVGAYFAIDMFIGTVVVFAWQKLDSKKAELMVPAAASGLICGEGLWTLPAAILALARIKPPICMKFVPT

SEQ ID NO: 3498 - protein, 713 aa, Glycine max
  misc_feature (383)..(383): Xaa can be any naturally occurring amino acid
MVTQQQPQPQLQVQPTPPSSQDEALKRNTDCVYFLASPLTCKKGNECEYRHSEYARVNPRDCRYWLSGNCLNPKCPFRHPPLDGLLGTQATAAGGPSVPPSQIPTASAAHAPYNSSKQAVPCYFFQKGLCLKGDRCAFLHGPPAPTPSTGNKVAAQVPVTIQGAENPSFKKPFVSNEKYTQERKTSQGNFAKSGGAPEAKPSPKIETAPQRNMFELEKKVPPPSAEFNNEASRFKTISPPVTNGPIVARSNRLHQARVPDDHNFQSGKDSDEFLRESSPGFDVLVADELRNSDYYHGEDEFGKARGQDERNLDSLNEYDLGHSGDYSLAADIDRERFRGPQGYESYDHMQEPYAWEQHRKPSSHLGRRTRRRSDSPENAEVSXLRHHLSRRRKGNGLKFVVGHDYAHEGHGEEQSRRPFSRKDSLELPLNESFLGNRFRGRIKLPANGGADHLEREDRGRFRNRLSSGRLPATHHLSPGEGRVHDRIRGRLQDDERRNSKDRLMGRELPGDRSDFAGPKSLSELKNGRNTENREQQSLGRRRSLRDDRPQSEDDFLFEGPKPLSEILKEKRGAGADADSGNGKSSDNKNQEVTNGQNPTPAANTQNGVLSETKEDVKNLPPNNEESSKLEVTDAAGGDNDGEYEEGMVYDEAGEDQYYEGDDQRDADYEYEQGEGDEGYYEYEQGEEGENQEEDYMEEEDGDDFAKKIGVVHS

SEQ ID NO: 3499 - protein, 191 aa, Glycine max
NLFLLTMHSHIERILWSEDQISRRVFELAAEISDDFGGHSPAPVVVGVATGAFLFLADLVRKIDLSIAVDFVRVESYGSGTVSNGAPTISFDLKVDVNSRHVIVVEDIVDTGHTLSKVIEHLKSKGASSVSVCTFLDKPARRKVHFQLVGEGKYYRGFECPNYFVVGYGLDFAELYRNLPYIGVLKPELYK

SEQ ID NO: 3500 - protein, 136 aa, Glycine max
  misc_feature (109)..(109): Xaa can be any naturally occurring amino acid
NQLLLTMHSHTVRVAWPADPLSCRVMQLDDAISDDSGGHSSAPVVVGVATGAFLFLADLVRKIDLSIAADFVRVESYGSGTVSNGAPTISFDLKVDNNSRHVIWVKDNXDTGHTLSKVIEHLKSKGAVSVSVALSL

SEQ ID NO: 3501 - protein, 159 aa, Glycine max
  misc_feature (13)..(13): Xaa can be any naturally occurring amino acid
  misc_feature (27)..(27): Xaa can be any naturally occurring amino acid
MAEEHRCQAPRLXAPNNCGFFGSPATXNMCSKCYRDFQLKEQQSSNAKMVLNQSLVPPPPPSVISQPSSSSAPAADPASAVVVDAPRAAEELKAPQQNRCMTCRRRVGLTGFKCRCGMMLCGTHRYPEQHACEFDFKGMGREQIAKANPVVKGEKLEKI

SEQ ID NO: 3502 - protein, 400 aa, Glycine max
MASSVVVANGNLNPNDTRGKTITCKAAVAYGPGEPFVVERILVHPPQKMEVRIKILFTTICHTDLTAWQGENEARRAYPRIFGHEASGIVESVGEGVSDMNEGDLVVPIFNGECGDCKYCKCEKTNKCERFGVDAMKKVMVSDGATRFYTMDGKPIFHFLNTSTFTEYTVVDSACIVKIHIDGSNGDLNRNIKRLTLLSCGVSSGVGAAWNTADVHFGSTVAVFGLGVVGLAVAEGARARGASRIIGVDINSDKFIKAREMGITDFINPKDDERPVYERIREMTGGGVHYSSECAGNLNVLRDAFLSAHEGWGLTVILGIHPSPQMLPIHPMELFQGRRIVGSVFGSFKGKTQLPHCAKECMNGVVKLDEFITSRPPIKGINKAFDLMTPGESLRCLLHL

SEQ ID NO: 3503 - protein, 321 aa, Glycine max
MECAIKQDVTELIGNTPMVYLNKVVEGCVARIAAKLESMEPCSSVKDRLALSMIKDAEDKGLITPGKTVLVETTSGNTGIGLAFIAALKGYRLILAMPASMSLERRVVLRALGAELHLTDPAKGFKGSLQKAEELLRETPDAFMPHQFENPANPKIHYETTGPEIWTDSGGKVDALVAGIGTGGTITGAGKFLKERNPKIKVYGVEPVESAVLSGGQPGGHLIQGIGAGIVPAVLDVNLLDEILQVSSEEAIETAKLLALKEGLLVGISSGAAAAAAIKLGKRPENADKLIVVVFPSSGERYLSSPLFESIRQEAEQMTFD

SEQ ID NO: 3504 - protein, 268 aa, Glycine max
MKDDKQAPVPASTTEGQPIRCKAAVSRRAGEPLVIEDIIVAPPKPREARIRIICSSLCHSDITLRNLQDPPAIFPRILGHEATGVVESVGKDVTEVTKGDVVIPVILPECGECIDCKSTKSNRCTNFPFKVSPWMPRDGTTRFTGQNGEIIYHFLFISSFSEYTVVDIANLIKIDPEIPPDRACLLGCGVSTGVGAAWRTAGVEPGSTVAIFGLGSIGLAVAEGARLCGATRIIGVDINPEKFEIGKKFGVTDFVNAGECGGKPVGQV

SEQ ID NO: 3505 - protein, 411 aa, Glycine max
  misc_feature (34)..(34): Xaa can be any naturally occurring amino acid
MEVLLVDQGFDYVRRKKKWILILCAVGLGGFSAXIRLEAPSVARKRKRLSKLLSAFVSVAESLSESADTIGIVSRDVKVFLESDSDQIPNSLKQISKIARSEHLSESLVSVTRAVTVGVLRGYESMNRTGGDQTGSSVVDRVLDKMLTPAGSGFASVVLGSFARNLVLAFYSDQQHNHSGGESNSINSNSETVLAWVDVVCGDRCGELIGNCVQLFVSTAVAVYLDKTMHINTYDDFFAGLTNPKHETNVRDMLVSVCNGAVETLVKTSHHVITSSNADVGSGSDSYLSIGETLRNEDLGIGMPSIQSKVDVCDDENKSGWVSKVSSSLAVPSNRRLVLDVTGRVTFETVRSFMEFVLQTFCASVRRCAHIVHEAVLEIVRYVAAKSSVVVTICLSLCLHMMGGGWALVPA

SEQ ID NO: 3506 - protein, 380 aa, Glycine max
  misc_feature (59)..(59): Xaa can be any naturally occurring amino acid
  misc_feature (211)..(211): Xaa can be any naturally occurring amino acid
MCVKDQEKDMMDSTTTNSWPLQHCHLLLKTHMDKEGSSLRTSCDDDTTNNISVQNSFPXSICEDAVVADKKQNLMNFVLALRSGEWSDIGERPYMEDTHICIGDLAKKFNYDVPFEEAVSFYGVFDGHGGKSAAQFVRDNLPRVIVEDVNFPLDLEKVVKRSFLETDAAFLKTYSHEPSVSSGTTAITAIIFGRSLLVANAGDCRAVLSRXGRAIEMSKDHRPSCINERTRVESLGGFVDDGYLNGQLGVTRALGDWHIEGMKEMSDREGPLSAEPELKLMTLTKEDEFLIIASDGIWDVFSSQNAVDFARRKLQEHNDEKQCCKEIVQEASKRGSTDNLTVVMVCFNLDPPPPVVVERTRVRRSISAEGLQNLKCLLKE

SEQ ID NO: 3507 - protein, 658 aa, Glycine max
  misc_feature (642)..(642): Xaa can be any naturally occurring amino acid
MDPPPLSAATQKNHPESVESFSPCFRVAETWTDETLPAVPGAKLRLMCSYGGHIMPRPHDKSLSYIGGDTRIVVVDRHSSLKDLCSRLSRTILNGRPFTLKYQLPNEDLESLITVTTDEDLDNMVEEYDRIMAKGSASSRLRVFLFFTKPEATVSMGSLLDDAKSETWFVDALNNSGMISRVVSDSAAGDSFVNLDGVGVGGVSASGSSNNLESLPDANKVKNFPEVVQVQSTPGSPMMENSSSSPSFSPSLVNLPPIRVHVDDNGSRLQQENKVGLVVEEQFAQMTIASGVKPDDGLVNVVSSAVAVPVIPASVTMASAGVITTSDNVMNRVVCEDDRSDPGFQKPPLPLQLVQPRTSGGVGLPSPDSVASDSSIAAANSFSKTVYYQDQVQAALLDNKIVAMPNAKSEISDQMIQVQGQLQDSGYTLPPQLDPNKQHFQQQKPFVHASTHYIHHPAATGPVPVSSYYPVYAPPQPQQLHPPIGQQQYPVYVMPVGPTQVTQPYNMALQPNIADPNVVASSRSLMPQSIVTSAAYKDGTPPIYPTKSVSSTMASNSGYAPIPTNQFQPQYVGLHQFHHPPQSIAVAPSSTTTNNNYGYEYGGHVQDQAYYTQQTTTAPLLPQYQSMTPAAAAAALSDASKXFPADNIQQPTRASQPV

SEQ ID NO: 3508 - protein, 304 aa, Glycine max
MDNNEEIPSTPATPGTPGAPLFGGFSNGRNNNSKKSLLKSCRCFSVEEWSLEDGGLPAVSCSLPLPSPPPVVPLARKIGAEFIGTFILMFAGTAAAIVNQKTNGSETLIGCAATTGLAVMIVILATGHISGAHLNPAVTISFAALKHFPWKHVPMYIGAQVLASICAGFALKGVYHPFMSGGVTVPSGGYGQSFALEFIIGFNLMFVVTAVATDTRAVGELAGIAVGATVMLNILIAGPVSGGSMNPVRTLGPAVAANNYKAIWVYLVAPILGALAGAGTYTAVKLPEEDDDAKAKTSISSFRR

SEQ ID NO: 3509 - protein, 171 aa, Glycine max
AECKCFIEKMKMEIEEVGNCEALPLLSLNHVSLLCRSVWVSMRFYEDVLGFVPIKRPSSFKFTGAWFYNYGIGIHLIENPNIDEFDTCVNEERPINPKDNHISFQCTDVELVKKRLEERGMRYVTAVVEEGGIQVDQVFFHDPDGYMIELCNCENIPIIPYFFLLFQASRS

SEQ ID NO: 3510 - protein, 169 aa, Glycine max
EAAAKFGKDPRSYEVLTKRFIGDENGVLKGLEVIRVCWEKDATDKFQFKEIEGSEEIIEADLVLLAMGFLGPESTIAEKLGVDRDNRSNFKADYGRFSTNVKGVFAAGDCRRGQSLVVWAISEGRQAAAQVENYLIKEDQDHRNQDGLVKRQQGLNMKQQGSNKHTVMT

SEQ ID NO: 3511 - protein, 341 aa, Glycine max
MSHLQGYDPSCLREFMLEILGRSSPYGNAGLQILDRNWGAGWHLLSLLLATKPSQRISCLDALRHPFLCGPRWRVVPSMDIIRWGLGSTAMRISEEYIYRQPQRSRLAHFIDLMEMLNPHPKPRNWLELLPGKWRLLYSTGKHVGLTLRQPPLRVIVGDVHLTVTRESKLKANLSFNSDTGFSVMIGQDWPHDKAGKSGRLQVNSSFTLRSGRLLYLKQDKTTEKFFFGPSSNVEALAQKFKGKKWRKVVPFEELPSSLPAAKLASGDIDVRMNLDDPLNQNVDTARNVLQELRTQLPPEIFDLSKLVCGTYVDSRMLVLRGVSGSALLFTRSFVDRNGSS

SEQ ID NO: 3512 - protein, 158 aa, Glycine max
YAMYKRFQAEELLGYGSISDSLTIKFLLGTSGSIQIQGRCPAKHGLSRFRMERGTEVWKVDCICGAKDDDGEKMLACDTCGVWQHTRCAGIDNNTDGMPSKFVCMRCVNSYREETKKLPTPGEEANETCKFTTSCRDEAVARECATVSCNIAVNFGVR

SEQ ID NO: 3513 - protein, 179 aa, Glycine max
LPLNATVLDLRSEATSAFQEVYAMYKRFQAEELLGYGSISDSLTIRFLLGTSGSIQIQGKCPAKHGLSRFRMERGTEVWKVDCTCGAKDDDGEKMLACDTCGVWQHTRCAGIDNNTDGMPSKFVCMGCVNLYREETKKLPAPGEEANETCKFNTSCRNEAVARDCATVSCNIAVNFGVG

SEQ ID NO: 3514 - protein, 231 aa, Glycine max
MKAPNALLGAKRRKFQGIFNALCSMVVLFFFYNREDIISNPILRQSSYFTNHGLPQNAILRDGSSLVHRRMVEISANTSGVAGENDLGVSSSGLCSGLVQHDGYSSPCEFLKVNPQCSSDGYLDYLKFFYCTCQGFSLFGYLVLGVWLAALFYLLGNTAADYFCPSLEHLSRLLKLPPTVAGVVLLSLGNGAPDVFASIAAFVGAESGDVGLNSVFGWCSFCYHYCCWNCF

SEQ ID NO: 3515 - protein, 1256 aa, Glycine max
  misc_feature (349)..(349): Xaa can be any naturally occurring amino acid
  misc_feature (371)..(371): Xaa can be any naturally occurring amino acid
  misc_feature (404)..(404): Xaa can be any naturally occurring amino acid
  misc_feature (443)..(443): Xaa can be any naturally occurring amino acid
  misc_feature (516)..(516): Xaa can be any naturally occurring amino acid
MRPLKACLIAISRLNKACNLRGLLKFKEAAVKVSLDEVEPASEIVKRFCTGAMSYGSISLEAHTALATAMNKIGGKSNTGEGGEQPSRMEPLSDGSKNPKRSAIKQVASGRFGVTSYYLTNADELQIKMAQGAKPGEGGELPGHKVVGDIAVTRNSTPGVGLISPPPHHDIYSIEDLAQLIHDLKNANPAARVSVKLVSEAGVGVVASGVVKGHADHVLISGHDGDTGASRWTGIKNAGLPWELGLAETHQTLVANDLRGRTVLQTDGQIKTGRDVAIATLLGAEEFGFSTGALITLGCIMMRKCHKNTCPVGIATQDPVLREKFAGEPEHVINFFFMIAEEMRTSVVXEIMRLFRSLVWFQGVKLLHTRXSVVKEVIKSNEKLENIDLSLLLRPAAELRPEAXAQYCVQKQDHGLDMALDNKLIGLSNAALEKGLPVYIESXLDNVNRAVGTMLSHAVTKKYHLNGLPTDTIHIRFNGSADQGQSGVWCLRLSPASVPDGDGDFRGMSGSNTVGXLPRQRRQRPQEQNIVIGNVALYGATSGEAYFNGMAAERFCVRNSGAKAVVEGVGDHGCEYMTGGIVVVLGNTGRNFAAGMSGGIAYVLDMDGKFLSRCNHELVDLDKVEEEEDITTLRMLIQQHQRHTNSVLAKEVLADFENLVPKFIKVFPKEYKRVLASIKSKEASKDAAESASKHGEEQDEIELVEKDAFEELKKLATASVNGKPIEAESFKRPSQVIDPVKHRGFVAYEREGVQYRDPNARINDWNEVMKETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPARRTGKRVAVVGSGPSGLAAADQLNKMGHTVTVYERADRIGGLMMYGVPNMKADKVDIVQRRVNLMAEEGINFVVNANIGHDPLHSLDRLREENNAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVRWEKDETGRFQFKEIEGSEEIIEADLVLLAMGFLGPESTIAEKLGIERDNRSNFKAEYGRFSTSLKGVFAAGDCRRGQSLVVWAISEGRQAAAQVDSFLTNEDLEHNVAGSPDELIKKKQQPRDTVAVANKQ

SEQ ID NO: 3516 - protein, 238 aa, Glycine max
  misc_feature (47)..(47): Xaa can be any naturally occurring amino acid
TGSVASLLHDERLPPLDWKTRHKIAIGTARGLHYLHKGCKRRIIHRXDIKASNILLTKDFEPQISDFGLAKWLPSQWTHHSIAPIEGTFGHLAPEYYLHGVVDEKTDVFAFGVFLLEVISGRKPVDGSHQSLHSWAKPILNKGEIEELVDPRLEGAYDVTQLKSFACAASLCIRASSTWRPTMSEVLEIMEEGETDIEKWKMPEEEKEQEEEFWGFEDLEYEYDSSFSMSLLDSIGST

SEQ ID NO: 3517 - protein, 124 aa, Glycine max
RSLGVISGMTGGGGNVGAVVTQLIFFKGSRFSKERGITLMGAMIIICSLPICLIYFPQWGGMFSGPSSKKVTEEDYYLAEWNSKEKEKGSHHASLKFADNSRSERGRKLNASTELTEEITPPHV

SEQ ID NO: 3518 - protein, 672 aa, Glycine max
  misc_feature (359)..(359): Xaa can be any naturally occurring amino acid
TRPHSQRTIYNVYSFWYCSFFFLCCLYLIIVICEASFGPSYEYSKYCNNSNGNYTANSIYQTNLNTLLSTLTSHTEIDYGFYNFSHGQNSDKVYAIGLCRGDVKPDECRSCLNNSRVSLTRLCPKQLEAINWEEKCMLRYSNRAIFHTMDASFSYHMNNVNNATDAEEFNKVLGELLRNLSDKAASGDSRRKYAADTAVFANLQTIYGLVQCTPDLSRQDCGDCLHWSLADFGNVFKNKVGAVVLRPSCNVRYEIYPFYDEPTPSASVPLSLKEKGNSLRTTIAIVVPTVLVVVALLIFISIYFRRRKLARKNLLADEDDDEIELAESLQFNLDTIKVATNNFSDSNKLGEGGFGAVYXLSNGQVIAVKRLSSDPGQGGVEFKNEVLLLAKLQHRNLVRLLGFCLEGKERLLVYEFVPNKSLDYFIFDPIKKARLDWQRRYKIIRGIARGILYLHEDSRLRIIHRDLKASNILLDEEMHPKISDFGMARLVLMDQTQANTSRIVGTYGYMAPEYAMHGQFSIKSDVFSFGVLVLEIISGQKNSGIRHGENVEDLLSFAWRNWREGTAANIVDPTLNNSSRNEMLRCTHIGLLCVQENLADRPTMANVALMLNSCSITLPVPTKPAFFMDSATTSLPNMSWEVNSGTTRSNQSTTKSAHDSVSEASISELYPR

SEQ ID NO: 3519 - protein, 355 aa, Glycine max
  misc_feature (83)..(83): Xaa can be any naturally occurring amino acid
  misc_feature (87)..(87): Xaa can be any naturally occurring amino acid
MGWSFSISVLLFLTFLIQIHGRGFAENYGCNLFQGSWVYDESYPLYATSQCPFIEKEFDCQNNGRPDKFYLKYRWQPAGCKVXSTNXFNGEDFLTRLRGKSIMFVGDSLGLNQWQSLTCMLHIAVPQAPYSLARNGDVSIFTFPTYDVKVMLSRNALLVDIVGESIGRVLKLDSIQAGQTWKGIDVMIFDSWHWWIHTGRKQPWDLIQVGNRTVRDMNRLVAYEIALNTWAKWIDYNIDPTRTRVLFQGVSPDHQNPAQWGEPRANFCAGQTKPISGLRYPGGPNPAEVVLEKVLKAMQKPVYLLDITTLSQLRIDGHPSVYGHGGHLDMDCSHWCLAGVPDTWNELLYVSLFQN

SEQ ID NO: 3520 - protein, 125 aa, Glycine max
  misc_feature (79)..(79): Xaa can be any naturally occurring amino acid
MATSVAVAGALTAHDRRILTAVNVGASSLSLAGSSFIVVCYLLFKELRKFSFKLVFYLALSDMLCSFFGIIGMIFFNGXPSKGFFCYAQGYSTHFFCVASFLWTTTIAFTLHRTVVKHKTDVEDL

SEQ ID NO: 3521 - protein, 76 aa, Glycine max
MATSVAVAGALTAHDRRVLTAVNAGASSLSLAGSSFIVVCYLLFKELRKFSFKLVFYLALSVCFFFLSFRVPLLQI

SEQ ID NO: 3522 - protein, 369 aa, Glycine max
FGSRSLSSDPSSKDTEKGIQRFTQSFVPGVHLFTYDELEEATNYFDSSKELGEGGFGTVYFGKLRDGRSVAVKRLYENNFKRVAQFMNEIKILANLDHPNLVTLFGCTSRHTRELLLVYEYIPNGTIADHLHGQRSKPGKLSWHIRMNIAVETASALKFLHQKDIIHRDVKTNNILLDNNFCVKVADFGLSRLFPDHVTHVSTAPQGTPGYVDPEYHQCYQLTKQSDVYSFGVVLVELISSLPAVDITRHRQEIKLSDMAINKIHSEALHELVDPSLGFESNFKVRKMINAVAELAFQCLQSSKEMRPSMEEVADTLKDIQSDGKHKSQPEVMDITSTADDVVLLKDDPPPPSPDSNAVSKLTTPNASG

SEQ ID NO: 3523 - protein, 142 aa, Glycine max
MRPPRKRVDFARDDKVEICGNEDGFLGSYYQATVVSRLDNGLYVVRYDTLLEDDASQQPLTETLFPKELRPQPPRVSKTDFALYQCVDAFDNDGWWLGQVTGKKDAEHYYVYFSTTNEEIAYHVSAIRVHHEWSHGEWVLSN

SEQ ID NO: 3524 - protein, 412 aa, Glycine max
MANTTMANMNTNSNSKEESKKMDEREAIPLLTPYKMGNFNLSHRIVLAPLSRSRSYNFIPQPHAALYYSQRTTKGGFLIGEASGVSDTAQGYPNTPGIWTREQLEAWKPIVSAVHEKGGIFFCQLWHAGRVSNYEYQPDGKAPISSTDKRLRKDIANNKATADKYPPPRRVRADEIPKLVNDFVIAAKNALEAGFDGIEIHGANGYLLDQFLKDKVNDRDDEYGGNLENRCRFPLQVVKAVADEIGADKVGMRLSPFADYNDCGDSDPHALGVHMAQSLNEMGILYIHLIEPRMVTQFHKFDGTKSSLTPIRKAFKDGTFIVAGGYDRNEGNEAISCAAADVVAYGRLFLANPDLPTRFQLDAQLNEPDATTFSTHDPVLGYTDYPYLRANASVEVIRGHKMNRLVLQKPIN

SEQ ID NO: 3525 - protein, 689 aa, Glycine max
MASNSELVRTVVESVLGVSVSDSVMVIAATSVALVIGLLVFVWRKSSDRSKEQKPLAVPKLLVKEEEEDEVDAGSGKTRVAIFFGTQTGTAEGFAKALAEEIKARYEKAAVKVADLDDYAMDDDQYEEKLKKESLAFFMLATYGDGEPTDNAARFYKWFTEGKDERGTWLQHLTYGVFGLGNRQYEHFNKIGKVVDEDLSEQGAKRLVTFGLGDDDQSIEDDFSAWKETLWPELDQLLRDEDDANTVSTPYTAAILEYRVVIHDPTVTSSYDNHLNVANGNAVFDIHHPCRVNVAVQRELHKPESDRSCIHLEFDISGTGITYETGDHVGVYADNCDETVEEAGKLLGQNLDLLFSLHTDKEDGTSLGSSLLPPFPGPCTLRTALARYADLLNPPRKASLVALAAHASEPSEADRLKFLSSPQGKDEYSKWLVGSQRSLLEVMAEFPSAKPPLGVFFAAVAPHLQPRYYSISSSPRFSPQKVHVTCALVYGPTPTGRIHKGVCSTWMKNAIPLEKSRDCSWAPIFIRTSNFKLPADHSIPIIMVGPGTGLAPFRGFLQERLALKEDAVQLGPALLFFGCRNRQMDFIYEDELKNFMEQGALSELIVTFSREGPEKEYVQHKMMDKAANLWNLISQGGYLYVCGDAKGMARDVHRTLHTIVQQQENVDSSKAEAIVKKLQMDGRYLRDVW

SEQ ID NO: 3526 - protein, 325 aa, Glycine max
MSSNSGKVVCVTGASGFIASWIIKLLLQRGYTVRATVRDPSKPEKVDHLLKLDGAKERLHLFKADLLEEGSFDSAFEGCDGVFHTASPVHFIVTDPQNQLIDPAIKGTLNVVKSCAKSPSVKQVILTSSVAAVLYNGRPRTPEVVVDETWFSDPDFLRENERWYAFAKTSAEDAARKFLSEYDIKLVVINPSMSIGPLLQPELNASSSSILNLINGSPTFSNNSFGWINVKDVANAHIQAYEIDSASGRYCLVERVIHFSELAKILRDMYPTLQIPDKCEDDEPFMPTFQVSKEKAKSLGVEFIPLEVSLRETVESLKEKKFVDF

SEQ ID NO: 3527 - protein, 361 aa, Glycine max
MVEQKNQVIPLLTPYRMGNLNLSHRIVLAPLFRARSYNNVAQPHAILYYSQRATKGGLLITEATTISPTSKYHPNAVGIWSREQIEAWKPIVDAVHAKGGIFFCQIVHTGRAYDPDLKPDGQTLISSTNKPFTHNATEPTALRTAEIPDIVNEFRLAARNAIEAGFDGVEIHGAHGFLIDQFLKDQVNDRTDKYGGSTENRCRFALEVVEAVVEEIGADRVGMRLSPFSDFNECSDSNPQALGLYMAKSLSKHGVLYCHMVEPRWDISGENKETPHTLAPMKKAFNGTFIVAGGYDRKEGNKAVAEEKANLVAYGRLFLANPDLPKRFEVDAPLNKYNRETFYTPDPVVGYTDYPFLEGSS

SEQ ID NO: 3528 - protein, 299 aa, Glycine max
  misc_feature (23)..(23): Xaa can be any naturally occurring amino acid
MLMGNLYVYEKNKDGAGDSSFPXVKDQTQFSVAHARYSKSNPIARWHICQGSINSISFSMDGAFLATVGRDGYLRVFDYSKEQLICGGKSYYGALLCCAWSMDGKYILTGGEDDLVQVWSMEDRKVVAWGEGHNSWVSGVAFDSYWSSPNSNDNGETIMYRFGSVGQDTQLLLWDLEMDEIVVPLRRPPGGSPTYSTGSQSSHWDNVVPLGTLQPAPSMLDVPKISPLVAHRVHTEPLSGLIFTQESVLTACREGHIKIWMRPGVAESQSSTSENLLATNLKEKPSLSSKISSNSSYKQ

SEQ ID NO: 3529 - protein, 990 aa, Glycine max
MLEPRESDIPVLFLVLVVLPLVAYILLGKWSETSKKRDRINLLAHLAAEEALRAEEMAVADVIPPVSASKNEHHVCARCSAPARTRCSRCKIVRYCSGNCQIIHWRLIHKQECQQLEPHKSSSFPLAVSVEEFGHGDGSYFYENLNNQFLGPSLKQTLRESAPLDYLVHPLTGTAASTTADFSVFNNFQHSAFERTSHKSNRETLRRDNGSIYESSIESSDYKASSSLSSVVPKEAFMRQKSRKSSDSVLEEEISNVSSGGFGVYINRFDASKNMIHENDSHQSQYGNALVTRHKYGRSNVSSAANNDNGVDEFETDITTKGVSVVKGGNYHSDEAAQYKRPSESTIKGSMKAKKILHTPKTKSSKSPKSTSKTSADFCCSEIEKKGKTADELKVAGNSDTIPLHGNGSNGTANTGIMKMMGLRKSTKPTPLASTESMDVKCKKVKKIKMLFPYDEFVKIFQSDVFGIYPRGLLNCGNSCYANAVLQCLTSTKPLVVYLLYRSHSKACCAKDWCLMCELEKHIMVLRENGDPLSPSRILWHMRSINCHMGEGNQEDAHEFLRLLIASMQSICLEALGGEKKVDPRLQETTFIQHTFGGRLQSKVKCLKCNHESERYENIMDLTLEILGWVESLEDALTQFTSPEDLDGENMYRCGRCTSYVRARKQLSIHEAPNILTIVLKRFQEGRYGKINKCITFPEMLDMIPFMTGTGDIPPLYMLYAVVVHLDTLNASFSGHYVSYVKDLQGNWFRIDDIEVQPVLVNQVMSEGAYILFYMRSCPRPPVEHTVKAVQQSVYDSSKHNPMEMQKPNKPGHSRHGSHQFFVSESSPNARPEISTHIIDTTNGFLRKSTNRNALPVTQTYAKNVRSEFSDTTSSDWSLFTSSDEASFTTESTRDSFSTVDYGDSGNMDPISSIFNYTPEKSYLKFSHSRPVTRVFPEKGHVEQVQRIDHSKRVGHSSNEHPPNGNCGLYVYYGSNPVCGTTRTSSQCEF

SEQ ID NO: 3530 - protein, 154 aa, Glycine max
  misc_feature (125)..(125): Xaa can be any naturally occurring amino acid
  misc_feature (136)..(137): Xaa can be any naturally occurring amino acid
  misc_feature (142)..(143): Xaa can be any naturally occurring amino acid
  misc_feature (145)..(145): Xaa can be any naturally occurring amino acid
  misc_feature (150)..(150): Xaa can be any naturally occurring amino acid
MAATSSLCSSTLQSQINGFFLHKTSLSHTPSLTFSRRKISTTVKATSRVDKFSKSDIIVSPSILSANFSKLGEQVKAVELAGCDWIHVDVMDGRFVPNITIGPLVVDALRPVTDLPLDVHLMIVXPEQRVPDFIKXXADIAXXLXQSSTXHLHR

SEQ ID NO: 3531 - protein, 668 aa, Glycine max
MSHSKTPAAGETLFSGTAFLILLHLFLFLTPALSLDFLFNSFAGVTNLTLIKDARVDASVIRMNNDSNQYSYGRAFYPVKIPMLKTNTSNNSSSISSFSTSFVFSILPQISTSPGFGLAFVLSNTTDPPGAIASQYFGLFTNATSPSVFPLVAVEFDTGRNPEFNDIDDNHIGIDLNNIESINATTAGYFNSSGAFVPVRMRTGQNIHAWIDFDGENLEFNVTVAPIGVSRPTKPTLRYQNPAIADYVSSNMYVGFSASKTNWIEAQRVLAWSFSDSGPARELNTTNLPVFELESSSSSLSNGAIAGIVIGSFIFVLICASGFYLWWRMNKANEEEDEIEDWELEYWPHRFSYEELSYATGEFRKEMLLGSGGFGRVYKGTLPNNTEIAVKCVNHDSKQGLREFMAEISSMGRLQHKNLVQMRGWCRKGNELLLVYDYMPNGSLNKWVFDKSDKVLGWEQRRRILVDVAEGLNYLHHGWDQVVIHRDIKSSNILLDADMRGRLGDFGLAKLYTHGEVPNTTRVVGTLGYLAPELATVAAPTSATDVYSFGVVLLEVACGRRPIETSVAEEEVVLIDWVRELYAKGCAREAADLRIRGEYDEGDVEMVLKLGLACCHPDPQRRPTMKEVVALLLGEDPPEAPGKVLSDLVRGGEDSDEAAPLQPSPPPV

SEQ ID NO: 3532 - protein, 133 aa, Glycine max
APYALIYRNMAVLGVEGFSALPHHCLQLCYGFFAFAVAVNMVRDLSPKKIGKWMPLPMVMAIPFLVGAYFAIDMALGTLVVYVWHKLNSKKAEAMIPATASGLICGEGLWALPASILALSKIKPPICMNFLAS

SEQ ID NO: 3533 - protein, 403 aa, Glycine max
ARAGIVIGSVVGVLLILLLLFFLCRKRNKKDENETLPPEKRVVEGEVVSREKSNESGGNSGSVEKSEVRSSSGGGGDNKSLVFFGNVSRVFSLDELLRASAEVLGKGTFGTTYKATMEMGASVAVKRLKDVTATEKEFREKIEQVGKMVHHNLVPLRGYFFSRDEKLVVYDYMPMGSLSALLHANGGVGRTPLNWETRSAIALGAARGIAYIHSLGPTSSHGNIKSSNILLTKTFEARVSDFGLAYLALPTSTPNRVSGYCAPEVTDARKISQKADVYSFGIMLLELLTGKAPTHSSLNDEGVDLPRWVQSVVQDEWNTEVFDMELLRYQSVEEEMVKLLQLALECTAQYPDKRPSMDVVASKIEEICHPSLEKEEEKNHDFKDADNGFSQQYHSVDSGVSQA

SEQ ID NO: 3534 - protein, 505 aa, Glycine max
MAGGSFTTGTVSKERAEQYKGRVTAYVIISCIVAATGGALFGYDIGISGGVTSMDDFLIEFFPSVYRQKKHAHENNYCKYDNQGLAAFTSSLYIAGLVASLMASPVTRKYGRRVSIIGGGISFLIGSALNASAVNLIMLILGRVMLGVGIGFGNQAIQFGSSEMAPTHLRGGLNMMFQVATTFGIFTANMINFGTQKIKPWGWRLSLGLAAVPALLMTVGGIFLPDTPNSLIERGLAEKGRKLLEKIRGTKEVDAEFQDMVDASELAKSIKHPFRNILERRYRPELVMAIFMPTFQILTGINSILFYAPVLFQSMGFGGDASLISSALTGGVLASSTFISIATVDRLGRRVLLVSGGLQMITCQIIVAIILGVKFGADQELSKGFSILVVVVICLFVVAFGWSWGPLGWTVPSEIFPLEIRSAGQGITVAVNLLFTFIIAQAFLALLCSFKFGIFLFFAGWITIMTIFVYLFLPETKGIPIEEMSFMWRRHWFWKRICLPTDGSI

SEQ ID NO: 3535 - protein, 318 aa, Glycine max
MATSVAVAGALTAHDRRILTAVNVGASSLSLAGSSFIVVCYLLFKELRKFSFKLVFYLALSDMLCSFFGIIGDPSKGFFCYAQGYSTHFFCVASFLWTTTIAFTLHRTVVKHKTDVEDLEAMFHLYVWGTSLVMTVMRSFGNDQEHFGAWCWTQTGRTGKAVHFVTFYMPLWGAILYNGFTYLQVIRMLNNATRMAVGMSGQTFVSDTRDNMRALNRWGYYPLILIGSWTFGTINRIHDFFEPNHKIFWLTFLDVGTAALMGLFNSIAYGLNSSVRRAICERLDKFWPERLNRWLPNSLKYKNLQQESELVLFKTEDQ

SEQ ID NO: 3536 - protein, 312 aa, Glycine max
  misc_feature (154)..(154): Xaa can be any naturally occurring amino acid
MATSVAVAGALTAHDRRILTAVNVGASSLSLAGSSFIVVCYLLFKELRKFSFKLVFYLALSDMLCSFFGIIGDPSKGFFCYAQGYSTHFFCVASFLWTTTIAFTLHRTVVKHKTDVEDLQSEDMQHVVAKWVFNSLKGHLQCKAVFSPFKINKXAVHFVTFYMPLWGAILYNGFTYFQVIRMLNNATRMAVGMSGQTFVSDTRDNMRALNRWGYYPLILIGSWAFGTINHIHDFFEPNHKIFWLTFLDVGTAALMGLFNSIAYGLNSSVRRAICERLDKFWPERLNRWLPNSLKYKNLQQESELVLFKTEDQ

SEQ ID NO: 3537 - protein, 227 aa, Glycine max
ERFDREEFVNGVSRWLQRAQRARVASGDAGPHTMKFLSDFHTETVREHDLLDVGGQVNEEAEGIENAKWISIKAVLLLLLGTIIAAAFADPLVDAVDNFSEATSIPAFFISFIFLPLATNSSEAVSAIIFASRDKRQTASLTFSELYGAVTMNNVLCLSVFLALVYARGLTWDFSSEVLVILVVCIVVGVFASLRTVFPLWTAILAILLYPFSLALVYVLDYVFGWS

SEQ ID NO: 3538 - protein, 192 aa, Glycine max
FLSCFVGNALHALRSRLSDPSNVLQSWDPNLVNACTWFHVTCDSNNHVIRLDLGNSKLSGTLGPELAQLPHLQYLELYRNNISGNIPRELSKLKNLISMDLYDNQFHGKIPKSFGNLNSLKFLRLNNNKLTGAIPRELTHLKNLKILDVSNNDLCGTIPVDGNFESFPMESFENNKLSGPELKGLVPYDFGC

SEQ ID NO: 3539 - protein, 372 aa, Glycine max
  misc_feature (158)..(158): Xaa can be any naturally occurring amino acid
  misc_feature (170)..(170): Xaa can be any naturally occurring amino acid
  misc_feature (239)..(239): Xaa can be any naturally occurring amino acid
  misc_feature (278)..(278): Xaa can be any naturally occurring amino acid
  misc_feature (304)..(304): Xaa can be any naturally occurring amino acid
MATANPFDLLGDDAEDPSQLIAAEQLKAAAAAATAPPKKDQAKPGARGGAPAQLPSKPLPPSQAVREAKNETSYGSRGGGRGGGRGFGRGRGGGGGFGRDFSNDDNSSAPANQGSFEGDSGNHSERRGYGGPRGPYRGGGGGRGRRGGFTNGEVGEEXGRPRRAFEHHSXGTGRGNEFKRDGSGRGNWGTQNDDIAVVTEEVVYETEKNFADEKPAGEEDAPEGNKDCPANENEEKEPXETRRMTLEEYEKGAGRKKEGPCRLKKTEAKKSWTSKEFXPMQPLSNKKENDEIFIKLGSDKDKRXDALEKEEKSKKSVNITEFLKPAEGERYYSGGRGRGRGRGSRGSYSGNAYSNVPAPSIEDPGPFPTLSG

SEQ ID NO: 3540 - protein, 179 aa, Glycine max
LFSAEQLKDLGCKWVVLGHSERRHIIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 3541 - protein, 159 aa, Glycine max
CKIFKILLEYCQLQFIGKKAAYALSQGLGVIACIGELLEEREAGKTFDVCFQQLKAYADAVASWDNIVIAYEPVWAIGTGKVATPQQAQEVHVAVRDWLKKNVSDEVASKTRIIYGGSVNGGNSAELAKQEDIDGFLVGGASLKVHGFFKICLTKVSKA

SEQ ID NO: 3542 - protein, 316 aa, Glycine max
MELRELGRTGLKLSTVGFGASPLGNVFGDVSEEQANASVRLAFQSGINFFDTSPYYGGTLSEKVLGKALKALGAPRNSYVVATKCGRYKEGFDFSAERVTRSIEESLERLQLDYVDILQCHDIEFGSLDQVVNETIPALVKLKEAGKARFIGITGLPLGIFSYVLDRVPPGTLDVVLSYCHYCVNDTSLGDLVPYLKTKGVGIINASPLSMGLLTESGPPEWHPASLELKSACQAAATHCKEKGKNISKLALQYSLLNKEITSVLVGMKSVEQVEENVAAARELATSGIDEETLSEVEAILKPVKNQSWPSGIQQS

SEQ ID NO: 3543 - protein, 533 aa, Glycine max
  misc_feature (257)..(257): Xaa can be any naturally occurring amino acid
  misc_feature (310)..(310): Xaa can be any naturally occurring amino acid
  misc_feature (400)..(400): Xaa can be any naturally occurring amino acid
MASAVLANRNEPNWPKHRVGGAGFMGKVPFSNPNPKSKSNPKLANSKRTLSASDDASSINRRSNDFVTFSQYVSFNIASYTNKEINDLKDRLTSELERTQRIRNRIESGDLQPGQSFNGHPKKPSNKKVSGNKRPLPSNSATDLKRSHSEVGSLMKGCSQVLQKLMKHKHGWIFNAPVDVVGLQLTDYYDVIKQPMDLGTVKSNLSMNKYTTPSDFASDVRLTFNNALAYNPKGHDVYTVAELLLTRFEELYRPVSXEKFEGSIVHDRESEEELQASSWSQVEPERVKKKENPIPPAKLHQEPPPPPCKXQILHWCSPVRTPSPMRAPPVKPLKQPKPKAKDPNKRDMSLEEKHKLGLGLQSLPPEKMEQVVQIIRRRNGHLKQDGDEIELDIEAVDTEXLWELDRLVTNYKKMVSKIKRQALMGNIDNNNNDVQSNKGNGELPSSEKVDGGPVEVKKPKKVEAGDEDIDIGDEMPTSMFPPVEIEKDKDVVGGHASSSSSSSGSSSSDSSSSSDSDSGSSSGSDSEADNGHS

SEQ ID NO: 3544 - protein, 355 aa, Glycine max
  misc_feature (237)..(237): Xaa can be any naturally occurring amino acid
MAVQPEIEHPRKAYGWAARDTSGVLSPFWFSRRKTGEKDVTFKVLYCGVCHSDLHKLKNEWSDSIYPLVPGREIVGEVTEVGSKVDKFKVGDKVAAGCLVGSCHSCQNCVNNLENYCQQVIPTYGAKYVDGTITYGGFSDFMVADEHFVVNIPSALPLDAAAPLLCAGITVYGPLRYFGLDKPGMHLGVVGLGGLGHLAVKFAKALGLKVTVISTSPKKKNEAIQHLGADFFVVSRXAMCTLDGIIDTVSAVHPLMPLIDLLKSHGKLVAVGAPEKPLELLLPPLILGRKSIAGSYIGGIKETQEMINFAAEHNVRPEIEVIPMDYVNTAMERLQKADVKYRFVIDIGNTLKPHY

SEQ ID NO: 3545 - protein, 71 aa, Glycine max
MAGAAPKQLFGFGVVAMLATLILALFMPAAVQAQSASPAPAPTSDGTSLDQGIAYVLMLLALVLTYIIHSP

SEQ ID NO: 3546 - protein, 482 aa, Glycine max
MTGSLAARLVLRRCRSPASQFFFRREASWPATERTTKDVVTSPPKELPAFDYSPPAYSGPSRDEIIAKRREYLSPSIFHNYKSPLNVVEGKRQYLFDDKGRRYLDAFGGIATVCCGHCHPDVVEAIVEQTKRLQHSTVLYLNHAITDFAEALAAKLPGNLKVAFFTNSGTEANELAILIAKLYTGSHDIISLRNSYHGNGGGTMGTTAQSIWKYNVVQSGVHHAVNPDPYRGLFGSDGEKYVRDVQEIINFGTSGNVAAFISEAIQGVGGIVELAPGYLPAAYDIVRKAGGLCIADEVQTGIARTGSHFWGFEAHGVVPDIVTIAKSIGNGIPLGAVVTTPEIAKALTRRSYFNTFGGNPVCTAAGLAVLRVIEKEKLQENAFVVGSYLKERLNALKDKYELIGDVRGRGMMLGVELVSDGKLKTPAQSETLHVMDQMKELGVLIGKGGYYGNVFRITPPLCFTKEDADFLVDAMDYTFSRM

SEQ ID NO: 3547 - protein, 383 aa, Glycine max
MCVQDGEQAGEDHIEKNVDNSIRVSWPLHCDLLNAHMDNKEKDSSFRTPSDQISVANSSPLESICEDAEIVDKKQNLMNFVPTLRSGEWSDIGDRTSMEDTHICIGDLAEKFGNNELYKEAISFYGVFDGHGGKSAAQFVRDHLPRVIVEDADFPLELEKVVTRSFLEIDAEFARSCSTESSLSSGTTALTAIILGRSLLVANAGDCRAVLSRGGGAIEMSKDHRPLCIKERKRIESLGGYIDDGYLNGQLGVTRALGNWHLQGMKEINGKGGPLSAEPELKLITLTKEDEFLIIGSDGIWDVFRSQNAVDFARRRLQEHNDVKQCCKEVIGEAIKRGATDNLTVVMICFHSEPPAPMVVERPRVRRSISAEGLQNLKCLLEG

SEQ ID NO: 3548 - protein, 172 aa, Glycine max
MLRTLVVKRSLGHHWHSHSQHLRLQRQFSSSPEPNSSVDAETRKYAGYAALLLFCGGATYYTFPLPDDAKHKKAQIFRYAPLPEDLHTVSNWSGTHEVQTRNFLQPENAEQLERELREARSRIRPVGSGLSPTGIGLSRTGMVNLALMDGILEVDKQRRTVRVQAGIRVQQL

SEQ ID NO: 3549 - protein, 440 aa, Glycine max
  misc_feature (406)..(406): Xaa can be any naturally occurring amino acid
MALCRTGPNPIPGSYSAQNLSTKLIVPAPLRFTRQFSNLVRRKRKGVCCSSLRNAASASSKESLEDAPTTLSVCLEEETDHVIQFKMSDFKILDTVSVGLGGRPDEVIFEGMVKDSGSSLCNTRVVLRQLSSAQAQRRGKRAIEVLKKLVRRKLLYHSYSMQVHGYISLPASDASGSFILVHGYHGSFSLRHWLQQSDWLPTLEATLALDEESVRKVGEDFTGGPAVSRQLRLVRILMRDLLIGVNYLHSHGLAHTELRLENVHISPIDRHIKVGILGNAADFYKDGSNGSSLDNLDRRQMMIAFDMRCVGFIMAKMVMRELMDPLIFAKFKLFLKKGYDPSCLREFMLEILGRSSPYGNAGLQILDRNWGAGWHLLSLLLATKPSQRISCLDALRHPFLCGPRWXRVVPSMDIIRWGLGSTAMRIREKYIYRQPQQSRL

SEQ ID NO: 3550 - protein, 328 aa, Glycine max
MSNNNAGKVVCVTGASGFIASWIVKFLLQRGYTVRATVRYPSNLKKVDHLVKLEGAKERLQLFKADLLEEGSFDSVVEGCHGVFHTASPVRFVVNDPQAELLDPAVKGTLNVLKSCAKSPSVKRVVLTSSISAVAFNRRPKTPQVVVDETWFSDPDVCRELELWYTLSKTLAEDAAWKFVNENSIDMISINPTMVAGPLLQPEINESVEPILNLINGKPFPNKSFGWVDVKDVANAHILAYEIASASGRYCLVERVIHYSELATILRGLYPTLQIPDKCEVDEPYIPTYQISTEKAKKDLGIEFTPLEVSLRETVESFREKKIVNFNP

SEQ ID NO: 3551 - protein, 443 aa, Glycine max
MERVIGGKFKIGRKIGSGSFGEIYIASNMDTSEIVAIKMESKKTKHPQLLYEAKLYSILQGESGIPSMKWCGTDGDNNVLVIDLLGRSLEDFFVYCGRKFSLKTVLMLADQMLTRIECMHSKGFLHRDIKPDNFLMGLGRKSNQVYIIDFGLAKRYRDPNTNKHIPYRENKSLTGTARYASCNTHMGIEQSRRDDLESLGYVLMYFLRGSLPWQGLKAATKKEKYDNICEKKLSTPIGMLCKSYPAEFASYFHYCQSLTFDQHPDYGYLKRLFRDLFKREGYDSDYIFDWTILKYQQAQQTKKQNQSSPSTAVPSSLEPVVVEKHKGVNDSAHVTVTKMLANLERPSAPRVQPKPSNVQNLDAKNHIEKHGVNNSPSTSSATPKSSTVNASKPERPAGTSNLGRVFGSNARVSSSWIPSLKASLRALFLFCKLDCNEKQDTLT

SEQ ID NO: 3552 - protein, 175 aa, Glycine max
QKLKGKDGMANPLQLKSLNHISIVCASVEKSVDFYVNVLGFSPIKRPSSLDFNGAWLFNYGIGIHLLQSENPEGMPKTAPINPKDNHISFQCESIAAVEKRLQQMKIEYVKNRVEESGTYVDQLFFHDPDGMMIEICNCDNIPVVPLTEDKVWSCSRFNCNIQNHQQQIQQMIPM

SEQ ID NO: 3553 - protein, 341 aa, Glycine max
  misc_feature (129)..(129): Xaa can be any naturally occurring amino acid
MAHFTSSGKSDDLTKEDCKGQSALVVCFGEILIDFVPTVGGVSLAEAPAFKKAPGGAPANVAVGISRLGGSSAFVGKVGADEFGYMLADILKKNDVETSGMKFDPNARTALAFVTLRADGEREFLFFRXPSADMLLQESELDENLIKKAKIFHYGSITLIDEPCKSAHLAAMRFAKESGCILSYDPNLRLALWPSAEAARDGIMSIWDQADIIKISEEEITFLTGGDDPYDDNVVLNKLFHPNLKLLIVTEGSEGCRYYTKEFKGRVAGVEVKPVDTTGAGDAFVSGIIYSLASDQSLFQNEEHLRKALYFANVCGAITVTERGAILALPTKEAVFQFAAT

SEQ ID NO: 3554 - protein, 498 aa, Glycine max
KWSKLVRQQKMASDKVVETVIAGNYVEMETEGKPKDVKTKLSSLLWHGGSVYDAWFSCASNQVAQVLLTLPYSFSQLGMLSGILFQIFYGLLGSWTAYLISILYVEYRTRKEREKVNFRNHVIQWFEVLDGLLGKHWRNVGLAFNCTFLLFGSVIQLIACASNIYYINDNLDKRTWTYIFGACCATTVFIPSFHNYRIWSFLGLLMTTYTAWYLTVASLLHGQMEGVKHSGPTKLVLYFTGATNILYTFGGHAVTVEIMHAMWKPQKFKALYLLATLYVLTLTLPSAAAVYWAFGDMLLNHSNAFALLPKSPFRDMAVILMLIHQFITFGFACTPLYFVWEKAIGMHECKSLCKRALVRLPVVIPIWFLAIIFPFFGPINSTVGSLLVSFTVYIIPALAHIFTFRSPSSRQNAVEQPPKFVGRWVGTFIINTFVVVWVLVVGFGFGGWASMVNFIRQIDTFGLFTKCYQCPPPLLPPMPPHQLNATAPSPLHHPHHAH

SEQ ID NO: 3555 - protein, 582 aa, Glycine max
MVLKSMVASASDLSLVSVAGNSPLDFKNRVFGGRLISLGFRFNKGSKCKGNERFNFEVRAAVEVGVERSKSKALEGGFGLDVVSEAELTVKGFAGLRKTKLVCTVGPACSSMEDLENLALGGMSVARLNMCHGTREWHRDVIRKIKKLNEEKGFCVSVMIDTEGSQIHVVDHGAPSSVKVEEGSNWVFTAEHYEGSRPFTVQTNYRGFSEGTEVGDELVIDGGMACFEVTEKTGNDLHCKCIDAGLFLPGAKFSFWRDGKLVRGNNKLPTLSTKDWADIDFGIAEGVDFFALSFVNHADSVKDLKMYLSTKSTKSIKVLAKIESLESLHKLEEIVQASDGIMVARGDLGVEIPLEQIPTVQEDIIYVCRQLNKPVIVASQLLESMVEYPTPTRAEVADVSEAVRQYADALMLSGESAIGSYGRKALAVLDMASSRMESWSREENRQSLVSHHQLGESLPECITEQICNCAVEMANNLGVDAIFVYTKYGHMASLLSRNRPNPPIFAFTNDDSTRMALTLQWGVVPILVDLSDDAESNISKSVQLMKSRGLISQGDVVLVVSDVAPTRASPMAFQSIQVKTII

SEQ ID NO: 3556 - protein, 273 aa, Glycine max
  misc_feature (78)..(78): Xaa can be any naturally occurring amino acid
  misc_feature (247)..(247): Xaa can be any naturally occurring amino acid
LSCQFHSTSLLNSKNVNRRRKRFIFCSAQPTQNNIKVVINGATKEIGRAAVVAVTKARGMEVAGAVDTCHVGEDIGKXCFQFFWLEGMEEPLEIPIINDLTMILGSISQSKAAGVVVDFTDPSSVYDNVKQGVLVAPTLSIGSILLQQAAISASFHYSNVEIVESRANANDLPSADANQIANNLSNLGQIYNREDPSTDVLARGQVLGDGIRVHSMVLPGIPSSTTVHFSGPGEVYSIKHDITDVKXLMPGLLLAIRKVVRLKNLVYGLEKFI

SEQ ID NO: 3557 - protein, 217 aa, Glycine max
METSQLFNVLAIFLLSDPFAVVNANSEGDALFAFRRAVKDPNNVLESWDPTLVDPCTWFHITCDDDKRVTRLDLGHAKLSGHLVPELGRLQRLQFLELYKNDLMGPIPKELGELKNLLSLGLYQNNLTGSIPATLSNLSNIKFLRLNSNKLTGRIPRELTKLGNLKILDLSNNDLCGTFPTYGSFSKFSQESFKNNPRLKGPELMGFVRYDTGESCK

SEQ ID NO: 3558 - protein, 432 aa, Glycine max
MDPQAFIRLSIGSLGLRCTGIELSTTKSGIQTLSLPCVCEIRLRGFPVQTSSVPVISSTEVIPDTQNVAFSFYLEESDLKALLAPGCFYNTHACLEIAVFSGRKGSHCGVGNKRQQIGIFRMQVGPEWGEGKPVILFNGWIGIGKNKQDNGKPGAELHLKVKLDPDPRYVFLFEDITTLSPQIVQLQGSIKQPIFSCKFSKDRVSQIDSLSAYWSGSNDISDLETERRERKGWKVTIHDLSGSAVAAAFITTPFVPSSGCDWVARSNPGSWLIVRPDIGRSESWQPWGKLEAWRERGIRDTVCCRFHLLSEAQEGGEFLMSEIHISAEKGGEFFIDTEKHMRTVATAASPIPSPQSSGDFGALSPLVGGFVMSCRVQGEGKRSKPSVQLAMRHVTCVEDAAIFMALAASVDLSIVACKPFRRKVRRGFWHSM

SEQ ID NO: 3559 - protein, 338 aa, Glycine max
MAAGVYNQPIVAFQSHSHINNFNHQQKFNNLVRLVTKDFIGSNFLSRRDCRVIQSLASQTSVVDTVSSPSKSKTSDRDTHKKSNEASLILIRHGESLWNEKNLFTGCVDVPLSKRGIDEAIEAGKRISSIPVDLIFTSALIRAQMTAMLAMTQHRRRKVPIIMHNESEQARGWSQVFSEDTEKQSIPVIAAWQLNERMYGELQGLNKQETADRYGKEQVHEWRRSYDIPPPNGESLEMCAERAVSYFRDQIEPQLLSGKNVMISAHGNSLRSIIMYLDKLTSQEVISLELSTGIPMLYIFKEGRFVRRGSPIGPTEAGVYAYTRRLALYRQRLDDMFQ

SEQ ID NO: 3560 - protein, 364 aa, Glycine max
MRIPSNCEFTRITPSAFSYHRLKSYVSDCRAVLLPSFGGPHVLQLRSHVPVPPLKPHDVLVRARAVSVNPLDTRMRAGYGRSIFEPLLPLILGRDVSGEVSAVGDKVRSVSVGEQVFGALHPTAVRGTYSDYAILSEEEVTPKPDSLTHVEASAIPFAALTAWRALKSTARISEGQRILVVGGGGAVGLSAVQLAVAAGCSVATTCGSQSVDRLLAAGADQAVDYVAEDVELAIKGKFDAVLDTIGVPETERMGINFLKRGGHYMTLQGEAASLSDRYGLTIGLPAATAVLLKKQLLYRFSHGIEYSWTYMRADLDGLIEIRKLCEAGKMKIPVYKTFPITQVKEAHEAKDKKLIPGKVVLELD

SEQ ID NO: 3561 - protein, 332 aa, Glycine max
MDREQEEMQFLGFFDIYKEASKIILSWRKIFTQITSTLILPLSFIFLIHMEISNLLFRKILINEIVMDETRRNTPQYNKLDRMISSELITLVLFKIAYFTLLLIFSLLSTSAVVYTIASIYTAKEVTFKRVMSVVPKVWKRLMLTFLCAFAAFFIYNIVTMLVMFLSIVTIGISSGGVVVLVLITVLYFIGFVYLTVVWQLASVVTVLEDSWGVRAMAKSKELIRGKMVLSIFIFFTLVASFVSIRVLFKVMVVDGWRVSSLDKTAYGVLCFLLLSCLFLFGLVLQTVLYFVCKSYHHENIDKSALADHLEGYRGEYVPLTAKDVQLEQYQV

SEQ ID NO: 3562 - protein, 233 aa, Glycine max
  misc_feature (179)..(180): Xaa can be any naturally occurring amino acid
FVFTMAAGGIFLFVLDRFLRFCQSRRTVNVISSRCLPCGTVELVLSKPQSLRYNALSFIFVQVRELSWLQWHPFSVSSSPLDGKNHLAILIKVLGKWTEKLRHRITDVDAQKDSSVITTSVEGPYGHEVPYHLMYENLILVAGGIGLSPFLAILSDILHRVREGKPCQSRNILLVWAVXXSNELPLLSTIDMQSICPSFSDKVNIDIHIYVTRESDPPVVSLHFFIQICTFFC

SEQ ID NO: 3563 - protein, 160 aa, Glycine max
MADIEGSPGSSMHGVTGREQTFIASVASPMVPTDTTANFALPVDSEHKAKIFKLFSLANPHMRTFHLSWISFFTCFVSTFAAAPLVPIIRDNLNLTKGDIGNAGVASVSGSIFSRLTMGAVCDLLGPRYGCAFLIMLSAPTVFCMSFVNDAAGYIAVRFM

SEQ ID NO: 3564 - protein, 122 aa, Glycine max
  misc_feature (87)..(87): Xaa can be any naturally occurring amino acid
  misc_feature (115)..(115): Xaa can be any naturally occurring amino acid
SRDNRNNRVSLFDGIEEGGIRASSVYSSSHEIGEHDYEQALDGLQDRVTLLTRLSGAYINGEVDSHNRMLDRMGNDMDSSRGVLSGXMDKFKMVFETKSNQRMFTLVASFVVLFXIIYYLTR

SEQ ID NO: 3565 - protein, 488 aa, Glycine max
MENLHNHRGITNSNSCPPRGFTDIFRRELGLSHPNSFARRFSASEVLVKSLDLYGKLDGHEGCVNAVEFNSTGDLLVSGSDDRQVMFWNWASKTRLFAYPSGHTDNIFQTKIIPFTDDCRIVTSAGDGQVRLGLLWEDGRVDTTMLGKHHGCVYKLAVEPGSAHIFYSSGEDGFIQHFDLRSNSATKLFCCSSSIGNNKQTLSKVGLNSIVIDPRNPYYFAIGGSDEYARVYDIRKCQWGSARNSDRPVNTFCPCHLIGSNNVHITGLAYSSFSELLVSYNDELIYLFEKNVHSDSSPSSATSEDPKNIHEAQVYSGHRNAQTIKGVNFFGPNDEYIMSGSDCGHIFIWKKKEAKLVRLMVGDQHVVNQLEAHPHIPILATCGIEKNVKIWAPLGNDIPPLPANVKEIMETNRQGREDRSRVTLTPDVIMHVLRLQRRQTLAYIERRHNRADIVSDEEDAEGYLLGFSDGDASSEEDSPGNSRDCNIS

SEQ ID NO: 3566 - protein, 172 aa, Glycine max
  misc_feature (158)..(159): Xaa can be any naturally occurring amino acid
ERFRELEDYWNESQGNLRLGPPAPDGWISEFSRQREKYDNPDSWANSFEQQYGANGWVSEFEHSQLSSVDQMRGMNMSNFAAREQTRMLANTLAQNGDPKFQNSKFLQFVSKMSRGELIIDDNQVKENALPASGDWATEYNQQYNHGHAWAGEFLNDXXYHGPDQWANEFTS

SEQ ID NO: 3567 - protein, 497 aa, Glycine max
  misc_feature (253)..(253): Xaa can be any naturally occurring amino acid
EFSQHREKYDNPDSWANSFEQQYGANLREDDRRDSQLSSVDQMRGMNMPNFAAMEQTRMLANTLAQNGDPKFQNSKFLQFVSKMSRGELIIDDNQVKENALPASGDWATEYNQQYNHGHAWAGEFLNDKVYHGPDQWANEFTSEGRQHDAVDDQWVNEFSKLKVNDWADEFGQQFGEGALGDSTSDSWAQAYDEFLNEQVAAKQQLDSSRGVYVFSDLNPYVGHPNPLKEGQDLFRKGLLSEAVLALEAEVLXKNPENAEGWRLLGIAHAENDDDQQAIAAMMRAQEANPTNLEVLLALGVSHTNELEQTAALKYLYGWLRHHPKYGTLAPPEMADSLYYADVARLFNEAAELSPDDADVHIVLGVMYNLSREYDKAIASFERALKLKPQDYSLWNKLGATQANSVQSADAIMAYQQALDLKPNYVRAWANMGISYANQGMYDESIRYYVRALAMNPKAENAWQYLRISLSCASRNDMLEACDSRNLDLLQKEFPLQ

SEQ ID NO: 3568 - protein, 246 aa, Glycine max
ARGKFQSRCNLELADLDKVEEEEDILALRMLIQQHQRHTNSLLAKEVLDDFENLLPKFIKVFPREYKRVLASMKSEETSKDALVHAAKDDQDDEAQAVEKDAFEELKKLVMASLNEEPSQAESPKRPSRVTGAIKHRGFVAYEREGVQYRDPNVRMTDWKEVMEETKPGPLLKTQSARCMDCGTPFCHQENSGCPLGNKIPEFNELVYQNRWREALERLLETNNFPEFTGRVCPAPCEGSCVLGII

SEQ ID NO: 3569 - protein, 111 aa, Glycine max
  misc_feature (42)..(42): Xaa can be any naturally occurring amino acid
QEWEVKLEYSALALGIVGYICLALLFFPVTRGSSILRFIGLXTSEGSIKYHIWLGHIAMTLFTAHGLGYIIFWGKTHQILEIFKWNKIGVSNVAGAGSLLAGIKPWAGTLT

SEQ ID NO: 3570 - protein, 210 aa, Glycine max
  misc_feature (69)..(69): Xaa can be any naturally occurring amino acid
LWKREVECLKLRDLASNVIGPEGSDKEFEGYIDSNLRVVETFLRLFPIGLCVTALVIMLKNSQENKYGXSLATPDLGAFRYLVHANGICAGYSLFSAIFVALPRLSSMHIAWTFFVLDQVLTYIILSAGAASAEVLYLAEKGNMATAWSSACRSFGPFCHKVTASTTITFVVVVFYVLLSLISSYKLFSKYDAPTVSNPSMGADIVAFHG

SEQ ID NO: 3571 - protein, 240 aa, Glycine max
MHLSNLIHTVPTRDMRVVNGELCCLENPLPPTHFASSSSSFLCFVNTEMSAVNITNVTVLDNPASFLTPFQFEISYECLTALKDDLEWKLIYVGSAEDETYDQLLESVLVGPVNVGNYRFVLQADPPDPSKIREEDIIGVTVLLLTCSYLGQEFIRVGYYVNNDYDDEQLREEPPPKVLIDRVQRNILSDKPRVTKFPINFHPENNENEEQQPPPSEHPSETGEDPLAVVDRDPPDEKDS

SEQ ID NO: 3572 - protein, 246 aa, Glycine max
  misc_feature (37)..(37): Xaa can be any naturally occurring amino acid
LCHIIRSPVHMDVVGDFCMAAHLTSQIPLLMHGETTXGCHIFARVFKSHHPEACHSGRLYIEIPYLISFLPYWWRAMQCARRWFDDSDVNHLANMGKYVSAMVAAGARVTYSRQDNHLWFAIVLITSVVATVYQLYWDFVKDWGFFNPKSKNPLLRDDLILKNKSIYYMSMALNVVLRVAWVETIVHLKVGPVQTRLLDFLLASLEVIRRGHWNFYRLENEHLNNVGRYRAVKAVPLPFRDIDSDS

SEQ ID NO: 3573 - protein, 360 aa, Glycine max
LAVGLEALLEGITDTLGTELLESLLKMAPSKEEERKLKEHKDDSPTKLGPAEKFLKAVLDVPFAFKRVEAMLYIANFESEVEYLRKSFQTLEAACEELRNSRMFLKLLEAVLKTGNRMNVGTNRGDAHAFKLDTLLKLVDVKGADGKTTLLHFVVQEIIRTEGARPSSTNQTPSANLNDDAKCRRLGLQVVSSLSSDLASVKKAAAMDSEVLSSEVSKLSKGIAHIAEVVQLDEAGGSDESSQKFRESMNKFMRMAEEEILKVQAQESVALSLVKEITEYFHGNLSKEEAHPFRIFMVVRDFLTVLDRVCKEVGMINERTMVSSAHRFPVPVNPMLPQPLPGLVGKRQYNSSDDDDSSSP

SEQ ID NO: 3574 - protein, 648 aa, Glycine max
  misc_feature (214)..(214): Xaa can be any naturally occurring amino acid
  misc_feature (329)..(329): Xaa can be any naturally occurring amino acid
  misc_feature (354)..(354): Xaa can be any naturally occurring amino acid
  misc_feature (372)..(372): Xaa can be any naturally occurring amino acid
  misc_feature (386)..(386): Xaa can be any naturally occurring amino acid
MSSAEKPSSKGQAWFCTTGLPSDIVVEVDDMTFHLHKFPLMSKSRKLHLLITQQEAASNSTVPQQQQQQQETEDEDEIVEEQCHVTFTGFPGGSEAFEMAAKFCYGVKIDLTPSNVAALRCAGEFLEMTEDYSEDNLVSKTEGFLSQHVLKNLKDSVKTLKSCDSLMPMAENLGAAQRCVDSVVSRASSADPALFGWPVSDATSVSKQVLWGGXTATADPALAPGPVSLGFEDLALLRLPLFKRLILAMRSAGLSPEIIETCLMYYAKKYIPGVSRSNRKPLPSSSSSSSSVATEAEQKELLETVVSNLLPSSSSSSSAATEALFEEIXRLVSNLPLACSYALEKKIGLHLEKXSLDDLLMPSYSYLNETLXDVDCAARSISHFLXLLKQKTSRNGGKRRARRSPGLMLVGKLIDGYLSEIASDANLKPEKFYNFAISVPDEARLFHDGLYRAVDVYLKAHPWVLEEEREKICGLLDCQKLTLEACTHAAQNERLPLRAVVQVLFFEQLQLRQAIAGTLMAAEAAAEPGRQSAALEREAEDGRGEGLGLEHVQERNGTWRVAVRENQVLRLDMDSMRTRVHQLERECSSMKRVISKFDKFAASGGGWRASLGRKFGCKFKTQVCDSHESTAVDTRKGRHHQQHHPHHD

SEQ ID NO: 3575 - protein, 132 aa, Glycine max
  misc_feature (94)..(94): Xaa can be any naturally occurring amino acid
  misc_feature (124)..(124): Xaa can be any naturally occurring amino acid
TEKDASGTIIELAKLKKVCWLEVRGKFDIRKLLPGILYQVSFLIMLEDSSEGWEVPINVRLVLPGGKRQQHKVNLNGKLREDWMEILVGEFVAXKKASEKDVGEMEISMYEHEGGMWKTGLSLXGVAIKPKN

SEQ ID NO: 3576 - protein, 173 aa, Glycine max
MGGCLSSKPKAVDNGSASGNTNCFMLYARALSITWGETPEYWIWVQQKEASGTIIELAKLKKVCWLEVRGKFDIRKLLPGILYQVSFLIMLEDSSEGWEVPINVRLVLPGGKRQQHKVNLNEKLRENWMEILVGEFVASEKDGGEMDISMYEYEGGMWKSGLVIQGVVIKPKN

SEQ ID NO: 3577 - protein, 527 aa, Glycine max
  misc_feature (370)..(370): Xaa can be any naturally occurring amino acid
MKNPRKKKRPKPAQKKVLEENNKGVVVAGNENEEEEKRKRSVLEALVEAFSLSSIREASMAYEIAGGDPDRASEILRKGSSDRFEDSFSCFSYGSSSSGGSSGGGGSSSCSGLELGSKGGRQQKKKVVASTGTVSTVLGKEYVRRNNIRNKGFSSNGVFEMEEAEQFLCSMLGDDSDINLAVVRDVLCQCGYDIETASDVLLDLAASTNDKPNTDRHPNYRVDNIDDERFFADPNDSLIDRRSECTSLSSEGYLSDNPWPFGRKYVEVLNSSKADSAISPGCTKSEIPQKVLESLFNIPKSTEHDKDTMNWRNVVKKIQSLGPGFNVSPHVAESQQHTCAKGDEYLKMMFDFKDFMVTLKMNYFIFTEDXTKHWESVAAYYTKAATAYTKRERAYAAYLSDQGKEQTRLAQKADTKASHDIFIARNKGIENMITIDLHGQHVKQAMRMLKLHLLFGSYVPSVQTLRVITGCGSHGVGKSKLKQSVINLLDREAIEWREENQGTVLIKLSGWREYSFLDTSSDSDSND

SEQ ID NO: 3578 - protein, 517 aa, Glycine max
MAEVAPPKKENPNLLLGRFELGKLLGHGTFAKVHHARNIKTGEGVAIKIINKEKILKGGLVSHIKREISILRRVRHPNIVQLFEVMATKTKIYFVMEYVRGGELFNKVAKGRLKEEVARNYFQQLVSAVEFCHARGVFHRDLKPENLLLDEDGNLKVSDFGLSAVSDQIRQDGLFHTFCGTPAYVAPEVLSRKGYDGAKVDIWSCGVVLFVLMAGYLPFNDRNVMAMYKKIYKGEFRCPRWFSSELTRLLSRLLDTNPQTRISIPEVMENRWFKKGFKQIKFYVEDDRVCSFDEKLLLHHDDDLATSDSEVEIRRKNSNGSLPRPASLNAFDIISFSQGFDLSGLFEEKGDEARFVSSAPVSKIISKLEEVAQLVSFSVRKKDCRVSLEGCREGVKGPLTIAAEVFELTPSLVVVEVKKKGGDKAEYEKFCNSELRPALENLGMEESASSSSSCHQSTHTQSEFQQHRTLSDSALNRHSDNECLFERELGLADETSISQHGESKFECQQENMAMFTI

SEQ ID NO: 3579 - protein, 589 aa, Glycine max
MVWVNEKLKGFVGHRWVVFVCAMWDMSFAGTSYMFGSISPVIKSSMGFNQKQVAFLSVAKDLGDNVGLLAGKICQSSPIWALILVGVVQNVVGYGLVWLIVTHQFPALPLWLLCILIFVGQNGSTYYNTAALVSCVQSFPESRGPVVGILKGFVGLSGAIWTQLIAMAQLPDQASLIFIIAVGPAMVSLAFMFIIRPVESYRQSRASDGTGFTFIYSICLLLAAYLMGVLLLENMFDLDQSTITLFAVILIILILLPIIVPILLVFFSGPQKSADQEALLEPPMLEATKPNKHFVGESSTSTTKVIKHVENEKSPSKLEVLPLSSEGPRDVFQCQARLWQAVTKAVKKIKRRNGPHRGEDFTLSQAMAKADFWVMFFSLVMGCGSGLTIINNMGQICQSLGDNNVNVYVSVISISNFLGRVGGGYFSEVIVRSFGYPRLAALAVIQAGMSLGLCYYVFGLAGQVYAVAISNGFGYGAHWSIALAAASELFGLKNFGTLYNFLTMASPAGSLFLSGFVASTIYDYYAEQQVKHRMLTGNNNDLLLCEGNICFSITFGILAVVCLCAASLSLIVAHRTRKFYAQLYEESQT

SEQ ID NO: 3580 - protein, 306 aa, Glycine max
FNSFSRYGNKIVAIKVLHRGSTSEERASLENRFAREVNMMSRVHHDNLVKFIGACKDPLMVIVTELLPGMSLRKYLTSIRPKLLDLDVAINFALDIARAMDWLHANGIIHRDLKPDNLLLTADQKSVKLADFGLAREETVTEMMTAETGTYRWMAPELYSTVTLRQGEKKHYNNKVDVYSFGIVLWELLTNRMPFEGMSNLQAAYAAAFKQERPGIPDDISPELAFVIQSCWVEDPNLRPSFSQIIRMLNAFLFTLSPPSPPLPVPPDNEPEVATTSNGTITEFSARNRGKFGFLRQLFSSKRTKN

SEQ ID NO: 3581 - protein, 342 aa, Glycine max
  misc_feature (128)..(128): Xaa can be any naturally occurring amino acid
  misc_feature (233)..(233): Xaa can be any naturally occurring amino acid
MDWVRGDALGRGSFATVSLAIPTTNPNQFPSLTAVKSAEAQTSCWLRNEKHVLDRLGSSSPRIIRCFGDDCSFENGVEYYNLFLEYAAGGSLADELKNHDGQISEHEAREYTRAIVEGLSHVHKSGFXHCDIKLQNILVFGDGGIKIADFGLAREAGQKQEKSECRGTPMFMSPEQATGGECESPADIWALGCAVVEMVTGKPAWQVEKGASMWSLLLRIGVGQEVPEMPLIXLSEDGKDFIEKCFIKDPKKRWSAEMLLKHPFLLNDDTVSFKRVHESPRSHFDFPDWVSSVANSLPSSPEFQEKWGFDDEFCSPEDRLRQLLTVNRPASWSESDGWSSVR

SEQ ID NO: 3582 - protein, 328 aa, Glycine max
QLRRPPRKGRVCVTGGTGFIGSWIIKRLLEDGYSVNTTVRPDPEHRKDVSFLTSLPRASQRLQILSADLSNPESFIASIEGCMGVFHVATPVDFELREPEEVVTKRSIEGALGILKACLNSKTVKRVVYTSSASAVDNNKEEIMDESSWNDVDYLRSSKPFGWSYSVSKTLTEKAVLEFGEQNGLDVVTLIPTLVFGPFICPKLPSSVRNSLDFILGEKGTFGVVLQTDMVHVDDVARAHIFLLEHPNPKGRYICSQCSVTYERISKLVSAKYPEFQPPPVESLNHIEGTKGSYLSSKKLIDAGFVYKYGLEEMVDDAIQCCKEKGYL

SEQ ID NO: 3583 - protein, 120 aa, Glycine max
MASLSGICSSSPTLKKFPNQSPSLTDPLRKDHVSFPARRADRTLSLAPPPRAVAREVSDGALAAMKKGLEKDPRALWRRYVDWLYQHKELGIYLDVSRVGFSDEFVKEMEPCFEAAFRAM

SEQ ID NO: 3584 - protein, 256 aa, Glycine max
MNDYKGREGESSVVVVRKRFKEKQQPCPSTRPIINQQHRRSASLPNTQYEESETDVEVSDVSVSEGDDTSWISWFCNLRGNEFFCEVDDDFVQDDFNLCGLSSQVPYYDYALDLILDVESSHGDTFTEDQNELIESAAEMLYGLIHARYILTSKGMAAMLHKYKNYNFGRCPRVFCSGQPCLPVGQSDVPRSSTVKIYCPRCEDMYHPKSKYQDIDGAYFGATFPHLFLMTYGNLKPQKQSQNYVPRVFGFKVHKS

SEQ ID NO: 3585 - protein, 514 aa, Glycine max
MNGGDEVVAAPAGPPHPLEWKFSQVFGERTAGEEVQEVDIISAIEFDKSGDHLATGDRGGRVVLFERTDTKDHGGSRRDLERMDYSIGRHPEFRYKTEFQSHEPEFDYLKSLEIEEKINKIRWCQTANGALFLLSTNDKTIKFWKVQEKKVKKISDMNVDPSKSMGNGSIASSSNSSSSRPYLANGGSPDRYNYISNDFSFPPGGLPSLRLPMVSSHETSLVARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRVSTGSYSNLFRVFGCVPGSTEATTLEASKNPMRRQVPTPSRPSRSLGNSITRVVRRGAESAGVDANGNSFDFTTKLLHLAWHPTENSIACAAANSLYMYYA

SEQ ID NO: 3586 - protein, 926 aa, Glycine max
PISQCAALIMDKKSRRKEESNVEMRRNPSMLRKLQENKLREALEEASEDGSLSKSQDIDQPDSAANQDDGLGRSRSLTRLHAQREFLRATALAAERIFESEEEIPSLQEAFAKFLTMYPKYQSSEKVDQLRSDEYSHLSPKVCLDYCGFGLFSFVQTIHYWESSTVSLAEITANLCTHALYGCAERGTVEYDIKARIMDYLNIPENEYGLVFTVSRGSAFKLLADSYPFHTNKKLLTMFDHESQSIAWMAQSAREKGAKVHSAWFKWPTLKLCSTDLRKQISNKKKRKKDSATGLFVFPVQSRVTGAKYSYQWMALAQQNNWHVLLDAGSLGPKDMDSLGLSLFRPDFIVTSFYRVFGYDPTGFGCLLIKKSVMQSLQNQSGCTGSGMVKITPEFPMYLSDSVDGLDKFVGIEDDDEITGIGDKTTETRQGTQLPAFSGAFTSAQVRDVFETEMDQDSSERDGTSTIFEETESISVGEVIKSPVFSEDESSDNSFWIDLGQSPLGSDSAGQSNKHKTASPLPPFWFNGRRNQKQHSPKPTSKMYGSPMYDDREVNLGAHEDRRVLSFDAAVLMSQELDRVKEVPEEEHVEEVDHYSRRLEGSDHLHVDEIVEEPGTSEAVNNGSWLNSTSLARHQSLENGSTSEICPDVKESAIRRETEGEFRLLGRREGNRYGGGRFFGLEENEANSRGRRVSFSMEDNRKEYLSQALEPGDISATSFDDEEVTSDGEYGDGQDWGRREPEIICRHIDHVNMLGLNKTTLRLRFLINWLVTSLLQLKLPASDGGEKASLVQIYGPKIKYERGAAVAFNVRDRSRGLINPEIVQKLAEKEGISLGLGFLSHIQILDDSRQHRGALNLEDTTLCRPMENGRRDGKGSFVRLEVVTASLGFLTNFEDVYKLWAFVAKFLNPTFIREGGLPTVQEGSEA

SEQ ID NO: 3587 - protein, 81 aa, Glycine max
MSSDTKANSNVGGGSRSRLNHYLYSGDKKHVFVGLTLITAVFTIPWFLMNRGTKHQSHQDYLEKADKARSQRLSSSSASAK

SEQ ID NO: 3588 - protein, 607 aa, Glycine max
  misc_feature (323)..(323): Xaa can be any naturally occurring amino acid
MEQLVNFIIRPPRAEYDPKSDLLDQEFMLKGKWYQRKDVEIKNSRGDVLQCSHYLPIVSPEGKPLPCVIYCHGNSGCRADASEAAIILLPSNITVFTLDFSGSGISGGEHVTLGWNEKDDLKAVVNYLRDDGNVSLIGLWGRSMGAVTSLMYGAEDPSIAGMVLDSPFSDLVDLMMELVDTYKVRLPKFTVKFAIQYMRRAIQKKAKFDITDLNTIKVAKSCFVPALLGHAIDDDFIQPHHSDRIFEAYMGDKNIIKFDGDHNSPRPQFYFDSINIFFHNVLQPPEDEVGESFFDPMNDYFGKDVWRSVHELGYSNESSSKNXTEPSTSSTINAIEQVRSRRPMSRMEVPSDISSKDEHREHEEKCGNISPSSSSMISFELSNDDPFGSHVPATLEDDQYVEYQLDDLAGFPSTAEEEERMFMEAVMESLKDLEVRNPNAEQPTSSFSSLSVAAVEPSDKGASSGEISRPVETESSSLKHTTESKFKTTSSTSEEFEPLNGESNSISVKHSQNVVSEPSPVPSVSLEGPAHLQLQPPPSAPTDTLSVTESSNTSGSARSDSSASLQSSSETDVSHNTKATVTVVRNPAGHVMDGLMRRWDFNFFKNK

SEQ ID NO: 3589 - protein, 190 aa, Glycine max
MEISSLEDYSSFFFPDMDPKRRGNDTAFNDLLNSLIHLDNKQTLMDPTQFQFDSSPPTKRPRRAIEDIHNVTVQQQQQQQRRLWVKDRSKDWWERCNQPDFPEEEFRRYFRMSKATFDMICQHLDSAVTKKNTMLRQAIPVRQRVAVCIWRLATGDPLREGSKRFGLGISTCHKLVLEVCSGIKTVLMPK

SEQ ID NO: 3590 - protein, 77 aa, Glycine max
SAEAALPFVGFAVAMFMFYSLVPVLLKINGSTMLNLSLLTSDMWAVLIRIFAYHEKVDRMYFESFGAVTIGLIIYSE

SEQ ID NO: 3591 - protein, 395 aa, Glycine max
MYVVESKVGAIGCMLVSLFFLGTWPAVMTLLERRGRLPQHTYLDYTLTNLMAAVIIAFTFGQIGNAQPNFLSQLSQDNWPSVLFAMGGGVVLSVGNLSTQYAWAFVGLSVVEVITSSITVVIGTTLNYFLDDKINKAEILFPGVGCFLIAVCLGSAVHSSNTVDNKAKLSDYKDAAKSTSVITFKETSEVESKDLEDGTHKAKAGTAAFLIELEKKRSIKVLGKSTFIGLAITFFAGVCFSLFSPAFNLATNDQWHTLKKGVHHLSVYTAFFYFSVSCFVIAIILNITFLYHPVLNLPKSSLKAYLSDWDGRGWAFLAGLLCGFGNGLQFMGGQAAGYAAADAVQALPLVSTFWGIVLFGEYRKSSRRTYVLLGSMLLMFVAAVAVLMASSGHRK

SEQ ID NO: 3592 - protein, 525 aa, Glycine max
MKFYISTRGIKRVTISNSEGKGSAKTTAVAAGSGRRISARTVFPVVLVLGIVLPFLFVRIAILMLESAAACSSLECAGWRFFSGVDTSLELRDELTRALIEANDGNVNEGAGSFNELVKEMTSKQDLKAFAFKTKAMLSQLERKVQLARQQESVYWHLASHGVPKSLHCLCLKLAEEYAVNAMARSRLPPPEFVSRLVDPTFHHLVLLTDNVLAASVVVTSTVESSINPEKLVFHIVTDKKTYAPMHAWFATNSIKSVVEVRGLHQYDWSEEVNAGVKEMLETNHLIWKQYYNKEKDLDYTQEHSRYLEALRPSSLSLMNQLRIYLPELFPDLKKIVFLDDDVVVQHDISSLWELDLNGKVIGSVLKSWCGDGCCPGSKYTNYLNFSHPPISSKFNGDQCVWLYGMNIFDLEAWRRTNITETYHQWLKLNLKSGMTMWNPGVLPPALMTFEGQVHPISSSMLVTDLGYRHQSAEISKEKLEAAAVIHFSGPAKPWLEIGFPEVRSLWSRYVNISNKFIRRCRITG

SEQ ID NO: 3593 - protein, 366 aa, Glycine max
  misc_feature (40)..(40): Xaa can be any naturally occurring amino acid
HAFGIPGSASVSRSNRKPLPSSSSSSSVATEAEQKEILEXLVSNLPLEKSSKAATATRFLFGLLRTTNILNASEACRDALEKKIGLQLEEATLDDLLVPSYSYLNETLYDVDCVERILSQFLEGLEARTAAETTEDAAATRSPALMLVGKLIDGYLSEIASDANLKPEKFYNFAISLPDEARLFDDGLYRAVDVYLKAHPWVSEEEREKICGLLDCQKLTLEACSHAAQNERLPLRAVVRVLFFEQLQLRRAIAEKLGAAEEPSRHSAAMAEEEEVEDDNNTWQVTVRENQVLRLDMDSMRTRVHELERECSSMKRAIEKMDKMGPRGGGPWRASLALGRKFGCKFKTQVCDSHEPATREGRPPRR

SEQ ID NO: 3594 - protein, 502 aa, Glycine max
MGSTPEVLAQRSCGKLIGTRLLQYLNGGPLSFKTHQAIVLIVTFFAYASYHATRKTTSIVKSVLDPQSAATGLTFFPFRPTNFTESNGSKRLSSNLGDGWAPFNGSDGTSLLGQLDVAFLAVYAFGMYFSGHFGDRCNLRIFLTVGMLGTGLFTSLFGVGYWGNIHNFYYYLVVQMIAGLFQSTGWPSVVAVVGNWFGKSKRGLIMGIWNAHTSIGNIAGSLIASAMLSYGWGWSFVVPGLITAFIGLAVFLILPVTPESVGAREEDEFSGPIKSGEEAAEPLLRQETPVEEKEAVGFIEAWKIPGVAPFALCLFFAKLRAYRVHRGMAYSGGCSFCYVSFLCHETSGTLSTLFDVGGVLGVLGGILAGHISDHLEARAITAASFMYCAIPALFFYRSYGHVSLIVNGALMFVTGTFETLQGDLITPAVSAAIIDGTGFIGAAVGPLTTGYISAKSWSAVFAMLMAAALIAGLLLTRLVVSEVATKIEESRSNRAQDCSLNV

SEQ ID NO: 3595 - protein, 857 aa, Glycine max
  misc_feature (159)..(159): Xaa can be any naturally occurring amino acid
  misc_feature (402)..(402): Xaa can be any naturally occurring amino acid
  misc_feature (730)..(730): Xaa can be any naturally occurring amino acid
AGPLVTSNKKSSKKSARFKDQEDEDFVEITLDVRDDTVSVQNIRGGDPETALLASRLEKRPFSLSVRLRQVSQELKRMTSSKKFDRVDRAKSGAARALKGLKFMTKNVGTEGWSQVDKRFDELAVDGKLPKTRFSQCIGMNESKEFAGELFDALSRRRXITSASISKDQLREFWEQITDQSFDSRLQTFFDMVDKNADGRITQEEVQEIIALSASANKLSKIQDRAEEYAALIIEELDPDNLGYIEIYNLEMLLLQAPAQSTNITTDSRIMSQMLSQKLVPTKDYNPIKRGFRSLAYFVEDNWKRIWVILLWLSICAALFTWKFIQYKHRAVFDVMGYCVTSAKGAAETLKFNMALILLPVCRNTITWLRSKTKLGMDAPFDDNINFHKAIAFGIAIGVGIXHAIAHLTCDFPRLLHATDEEYEPMKPFFGEDRPNNYWWFVKGTEGWTGIAIVVLMAIAYTLAQPWFRRNRLNLPKPLKRLTGFNAFWYSHHLFVIVYGLFIVHGYYLYLSKEWYKKTTWMYLAIPMILYACERLLRAFRSGYKSVKILKVAAYPGNVLALHMSKPQGFKYSSGQYIFVNCPDVSPFQWHPFSITSAPGDDYVSVHIRTLGDWTSQLKAAFAKACQPACSDQSGLLRADMLQGNNIPRMPKLVIDGPYGAPAQDYKNYEVILLVGLGIGATPLISILKDVLNNMKHQKDIEEAMVESGVKNNKRKPFATNRAYFYWVTXREQGSFEWFKGVMDDVAEYDKDGIIELHNYCTSVYEEGDARSALITMPQSLHHAKSGVDIVSGTRVKTHFARPNWRSVFKHTALKHPGKRVGVFYCGAHTLVGELKRLSLDFSRKTNTKFDFHKENF

SEQ ID NO: 3596 - protein, 488 aa, Glycine max
MSGEETQRNVFGAETASSLVKELRDNFGKGTTRSYEWRVSQVKALLKAVVENEDQIVGALCSDLAKPPLETVVYEIGMFKNSCEVILKELKHWMTPEKVKTSIRTFPSSAEIVPEPLGVVLVISAWNYPILLSLDPVVGAIAAGNAVVLKPSEIAPASSSLLLKLIEKYMDNSFIRVVEGAVDETTALLQQKWDKIFYTGNGKVGRIVMTAAAKHLTPVVLELGGKSPVVVDSNVDLQIAARRIISGKWGLNNGQACISPDYVITTKDYAPKLVDALKTELESFYGRNPLESEDLSRIVSSNHFARLSKLLNDDKVSGKIVYGGEKDEKKLRIAPTILLDVPQDSSIMGEEIFGPLLPIITVNKLEESIDVINSGAKPLAAYVFTTDNKFKEQFVKNVSAGGLLVNDTALHLVVDTLPFGGVGESGMGAYHGKFSFDAFTHKKAVLYRSFAGDSAIRYPPYTDTKLRLMKALVGGRILGIIRALFGWS

SEQ ID NO: 3597 - protein, 670 aa, Glycine max
  misc_feature (227)..(227): Xaa can be any naturally occurring amino acid
MELTVFSLFFFFFTFHLPSCFSGQSSSMESVPDLQNTMYASIDGYPCVRLMNLSGTIGCSNPGRDKVVAPILRFENVDKIAEPSAILVSLDEFPTLFTRISDDSSFASKVLGVLVEPTGDVQNKLKGFSPDQKFPQAQFALYHNTSYQWNSIGSGIMWKSYKFPVFLLTESGSKTLQEFVTKNEDKKKSYTSNVAEFDLVMQTVKSGTHDSESCLKEETCLPLGGYXSVWSSLPPINISSLQRSKPILLTVASMDSASFFRDKSLGADSPISGLIALLAAVDALSHLDGLGDLSKQLVFAVFTGEAWGYLGSRRFLVELDMHSDAVHGLNHTLIETVIEIGSVGKGLSQGVKNFFAHKEGDSSATNQTVAALKRAQESLISENIKIASASASNPGIPPSSLMSFLEKNPAISGVALEDFDSVFVNKFYHSHLDDLSNVNSSAVVAAASLIARTLYMLASETEDVQNSTLAAINVNVSLVEQLMGCLLDCDPGLSCELVTKYISPMSTCPSHYVGVILDEPSSTPYTGYINDVPRFIWNFLADRTSIPRENNSSDCQHGCNGRDEVCIKAETDGKGVCVLSTTRYVPAYSTRLKFESGVWNVLPPNSSDKMGVVDPVWTESNWNTIGMRVYIVQNAAYDRLVLFGGITLTVFAYLAIATARAFFNKAMKRD

SEQ ID NO: 3598 - protein, 341 aa, Glycine max
MDWVRGDAVGRGSFATVSLAIPTTNYNQFPSLTVVKSADAQTSCWLRNEKHVLDRLGSCPRIIRCFGDDCSFENGVEYYNLFLEYAAGGSLADELRNHDGRIPEPQAREYTRDIVEGLSHVHKNGFVHCDIKLQNILVFEDGRIKIADFGLAREAGERQGKKSECRGTPMFMSPEQVTGGECESPADIWALGCAVVEMVTGKPAWQVENGSSMWSLLLRIGVGQEVPEIPNNLSEDGKDFIEKCFIKDPKKRWSAEMLLKHPFLLNDDTVSFKRVHESPRSHFDFPDWVSSVANSLPSSPEFQEKWGFDDEFCSPEDRLRQLLTVNRPASWSESDGWSSVR

SEQ ID NO: 3599 - protein, 193 aa, Glycine max
QIQTKWFKPILSDSPISLVLGPNNWLWLGAIISSSFLMFLLLLGIITRYYIYPIENNSDEVYHWTFKVLWFMFLLCAVICICSSAVFLWWKRQNSLESKQIMNVEFPTPTRSPGSWIYGSERELESLPHQSLVQATNVHFGARPDLKKILFECKDKDIGVLVSGPRSMRHEVGKICASGLADNLHFESFSFTW

SEQ ID NO: 3600 - protein, 368 aa, Glycine max
LIASVFFLPPKSHTFHCIIIHKWLIPPSSSGQSHDLKKEDCKETRSLVVCFGEMLIDFVPTVGGVSLAEAPAFKKAPGGAPANVAVGISRLGGSSAFIGKVGADEFGYMLGDILKQNNVETSGMRFDSNARTALAFVTLRADGEREFLFFRNPSADMLLQESELDKDLLKQARIFHYGSISLIDEPCKSAHLAAMSIAKNSGCILSYDPNLRLALWPSADAARKGIMDIWDQADVIKISEDEITFLTGGDDPYDDNVVLKKLFHPNLKLLIVTEGSQGCRYYTKAFKGRVAGVKVKPVDTTGAGDAFVSGILYCIASDQTIFQDEKRLRKALYFANVCGALTVTERGAIPALPTKEAILQFLLEAAVI

SEQ ID NO: 3601 - protein, 357 aa, Glycine max
CFEVVEKTGNDLHCKCIDAGLFLPGAKLSFWRDGKLVRGNNKLPTLSTKDWADIDFGIAEGVDFFALSFVNHADSVKDLKNYLSSKSTKSIKVLAKIESSESLHKLEEIVRASDGIMVARGDLGVEIPLEQIPTVQEDIIYVCRQLNKPVIVASQLLESMVEYPTPTRAEVADVSEAVRQYADALMLSGESAIGSYAQKALAVLDMASSRMESWSREENRQNLVNYHQLGASLPECITEQICNCAVEMANNLGVDAIFVYTKYGHMASLLSRNRPNPPIFAFTNDDSTRMALTLQWGVVPLLVDLSDDAESNISKSVQLMKSRGLISQGDVVLVVSDVAPTRATPMAFQSIQVKTII

SEQ ID NO: 3602 - protein, 319 aa, Glycine max
MWWPFSRKEKEGSGFSSSSTAEEVTEGIDGTALTAIVTGASSGIGAETTRVLAMRGVHVIMGVKNMNAAKNIKETILKGIPSAKVDAMELDLSSMTSVRKFASEFISSSLPLNILINNAGIFGTPFMLSEDNIELQFATNHIGHFLLTNLLLDTMKKTTHESKKQGRIVNVSSQGHQFTYREGILFDKLNDQSSYQAFRAYGQSKLANILHANELARRLKEDGVDITANSLHPGAIATNIHRYNSVLTGLPGVVKKLLSYVVKNVQQGAATTCYVALHPQVRGISGEYFADSNIAKANSQGRDIDLAEKLWDFSMNLTK

SEQ ID NO: 3603 - protein, 273 aa, Glycine max
MEGGRRRITLYDQMKAGNSSRYSLASLMLGDVVFKKVEAEEAEEAEAEAEASCELSRSRTLQDIIREEKPSNSSNNTKDRNSWRAFTAKLRLKRAIGSAWSSTTTITNHSNDDRNLPNIPETRHDSDELTQQNDIVVEGANDSDPIARFGSPVEHVEAVGNSSDGENNHEAVVGVSLMDLLEEAEQEMDLYRVSDDDDDVAEYEKREEEKGGVEEEIGSVVEYNCCVCMVRHKGAAFIPCGHTFCRTCSREIWVSRGNCPLCNNLILEILDIF

SEQ ID NO: 3604 - protein, 428 aa, Glycine max
MERVIGGKFKIGRKIGSGSFGEIYIASNMDTSEIVAIKMESKKTKHPQLLYEAKLYSILQGESGIPSMKWCGTDGDNNVLVIDLLGRSLEDFFVYCGRKFSLKTVLMLADQMLTRIECMHSKGFLHRDIKPDNFLMGLGRKSNQVYIIDFGLAKRYRDPNTNKHIPYRENKSLTGTARYASCNTHMGIEQSCRDDLESLGYVLMYFLRGSLPWQGLKAATKKEKYDNICEKKLSTPIGMLCKSYPAEFATYFHYCQSLTFDQHPDYGYLKRLFRDLFKREGYDSDYIFDWTILKYQQAQQTKKQNQSSPSTAVPSSLEPVVMEKHKGVNDSAHVTVTKMLANLERPSARARVQPKPSNVQNLDAKNHTEKHGVNNSPSTSSAIPKSSTENVSKPERPTGTSNLGRVFGSNARVSSSWIPSLRRISSAK

SEQ ID NO: 3605 - protein, 365 aa, Glycine max
  misc_feature (143)..(143): Xaa can be any naturally occurring amino acid
MELKFVLFLLLLLAVAGYGLASNATLNETCGYFDGSLNRDPKVPCPIGWIMDPNKTKCFLHVGRPQSWNDSETCCSKYGGHLVSLTSLQELQFAQGLCGESINSCWVGGQRVNATAGNQWMWSDNSPWNNSIFSMVPHPCSTXCNGTGPSCHRNSTDNLCTVVTNNSNSLITERCDNPHASLCILDIDTKRNQMHRRREYLIILTVVSTLILSTTLSVVVWLLVYKRGKKRRRSRKLSIPGASLPSWKVFTKEELRSITKNFSEGNRLVGDAKTGGTYSGVVSDGSKVAVKRLKRSNFQRKKEFYSEIGRVARLRHPNLVAVMGCCYDHGDRYIVYEFVANGPLDKWLHHIPRGGRNLDWAMRMK

SEQ ID NO: 3606 - protein, 169 aa, Glycine max
NLSFNSDTGFSVMIGQDWPHDKAGKSGRLQVNSLFTLRSGRRLYLKQDKTTEKFFFGPSSNVEALAQKFKGKKWRKIVPFKEFPSSLPAAKLASGDIDVRMNLDDPLNRNVDTARNVLQELRTQIPPEIFDLSRLVCGTYVDSRMLVLRGVNGSALLFTRSFVDRNGSS

SEQ ID NO: 3607 - protein, 217 aa, Glycine max
RLEIKWHVSSTTTRNPDPEKLLLLLNISFIYLTFLFLKTYLHPSSSPNIVHASTKIFNHARMLSDISVDGCTDLHKYSDYDSKCLYVKSNVHCRSKGYINYLQIFYCSFGHSPILGHSLLVMWLVVLFYLLADTASNYFCNNLEGLSDILRLSPTIAGVTLLSLGNGAPDFFASVVSFTRSNDGAVGLNSILGGAFFVSSAVLGVISFLVRANEIAI

SEQ ID NO: 3608 - protein, 419 aa, Glycine max
MEMKKPCCEESETIVGSWECWFDDACIVDMDYFVKTLSSIKQKGVRADLIGSIITHYASIWLPDLSSSAENGVTTHFQSPESVTNSWMKKRFFVETLVSVLPPEKDSVPCNFLLRLLRTANMVRVDATYRGELENRISWQLDQASLKELMIPSFSHTCGTLLDVELVLRLVKRFMSLDRDGAALVKVAKLVDCYLAEAAVDANLTLSEFIALAGALPSHSRATDDGLYRAIDTYLKAHPDVSKQERKGLCRLLDSRKLTTEASLHAAQNERLPVRAVIQVLFSEQTKLNRHIDWSGSFSSLRSPNGGLDPPGRCLSKRETNAQQMEIRKLKEDVYRLQSQFNAMQGQMERMAAKKKGLFKWRKFGMPTFSRNVGEVEKIEEEEEEEEAEREVGFGRQTPMDMKTSLVKRTPHKWRKSMS

SEQ ID NO: 3609 - protein, 556 aa, Glycine max
MASHNYKVFSCFNRKFTVTEPGPPPDVERAFSEFAAGASSLSGDHILRFLAEHQGDVDCTAADSERMLQQSRKEDRESGMDLHDFFRFLLHDDFNSPIKSQVHHDMTAPLSHYFIYTGHNSYLTGNQLSSDCSDVPIIKALQRGVRVIELDLWPNSDKDDIEVVHGRTLTTPVSLIQCLKSIKEYAFVKSHYPLIITLEDHLTPYLQAKAAEMATQVFGELLYYPQTDSLMEFPSPESLKGRILISTKPPKEFLESKECDDKDNEKESADEVLSLPDQTSERETDDKSAPEYKRLITIHAGKPKGDIQDELKAAGAVRRLSLSEQALEKASESYGADIVRFTQNNILRVYPKGTRLNSSNYKPHIGWTYGAQMVAFNMQGYGKSLRYMQGMFRANGGCGYVKKPEFLIEKGPYNEVFDPKRTLPVKKTLKVKVYMGTGWSLDFSQTDFDTYSPPDFYVKVCIVGVPADMAKKKTCVISNNWFPVWDEQFDFPLTVPELALLRIEVRENDKSQKDDFGGQTCLPVSELKSGFRSVPLYDEKGDKLKSVKLLMRFQFR

SEQ ID NO: 3610 - protein, 90 aa, Glycine max
KSVLSVPANRGFVLDVTGRVTFETVRSFVAFLVWRISDGFKRSVSKVHEEVMGKGLEVVRYVGAKSSVILTLCLALYLHIMGGSRILLPA

SEQ ID NO: 3611 - protein, 148 aa, Glycine max
MLGLSSRFSRRNKKYLLLIALFGASGYGAYRAYNSPYVAQKRCRIAKLLRAFVSVAELISNSADTVTVISNDLNRFLASESDEIPNSLKQLAKIAKSNEFSMSLARVSEAVTLGILLGYKSQPGNDKKDTKITAEASGFSDRVLERFF

SEQ ID NO: 3612 - protein, 463 aa, Glycine max
MGAVYFSQSCYKPRQIFNLERESTLVGRCPVVQIRCRRVVSACLNVDVDAPNTGNTTSEKKKTKDVIEMEGMYLVGTYARTPVVLERGEGCKLYDVEGNEYLDLSAGIAVNALGHGDADWLKAVVEQAGTLTHTSNIFHTIPQVELAKRLVASSFADRVFFANSGTEANEAAIKFARKYQRHTTSNGKVPATEFIAFSNCFHGRTLGALALTSKVQYRMPFEPVMPGVTFLEYGNAQAAVELIKQGKIAAVFVEPIQGEGGIYSATKEFLQSLHSACDEAGALLVFDEVQCGLGRSGFLWAHEAFGVFPDMMTLAKPLAGGLPIGAVLVTERVASSINYGDHGSTFAGNPLVCSAALAVFDKISKPDFLSSVSKKGLYFKELLKQKLGGNQHVKEIRGVGLIIGIDLDVPASPFVDACRNSGLLVLTAGKGNVVRLVPPLIITEKELELAADILCKTLPVLDN

SEQ ID NO: 3613 - protein, 463 aa, Glycine max
MPSKRLQWRSLVLGCFKATKNQSLESPNIVSKKSSSSRIFLSDLSLSDYSSVSIMSDLSNSLVGSNLRIFTYQELSEVTHNFSKSNYLGEGGFGKVFKGFIDDNLKPGLKAQTVAVKALNLDGKQGHREWLAEVVFLGQLKHRHLVNLIGYCCEDEHRLLVYEYMERGNLEEKLFKGYLAALPWLTRFKIAIGAAKGLMFLHEEEKPVIYRDIKASNILLDADYNPKLSDFGLAIDGPEKDQTHITTHVMGTHGYAAPEYIMTGHLTTMSDVYSFGVVLLELLTGKKSVDKKRPTREQDLVEWARPLLKDSHKLERIMDTRLEDQYSTEGARKFAALAYQCLSHHAKARPTMRTVVRTLEPLLELKDIPVGPFVYVVPSEEESTKVNEKVPENEHVEINQGEFKTKEKEEEEKGAKKEKGPPRQRKSRPNKRRVKPLRSLTAYSDTALYKTLGTNLYSPKHSQ

SEQ ID NO: 3614 - protein, 475 aa, Glycine max
  misc_feature (126)..(126): Xaa can be any naturally occurring amino acid
  misc_feature (326)..(326): Xaa can be any naturally occurring amino acid
VAAGWPSWLSKVAGEAINGLTPRRADTFEKIDKIGQGTYSNVYKARDTLTGKIVALKKVRFDKFGSRFMAREILILRHLDHPNVVKLEGLVTSRMSCSLYLVFEYMVHDLAGLATSPAIKFTESQXKCYMHQLLSGLEHCHNRHVLHRDIKGSNLLIDNDGILKIGDFGLASFFDPNHKHPMTSRVVTLWYRPPELLLGATDYGVGVDLWSAGCILAELLAGKPIMPGRTEVEQLHKIFKLCGSPSDEYWKKSKLPHATIFKPRLSYKRCIAETFKDFPPSSLPLMETLLAIDPAERLTATAALHSEFFTSKPYACEPSSLPKYPXPSKEMDAKLRDEEARRLRAAGKANAAGVKKSRPRDRGGRGISVPDSNAELQANIDRWRLVTHANAKSKSEKFPPPHEDGTLGYPLGSSHHMDPIFDPPDVPFSATSWAYPKANFQTWSGPLVEPSVDAPRRKKNMAGNGHRQSKKDSYR

SEQ ID NO: 3615 - protein, 171 aa, Glycine max
MAQPASLTRIGLAGLAVMGQNLALNIAEKGFPISVYNRTASKVDETVERAKQEGNLPVYGYHNPKFFVQSIQKPRVIIMLVKAGAPVDQTIKTLSAHLEKGDCIIDGGNEWYENTERREKAMSELGLLYLGMGVSGGEEGARHGPSLMPGGSFEAYKYIEDILLKVAAQVP

SEQ ID NO: 3616 - protein, 531 aa, Glycine max
MPGTNDGSPRKWADAWGLVQLRRPPPPGCHNFCVGLVVHWKLTMAQPASLTRIGLAGLAVMGQNLALNIAEKGFPISVYNRTASKVDETVERAKQEGNLPVYGYHNPKFFVQSIQKPRVIIMLVKAGAPVDQTIKTLSAHLEKGDCIIDGGNEWYENTERREKAMSELGLLYLGMGVSGGEEGARHGPSLMPGGSFEAYKYIEDILLKVAAQVPDSGPCVTYIGKGGSGNFVKMIHNGIEYGDMQLIAEAYDVLKSVGKLSNEELQSAFSEWNKGELLSFLIEITADIFGIKDDKGEGHLVDKVLDKTGMKGTGKWTVQQAAELSIAAPTIEASLDARFLSGLKEERVEASKVFKSSGFDEILSDQHVDKKQLIDDVRKALYAAKICSYAQGMNLIRAKSIEKGWDLKLGELARIWKGGCIIRAIFLDRIKKAYDRNPNLANLLVDPEFAKEIVDRQSAWRRVVCLAINYGTSTPGMAASLAYFDTYRRERVPANLVQAQRDYFGAHTYERIDMEGSFHTEWFKLAKQSRT

SEQ ID NO: 3617 - protein, 346 aa, Glycine max
  misc_feature (11)..(11): Xaa can be any naturally occurring amino acid
MNWVRGEPLGXGSFATVNIAIPTNTSTQFLSSTAVKSSYVHTSSMLKNEKEILDCLGASPYVINCFGDDHTVENGEEYYNIFLEYAAGGSLADQVKKHGGRLPESYVRRCTRSLVEGLKHIHDNGYVHCDVKLQNILVFQNGDVKIADFGLAKEKGEKQGKLECRGTPLFMSPESVNDNEYESPADIWALGCAVVEMLTGKPAWDVRGSNIWSLLIRIGAGEELPKIPEELSEEGKDFLLKCFVKDPMKRWSAEMLLNHPFVNGETVSFQKVNEPLPLPSPSPRTHFDLTHWASTVTALLPSSPDSDEWRMWESGSSCSPENRLRRLVTVQTPANWSESDGWTSVR

SEQ ID NO: 3618 - protein, 692 aa, Glycine max
  misc_feature (139)..(139): Xaa can be any naturally occurring amino acid
  misc_feature (161)..(161): Xaa can be any naturally occurring amino acid
MVVSGGKGLKRAAKKRVTADFYDFLTFPTPALAESENFAGGPFRSNVRAFLTKHALLPPPSALFPHLLTWQIVFRVGELTEGPDAPVVCLDVVEEDVARSRSVYCDQCRVFGELTRQYFSRFSFLHESLWFYRFFQLSXGSRFPIMNLLENMQNEKKESIXPTTHLLHGVVHTNGYGHLEPNRLEEGGSRFLSGIHIMDFWDRLCKTLGVRKVSVMDVSKKYGIEYRLLHAIMKGHPWYGDWGYKFGSGSYCLTHESYKSAVESLSNLPLSTFSQGKMPDSRVQDMIKYYQSLSEHELVNIRDLFCFIMGLIGDAHKTASNVDETTCKKRCFNASGLSMSWDKSGIERVEQAMIRVLRAVSESKWVSWRALRGAASKLGSPELLDYCLGELGGKMVYGGMVVNSQCNPQTGVGEFRLEAATGACYGILAKNNSLGSKYPSEENLLQCLRYLYDSLLHPQMMVNYEAGTRTLAMNSAQKLFDCKQFVKDYNPEMWPLSDSQMFRLSCHVELVDEFEDSEAITPPELVVLPLNATVAELKNQAANAFQDVYLRFRRLQVDGLHGYSGVDDSTQVKLLLGSRDVVCVRGRCIGKNGLSKFRMERGLERWTVDCSCGAKDDDGERMLACDICGVWRHTRCSDIHDTDPVPARFVCLKCQNCESKLKCSGHCKDETVTNVSGSSCFRNGLPVPSDVI

SEQ ID NO: 3619 - protein, 696 aa, Glycine max
  misc_feature (214)..(214): Xaa can be any naturally occurring amino acid
MAMIPLMMMILLLLFKFPSVVLATLKSDEANLELVFTYHKCNEELGNFTTETYSNNRNVLLSNMYSDKEIENGFYNSSYGEGPDKVYGIGFCRGDVKPDKCRSCLEKSSTLLTDRCPVQKEAIGWYDLCMLRYSNRSIVEQPVTDTDDIIKCSNTNATNKDRFDKELDDLVVRMRSRSAEGDSRLKFAEGEAPVQSSNETIHALLQCVPYLSHXNCTRCLEYAMSRISYWCDGKTGGWYLGRSCSLRYETYLFFELIFHDAPAPQPSQPAVTPTKDFPKKTNPSRNIIVIVVPVFAVAIVVVGLIVLIYNYFGARRPRHKPIQSEGDGEGDGEGEGELDNDIKTDELAQFEFATIKFATNNFSDANKLGQGGFGIVYKGTLSDGQEIAIKRLSINSNQGETEFKTEISLTGKLQHRNLVRLLGFCFAKRERLLIYEFVPNKSLDFFIFDPNKRGNLNWERRYNIIRGIARGLLYLHEDSRLQVVHRDLKISNILLDEELNPKISDFGMARLFEINQTEANTNTVVGTFGYMAPEYIKHGKFSVKSDVFSFGVMMLEIVCGQRNSKIRGNEENAEDLLSFAWKNWRGGTVSNIVDTTLKDYSWDEIKRCIHIGLLCVQEDINGRPTMNSVSIMLNSSSFSLAEPSEPAFLMRGKSQLPMIMLSGSEQYSEATKSSDSGSQFAQGSSNKAPITEPYPR

SEQ ID NO: 3620 - protein, 426 aa, Glycine max
MEFDAAIPVSREHLPQDAMWQINLRSSETMESGPYPEHPGEPDCSYYIRTGLCRFGATCRFNHPPNRKLAIAAARMKGEFPERIGQPECQYYLKTGTCKFGATCRFHHPRDKAGIAGRVAMNILGYPLRPNEPECAYYLRTGQCKFGNTCKFHHPQPNNMVLSMRSSPVYPTVHSPTTPGHQSYATGITNWSSSSYIPSPRWQGPSSYAPLILPQGMVSVPGWSAYSGQMGSDSPQQTMGNGQSYGTSRQSEPANSGSQGAYSQFRSGSVPVGFYALQRENIFPERPDQPECQFYMKTGDCKFGAVCRFHHPHERMIPAPDCVLSPIGLPLRPGEPLCVFYSRYGICKFGPSCKFDHPMGVFTYNMSASPLADAPGRRMLGSSSGTSALNLSSEGLVESGSANPRRLSLSETRQIPSGDDNIDEEG

SEQ ID NO: 3621 - protein, 168 aa, Glycine max
MLVYQDLLTGDELLFDFFRYKEIENGMLWEVEGKWVVKGAVDVHIGANPSAEGGGEDEGVDDAAGKVVDICCTFILHERPAFDKKQFVTFMKRVIKNLTPKLDAEQQELVKKHIEGATRYLLSNIKDFQFFAGESMGDDACLVFAYYKDGAADPAFLYFAYALKEVQC

SEQ ID NO: 3622 - protein, 491 aa, Glycine max
  misc_feature (183)..(183): Xaa can be any naturally occurring amino acid
GIGVDEGQCDGCIKSGGRCGHNVSKDAFTCLCANQQSYDEVCSKSQTSSPLAAPTPKPTPEQELSPPFGPKFQVTLLTVADPRKLRLIIGVVSGVVGALGMGIIGFLCYRRKKNRYAISYIQSRSLSSDPSSKDTEKGVQSFTQSFVPGVPLFLYDELEEATNYFDSSKELGEGGFGTVYFVXGKLRDGRSVAVKRLYENNFKRVAQFMNEIKILAKLVHPNLVKLYGCTSRHSRELLLVYEYIPNGTVADHLHGQRSKPGKLPWHIRMKIAVETASALNFLHHKDVIHRDVKTNNILLDSDFCVKVADFGLSRLFPDHVTHVSTAPQGTPGYVDPEYHQCYQLTKQSDVYSFGVVLVELISSLPAVDITRHRHEINLSNMAINKIHNQALHELVDPTLGFESDFKVRKMINAVAELAFQCLQSSKEMRPSMEEVVETLKDIQSDGKHKSQPEVMDITSTADDVVLLKDDPPPPSPDSNAVSKSTTPNASG

SEQ ID NO: 3623 - protein, 569 aa, Glycine max
VRNSPSTHASGLFAPVVLTWLLCISAIGVYNIFHWNPHVYEALSPYYMFKFLKKTQKGGWMSLGGILLCITGSEAMYADLGHFSQLSIKIAFTFLVYPSLILAYMGQAAYLSRHHSLESDYRIGFYVSVPVKLRWPVLAIAILQAVVGSQAVITGTFSIIKQCSAMGCFPKVKIIHTSSKMHGQIYIPEINWSLMLLCLAITVGFRDTKRMGNAAGLAVITVMLVTTCLMSLVIVLCWHKNILLAVCFILFFGSIEALYFSASLIKFLEGAWVPIALSLIFLISMYVWHYGTLKKYEFDVQNKVPINWLLSLGPSLGIVRVKGIGLIHTELVSGIPAIFSHFVTNLPAFHQVVIFLCIKSVQVPHVRPEERFLVGRVGPKEYRLYRCIARYGYRDIHKDDIEFERDLICSIAEFIRSDASEYGLGFGSFEEDTKMTVVGTSASNLEGSIRMTEDDDQQDSQMEEGPSELMEVKSSPEKVRKRVRFVVPDSPQIDLDAREELLELMDAKEAGMAFILSHSYVRAKSGSSWLKKVVINYGYDFLRRNSRGPAYALSIPHASTLEVGMIYHV

SEQ ID NO: 3624 - protein, 173 aa, Glycine max
MEGLPQGYRPNVGVCLINSDDQIFVASRLNVPGAWQMPQGGIEDGEEPKSAAIRELREETGIVSAEIIAEVQKWLTYDFPPAVKSKVNRLWGGEWHGQAQKWFLMRLTKDDSEVNLTNGEAEPEFAEWKWADPEEVIEQAVDYKRPTYEEVIRTFKPYFQGSGISAKCKSTKW

SEQ ID NO: 3625 - protein, 386 aa, Glycine max
MEHKLATTEGQPIRCKAAVCRKAGEPLGIEEIMVAPPMPGEARIRIICSSLCRTDISFRNMQGPPANFPTILGHEAIGVVESVGEDVTEVAKGDVVVPIFLPDCGECIDCKSSKSNLCSKFPFEVSPWMPRYATSRFTDLKGEIIHHFLSVSSFSEYTVVDIAHLIKIDPAIPPNRACLLSCGVSAGIGAAWRAAGVEPGSTVAIFGLGSIGLAVAEGARLCGATKIIGVDVNPEKYEIGKRFGLTDFVHSGECENKSASQVIIEMTGGGADYCFECVGMASLMHEAYASCRKGWGKTIVLGLDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 3626 - protein, 37 aa, Glycine max
MIDDQDLGFFANFLGVFIFVLVIAYHFVMADPKFEGN

SEQ ID NO: 3627 - protein, 321 aa, Glycine max
MAAKKVCVTGAGGFVASWLVKLLLSKGYIVHGTVRDPEPATQKYEHLLKLHGASENLTLFKADLLNYESLRSAISGCTAVFHLACPVPSISVPNPQVEMIEPAVKGTTNVLEASLEAKVQRLVFVSSLAAISNSPNLPKDKVIDESYWSDKDYCKTTQNWYCFSKTEAEEQALDFAKRTGLDVVSICPSLVLGPILQSTTVNASSLALLKLLKGVNSMENKIRWIVDVRDVADAILLAYEKLEAEGRYICHSHTIKTRDMLEKLKSIYPNYKYPAKYTEVDDYISFSSEKLQRLGWKYRSLEETLVDSVESYREAGHLQSE

SEQ ID NO: 3628 - protein, 374 aa, Glycine max
MANRVARMANTNSDTKEESKKMDERETIPLLTSYKMGNFNLSHRIVLAPLTRSRSYNFVPQPHAALYYSQRTTKGGFLIGEATGVSDTAKDGYPNTPGIWTREQVEAWKPIVSTVHEKGGIFFCQLWHAGKVSNYDEFQPHGEAPISSTNKRPRKEIPKLVNEFVIAAKNAMEAGFDGIELHGANGYLLDQFLKDKVNDEDDEYGGTIENRCRFPLQVVKAVADEIGADKVGIRLSPFADCVGDDTNNDDPQALGIHMAESLNQLGILYIHLIEPRTMVTQFHKFDTKYLSLEPIRKAFKGTFIVAGGYDRSEGNLAISSSAADLVAYGRLFLANPDLPTRFQLDAQLNEPDATTFSTHDPVLGYTDYPFLQDI

SEQ ID NO: 3629 - protein, 220 aa, Glycine max
MAMRDLVSGAAACGDSSSSSSNPLASLANALIGSSSKTQERLKEIPTSTPTDPASQFYSTALPANQLPGSEFDKPLLNLNSQASEFLHRFRGSTGLEETWDEIQRDGAAAQMRQLPPGIQQPPLDGTPQRVLSNILHSFLDSSRGGVPFHPAPLPMLGLSEGDKQCIRDRSSIMARHLFVDKSEEFIDAQVNALLCSLDIDSSVRGRGPMPGRFRGPEGY

SEQ ID NO: 3630 - protein, 378 aa, Glycine max
  misc_feature (254)..(254): Xaa can be any naturally occurring amino acid
MAVMAVHQFAQCITCHAWSPDQSMVALCPNNNEVHIYRLVEDKWEKLYVLQKHDQVISGIDWSARSNRIVTASHDRNSYVWNLEGSEWVPTLVILRLNRAALCVQWSPKENKFAVGSGAKTVCICYYEQENNWWVSKLIRKRHDSSVTSVSWHPDNILLATTSTDGKCRVFSTFIKGVDARDSKKGTSPDSKFGEQIVQLDLSSSWTFGVKWSPSGNTLAYVGHNSMIYFVDDVGPSPLAQNVVFRDLPLRDVXVLFVSERKVIGVGFDCNPMVFAADERGIWSFVRYLAERKAVSSGSRYGSQFSEAFGKFYGQSKHGVSNDTVETSRTRGTVHENCINCIMPLGDHGTLLRRFSTSGLDGRIVVWDLENEQDLLEL

SEQ ID NO: 3631 - protein, 119 aa, Glycine max
  misc_feature (52)..(52): Xaa can be any naturally occurring amino acid
  misc_feature (104)..(104): Xaa can be any naturally occurring amino acid
MAVMAVHQFAQCITCHAWSPDQSMVALCPNNNEVHIYRLVEDKWEKLYVLQXENKFAVGSGAKTVCICYYEQENNWWVIKLIMKRHDSSVTSVSWHPDNILLAXTSTNWKCLIFITFIK

SEQ ID NO: 3632 - protein, 274 aa, Glycine max
ECILILVCHPGVPQHHPQPPMSSQPNLFGNAFNSSGSGLIRGGLGAYGEKILGSSSEYVQSNISRYFSDPQYYFQVNDHYVKNKLKVVLFPFLHRGHWTRITEPVGGRLSYKPPIYDINAPDLYIPLMAFGTYVVLAGISLGLRGKFSPEALNWLFIKGLVGWFMQTALLKVTLLSLGSGEAPLLDIIAYAGYTFPGLCLAVSGRIIWSYSYYFLMLWTCLCMAVYLVKTMKRVLFAEVRSYDSSKHHYLLLLIALAQFPLFTWLGNITVNWLI

SEQ ID NO: 3633 - protein, 213 aa, Glycine max
  misc_feature (168)..(168): Xaa can be any naturally occurring amino acid
MVVSGGKGLKRAAKKRVTADFYDFLTFPTPALAESENFAGGPFRSNVRAFLTKHALLPPPSALFPHLLTWQIVFRVGELTEGPDAPVVCLDVVEEDVARSRSVYCDQCRVFGWSGHPVCGKRYHFIIKADGSSIGGYHKPCMCCGDILHLSESKCKSCNHVTTTDDVXDWVYHQLKNTTHLLHGVVHTNGYGHLFRVNGREGGSRFLSGIHIM

SEQ ID NO: 3634 - protein, 165 aa, Glycine max
MVVSGGKGLKRAAKKRVTADFYDFLTFPTPSLAEAENFAGGPFRSNVRAFLTKHALLPPPSALFPHLLTWQIVFRVGELTEGPDAPVVCLDVVEEDVARSRSVYCDQCRVFGELTRQYFSRFFFSMNRFGFIAFFRFLFGSRLLENMQTEKNESIPRNYRVLFAI

SEQ ID NO: 3635 - protein, 204 aa, Glycine max
  misc_feature (159)..(159): Xaa can be any naturally occurring amino acid
MVVSGGKGLKRVYDFLTFPTPSLAEAENFAGGPFRSNVRAFLTKHALLPPPSALFPHLLTWQIVFRVGELTEGPDAPVVCLDVVEEDVARSRSVYCDQCRVFGWSGHPVCGKRYHFIIKADGSSIGGYHKPCMCCGDILHLSESKCKSCNHVTTTDDVXDWVYHQLKNTTHLLHGVVHTNGYGHLFRVNGREGGSRFLSGIHIM

SEQ ID NO: 3636 - protein, 223 aa, Glycine max
MARRLLPLTSLRHLSIAASRRLLSSALPVAPRPYPPLTARFAVVRCLCNRPGDSAYSPLNTGKPTSILSSITERPPTDMAPLFPGCDYHHWLVVIHKPGGEGATKQQMIDCYVQTLAKVLGSEEEAKKKIYNVSCERYFAFGCDIDEETSNKLEGLPGVLFVLPDSYVDPEHKDYGGELFVNGEIVQRPPERQRRVEPQPQRQQDRPRYNDRTRYVRRRENTK

SEQ ID NO: 3637 - protein, 136 aa, Glycine max
FGTRFYCVCSTITTLGYGDQSFSTQAGRIFAVFWILTGTITLAQLFVYIAELNTEIRQKELVKWVLTRKVTNLDLEAADLDEDGTVGAAEFVIYKLKEMGKISQEDISLVMQEFEQLDVDDSGTLSTSDITLAQSY

SEQ ID NO: 3638 - protein, 136 aa, Glycine max
FGTRFYCVCSTITTLGYGDQSFSTQAGRIFAVFWILTGTITLAQLFVYIAELNTEIRQKELVKWVLTRKVTNLDLEAADLDEDGTVGAAEFVIYKLKEMGKISQEDISLVMQEFEQLDVDDSGTLSTSDITLAQSS

SEQ ID NO: 3639 - protein, 649 aa, Glycine max
  misc_feature (213)..(213): Xaa can be any naturally occurring amino acid
  misc_feature (404)..(404): Xaa can be any naturally occurring amino acid
MSSAEKPSSKGQAWFCTTGLPSDIVVEVDDMTFHLHKFPLMSKSRKLHLLITQQEAASNSTVPQQQQQQQETEDEDEIVEEQCHVTFTGFPGGSEAFEMAAKFCYGVKIDLTPSNVAALRCAGEFLEMTEDYSEDNLVSKTEGFLSQHVLKNLKDSVKTLKSCDSLMPMAENLGAAQRCVDSVVSRASSADPALFGWPVSDATSVSKQVLWGXSTATADPALAPGPVSLGFEDLALLRLPLFKRLILAMRSAGLSPEIIETCLMYYAKKYIPGVSRSNRKPLPSSSSSSSSVATEAEQKELLETLVSNLPLEKTSKAATATRFLFGLLRTTNILNASEACRDALEKKIGLQLEEATLDDLLVPSYSYLNETLYDVDCVERILSHFLEGFEARNVAQSTADVLRXSPALMLVGKLIDGYLSEIASDANLKPEKFYNFAISLPDEARLFDDGLYRAVDVYLKAHPWVLEEEREKICGLLDCQKLTLEACTHAAQNERLPLRAVVQVLFFEQLQLRQAIAGTLMAAEAAAEPGRQSAALEREAEDGRGEGLGLEHVQERNGTWRVAVRENQVLRLDMDSMRTRVHQLERECSSMKRVISKFDKFAASGGGWRASLGRKFGCKFKTQVCDSHESTAVDTRKGRHHQQHHPHHD

SEQ ID NO: 3640 - protein, 646 aa, Glycine max
  misc_feature (232)..(232): Xaa can be any naturally occurring amino acid
MSSAEKPSSKGQAWFCTTGLPSDIVVEVDDMTFHLHKFPLMSKSRKLHLLITQQEAASNSTVPQQQQQQQETEDEDEIVEEQCHVTFTGFPGGSEAFEMAAKFCYGVKIDLTPSNVAALRCAGEFLEMTEDYSEDNLVSKTEGFLSQHVLKNLKDSVKTLKSCDSLMPMAENLGITQRCVDSVVSRASSADPALFGWPVSDATSVSKQVLWNGLDGDGRRKVGAGAGESWFXEDLALLRLPLFKRLILAMRSAELSPEIIETCLMYYAKKYIPGVSRSNRKPLPSSSSSSSVATEAEQKEILETLVSNLPLEKSSKAATATRFLFGLLRTTNILNASEACRDALEKKIGLQLEEATLDDLLVPSYSYLNETLYDVDCVARILGHFLEEERNVAAIDGRAPRSPGLMLVGKLIDGYLSEIATDANLKPSKFYDLAISVPDRARLFHDGLYRAVDVYLKAHPWVFEAEREKICGLLDCQKLTLEACTHAAQNERLPLRAVVQVLFFEQLQLRQAIAGTLMAAEAAAEPGRQSAALEREAEDGRGEGLGLEHVQERNGTWRVAVRENQVLRLDMDSMRTRVHQLERECSSMKRVISKFDKFAASGGGWRASLGRKFGCKFKTQVCDSHESTAVDTRKGRHHQQHHPHHD

SEQ ID NO: 3641 - protein, 252 aa, Glycine max
  misc_feature (110)..(110): Xaa can be any naturally occurring amino acid
MSSPDIVSILENSKEFDRVRKEQEDILSEINKLHKKLQATPEVVEKPGDNSLARLKFLYTQAKDLSESEASISNLLINQIDALLPTGPQGQTRRRIGKEGNEQKRKRVKXESDISRLTPNMRSQLEACASLKGEQVAARVTPRNADKDEWFVVKVIHFDKESKEFEVLDEEPGDDEESSGQRQYKLPMANIIPFPKSNDPSSAPDFPPGKHVLAVYPGTTALCIPPVVPQLCRGRPRSKYTLLRLHGMLAQF

SEQ ID NO: 3642 - protein, 528 aa, Glycine max
  misc_feature (74)..(74): Xaa can be any naturally occurring amino acid
KPLPQASHETIRFPLPQNHHHHHHHHHHRSVLGLGFFAHFDRVFMKIMKGGHKTPAKSDASDPVPPPYAARQPXAPAAPSANAVSNHASRISSTPLTLSSGGSIEPVPLFRDAPVAERQNLFLRKLHVCCYVLDFSDTLKNGSRKEIKRQALMDLVDFIQSGSGKISENCQEEMIRMISVNIFRCLPPASHENTGQEPTDPEEEEPSLDPSWPHLQLVYELLLRYVVSSDTDTKIAKRYIDHSFVLKLLDLFDSEDPREREYLKTILHRIYGKFMVHRPFIRKAINNIFFRFIYETERHSGIGELLEILGSIINGFALPMKEEHKLFLARALLPLHKPKPVGVYHQQLSYCIAQFVEKDYKLADTVIRGLLKYWPVTNCQKEVLFLGELEEVLEATQTAEFQRCMVPLFRQVARCLNSSHFQVAERALFLWNNEHIVSLIAQNRTVVLPIIFEALEKNIKSHWNQAVHGLTVNVRKMFIEMDAELFEECQRQYEEREAKAKELEEQRELNWKRLADAAAQNGVDMVTA

SEQ ID NO: 3643 - protein, 374 aa, Glycine max
QTIKCKAAIAWEAGKPLVIEEVEVAPPQAGEVRLKILYTSLCHTDVYFWDAKQTPLFPRIFGHEASVGGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVAVAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEINKAFDLMLKGSIRCIIRMQE

SEQ ID NO: 3644 - protein, 438 aa, Glycine max
GSRRKGKWIRVLQRAISKTLSRGHNSIVAPIKGVVVKEPEWMVAAAAAAAEKHNENLSVNLSSEGSLEDYDSMESQNLQWAQGKAGEDRVHVVVSEEHGWVFVGIYDGFSGPDAPDYLLSNLYTAVHKELKGLLWDDGSAPENSTIKEDMLRDVTTVTADVTVTDEDDACSHCVEQDNNDNNRKSSNKRGRNSRNKFKGAAKKWEENQRRWKCEWDRERLELDRRLKEQLNLSRSGSGGAASSINHSDVLEALSRALKKTEESYLDVADKMVMENPELALMGSCVLVMLMKGEDVYVMNVGDSRAVLAQKAEPDYWLGKIRQDLERINEETMNDLESWDVDTSNLVPSLSAIQLTKDHSTSVEEEIQRIKKEHPDDPFAVVNDRVKGSLKVTRAFGAGFLKQPKWNNALLEMFRIDYVGNSPYISCLRNTVGFGSIWT

SEQ ID NO: 3645 - protein, 373 aa, Glycine max
  misc_feature (264)..(264): Xaa can be any naturally occurring amino acid
  misc_feature (340)..(340): Xaa can be any naturally occurring amino acid
  misc_feature (344)..(344): Xaa can be any naturally occurring amino acid
MKNPRKKKRPKPAQKKVLEENNKGVVVAGNENEEEEKRKRSVLEALVEAFSLSSIREASMAYEIAGGDPDRASEILRKGSSDRFEDSFSCFSYGSSSSGGSSGGGGSSSCSGLELGSKGGRQQKKKVVASTGTVSTVLGKEYVRRNNIRNKGFSSNGVFEMEEAEQFLCSMLGDDSDINLAVVRDVLCQCGYDIETASDVLLDLAASTNDKPNTDRHPNYRVDNIDDERFFADPNDSLIDRRSECTSLSSDGYLSDNPWPFGSXDVEVLNSSKDEYHVFREDSKQQWDSVKSYYTKAATAYTKRERAYAAYLSDQGKEQTRLAQKADTKASHDIFIARNXGIEXMITIDLHGQHVKQSMRMLKLHLLFGSYVP

SEQ ID NO: 3646 - protein, 287 aa, Glycine max
MDASMAYNIAVGDPDRAYEILRKGFSDRCEDSFSCFSYGSSSSSYSSSGLELGSKGGWRQQHQHKKMVASTGTVSTVLGKEYVRRNNNNIRNKGPAPPARPEMEEAEQFLCSMLGDDSDINLAVVRHVLCQCGYDIETASDVLRDLAASTNDKPNTDRHPNYRVDNIDDERFFADPNDSLIDRRSECTSLSSEGYLSDNPWPFGRKYVEVLNSSKADSAISPGCTKSEIPQKVLESLFNIPKSTEHDKDTMNWRNVVKKIQSLGPGFNVSPHVAESQQHTWAYGVAF

SEQ ID NO: 3647 - protein, 478 aa, Glycine max
MGRAFVYVILGGGVAAGYAALEFVKKGVSHGELCIISDEPVAPYERPALSKGFLLPEAAARLPSFHTCVGANEERLTSKWYKEHGIELVLGTGVKSADVKRKTLLTTTGETISYKILIVATGARALKLEEFGVTGSDAGNVCYLRDIADANRLVDVMQSCPEGNAVVIGGGYIRMECAASLVINKINVTMVFPEEHCMARLFTSKIANYYEEYYKSRGVNFIKGTVLSSFDFDSNGKVTAVNLRDGTTLSVDMVVVGIGIRPNTGLFEGQLTLEKGGIKVNGMLQSSNSSVYAIGDVAAFPVKAFGETRRLEHVDSARKSAIHVVSSIMEPNKTGEFDYIPFFYSRVFTLSWQFYGDNVGEVVYYGDMSGSAFGAYWVSKGHLVGAFLEGGTKEEYEAIAKATRLRPVIEDLTELERQGLSFAVTVSQKPVVPPPVEVRASDLLLEKPLYAWHATAGVIIAASIAGFAYFYGKKRRRW

SEQ ID NO: 3648 - protein, 277 aa, Glycine max
MATSIGIMDSAYFVGRNEILSWINNRLQLNLSRIEEAASGAVQCQMMDMTYPGVVPMHKVNFDAKTEYDMIQNYKVLQDVFNKLKIEKHIEVGRLVKGRPLDNLEFLQWLKRYCDSVNGGIMNENYNPVERRIKGGKDRNVKSLKSSKSLQTNTMNHSGSGDSLRSKQLRSSGGADGVNSSAEIQALSKQVSDLKLSVDHLEKERDFYFAKLRDIEILCQASELENDPMSLAIKKILYAADAKGSALDEAQEYLNDVINGGEDEAEAEAEAEVETEA

SEQ ID NO: 3649 - protein, 402 aa, Glycine max
MAIQHHNDQLEHNENVSSVLDALYCDEGKWEEEEEEKEEEEDEGENESEVTTNTATCLFPLLLLEQDLFWEDEELNSIFSKEKVQHEEAYGYNNLNSDDDNNNNNNTSNNNVHLDSCLSQPRREAVEWMLKVNAHYGFSALTATLAVTYLDRFLLSFHFQREKPWMIQLVAVTCISLAAKVEETQVPLLLDLQVQDTKYLFEAKTIQRMELLVLSTLKWKMHPVTPLSFLDHIIRRLGLRTHLHWEFLRRCEHLLLSVLLDSRFVGCLPSVLATATMLHVIDQIQHSGGIEYKTQLLSVLKISKEKVDECYNAILQLSKANKYGHNNINNTSKRKYEQIPSSPSGVIDAAFCSDGSNDSWAVGSSLLYSPPEPLFKKSRTQGQQMNLSPLKRFIIGIVGTSP

SEQ ID NO: 3650 - protein, 104 aa, Glycine max
TSSHVCACTCTSPTITTTSTRSSRTFLSIIGGVVAGILGFTSLKGFVFYFLLMMVTSLGLVAKARFSIHSYFDSSNRVLLDGFLGGLMSFVLFWTFAFDIVHIF

SEQ ID NO: 3651 - protein, 518 aa, Glycine max
  misc_feature (178)..(178): Xaa can be any naturally occurring amino acid
MALLSSVLKQLPHELSSTHYLTVFFCIFLILLQLIRRNKYNLPPSPPKIPIIGNLHQLGTLPHRSFHALSHKYGPLMMLQLGQTPTLVVSSADVAREIIKTHDVVFSNRPQPTAAKIFLYNCKDVGFAPYGEEWRQTKKTCVVELLSLRKVRSFRSIRQEVVSELVEAVREACGVVKXENRPCVNLSEMLIAASNNIVSRCVIGRKCDATVGDSVNCSFGELGRKIMRLFSAFCVGDFFPSLGWVDYLTGLIPEMKATFLAVDAFLDEVIAERESSNRKNDHSFMGILLQLQECGRLDFQLSRDNLKAILVDMIIGGSDTTSTTLEWTFAEFLRNPNTMKKAQEEVRRVVGINSKAVLDENCVNQMNYLKCVVKETLRLHPPLPLLIARETSSSVKLRGYDIPAKTMVFINAWAIQRDPELWDDPEEFIPERFETSQVDLNGQDFQLIPFGIGRRGCPAMSFGLASTEYVLANLLYWFNWNMSESGRILMHNIDMSETNGLTVSKKVPLHLEPEPYKT

SEQ ID NO: 3652 - protein, 128 aa, Glycine max
MGTETSSVDISEPLLLDPHGNEEKEEYLREEVPEWKEQITIRGLVVSAVLGSLFCIITHKLNLTVGIIPSLNVAAGLLGFFFVRTWTGLLTKMGFFTKPFTRQENTVIQTCVVACYGLAFSGGFGSSL

SEQ ID NO: 3653 - protein, 440 aa, Glycine max
  misc_feature (188)..(188): Xaa can be any naturally occurring amino acid
MSVTAGVSDTVIAVRDKLRGKIGQTKVKRYWPGKVPEWADDENEDAAPADIRPSREAALEKAFPRHQEDTAIVRKDDRRLRRLAQSRIDNREEVRADHRRIRQAEIVSTIEEEARRQEWLEFEEEDENALAERRRLIKEKLLQREQEEALPQEEEEEEEEEEEEEESEYETDSDEEYTGVAMVKPVFXVPKSERDTIAERERLEAEELAFEEKRKRRLEERRIETKQIVVEEIRKDEEIQKNLEMEANIADVDTDDEVNEAEEYEAWKVREIGRIKRDREDREAMLKEKEEIEKVRNMTEEERREWERRNPKPAPPPKQKWRFMQKYYHKGAFFQNESDDRAATVGSDGIFARDFSAPTGEDKMDKTILPKVMQVKHFGRSGRTKWTHLVNEDTTDWNNPWTYNDPLRAKYNDKMAAMNAPIVKPKGSKKLKDWESRESG

SEQ ID NO: 3654 - protein, 512 aa, Glycine max
AFTPPLTAYLLQGLHSKSCANKKWCFTCEFESLILKSKDTNSPISPVGILSQLQNIGSQLGNGREEDAHEFLRLAVETMQSVCLMESGDNMSDSLKEETNLMGLTFGGYLQSKIKCMKCGGKSERQERMMDLTVEIEGEIATLEEALRQFTSAETLDGENKYRCVRCKSYEKAKKKMTVLEAPNVLTIALKRFQSGKFGKLNKPIRFPEILDLAPFMSGTSDLPIYRLYGVVVHLDIMNAAFSGHYVCYVKNFQSRWFKVDDSVVTAVELESVLAKGAYMLFYSRCSPRAPRLIRNSIVSSDSKWKLNGKTATMKSRRLSTGAGVNLTSPGGSASLDTLYSKFLHSKRILEEDSSSDNSSLISSNSDEGSCSTDSTADSTSTDDFADYIFGDVGRGAGGMLRNSDSNICPALPSFPHSGYFPSSDIDQHDSVVLPHSTGFQPSPSEEGLLYRNRVVDVKRSGGGVSHFHLDTNIEHRKLDTSSSSISFRETDSVFNDRNSGVSCTKSRYRTD

SEQ ID NO: 3655 - protein, 320 aa, Glycine max
  misc_feature (265)..(265): Xaa can be any naturally occurring amino acid
MESQCAIKKDATELIGNTPMVYLNNIVEGCMARIAAKLESMQPCFSIKDRTAFSMIKDAEDKGLITPGKSVLVEATSGNTGIGMTFIATLKGYKVIVAMPASVSLERKIVLRAFGAEVYLTDPAKGTDAVLMKAEEIVNNTPGSYMLRQIDNPANPKIHYETTGPEIWRDSGGKVDALVAGVGTGGTITGAGRFLKERNPNVKLYGIEPVESAVLSGGPPGDHLIQGIGNGLIPSVLDFNLLDEVIQISSEEAIETAKLLALKEXGISSGAAAAAAIKLGKRPENAGKLIVVVFPSYGERYLSSPLFESIRHEAEQMTFD

SEQ ID NO: 3656 - protein, 177 aa, Glycine max
HTQLLAILLVQRKTFGSKKKLYKDYIDHARSMEVEIWHDLAFVYISLSRWHDAEVCLSKSKAIKLYSASRCHAIGTMHEAKGLYKEALKAFRDALNIDPGHVPSLISAAVVLRWCSNRSNPAIRSFLMDALRHDRFNASAWYNLGIFHKDEGTILEAAECFETANSLEESAPVEPFR

SEQ ID NO: 3657 - protein, 105 aa, Glycine max
CRGTMYEAKGLYKEAIKAFRDALSIDPGHVPSLISTAVVLRRCSNQSNPAIRSFLMDALRHDRFNASAWYNLGIFNKDEGTILEAADCFETANFLEESAPVEPFR

SEQ ID NO: 3658 - protein, 577 aa, Glycine max
MAQVVASRSIQSTPLCPTSGSARDRTQNLLKPPSFASKVFPLGENNNKRSKLRLRSLQISARKSAPSEVIPMSPEDDPKIEEHLQHLRGVQPFGENSVGMWSKPTFRRKTKIVCTIGPSTNTREMIWKLAEAGMNVARLNMSHGDHASHQKVIDLVKEYNASHEDNVIAIMLDTKGPEVRSGDLPQPITLMPGQEFTFTIQRGVGTADCVSVNYDDFVNDVEMGDMLLVDGGMMSMVVKSKTEDSVKCEVVDGGELKSRRHLNVRGKSATLPSITGKDWDDIKFGVDNKVDFYAVSFVKDAEVVHELKNYLKSCGADIHVIVKIESADSIPNLHSIITASDGAMVARGDLGAELPIEEVPLLQEEIINLCRSMGKAVIVATNMLESMIVHPTPTRAEVSDIAIAVREGSDGIMLSGETAHGKFPLKAVQVMHTVALRTEATIPGGKMPPNIGQVLKNHMSEMFAYHATMMSNTLGTSTVVFTRTGFMAVLLSHYRPSGTIFAFTDEKRVQQRLALYQGVCPIYMEFCDDSEATFRRALDLLQKQAMVKEGEEVALVQSGRQPIWRFQSTHNIQVRKV

SEQ ID NO: 3659 - protein, 315 aa, Glycine max
  misc_feature (177)..(177): Xaa can be any naturally occurring amino acid
GSSSSRIGSSSTIESSINPEKLVFHIVTDKKTYAPMHAWFATNSIKSVVEVRGLHQYDWSEEVNAGVKEMLETNHLIWKQYYNKEKDLDYTQEHSRYLEALRPSSLSLMNQLRIYLPELFPDLKKIVFLDDDVVVQHDISSLWELDLNGKVIGSVLKSRCGDGCCPGSKCTNYLNYXHAAILLMFNGDQCVWLYGMNIFDLEAWRRTNITETYHQWLKINLKSGMTMWNPGVLPPAFIAFEGHVHPISSSMLVTDLGYRHQSAEISKEKLEAAAVIHFSGPAKPWLEIGFPEVRSLWSRYVNISNKFIRRCRITG

SEQ ID NO: 3660 - protein, 326 aa, Glycine max
  misc_feature (270)..(270): Xaa can be any naturally occurring amino acid
MEPQCRIKKDATELIGNTPMVYLNNIVDGCVARIAAKLEYMQACCSVKDRIALSMIEDAEKKGLITPGKTVLVEYTSGNTGIGLAFIAALRGYKLQVTMPSYVSLERKIILRAFGAEVYLTDPAKGIDGVIQKAEELIAKTPDSFMLNQFENPANPNIHYETTGPEIWRDSGEKIDALVSGIGTGGSIAGAGRFLREKNPDIKLYGVEPAESPVLNGGQPGKHLIQGIGAGIIPKVLDVNLLDEVIQVSSEEAIETAKLLALKEGLLSLXMGISSGAAAAAAIKVGKRPENAGKLIVVIFPSFGERYLSSPLFESIRKEAEQMTFD

SEQ ID NO: 3661 - protein, 514 aa, Glycine max
MALLSSVLKQLPHELSSTHYLTVFFCIFLILMLKLTRRNKSNFPPSPPKIPIIGNLHQLGTLPHRSFQALSRKYGPLMMLQLGQTPTLVVSSADVAREIIKTHDVVFSNRPQPTAAKIFLYNCKDVAFAPYGEEWRQKKKTCKVELMSLKKVRLFRSIREEVVSELVEAIGEACGSERPCVNLTEMLMAASNDIVSRCVLGRKCDDACGGSGSSSFAALGRKIMRLLSAFSVGDFFPSLGWVDYLTGLIPEMKTTFLAVDAFLDEVIAEHESSNKKNDDFLGILLQLQECGRLDFQLDRDNLKAILVDMIIGGSDTTSTTLEWTFAEFLRNPNTMKKAQEEVRRVVGINSKAVLDENCVNQMNYLKCVVKETLRLHPPLPLLIARETSSSVKLRGYDIPAKTMVFINAWAIQRDPELWDDPEEFIPERFETSQVDLNGQDFQLIPFGIGRRGCPAMSFGLASTEYVLANLLYWFNWNMSESGRILMHNIDMSETNGLTVSKKVPLHLEPEPYKT

SEQ ID NO: 3662 - protein, 323 aa, Glycine max
MWWPFSRIGSSGFSSYSTAEEVTHGIDGSGLTAIVTGASSGLGAETARVLALRGVHVIMGVIDMIGAKTIKEAILKEIPIAKVDVMELDLSSMTSIRNFASNFNSSGLSLNILINNAGICAAPFALSKDNIELQFAINYLGHFLLTNMLLDTMKKATSESKKQGRIINVSSIGYRFTYREGIIFDKINDQSSYNNWCAYGQSKLANILHANELARRLKEDGIDITANSVHPGATVSTNIHIHSGLLNGLHKIAWLFGLEKILGYMAKNVQQGASTTCYVALHPQVSGISGKYFEDNNLAEVYSHGRDMNLAKKLWDFSINLTK

SEQ ID NO: 3663 - protein, 509 aa, Glycine max
MIEMIVFLFLVLLISLILSSSSNNSLQLPPSPPSIPLLGHLHHLTPSLYKSLYTLSSKHGPLLLLRLGPSRRLLLLVSSAAVATDVFKTHDLAFSSRPAFAFAERLPFGTSGFVTAPYGPYWRFMKKLCVTELLSTRQLERSRSIRREEILRSIKRVIDNARETVALDLGSEFTKFTNNVTCRTAMSTSCAEKCEDAERIRKLVKESFELAAKLCFGDVLGPFKELSFWVYGKKAIDMSTRYDELLEEVLKEHEHKRLSRANGDQSERDLMDILLDVYHDAHAEFKITMAHIKAFFMDLFIAGTHTSAEATQWAMAELLNHPEAFQKVRKEIELVTGNVRLVDESDITNLPYLQAVVKETLRLYPPAPITTRECRQHCKINSFDVPPKTAVAINLYAIMRDPDSWDNPNEFCPERFLQEQDHEDLSDDGKRMKFNFVPFGGGRRGCPGTALAFSLMNTAVAAMVQCFDWKIGKDGKGEKVDMESGSGMSLSMVHPLICVPVVHFIPYDI

SEQ ID NO: 3664 - protein, 478 aa, Glycine max
MVTEEVVGGDSGDSHHHHRNSDIELIATAERAPLPHSGPLNKRRSSKLSNASSASASASASISAPEEQQDEGDYVEVTMDIQGGSVALHSVKTVNNDQGEDEKLILLGKGMEKKRSFGASVVRSASIRIQQVSQELKRLASLSKQTAPAARVHYDRNKSAASHALKGLKFISIKTTDADAGWVEVERQFDALTASTNGYLHRSLFAKCIGMNKESEAFAGELFDALSRRRGIQGDSINKAQLKDFWDQVSDQSFDSRLRTFFDMVDKDADGRITEEEIKEIICLSATTNKLANIQKQAEEYAALIMEELDPEDTGFIMVNDLEMLLLHGPTHSTRGDSKYLSQMLSLKLKPIDEDNPIKRWYKSTKYFLQDNWQRTWVLLLWIGVMLGLFAYKFVQYRRQPAYEVMGHCVCMAKGAAETLKLNMAIILLPVCRNTITWLRNKTKLGIMVPFDDNLNFHKCIATAITIGVGIHGIYHLA

SEQ ID NO: 3665 - protein, 324 aa, Glycine max
MEEPQCAIKKDATELVGNTPMVFLNNIVVGCVARIAAKLEYMQACCSVKDRIALSMIEDAEKKGLITPGKTVLVEYTSGNTGIGLAFIAALRGYKLQVTMPSYVSLERKIILRAFGAEVYLTDPAKGIDGVIQKAEELLAKTPDSFMLNQFENPANPNIHYETTGPEIWRDSGGKIDALVAGIGTGGSIAGAGRFLREKNPDIKLYGVEPAESAVLNGGQPGKHLIQGIGAGIIPKVLDVNLLDEVIQVSSEEAIETAKLLALKEGLLMGISSGAAAAAAIKVGKRPENAGKLIVVIFPSFGERYLSSPLFESIRKEAEQMTFD

SEQ ID NO: 3666 - protein, 423 aa, Glycine max
LVIEDGEVVHLKDGGVSILKYENDMGEHGASLSRAFSVRRALSVLEMEVEQINKGNYEHYMQKEQKGQPESLTTTMRGGLIHRGSNKSKSVLLGGLKDHLKTIRRSRRILFIGCGTSYNAALAARPILEELSGVPVTMEIASDLLDREGPIYREDTAVFVSQSGETADTLLALQYALDNGALCVGITNTVGSAIARNTHCGVHINAGAEIGVASTKAYTSQIVVMVMLALAIGGDTISNQARREAIIDGLFDLPNKVREVLKLDQEMKDLAKQLIAEQSLLVFGRGYNYATALEGALKVKEVALMHSEGILAGEMKHGPLALVDENLPIAVVATRDACFSKQQSVIQQLNARRGRLIVMCSKGDASSVCPNESCRVIEVPQVEDCLQPVINVVPLQLLAYHLTVLRGHNVDQPRNLAKSVTTQ

SEQ ID NO: 3667 - protein, 351 aa, Glycine max
MAEAESVQIPQVKLGTQGLVVSKLGLGCMTLSGRYNDPLPEEEGISVIKHAFSQGITFFDTSDVYGLDHANEFLLGKALKQLPREKIQVATKFGVAVAKFPNFQIKGTPEYVRSCCEASLKRLDVEYIDLYYQHRIDQTVPIEETVGELKKLVEEGKVKYIGLSEASPDTIRRAHAVHPITALQIEWSLWTRDIEEEIIPLCRELGIGIVPYSPLGRGFFGGKGVLENMPASTVLTLHHPRFQAENINKNKRIYEQIESLAKKYQSTPPQLALAWVLHQGNDVVPIPGTTKIKNLDQNIGALSLKFTESDLREISEAVPIHDVAGSQYFFGNDKDSWKFANTPPKDPRVST

SEQ ID NO: 3668 - protein, 233 aa, Glycine max
LWNDRVSQIDPLSAYWSGSNDISDLETERRERKGWKVTIHDLSGSAVAAAFITTPFVPSSGCDWVARSNPGSWLIVRPDLGRSESWQPWGKLEAWRERGIRDTVCCRFHLLSEAQGGEFLMSEIHISAEKGGEFFIDTEKHMQTVATAASPIPSPQSSGDFGALSPLVGGFVMSCRVQGEGKRSKPLVQLAMRHVTCVEDAAIFMALAASVDLSIVACKPFRRKVRRGFWHSM

SEQ ID NO: 3669 - protein, 479 aa, Glycine max
MASFIFTPVLFLLIISAVLLFLHRRSRCRRFRLPPGTLGLPFVGETLQLISAYKSDNPEPFMDQRVKRYGPIFTTHVFGEPTVFSTDPETNRFILLNEGKLFECSYPGSISNLLGKHSLLLMKGSLHKRMHSLTMSFANSSIIKDHLLVDIDRLIRLNLDSWSDRVLLMEEAKKITFELTVKQLMSFDPGEWTETLRKEYVLVIEGFFSVPLPLFSSTYRRAIKARTKVAEALTLVVRDRRKESVTEEKKNDMLGALLASGYHFSDEEIVDFMLALLVAGYETTSTIMTLAIKFLTETPLALAQLKEEHDQIRAKKSCPEAPLEWTDYKSMAFTQCVVNETLRVANIIGAIFRRAMTDINIKGYTIPKGWRVVASFRAVHLNPDHFKDARTFNPWRWQSNSEASSPGNVYTPFGGGPRLCPGYELARVVLSVFLHRIVTRYSWFPAEEDKLVFFPTTRTQKRYPIIVKRREESKLSKSP

SEQ ID NO: 3670 - protein, 387 aa, Glycine max
MEHKVATTTEGQSIRCKAAICRKAGEPLSIEEIIVAPPMPGEARIRIICSSLCQTDISFRTMQDPPANFPTILGHEAIGVVESVGEDVTEVAKGDMVVPIFIPECGECIDCKSSKSNLCSKFPFKLSPWMPRHATSRFTDLKGEIIHHFLSVSSFSEYTVVDIAHLIKIDPEIPPNRACLLSCGISAGIGAAWRAAGVEPGSTVAIFGLGSIGLAVAEGARLCGATKIIGVDVNPERYEIGKRFGLTDFVHSGECENKSVSQVIIEMTGGGADYCFECVGMASLMHEAYASCRKGWGKTIVLGVDKPGSKLNLSCSEVLVSGKSLRGCLFGGLKPKSHVPILLKRYMDKELNLDEFVTHEMEFKDINKAFDLLIEGQCLRCVIWMDK

SEQ ID NO: 3671 - protein, 538 aa, Glycine max
LSSSEASREERREEVREAKAEEEGRGEVVENENIEKEGGREERRTRARGERRRSSKPNPRLSNPPNHVHGEQVAAGWPSWLSKVAGEAINGLTPRRADTFEKIDKIGQGTYSNVYKARDTLTGKIVALKKVRFDNLEPESVKFMAREILILRRLDHPNVIKLEGLVTSRMSCSLYLVFEYMVHDLAGLATNPAIKFTESQVKCYMHQLFSGLEHCHNRHVLHRDIKGSNLLIDNDGILKIGDFGLASFFDPNHKHPMTSRVVTLWYRPPELLLGATEYSVGVDLWSAGCILAELLAGKPIMPGRTEVEQLHKIFKLCGSPSDEYWKKSKLPHATIFKPQQSYKRCIAETYKDFPPSSLPLMDTLLAINPDERLTATAALHSEFFTTKPYACEPSSLPKYPPSKEMDAKLRDEEARRLRAAGKANADGVKKSRPRERVGRGIAVPEANAELQANIDRRRLITHSNAKSKSEKFPPPHQDGALGYPLGSSHHMDPVFDPPDVPFSSTNFSQPKANIQTWSGPLVDPSGVGVPRRKKKHGK

SEQ ID NO: 3672 - protein, 145 aa, Glycine max
MSELLFDDIFKVEKVDPDGKKYDKVSRIVARSEKCDMNMLLDVNTEIYPMGEKERFLMALSPSLVLNTKDGSVSIQDKFEYIMHGRLYNITKPQLEEKECSKPQLEVEVYASFGGLQLMLKGHASHCVKFAVDQKLFLLIRKVES

SEQ ID NO: 3673 - protein, 160 aa, Glycine max
MSELLFDDIFKVEKVDPDGKKYDKVSRIVARSEKCDMNMLLDVNTEIYPMGEKERFLMALSPSLVLNTKDGSVSIQDKFEYIMHGRLYNITKPQLEKKEKKEKRSESQPEENEECSKPQLEVEVYASFGGLQLMLKGHASHCVKFAVDQKLFLLIRKVES

SEQ ID NO: 3674 - protein, 433 aa, Glycine max
  misc_feature (55)..(55): Xaa can be any naturally occurring amino acid
FFFRFSIFYSMGIGGSALDHICCRSMAPDNPPLKIRFVDNTDPAGVDHQIAQLGXELASTLVIVISKSGGTPETRNGLWEVQKAFREAGLDLPKQGVAITQENSLLDNTARIEGWLARLPMFDWVGGRTSEMSAVGLLPAALQGIDIREMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIGLYERAVGIYASLVNINAYHQPGVEAGKKAAGEVLALQKRVLAVLNEASCKEPVEPLTLEEIADRCHAPEDIEMIYKITAHMAANDRALIAEGSCGSPRSIKVFLGECNIDELYA

SEQ ID NO: 3675 - protein, 163 aa, Glycine max
RADSARGRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQFGSRRTVGALIGLYERAVGIYACLVNINAYHQPGLGNMACGRGMLNCIQMKT

SEQ ID NO: 3676 - protein, 224 aa, Glycine max
MSFESGMVMEEHDSEKVEIVLKTIGPARPSRLLVSSSIKVRDLRRLIAGNDNLQIDNLSLILRGSALYDTKNGDDVYIQLNDGDCLIVAVKPKPPVKDGYDNDDEDEDLKFRLPQSSSWWKKRLYTFLHDNLKLPDILLMVIFTLSLKAWLLIILWFILAPVAHRWDLGPLYILATGFCLILFNLGKRQAGDISAYSIFNEDFRELPGTLNADRLDRDIRAGQF

SEQ ID NO: 3677 - protein, 201 aa, Glycine max
MNPARPSRLLVSSSIKVCDLRRLIARNENLQIYNLSLILRGSALYDTKNGDDVYIQLNDGDCLIVAVKPMPPVKDGYDNDEEDEDLKFRLPQSSSWWKKRLYSFLHDNLKLPDILLMVIFTLSLKAWLLIILWFILAPVAHRWDLGPLYILATGFCLILFNLGKRQAGDISAYSIFNEDFRELPGTLNADRLDRDIRAGQF

SEQ ID NO: 3678 - protein, 467 aa, Glycine max
MAATRPVQCLLRRVCRGSRTIGVATEVNASSSSQKIIDKEYEHSAHNYHPLPIVFAQAKGTSVWDPEGNKYLDFLSGYSAVNQGHCHPKILKALQEQAERLTVSSRAFYNDRFPDFAEYVTNMFGYDMVLPMNTGAEGVETALKLARKWGYEKKRIPKDEAIIVSCCGCFHGRTLGVISLSCDNEATRGFGPLLPGNLKVDFGDAEALEQIFKEKGEHIAAFILEPVQGEAGVIFPPDGYLKAVRDLCSKYNVLMIADEIQTGLARTGKMLACEWEEVRPDVLILGKALGGGVIPVSAVLADKDVMLCIQPGQHGSTFGGNPMASAVAIASLEVIKNERLVERSAQMGEELTGQLLKIQQQYPDYVKEVRGRGLFIGVEFNSKKLFPVSGYELCKKLKYRGVLAKPTHDAIIRFTPPLCISVDEIQQGSKALADVLEIDLPKLQKTKPIDAAPVATSACDRCGRVLY

SEQ ID NO: 3679 - protein, 359 aa, Glycine max
MAAQAEIEHPRKAFGWAARDSSGLLSPFNFCRREPGEKDVAFRVLYCGICHSDLHSIKNEWGTSIYPMVPGHEVAGVVTEVGSKVEKFKVGDKVGVGCLVDSCRTCQNCCDNLENYCPQSTFTYGAKYRDGTITYGGYSDSMVADEHFVVRIPDRLPLDAAAPLLCAGITVYSPLRYYGLDKPGLHVGVVGLGGLGHMAVKFAKAFGAKVTVISTSPNKKEEAIQNLGADSFLISRDQDQMQAAMGTLDGIIDTVSAVHPLLPLIGLLKSHGKLVMVGAPEKPLELPVFPLLAGRKIVAGTLIGGLMETQEMIDFAAKHNVKPDIEVIPMDYVNTAMERLLKADVKYRFVIDIGNTLKF

SEQ ID NO: 3680 - protein, 389 aa, Glycine max
  misc_feature (124)..(124): Xaa can be any naturally occurring amino acid
  misc_feature (160)..(160): Xaa can be any naturally occurring amino acid
HLQCQGVGGDALPSYMRGAVYWEPNKPLTIEEFNMPRPKAGEVLIKTKACGVCHSDLHVMKGEIPFSSPCVVGHEITGEVVEHGALTDSKTIERLPVGSRVVGAFIMPCGNCSYCSKGHDDLCXEAFFAYNRAKGTLYDGETRLFFRNSGKPAFMYSMGXGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFDEAGKAFQDLNEGKIVGRAVIEII

SEQ ID NO: 3681 - protein, 276 aa, Glycine max
LSNDGLIVSGNHFRRIRGVDMKNDFAFVEFSDPRDADDARYSLDGRDVEGSRIIVEFAKGGPRGSRENLGRGLPPGSGRCFNCGIDGHWARDCKAGDWKNKCYRCGERGHIEKNCKNSPQKSSRHGRSLSRSPVRSHSPHRGRSRDRSYSRDRNYSRSRSPVRRERSPVSEDRSQSPEPSKIRKHSTSPDQSSPRKRGDPAPGNDRLATLQDGSDYSDGPRGKSRSPASPARDHDEGNYDSPKASGRSHSPSRSPREDDRSPIDEDDDNNRRSGSP

SEQ ID NO: 3682 - protein, 417 aa, Glycine max
AQSKDNVIAIMLDTKGPEVRSGDLPQPINLTTGQEFTFTIRRGVGTADCVSVNYDDFVNDVDVGDMLLVDGGMMSLVVKSKTEDSVKCEVVDGGELKSRRHLNVRGKSATLPSITEKDWDDIKFGVDNKVDFYAVSFVKDAQVVHELKNYLKSCDADIHVIVKIESADSIPNLHSIITASDGAMVARGDLGAELPIEEVPLLQEEIITICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETFTRALDLLQKQGMVKSGEEVALVQSGTQPIWRFQSTHNIQVRTV

SEQ ID NO: 3683 - protein, 232 aa, Glycine max
  misc_feature (186)..(186): Xaa can be any naturally occurring amino acid
  misc_feature (203)..(203): Xaa can be any naturally occurring amino acid
MSHVVVTRSIHTSLTRPTSGSAHHRAQTLLKPPTFASKVFPQQRNNPSKVCSRSCLVNARKSAPTEVVPVSPEDDSKIEEELQHSRGMRQLGDTSVGMWSKPTFRRKTKVVCTIGPSTNTREMIWKLAEAGMNVARLNMSHGDHASHQKIIDLVKEYNAQSKDNVIAIMLDTKGPEVRSGDLPQPXINLTTGQEFTFTIRRGXGTADCVSVNFDIKFGGDNKVDFYASFGKM

SEQ ID NO: 3684 - protein, 283 aa, Glycine max
MEDPSAATTLLLNSEYSRLFVEDTDLYNRIVLGTLLPHFVWGPLPHFLQTWLRNYLGGVLLYLLSGLLWCFYIYYWKRNVYVPKDAIPSRRAMLLQISVAMKAMPWYTLLPTVSEYLVETGWTKCYPRLYNVGWLAYLVYLAIYLSIVEFGIYWMHRELHDIKPLYKYLHATHHIYNKQNTLSPFAGLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAM

SEQ ID NO: 3685 - protein, 283 aa, Glycine max
  misc_feature (172)..(172): Xaa can be any naturally occurring amino acid
  misc_feature (192)..(192): Xaa can be any naturally occurring amino acid
MGRKRKVAPKSSVSAEPPLKQHQPKPENAAQEYEEEVEEEVEEEEVEEEVEEEEEEEEDEEDEEEEEEDQKDQYQHQQQQQDEDDVPISKLLEPLGKDQLLILLCEAAAKHRDVDERIRKAADEDPVHRKIFVHGLGWDTTAGTLIRSFRQYGEIEDCKAVTDKVSGKSKGXYGFMLFKTRRGARNALLQRXPSSSVSEYTQKKIYVSNVGADLDPQKLLAFFSRFGEIEEGPLGLDKATGKPKGFCLFVYRNPESARRALEEPHKDFEGHILHCQKAIDGPK

SEQ ID NO: 3686 - protein, 232 aa, Glycine max
VFLVLFLFHVGDRHFYTVFPGIFLFSLDKLIRIIQSSPKTCMVSARIFPGRALELILPKDPGMKYNPTSVIFLKIPTISHLQWHSFSIISSSRADDHILSVIIKCEGWWTNSLYDLIHAELDKTADKRKGIPIAIEGPYGPASLDFLRYDTLLLVAGGSGITPFLSILAEADSATNKSRFPSRIQLVYVIKKAQDFCLLHPISHLLLNQSTEKFHLNLKLFVTQETQAEVGN

SEQ ID NO: 3687 - protein, 432 aa, Glycine max
  misc_feature (205)..(205): Xaa can be any naturally occurring amino acid
  misc_feature (263)..(263): Xaa can be any naturally occurring amino acid
MERIVGGKYKLGRKIGSGSFGEIYLATHIDTFEIVAVKIENSKTKHPQLLYEAKLYNILQGGSGIPNIKWSGIDGEDNVLVIDLLGPSLEDLFVYCGRKFSLKTVLMLADQMITRIEYVHSKGFLHRDIKPDNFLMGLGRKANQVYIIDFGLAKRYRDSTTNRHIPYRENKNLTGTARYASCNTHLGIEQSPRHDLESLGYVACXFLRGSLPWQNLKAATKKQKYDKICEKKVSTPIEVLCKSHPVEFASYFHYCHSLTFDQXPVYGFLKRLFRDLFAREGYEFDYVFDWTILKYQQAQKNRVQSRISTVPGTSSSPAMPMDVDNHRGINAYSGDVSAERIKSGNVTGSGVKIQFKSPVGKNLGSEKPLDKNIFGESNIPSTSYSIAGTSRRNTMKPALSTEAPKPGHGQGSNKIGPSSSWISSVQRISSAK

SEQ ID NO: 3688 - protein, 533 aa, Glycine max
MSKQDMMKSQNCLLKVNIHCDGCEQKVKKILQKIDGVYSVNIDAERGKVMVSGHVDPAKLIKKLKRSGKHAELWGGQRGMMYNQNYPTYPQFKNLHIDNTKGGSKDNKSQNHKGGAQKGGGQLAHFQSANGGSKVPPKNQKSVDFNLSEDELDESDFDEFDDDYDEFEDDFDEEDEEEEYGHGHGHGHGQQGHPMQHNKMMAMMAQMGNGRGPHGPGGMMNGPAMNGHKGNGGVKKGEVIDLPIQMKGKGGNFSFSEGKNEIKGNGDGGQKNKGGKQKGGDNNHNNGNKKKNSKGKNGGGFLVRFLGLGKKNKKGGGGGGSADTTTSKNKNNNKGKKDGGKFDKIDFDFQDFDIPPTKGKNGKGGNNGKNNNDKGHGSNNGNVGHHMGPMGQMGPMVQRGPMNQMGPMDHMRNMNINMPAVQGLPAATAAAAMNGGYYQGMQMQMQQPNPYNMQQQQQQQQLMAMMMNQQQQQQQQANMNMYPPHMMYGRPHPHQHQHPSMNYFPPPPMPSHPMADPITHVFSDENTESCSIM

SEQ ID NO: 3689 - protein, 196 aa, Glycine max
MAFSCKLDSFILSAYKPQNSILPLSIQPSSFLPSPSSLKPQKLPFRIRYGSTIRATSSSSTPSATIAEPEGIKIKSIPTKPIDGQKTGTSGLRKKVKVFMQDNYLANWIQALFNSLPPEDYKNGLLVLEGDGRYFNQEAAQIIIKIAAGNGVGKILVGKEGILSKPGGGAKISLSIKNGGLFFFSSHNPPLFWVVL

SEQ ID NO: 3690 - protein, 436 aa, Glycine max
  misc_feature (381)..(381): Xaa can be any naturally occurring amino acid
  misc_feature (421)..(421): Xaa can be any naturally occurring amino acid
NGSIPDALQIFPNSSFEGNSLCGLPLESCSVVSSTPPSSPVSPSTPARHSSKSILSKAAIIAVAVGGGVLLLVVALITVLCCLKKEDNRGSNVIKGKGPSGGRGEKPKEEFGSGVQEPEKNKLVFFEGSSYNFDLEDLLRASAEVLGKGSYGTAYKAILEESMTVVVKRLKEVVVGKKDFEQQMEIMGRVGQHTNVVPLRAYYYSKDEKLLVYDYVPGGNLHTLLHGGRTGGRTPLDWDSRIKISLGTAKGLAHIHSVGGPKFTHGDINSSNVLLNQDNDGCISDFGLSPLMNVPATPSRAASYRAPEVIETRKHTHKSDVYSFGVLLLEMLTGKAPQQSPGRDDMVDLPRWVQSVVREEWTAEVFDVELMRYQNIEEEMXQMLQIAMACVAKVPDMRPSMEEVVRMIEEIRLSDSENRPXSEENRSKEESTAQTP

SEQ ID NO: 3691 - protein, 510 aa, Glycine max
  misc_feature (318)..(318): Xaa can be any naturally occurring amino acid
MAEVRGRDTWTEELASLIEDSGVRYGGDSPPTSFEVHAPQSESGESLKEQALGFVMAWCEILMELGRGFRDILRQNLINEDSYVVRKFGGPCSKVSKRLRFLNDFLPEDRDPFHAWSVVFFVFILALAAISVDPNREAVAPVVKVRQHPPSASRVLLPDGRYMAYHEQGVLADTARFSLVAPHSFLSSRLAGLPGVKASLLEEYGIRLVTYDLPGFGESDPHPNRNLNSSAMDVLHLVNAVNVTDKFWILCHSSGCIHAWASLRYIPEKIAGAAMLAPMINPYDPHMTKEEMKRTWEKWLPRRKMMYSLARRFPKLLXFFYRKSFLPEQHDEIDKLLSVSPGKKDKLVTEEPEFEEFWQRDVEESVRQGNIRPFIEEAVLQVSNWGFDIKELHVQKKCQTRGILLWLKSMYSQAGCELAGFLGLKHIWQGLDDRVVPPSMMEYIERVLPEAVIHKLPNEGHFSYFYLCDQCHRQIFTTLFGTPQGPVERQEETATAFEEEDKEEVLQVPV

SEQ ID NO: 3692 - protein, 278 aa, Glycine max
GAGPMAGDDVIVVHSEERARMLSSGRQRKYEENRLRNKMIQDKPTTSDDSKEVPQWVEMPVIVKADVQGTVQAVTDALKTLNSAQVFVNVVHVGAGPISQSDLDLAQACGACIVGFNVKSPPTALSQEAARAGIKIVLHRVIYHLLEDIGNLIIERAPGTSETHVAGQAEVLNIFEIKGSKSKGPDVKIAGCRVIDGSVTRSATLRLLRSGEVVFEGLCTSLKREKQDVDSVKKGTECGVVINNWCDFQIGDVIQCLEQVIRKPKFIKSESGAVRIEC

SEQ ID NO: 3693 - protein, 669 aa, Glycine max
MVMASWKKLVLLLLIFLCTCKAQEEQSSTPVYLYHNCSGGNTTANSAYQLNLRTLLTSLSSNATTTEFSNNTVGLGTSPSDRVYGLFMCRGDVPSALCQQCVVNATGRLRSQCSLAKQAVIWYDECTVRYSNRSFFSTVDTRPRVGLLNTANISNQDSFMRLLFQTINRTADEAANFSVGLKKYAVNQANISGFQSLYCLAQCTPDLSQENCRSCLSGVIGDLPWCCQGKQGGRVLYPSCNVRYELYPFYRVTASPPSSSPSPPTLLPPPTSPISPGSSGISAGTIVAIVVPITVAVLIFIVGICFLSRRARKKQQGSVKEGKTAYDIPTVDSLQFDFSTIEAATNKFSADNKLGEGGFGEVYKGTLSSGQVVAVKRLSKSSGQGGEEFKNEVVVVAKLQHRNLVRLLGFCLQGEEKILVYEYVPNKSLDYILFDPEKQRELDWGRRYKIIGGIARGIQYLHEDSRLRIIHRDLKASNILLDGDMNPKISDFGMARIFGVDQTQGNTSRIVGTYGYMAPEYAMHGEFSVKSDVYSFGVLLMEILSGKKNSSFYQTDGAEDLLSYAWQLWKDGTPLELMDPILRESYNQNEVIRSIHIGLLCVQEDPADRPTMATIVLMLDSNTVTLPTPTQPAFFVHSGTDPNMPKELPFDQSIPMSVNDMSISEMDPR

SEQ ID NO: 3694 - protein, 657 aa, Glycine max
VYPRVRALIDKQGNGSVRVRGESFERKREKMEYAVAQHPGIGSVPKAMEGEQVAAGWPSWLAAVAGEAIKGWLPRRADSFEKLDKIGQGTYSNVYRARDLEQRKVVALKKVRFDNLEPESVRFMAREIHILRRLDHPNVIKLEGLVTSRMSCSLYLVFEYMEHDLAGLASHPGLKFTEAQVKCYMQQLLRGLDHCHSCGVLHRDIKGSNLLIDNSGILKIADFGLASFFDPNQAQPLTSRVVTLWYRPPELLLGATYYGTAVDLWSTGCILAELYAGKPIMPGRTEVEQLHKIFKLCGSPSEDYWRKSKLPHATIFKPQQPYRRCVSETFKEFPAPAIELIEILLSIDPADRGTSASALNSEFFSTKPLPCDPSSLPKYPPSKEFDAKVRDEEARRQGAAGSKGQRHDLERRGARESRAIPAPDANAELVLSMQKRQGQANSQSKSEKFNPHPEEVASGFPIDPPRPSQAAGLIADPPVHQHKRASHSGPLTHRAAWAKAGKNQEDAPKISMGGDLSTVSGLVAARRSMLSDDRREWSGSSQAEAPKLISRFPGSFKEASESMMQQDQKHHAHAPQKEEGRGSRNKDSNLVGYGSKGHKIHYSGPLLVPSSNHDQMLKDHDRQIQEAVRRARLDKAKMRRLQAEGSQISNSLFVSGR

SEQ ID NO: 3695 - protein, 231 aa, Glycine max
MANPSGNHQEHTHVVSSSAPETSGAALAMKHNPGISLDWTAEEQAILEDGLSKYASESNIVRYAKIALQLQHKTVRDVALRVRWMNKKDESKRRKDDHNLTRKSKDKKERVSDPAVKSSNFVARSNVSPYAPPMIAMDNDDGISYTAIGGPTGDLLEQNAQALNQISTNLSAFQVQENINLFCQTRDTILKIMNELNDSPEVMKQMPPLPVKVNEELASSILPRTNLPPQS

SEQ ID NO: 3696 - protein, 576 aa, Glycine max
MAARYWGQMGLLRCYHCNPFDVACVIVGGFGSYLLGLNRRTYEQAGVGTEGNNPGSTKEPGIGWMTAFLFVTSFVGLLALVPIRKIMIIDYKLTYPSGTATAVLINGFHTPKGDVMAKKQVHGFLKFFSASFLWAFFQWFYSGGDNCGFVQFPTFGLKAWKNSFYFDFSMTYVGAGMICSHLVNLSLLLGAVISWGIMWPLIRGLKGEWFPASIPESSMKSLNGYKVFISIALILGDGLYNFVKVLYFTATNIHATVKRKNPETFSDNQKPLPLDDLRRNEVFARESIPIWLACTGYILFSIVSIIVIPLMFPQLKWYYVVFAYLFAPSLGFCNAYGAGLTDMNMAYNYGKVALFVLSALAGKNDGVVAGLVGCGLIKSIVSISSDLMHDFKTGHLTFTSPRSMLLSQAIGTAIGCVVAPLTFFLFYKAFDVGNPDGDYKAPYAIIYRNMAILGVEGFSALPHHCLQLCYGFFTFAIAANLVRDLGPKKIGKWIPLPMAMAVPFLVGGYFAIDMCMGSLVVFLWHTLNRNEAGLMVPAVASGLICGDGLWILPSSILALLKIRPPICMSFLSASAS

SEQ ID NO: 3697 - protein, 489 aa, Glycine max
MALNLIHRPATKPPSSSSSFVTPRPLRTTQSIPVRNSRRSIAVRAAATEAPVATITAARECRVKSVKARQIVDSRGNPTVEVDLVTDGLFRAAVPSGASTGIYEALELRDGDKSVYGGKGVLNAVRNINEVLAPILVGVDVRNQADVDAIMLEIDGTPNKSKLGANAILGVSLSVCRAGAGAKGVPLYRHIQEISGTKELVMPVPAFNVINGGSHAGNNLAMQEFMILPVGATSFAEALRMGSEVYHVLKGIIKAKYGQDACNVGDEGGFAPNVQDNREGLVLLMDAIDKAGYTGKIKIGMDVAASEFYTKDGKYDLNFKKQPNDGAHVHSAQSLGQLYKDFVKEFPIVSIEDPFDQDDWGSWASLLASVDIQLVGDDLLVTNPKRIAEAIKKKACNGLLLKVNQIGTVTESIQAALDSKAAGWGVMVSHRSGETEDNFIADLSVGLASGQIKTGAPCRSERLAKYNQLLRIEEELGSVRYAGETFRSP

SEQ ID NO: 3698 - protein, 63 aa, Glycine max
MRTVNIFALPLLALFIMAISRLAQAQDLPLSPAPPPTSDGTAIDQGIAYILMLVALGITYMIH

SEQ ID NO: 3699 - protein, 334 aa, Glycine max
  misc_feature (196)..(196): Xaa can be any naturally occurring amino acid
MPTDTSSVSGGEIVCVTGAGGFIASWLVKHLLEKGYTVRGTVRNPDDPKNGHLKELEGGKERLTLHKVDLFDIDSIKEALNGCHGVFHTASPVTDNPEEMVEPAVNGTKNVITAAAEAKVRRVVFTSSIGTVYMDPNTSRDALVDESFWSDLEYCKNTKNWYCYGKTVAEQTAWDVAKERGVDLVVVNPVLVIGPXLLQPTINASTIHILKYLTGSAKTYVNATQAYIHVRDVALAHILVYETPSASGRYICAESSLHRGELVEILAKFFPEYPIPTKCSDEKNPRVKPYIFSNQKLKDLGLEFTPVKQCLYDTVKNLQENGHLPVPPKQKDSY

SEQ ID NO: 3700 - protein, 540 aa, Glycine max
MQVMASRILSTLHYVCSSSASATKRCLGLYSHWQRSISGIAASVVADVEPSIAPVQIDQSQLLIDGKFVDAASGKTFPTFDPRTGDVIANVAEGDAEDVNRAVHAARKAFDEGPWPKMTAYERSRIILRFADLLEKHNDEVAAIETWDSGKTYEQAANVEIPMVVRLFRYYAGWADKIHGLTVPADGPYHVQTLHEPIGVAGQIVPWNFPLLIFSWKVAPALACGNTVVMKTAEQTPLSALYVSKLFLEAGLPPGVLNVISGFGPTAGAALCSHMDVDKLAFTGSTSTGKRVLELSAHSNLKPVTLELGGKSPFIVCKDADVDAAVEASHFALFFNQGQCCCAGSRTFVHESIYGEFVEKAKARALKRVVGDPFKNGVEQGPQIDSVQFEKIMKYIRSGVESGAQLESGGQRIGSKGYYIQPTVFSNVQDNMLIAKDEIFGPVQSILKFKDLEEVIRRANATSYGLAAGVFTKNMDTANTLMRALQAGTVWINCYDVFDAAIPFGGYKMSGQGRVRGIYSLRSYLQVKAVVTALKNPAWL

SEQ ID NO: 3701 - protein, 712 aa, Glycine max
  misc_feature (525)..(525): Xaa can be any naturally occurring amino acid
MRRTMSNASACFFFFAFVVLVALHNAECRSLRPSVSDGVDAVQLPQESSYLQLKDQSVVVESSSDEHFCKQMYGFLPCSNNILGHLFLILVYEYLLFHGESYLAAGGEQIFKILGPGVFGASAFDILGALPESLILGVTGLSSDKESAQEYASTGVGLLAGSSIMLLTVVWGTCVFIGRQKLKNDSNYGGTNSSSGGIKESLTGYGITMDVDTRKMARIMVFSVIPLLIMQIPSIFNFSSIPRNVTLMVALTVAVAFLISYFIYQVFKPQIEKTRLEYIKHDDLILRIFQRVEKQTLQKILTDDGTPNVAAISGLYHEISQRGGKDLLASEVKELLFGTKLNDTNIKEEQIADMLKVFDRNGDQIITKEEFVTGLTEYINQSKHALDRQYLPKESLNKMYQTFIKPWIEHVRKQRELKGHLISEVLKHAQNDMVGRLRQDDGTPDKIAIKRLFEEIDVNQDNHISRSELEKVVKDIQFGKAVETEEAVTKLVQDLDLNRDDEISETEFVEGFTKWMNSNSSQAAXLKIFVSRNFVEPGKMLKRLIEENQTKGTSAWLTAIGYVVLGVTILALLAEPLIASVQKFSEEAGISSFFISFILVPLATNFREATSAIKEASHKKTSNTSQTMYEIYGAVFMNNILGFVVISILIYMREITWEFSADVLVVAIVCAVTGLTASFRPTFPLWTSFPAYLMYLVALLLVFVLKDVLNYV

SEQ ID NO: 3702 - protein, 238 aa, Glycine max
  misc_feature (217)..(217): Xaa can be any naturally occurring amino acid
PFFFCPVPLQFVVLFRAVIRVRATAAPLNAAYTAEEFEFYLSDSESKLLLTSAEGNNSAQAAASKLNILHSTASITQAEDKEAELSLSLSHSESESINSVESLGNDPDDVALFLHTSGTTSRPKGVPLTQHNLFSSVNNIKSVYRLTESDSTVIVLPLFHVHGLIARLLSSLSTGKAEALAAARRFSAWPFRKDMIKYSATWFTAVPTIHQIMLRPXSGQTRSGYPRIQFIKICVELW

SEQ ID NO: 3703 - protein, 212 aa, Glycine max
  misc_feature (30)..(30): Xaa can be any naturally occurring amino acid
  misc_feature (43)..(43): Xaa can be any naturally occurring amino acid
  misc_feature (65)..(65): Xaa can be any naturally occurring amino acid
ESASGIRQGVSIEGVPPTIEAGEIDFGENXTIGPHNFLHSTIXGPIIPCDFIGIVKNQQPVFLKXEVVSNHDELMSNYFAQSVPHAYGKAAEQLQKENVSPHLIPHKTFSGNRPSLSLLLPSLNAYNIGQLLAIYEHRIAVEGFIWGINSFDQWGVELGKSLATQVRKQLNASRTKGEPIQGFNFSTTTMLTRYLQASSDVPADLSTVLPKI

SEQ ID NO: 3704 - protein, 540 aa, Glycine max
MATRRLSLLLSRSLSSTSFQAASLLHSLGRNSGKWGNFNRFSTAAAVEDLITPQVPITYTKHLINGQFVDAASGKTFPTYDPRTGEVIAQVAEGDAEDINRAVSAARKAFDEGPWPKLTAYERCKIILRFADLVEKHGDELAALETWNNGKPYEQSATAELPTFVRLFRYYAGWADKIHGLTVPADGNYHVETLHEPIGVAGQIIPWNFPLLMFAWKVGPALACGNTVILKTAEQTPLTALYVAKLFHEAGLPPGVLNVVSGYGPTAGAALASHMDVDKLAFTGSTETGKVVLGLAAQSNLKPVTLELGGKSPFIVCEDADVDQAVELAHFALFFNQGQCCCAGSRTFVHEHIYDEFLEKAKARALKRVVGDPFKKGVEQGPQIDVEQFQKVLRYIKSGIESKATLECGGDQIGSKGFFVQPTVFSNVQDDMLIAKDEIFGPVQTILKFKDIDEVIRRSNATHYGLAAGVFTKNVHTANTLMRALRVGTVWINCFDVFDAAIPFGGYKMSGIGREKGIYSLNNYLQVKAVVSPVKKPAWL

SEQ ID NO: 3705 - protein, 569 aa, Glycine max
MLGRAAFSRTGSFRPENLGQNAMAMIGNVCFSFFVIGVLVFTIMAATYEPEDPLFHPSTKITTFLTSKSNATFKSDNSVVRTGEDFMAANETAFGSIINSTDVDNLASAEIIDAGDAAAATQCDVSGPIDCKDPEVFHLMMRATIDKFQDIHFYRFGKPAPGSNDSTCDMAWRFRPKEGKAAAFYKDYRRFVIDRSANCSLSVVSIGEYHTGVNARKRKKHQKAGLEKTPLDMYQANTLPVVGEIVNDSLPVVESESSFSHGKYLLYEGGGDRCKSMNHYLWSFLCALGEAQYLNRTLIMDLSICLSSIYTSSKQDEEGKDFRFYFDFEHLKEAASVLDKEQFWADWNQWQQKDGMSLHLVEDFRVTPMKLMDVKDALIMRKFGSVEPDNYWYRVCEGETESVVQRPWHLLWKSRRLMDIVSAISSKLNWDYDSVHVVRGEKARNKELWPNLDAHTSPDALLSTLRDKIDEGRNLYIATNEPDTSFFDPLKDKYTTHFLDEYTELWDENSEWYSETTKLNNGIPVEFDGYMRVSIDTEVFFRGKKQLETFNDLTSDCKDGINTCNVAAN

SEQ ID NO: 3706 - protein, 170 aa, Glycine max
  misc_feature (40)..(40): Xaa can be any naturally occurring amino acid
  misc_feature (80)..(80): Xaa can be any naturally occurring amino acid
MDDAETKGRIEETVRRVLQESDMDEVTESKIRKQASEQLXLDLSQPHFKAFVKQVVKGFSSKEEEQRTATNRQQGWKMMXMKEERTREEFSKGKEYDDEGDLIICRLSDKRRVTIQDFRGKTLVSIREYYKKDGKELPTSKGISLTEEQWSTFKKNVPAIEKAIKKMESS

SEQ ID NO: 3707 - protein, 163 aa, Glycine max
MDDTETKGRIEETVRRILQESDMDEVTESKIRKQASEHLGLDLSQPYFKAFVKQVVKAFLQEEEQRQKQQQQDEDEEEELGGASKGKEYDDEGDLIICRLSDKRRVTIQDFRGKTLVSIREYYKKDGKELPTSKGISLTEEQWSAFKKNVPAIEKAIKKMESS

SEQ ID NO: 3708 - protein, 568 aa, Glycine max
MASSALISDTQQWKDLKAHVEDVKKTHLRDLLSDDKRCQSMLVEFDDILLDYSRQQATPETIQKLFELAEAASLKEKINRMYSGEHINSTENRSVLHVALRASRDAVIQSDGKNVVPEVWKVLDKIQEFSERVRNGSWVGATGKALKDVVAVGIGGSFLGPLFVHTALQTDPEAVESARGRQLRFLANVDPIDVARNITGLNPETTLVVVVSKTFTTAETMLNARTLREWISSALGPSAVAKHMVAVSTNLTLVEKFGIDPKNAFAFWDWVGGRYSVCSAVGILPLSLQYGFSVIEKFLRGASSIDQHFYSQPFESNIPVLLGLLSIWNVTFLGYPARAILPYSQALEKFAPHIQQVSMESNGKGVSIDGVPLPFEAGEIDFGEPGTNGQHSFYQLIHQGRVIPCDFIGVVKSQQPVFLKGEVVSNHDELMSNYFAQSDALAYGKTAEQLQKENVSPHLIPHKTFSGNRPSLSLLLPSLNAYNIGQLLAIYEHRIAVEGFIWGINSFDQWGVELGKSLATQVRKQLNASRTKGEPVQGFNFSTTTMLTRYLQASSDVPADLPTVLPKI

SEQ ID NO: 3709 - protein, 780 aa, Glycine max
  misc_feature (118)..(118): Xaa can be any naturally occurring amino acid
  misc_feature (394)..(394): Xaa can be any naturally occurring amino acid
  misc_feature (406)..(406): Xaa can be any naturally occurring amino acid
MGSTKLNLGFFFTTTLVFLCGTVLQDGVPSALEHSVILVEFLLQFVSMEKNSLDYSPLLSPRGDENGSETTASPLVSATKWTLKTLILMIFVLWAAFIFCLPAKPVNTVFSIWNDLNXFFLFWTAPILIIAFLAIAHLILTGEDQLQGKKTSKLPRFRLWTFPVLVKGPFGVVSATELIGIVLVLLYVIWALYAYTVRALDFISEFDVSSFRDKSIIMFKVMGLRTGAIGLMCLAFLFIPVSRGSVLLRYIDIPFEHATRYHVWLGHLTMVIFTVHGLLYVVAWAMEGHLVQELVQWKDIGVANLPGVISLLAGLLMWVTSLPGVRTWNFELFFYTHQLYVVFIVFLALHVGDFVFTMAAGGIFLFVLDRFLRFCQSRRTVNVISSRCLPCCTXELVLMRKPGMGXYNALSLRYNALSFIFVQVRELSWLQWHPFSVSSSPLDGKNHLAVLIKVLGKWTEKLRQRITDVDAQKDSCVITTSVEGPYGHEVPYHLMYENLILVAGGIGLSPFLAILSDILHRVREGKPCQSRNILLVWAVKKSNELPLLSTIDMESICPSFSNKVNIDIHIYVTRESDPPLEEGYSYKPIKSSFCPMASDCGMSVLVGTGDNFWSGLYVISSTVGFVILLALLYVYYVTPFHIETWWYRGLLYVICMVASVVIFGGSVVAMWHIWEKQNSLKDKSNDTKVDKIHQNGSLATKDQSQVSSIAKSTVIHYGSRPNFKEIYDSISEKWGLVDVGVIVCGPSTLQTSVAEEIRSHSMTRQRHHSIFHFHSHSFDL

SEQ ID NO: 3710 - protein, 427 aa, Glycine max
  misc_feature (176)..(176): Xaa can be any naturally occurring amino acid
MNSERQSTTTTLLHGKYELGRVLGHGSFAKVYHARNLKTGQHVAMKVVGKEKVIKVGMMEQVKREISVMKMVKHPNIVELHEVMASKSKIYISIELVRGGELFNKVSKGRLKEDLARLYLQQLISTIDFYHKPHIYHHNPPPENLLLDERRNLKVSDFGLTAFSEHLKEDGLLHTXTCGTPAYVSPEVIAKKGYDGAKADIWSCGVILYVLLAGFLPFQDDNLVAMYKKIYRGDFKCPPWFSLDARKLVTKLLDPNPNTRTGVGSRMESSWFKKPVPRKLAAEKVDLEEEKIESQLETINAFHIISLSEGFNLSPLFEDKRREEMRFATAGTPSTVISRLEEVAKAGKFDVRSSETKVRLQGQERGRKGKLAIAADIYAVTPSFMVVEVKKDNGDTLEYNQFCSKQLRPALKDIFWNSSQNSAPASA

SEQ ID NO: 3711 - protein, 158 aa, Glycine max
MAEKLAPEKRHSFVHNGQKVFEWDQTLDEVNIYITLPPNVHSKQFYCKIQSKHLELGIKGNPPYLNHDLTSPVKTDSSFWTLEDDIMHITLQKRDKGQTWASPILGQGQLDPYATDLEQKRLMLQRFQEENPGFDFSQAQFSGNCPDPRTFMGGIRSD

SEQ ID NO: 3712 - protein, 72 aa, Glycine max
MHITLQKRDKGQTWASPILGQGQLDPYATDLEQKRLMLQRFQEENPGFDFSQAQFSGNCPDPRTFMGGIRSD

SEQ ID NO: 3713 - protein, 468 aa, Glycine max
  misc_feature (467)..(467): Xaa can be any naturally occurring amino acid
MAWRELGKKRIYMNFTRALTTTPFRYAAGSNFASIFTVQSVCASARCVPDFTNQSSQGVAGCGRETKECEIRCFHASSQVWARSDGPLGLQTPKRVYVKRGGRNQLPVGAPYACRNVPATKSNPDKTIEIFEGMTLVELAKRTGRSVSSLQDILTNVGEKVQSEFELLSMDIAELVTMEAGINVKRLHSAEGAEILPRPAVVTVMGHVDHGKTSLLDALRQTSVAAKEAGGITQHIGAFVVAMPSGASITFLDTPGHAAFSAMRARGAAVTDIVVLVVAADDGVMPQTLEAMSHAKAANVPIVVAINKCDKPGANSEKVKMQLASEGLLLEEMGGDVQVVEVSATEKIGLDNLEEALLLQADMMDLKARIDGPAQAYVVEARLDKGRGPLVTTIVKAGTLVCGQHVVVGSQWGRIRAIKDMAGKLTRRATPAMPVEIEGLRGLAMAGDDVIVVHSEERARMLSSGRXR

SEQ ID NO: 3714 - protein, 669 aa, Glycine max
  misc_feature (206)..(206): Xaa can be any naturally occurring amino acid
  misc_feature (600)..(600): Xaa can be any naturally occurring amino acid
  misc_feature (649)..(649): Xaa can be any naturally occurring amino acid
MPSNSDLVRAVESLLGVSLADSVSDSLLLIATTSAALIIGLLVFLWKKSSDRSKELKPVIVPKGLPKDDDDEVDVADGKTKVTIFFGTQTGTAEGFAKALAEEIKARYDKAAVKVVDLDDYAADDDQYEEKLKKETLAFFMLATYGDGEPTDNAARFYKWFTEGKDERGTWLQHLTYGVFGLGNRQYEHFNKIGKVVDEDLSEQGXAKRLVTFGLGDDDQSIEDDFSAWKETLWPELDQLLRDEDDANTVSTPYTAAILEYRVVIHDPTFTSSYDNHVTVANGNAVFDIHHPCRVNVAVQRELHKPESDRSCIHLEFDISGTGLTYETGDHVGVYADNCDETVEETGKLLGQNLDLLFSLHTDKEDGTSLGGSLLPPFPGPCTLRTALARYADLLNPPRKAALVALASHASEPSEAERLKFLSSPQGKDEYSKWVVGSQRSLLEVMAEFPSAKPPLGVFFAAVAPRLQPRYYSISSSPRFAPQRVHVTCALVYGPTPTGRIHKGVCSTWMKNAIPLEKSPDCSWAPIFIRPSNFKLPVDHSIPIIMVGPGTGLAPFRGFLQERFALKEAGVQQGPAILFFGCRNRRLDFFFEVEQKIFVXNQVLLFKIDSCTLLREGLEKDFVQHKMMDLAALLWNLISQGGFLYVCGXAKGMARDVLRILLPLSSSRC

SEQ ID NO: 3715 - protein, 163 aa, Glycine max
MAFSFTQRFFLSPSLLLLLLLIALSASSLTPTCFSDSVFDSQAAHAGRNLLQAKKSCPVNFEFLNYTVITSKCKGPQYPPKQCCAAFKEFACPYANALNDSTNDCAAIMFSYINLYGKYPFGFFASVCRQGKKGITINCPASAASPPSVSEDDTGMKTHQIRV

SEQ ID NO: 3716 - protein, 348 aa, Glycine max
MRKKKQGFRRPVVIKKPKQPQEQPSVDPITGKKIPKSFVFSRGKLPAPLKQLQMDLRKLMLPYTALSLREKKRNNLRDFLNVAGPMGVTHFFILSKTATSSYLRVATTPQGPTLTFKIHEYSLAADIARSQLHPRCPKDLFKNSALIVLSGFVSGDPPLQLTTNMFQNIFPTIDVKTVKLSTCQRIVLLNYNKDTKLIDFRHYSIRLQPVGVSRRIRKLVQSHQVPDLRNLQDVSDFVTKAGYGSESEADEEAATVTLSSDIGRVNRASTKSAVKLQEVGPRMTLQLVKIEKGLCSGEVLFSEYGKAGGKGKSDDEMQGEEDSDGDEDEEDQDGDHPEDSEDKDQDLD

SEQ ID NO: 3717 - protein, 169 aa, Glycine max
QAIGTAIGCVVAPLTFFLFYKAFDVGNPDGDYKAPYAIIYRNMAILGVEGFSALPHHCLQLCYGFFAFAIAANLVRDLAPKNIGKWIPLPMAMAVPFLVGGYFAIDMCMGSLVVFLWHKLNRNEAGLMVPAVASGLICGDGLWILPSSILALFKIRPPICMSFLSASAS

SEQ ID NO: 3718 - protein, 484 aa, Glycine max
IRLEAGIRNCGQDGINEIKFLIKEAHKRGIEVIMDVVFNHTAEGNENGPIISFRGVDNSMYYMLAPKGEFYNYSGCGNTFNCNHPVVRQFIVDCLRYWVTEMHVDGFRFDLASIMTRSSSLWDGANVFGAPIEGDLLTTGTPLSSPPLIDLISNDPILCGVKLIAEAWDAGGLYQVGTFPHWGIWSEWNGKYRDTVRLFIKGTDGFAGAFAECLCGSPNLYQGGGRKPWHSINFVCAHDGFTLADLVTYNNKNNLSNGEDNNDGENHNNSWNCGQEGEFVSTSVKKLRKRQMRNFFLSLMVSQGVPMIYMGDEYGHTKGGNNNTYCHDNYHNYFQWDKKEESSSDFFRFCRLMTKFRQECESLGLADFPTSERLQWHGHFPGKPDWSETSRFVACTMVDSVKGEIYIAFNMSHLPFTVTLPERPGYKWEPLVDTSKPTPYDFLTPDLPGRDIAIQQYAQFLDANMYPMLSYSSIILLRIPDENL

SEQ ID NO: 3719 - protein, 338 aa, Glycine max
FCCEKTTEGDISGCVSLHGSIAIPRVRVCVTGAGGFVASWLVKLLLSKGYIVHGTVRDPEPATQKYEHLLKLHGASENLTLFKADLLNYESLRSAISGCTAVFHLACPVPSISVEMIEPAVKGTTNVLEASLEAKVQRLVFVSSLAAISNSPNLPKDKVIDESYWSDKDYCKTTQNWYCFSKTEAEEQALDFAKRTGLDVVSICPSLVLGPILQSTTVNASSLALLKLLKGVNSMENKIRWIVDVRDVADAILLAYEKLEAEGRYICHSHTIKTRDMLEKLKSIYPNYKYPAKYTEVDDYISFSSEKLQRLGWKYRSLEETLVDSVESYREAGHLQSE

SEQ ID NO: 3720 - protein, 369 aa, Glycine max
MEEIEGVNCCSESESRSSSETRPPNPNPPSYRQCKLVRHASLMKTKLSDVSAEPGHVTEDCQSDFFPMLRSGACADIGFRSNMEDVYVCADNFMEDYGLKNHIDGPSAFYGVFDGHGGKHAADFACHHLPKFIVDDKDFPRDIERIVASAFLQTDNAFAEACSLDAALASGTTALATLVIGRLLVVANAGDCRAVLCRRGKAIEMSRDHKPGCNKEKKRIEASGGYVYDGYLNGQLNVARALGDWHMEGMKSKDGGPLTAEPELMTTKLTTEDEFLIIGCDGIWDVFRSQNAVDFARRRLQEHNDPAMCSKDLVDEALKRKSGDNLAAVVVCFQQQPPPNLVAPRSRVQRSFSAEGLKELQSFLDSLGN

SEQ ID NO: 3721 - protein, 204 aa, Glycine max
MFVLGVSSSSFAAAAASAAATTTTSTHHLLCGTLHSASFLSTTHPFPTTSLRSSSLHFRCVPIRAMAEIDTISVSKSASSSAPGSKQALISLSDKKGLAFVGNGLQELGYSIVSTGGTASALESAGVAVTKVEQLTKFPEMLDGRVKTLHPNIHGGILARRDQKHHIEALSTHGIGTFDGGVVNLYPFYDEGTSAGGIESEDGI

SEQ ID NO: 3722 - protein, 605 aa, Glycine max
MMFVLGVSSSAAAAPAAATSSTHHLLSGTLHSPSSLSTSHLFPTTSVRSSSLHFRCVPIKAMAEVDTIAVSKTASSSAPGSKQALISLSDKKDLAFVGNGLQELGYTIVSTGGTASALESAGVAVTKVEKLTKFPEMLDGRVKTLHPNIHGGILARRDQKHHIDALSAHGIGTFDVVVVNLYPFYDKVTSAGGVEFEDGIENIDIGGPAMIRAAAKNHKDVLVVVDTEDYPALLEFLKRNQDDQKFRLKLAWKAFQHVASYDSAVSEWLWKQSVGDKFPPSLTVPLSLKSSLRYGENPHQKAAFYIDKSISEVNAGGIATAIQHHGKEMSYNNYLDADAAWNCVCEFRNPTCVVVKHTNPCGVASRDDILEAYRLAVKADPVSAFGGIVAFNVEIDEALAKEIREFRSPTDGETRMFYEIVVAPSYTEKGLEILCGKSKTLRILEAKKNEAGKLSLRQVGGGWLAQDSDDLTPHDIKFNVVSEKAPQDDELRDAEFAWLCVKHVKSNAIVIAKNNCMLGMGSGQPNRVESLRIAMRKAGDDVKGAALVSDAFFPFAWKDAVEEACESGIGVIAEPGGSIRDQDAIDCCNKYGVSLLFTNVRHFRH

SEQ ID NO: 3723 - protein, 159 aa, Glycine max
TAARRRQKGGTQIWPLKTVNSKHHLFERDPIGEGRQDSCSCRVQGSVECVRFHIAKKRAKVKLELGEAFHQWNLHKVGEEIGGSWTEKEEKKFKDVVKSNPASLEKCFWDHLFKTFPKKSREDLVSYYFNVFLLQRRAYQNRHTPDNIDSDDDESECTP

SEQ ID NO: 3724 - protein, 68 aa, Glycine max
NSGSSCTFKIAICFDKKGLFTQLHICLYNARKEEGVSINPTFNVSVIFGKRDEPMLVACARQMIEHMR

SEQ ID NO: 3725 - protein, 337 aa, Glycine max
MATIKPTGKKACVIGGSGFMASLLIKQLLEKGYAVNTTVRDPDNTKKIPHLLALQSLGELNIFGADLTGEKDFDAPIAGCELVFQLATPVNFASEDPENDMIKPAITGVLNVLKACVRAKGVKRVILTSSAAAVTINQLKGTDLVMDESNWTDVEYLSTAKPPTWGYPASKALAEKAAWKFAEENHIDLITVIPTLTTGPSVTTDIPSSVGMAASLITGNDFLINALKGMQLLSGSISITHVEDICRAQIFVAEKESASGRYICCAHNTSVPELAKFLSKRYPQYKIPTEFDDCPSKAKLIISSEKLVKEGFSFKYGIEEIYDQTLEYLKSKGALNN

SEQ ID NO: 3726 - protein, 546 aa, Glycine max
MKNANGLISTTSSNTAQSQSTGLKTYFKTHEGRYKLYYDKTYPSTLLHYAHGKTVSQVTLAHLKDKPVPSTPTGQSSTFSATSGVRSAAARLWGGSNGGRSLSFVGGNGTSKNLGGNSRIGSIGASSSSNATANSNFDGKGTYLIFNVGDAIFISDLNSQDKDPIKSIHFSNSNPVCHAFDQDAKDGHDLLIGLNSGDVYSVSLRQQLQDVGKKPVGAQHYNKDGSVNNSRCTCIAWVPGGDAAFVVAHADGNLYVYEKNKDSAGDSSFAVVKDQTQFSVSHARNSKSNPIARWHICQGSINSISFSTDGTYIATVGRDGYLRVFDYLKEQLICGGKSYYGALLCCAWSMDGKYILTGGEDDLVQVWSMEDRKVVAWGEGHNSWVSGVAFDSYWSSPNSNDNEETVRYRFGSVGQDTQLLLWDLEMDEIVVPLRRPSGGSPTYSAGSQSSQWDSVVPLGTLQPAPSMLDVLKISPLVTHRVHTEPLSGLIFTQESVLTACREGHIKIWIRPAAAESQSSNAETLLSTSLKEKPSILSKVGNSSHRQ

SEQ ID NO: 3727 - protein, 536 aa, Glycine max
  misc_feature (268)..(268): Xaa can be any naturally occurring amino acid
  misc_feature (332)..(332): Xaa can be any naturally occurring amino acid
  misc_feature (342)..(342): Xaa can be any naturally occurring amino acid
  misc_feature (350)..(350): Xaa can be any naturally occurring amino acid
MMNTANGTMISPSSSSGTAAQSPGLKTYFKTPEGRYKLQYEKTHPSGLLHYAHGKTVTQVTLAHLKDKPAPSTPTASSSSSFSASSGVRSAAARLLGGSNGSRALSFVGGNGGSKSNGGNTRISSIGASSTSSAMANPNFDGKGTYLIFNVGDAIFISDLNSQDKDPIKSIHFSNSNPVCHAFDQDAKDGHDLLIGLNSGDVYSVSLRQQLQGGGKKPVGALHYNRDGSVNNSRCTCIAWVPGGDGSFVVSQADGNLYVYEKNKDGAXDSLFSQVGKWIQTSSFFGLPHCTFTSKSNSLYAKIGHILPQGVILNKYNFIIVAGKSYYGALLXCCAWSIGWKXYILTGGEXDLVQVWSMEDRKVVAWGEGHNSWVSGVAFDSYWSSPNSNDNGETIMYRFGSVGQDTQLLLWDLEMDEIVVPLRRPPGGSPTYSTGSQSSHWDNVVPLGTLQPAPSMLDVPKISPLVAHRVHTEPLSGLIFTQESVLTACREGHIKIWMRPGVAESQSSTSENLLATNLKEKPSLSSKISSNSSYKQ

SEQ ID NO: 3728 - protein, 254 aa, Glycine max
MAESISSFWGPVTSTKECCEINYAYSSYIAEFFNTISNIPTILLALIGLINALRQRFEKRFSVLHVSNMTLAIGSMLYHATLQHVQQQSDETPMVWEVLLYMYILYSPDWHYRSTMPIFLFVYGALFAVAHSVFHFGIGFKVHYIILILLCVPRMYKYYIYTQDVSAKRLAKLFLVTFVLGSLFGFCDRVFCKEISRWPINPQGHALWHVFMGFNSYFANTFLMFCRAQQRGWSPKVVHLMGVPYVKIEKPKSQ

SEQ ID NO: 3729 - protein, 653 aa, Glycine max
  misc_feature (333)..(333): Xaa can be any naturally occurring amino acid
MHPPYALYRLGGQTVRDRIAFWWKRKGSRQLYGDHHDVKKKLEKPGLTVVDHIGPGRVPKAIEGEQVAAGWPAWLSSVAGEAIKGWIPRSANTFERFHKIGQGTYSTVYKARDVINQKFVALKKVRFDNLDPESVKFMAREIHVLRRLDHPNIIKLEGLITSRMSRSLYLVFEYMEHDLTGLASNPDIKFSEPQLKCYMQQLLSGLDHCHSHGVLHRDIKGSNLLIDNNGVLKIADFGLASFYDPHHNVPLTSRVVTLWYRPPELLLGASNYGVAVDLWSTGCILGELYSGRPILPGKTEVEQLHRIFKLCGSPSEDYWRKLRTPHSTVFRPXHYRKCVADTFKDYPSTAVKLIETLLSVEPAHRGSAAAALKSEFFTSEPLPCDPSSLPKYAPSKEIDAKLRDEARRQRAVGGREQKVASGVGQEKGHRANVATKDNADPGLLVQQGRYSSSRNQSELSNPHRGTVSGILVFPHKQSEKEMDNNFSGHIYKRPSHSGPLVPGSVWAKGRKEVDDVPPVSNRVNLSKLSGLVASRTLPEDQEVKPVHLHHRKPIEVRKSVESTNGSESRRRQDQKRIVDLNQIESRRVAAEKSTPGGRESMGNKIYLSGPLMVSSSNMDQMLKDHDRKIQEFSRRARIDKSRARGEKVRALRK

SEQ ID NO: 3730 - protein, 376 aa, Glycine max
CKRSQNSILRQKQCRCFVLLKISSSKVLADKGVSDVENGAGHANGNSAVAAVAVGNGGSKAAEGNAKKLVFFGNAARAFDLEDLLRASAEVLGKGTFGTAYKAVLEAGPVVAVKRLKDVTISEKEFREKIEAVGAMDHESLVPLRAYYFSRDEKLLVYDYMSMGSLSALLHGNKGAGRTPLNWEVRSGIALGAARGIEYLHSRGPNVSHGNIKSSNILLTKSYDARVSDFGLAHLVSPSSTPNRVAGYRAPEVTDPRKVSQKVDVYSFGVLLLELLTGKAPTHALLNEEGVDLPRWVQSVVREEWTSEVFDLELLRYQNVEEEMVQLLQLAVDCAAQYPDMRPSMSEVVRRIQELRRSSLKEEDQDQIQHDNDIQL

SEQ ID NO: 3731 - protein, 343 aa, Glycine max
MASERECFDLSGPLHLTYVDWDNAYHRKSVAASLVQGVYVLEKDRQERREGPDALALPWWAFFHFKLFCSLVDDVDSSIFGAIYEFKPPSSMCNDTLHRSPRYVIAFRGTITKADSVSRDIKLGIHFVRNGLHQTSRAEIAIQAVRNMVATVGASNIWLAGHSLGSAMAMLTGKTMAKTGIFIESFLFNPPYVSAPIERIKDKKLKHGLRFAGSVVTAGLAIAMKDKQKKSLSFDPFAALSAWVPSLFVNPSDHICSEYVGYFEHRRKMEEIGAGNIEKLATQTSLNCLLMGVLGKESDEPLHLIPSASLTVNHTPSKDFKEAHGIHQWWKPDLRLESKLYRY

SEQ ID NO: 3732 - protein, 336 aa, Glycine max
MPSAEASSETICVTGAGGFIASWMVKLLLEKGYTVRGTLRNPDDPKNGHLKEFEGASERLTLHKADLLHLDSVRSVINGCHGVFHTASPVTDNPEEMVEPAVSGAKNVIIAAAEAKVRRVVFTSSIGAVYMDPSRSIDLVVDESCWSDLEYCKNTKNWYCYGKAVAEQAAWDTAKENGVDLVVVNPVLVLGPLLQPTINASTIHILKYLTGSAKTYANATQAYVHVRDVALAHILVYEKPSASGRYLCAESSLHRGELVEILAKYFPEYPVPTKCSDEKNPRAKPYTFSNQKLKDLGLEFTPVSQCLYETVKSLQEKGHLPVPAKQQEEDSTTVKS

SEQ ID NO: 3733 - protein, 338 aa, Glycine max
MVSDSIAAVPIPSAANTRNPGKKKRTNRSAKLKQYKIDARREQWLSQGAVKSKGYKDGLDDDGHAPPPSPAEVKHSVEPLNTRRRGEEDDGLIHHDSDSESPTNCPAGVLCGTDSGTNFTGSSSGGSSSSSSSSSSSSGGCCSGNVTEVEEEEEGDDDDDDDDGCLDDWEAMADALAADDKRENPCPDSPPVVSPSEGSNLGSPNSKPESGRLVPWGSGNSRAWRADDAFRPQSLPNLSKQHSMPNPDRRGVPWGRAPTPSSCPICCEDLDLTDTSFMPCLCGFRLCLFCHKRILEEDGRCPGCRKPYECEPVETEASVLGDSLTLRLARSCSMIERS

SEQ ID NO: 3734 - protein, 674 aa, Glycine max
  misc_feature (300)..(300): Xaa can be any naturally occurring amino acid
MKKVCHCPIFLALALCLCILCVAAEAAGQNDTLALTEFRLQTDTHGNLLTNWTGADACSAAWRGVECSPNGRVVGLTLPSLNLRGPIDTLSTLTYLRFLDLHENRLNGTISPLLNCTSLELLYLSRNDFSGEIPAEISSLRLLLRLDISDNNIRGPIPTQLAKLTHLLTLRLQNNALSGHVPDLSASLLNLTVLNVTNNELRGHVPDSMLTKFGNVSFSGNHALCGSTPLPKCSETEPDTETTTITVPAKPSSFPQTSSVTVPDTPRKKGLSAGVIVAIVVAVCVAVLVATSFAVAHCCXRGSTSGSVVGSETAKRKSGSSSGSEKKVYGNGGNLDRDSDGTNTETERSKLVFFDRRNQFELEDLLRASAEMLGKGSLGTVYRAVLDDGCTVAVKRLKDANPCERNEFEQYMDVVGKLKHPNIVRLRAYYYAKEEKLLVYDYLPNGSLHALLHGNRGPGRIPLDWTTRISLMLGAARGLARIHAEYNASKIPHGNVKSSNVLLDKNGVALISDFGLSLLLNPVHAIARLGGYRAPEQVEVKRLSQEADVYGFGVLLLEVLTGRAPSKEYTSPAREAEVDLPKWVKSVVKEEWTSEVFDQELLRYKNIEDELVAMLHVGLACVAAQAEKRPCMLEVVKMIEEIRVEESPLGDDYDEARSRTSLSPSLATTEDNLA

SEQ ID NO: 3735 - protein, 470 aa, Glycine max
  misc_feature (51)..(51): Xaa can be any naturally occurring amino acid
  misc_feature (285)..(285): Xaa can be any naturally occurring amino acid
MAMAIAMVPQPLLTLFLFFSLLSIANSSPSQHLQIANAERRIDLTSHIIKXYLTLKVENLGTSPASEVHIAFSPTEVEHLAIVKAAATSGKRKKKTYVPLDVKSAELPDGPNGTKFFSITLLTPLSKGETTTLEVLYILTHSLEPFPVEISQSESQLVYFRDSAILLSPYHVKQQTTFIKTPSTRVESFTVVDPTKRAGTELKYGPYENHPPYSYSPVLIHFENNNAFAVVEELEREIEISHWGSIQVTEQYSLVHAGARHKGVFSRVEYQTKPGGTGVSSFKHXLLAKLPPRVHSVYYRDGIGNISSSHLRTDSWKSELEIEPRYPLFGGWKSTFVIGYGLPLQDFLFESPDGRRYLNFTFGCPLVETVVDKLIVKVVLPEGSKDPTVEIPFEVKQHLEIKYSYLDVVGRTVVVLEKRNAVPEHNAPFQVYYSFNPIFMLAEPLMLVSAFFLFFVASVAYLHIDLSIRK

SEQ ID NO: 3736 - protein, 463 aa, Glycine max
MGAVYFSQSCYKPRQIFNLERESTLVGRCPVVQIRCRRVVSACLNVDVDAPNTGNTTSEKKKTKDVIEMEGMYLVGTYARTPVVLERGEGCKLYDVEGNEYLDLSAGIAVNALGHGDADWLKAVVEQAGTLTHTSNIFHTIPQVELAKRLVASSFADRVFFANSGTEANEAAIKFARKYQRHTTSNGKVPATEFIAFSNCFHGRTLGALALTSKVQYRMPFEPVMPGVTFLEYGNAQAAVELIKQGKIAAVFVEPIQGEGGIYSATKEFLQSLRNACDETGALLVFDEVQCGLGRSGFLWAHEAYGVFPDMMTLAKPLAGGLPIGALLVTERVASAINYGDHGSTFAGSPLVCSAALAVLDKISKPDFLSSVSKKGLYFKELLREKLGENRHVKEIRGVGLIIGIDLDVPASPLVDACRSSGLLVLTAGKGNVVRLVPPLIITEKELEQAAGILCQTLPVLDN

SEQ ID NO: 3737 - protein, 209 aa, Glycine max
MNGGDEVVAAPAGPPQPLEWKFSQVFGERTAGEEVQEVDIISAIEFDKSGDHLATGDRGGRVVLFERTDTKDHHGSRRDLERMDYSISRHPEFRYKTEFQSHEPEFDYLKSLGIEEKINKIKWCQTANGALFLLSTNDKTIKFWKVQEKKVKKVSDMNVDPKAMGNGSIARSRRSGSPVDHILQMEFIYRWNLIMYLNDDISFPHNWRE

SEQ ID NO: 3738 - protein, 400 aa, Glycine max
MGKRQIPDPPNFKKYGVPFYSVAWIPQHVVKSRQIETADESSDSDHSTSPATEAEKEPATVAGNYLLFAGGGGAGHSGIPNALVIAHFDVASNSLSDQPVCKLGTDSELPYRMALNSNGDGLICAMETPMVCRWFDWDQNKSSEIHKLSLKLSEKVLSQLEDVGQQLALAFNNDGTALAAGGEDGNLRVFKWPSMEIILNETNAHSSLKDLHFSSDGKLLASLGSGGPCKVWDVSSSMVLSSLSNENRETFSSCRFSQTNDETLILYIAAMTDKGGSILTWNTQTWERMASKHIIRDPISAFNVSADGKFLACGTPSGDIVVVNSTNMQIHTMIKKAHLGIVTALAFSPDSRAVASVSMDSSARVTIIEEKKTNGLSLWIALFIILLAVAAYFLRQEIEK

SEQ ID NO: 3739 - protein, 134 aa, Glycine max
MHSGHLLLEEPIRMVSILEPSKPNFFPAMTKIVGTLGPKSRSVEVISACLKAGMSVARFDFSWGDPEYHQETLENLKNAIKTTKKLCAVMLDTVGAEMQVVNKSEKAISLQADGQVVLTPDRGQEASSQILPIN

SEQ ID NO: 3740 - protein, 232 aa, Glycine max
MHSSHLLLEEPIRMVSILEPSKPNFFPAMTKIVGTLGPKSRSVEVISACLKAGMSVARFDFSWDDPEYHQETLENLKNAIKTTKKLCAVMLDTVGAEMQVVNKSEKAISLEADGQVVLTPDRGQEASSQILPINFDGLAKSMKKGDTIFIGQYLFTGSETTSVWLEVSEVKGQDVICTIKNSATLAGSLVTLHASQVHIDLPTLTDKDKEVISTWGVKNKIDFLSLSYTRHA

SEQ ID NO: 3741 - protein, 496 aa, Glycine max
MQKKTLVMPPMGRKRKVAPKSSLSTEPPLKQQQPKPENPPQEYEEVEEEVEEEEVEEEVEEEEEEEEEDEEEEEEEEEEEEENDVVKQQQQQQQDEDDIPISKLLEPLGKDQLLNLLCDAAAKHRDVEERIRKAADGDPVHRKIFVHGLGWDTTAGTLISAFRQYGEIEDCKAVTDKVSGKSKGYGFILFKTRRGAQNALKEPQKKIGNRMTACQLASIGPVSNPPPTPMAPSAAPSSSVSEYTQKKIYVSNVGADLDPQKLLAFFSRFGEIEEGPLGLDKATGKPKGFCLFVYRNPESARRALEEPHKDFEGHILHCQKAIDGPKAGKFQQQQQHGNVNAHAQRAQFQRNSNVGANAAAGYGGGGSAVQPGHLMAPAGPGIGFNPSAAAAAQAALNPAMAQALTALLASQGTLGLTNLLGSIGTSAAVNPGVPAAGSAVQGGGYSAQPNISPGVVGGYGNQVGLQAAYPNQNQQIGQGGSGRGQYGGGAAPYMGH

SEQ ID NO: 3742 - protein, 256 aa, Glycine max
MSSADTFNASSAESVKEPVIGSSLEVKQDDAEIKAQVDAMWEQMNKGVSNKTLNKFTSKPNSTSKKTAKKSSSNWMSYLGLAPTATESLGQGASKNGPGVLQSSTSDEVKKLAAAALAAVKDDAAIAASSRGKLVITEVRDFAGQDIEVKKLVDSDSKEAMERAKAPPLSAVDTVLEQIKKKQKLSVLDKTKKDWGEFKEEKRLEEELDAYKKSSNQYLDKVSFLQRADYREFERERDARLALQSRKRPDNMQEDD

SEQ ID NO: 3743 - protein, 256 aa, Glycine max
MSSADTVNASSAESVKEPVIGSSLEAKQDDTEIKSQVDAMWEQMNKGVSNKTLNRFTSKPNSAPKKTAKKTSSNWMSYLALAPKATESLGQGASKNGPGILQSSTSDEAKKLAAAALAAVKDDAAMAASSRGKLVITEVRDFAGQEIEVKKLVDSDSKEAMERAKAPPPSAVDTVLEQIKKKQKLSVLDKTKKDWGEFKEEKRLEEELDAYKKSSNQYLDKVSFLQRADYREFERERDARLALQSRKRPDNMQEDD

SEQ ID NO: 3744 - protein, 889 aa, Glycine max
  misc_feature (92)..(92): Xaa can be any naturally occurring amino acid
  misc_feature (765)..(765): Xaa can be any naturally occurring amino acid
MEIHENQHESWSETESTGSRSRRVGFSGPLSGPLSGPLSGPLVSSNKRNSSKNKSARFKDDEEMVEITLDVRDDAVSVQNIRGGDSETAFLXASRLEMRPSSFSDRLRQVSRELKRMTSNKAFDRVDRSKSGAARALGGLKFMTKAGTEGWSQVEKRFDELAIDAKLPKTRFSQCIGMNESKEFAGELFDALARRRGITSASITKDQLREFWEQITDQSFDSRLQTFFDMVDKDADGRINEEEVKEIITLSASANKLSKLKDRAEEYAALIMEELDPDNLGYIELYNLEMLLLQAPAQSTHITTDSRVLSQMLSQKLVPTKEYNPIKRGFRALAYFVQDNWKRLWVIALWLSICAGLFTWKFIQYKHRAVFDVMGYCVTVAKGGAETTKFNMALILLPVCRNTITWLRSRTKLGAIIPFDDNINFHKVVAFGIAIGVGLHAISHLTCDFPRLLHATDEEYEPMKQFFGDERPNNYWWFVKGTEGWTGVAMVVLMAIAFILAQPWFRRNRLKLPKTLKKLTGFNAFWYSHHLFVIVYVLFIIHGYFLYLSKKWYKKTTWMYLAVPMILYGCERLLRAFRSGYKSVRILKVAVYPGNVLALHVSKPQGFKYSSGQYIYVNCSDVSPFEWHPFSITSAPGDDYLSVHIRTLGDWTSQLKGVFAKACQPASEGQSGLLRADMLQGNNKPRMPRLLIDGPYGAPAQDYKNYDVILLVGLGIGATPLISILKDVLNNIKQHKDVEEGEVEKDKRKPFATKRAYFYWVTREXGSFEWFKGVMNEVEENDKEGVIELHNYCTSVYEEGDARSALITMLQSLHHAKNGVDIVSGTRVKTHFARPNWRNVFKHAAIKHPDQRVGVFYCGAHGLVGELKKLSLDFSRKTSTKFDFHKENF

SEQ ID NO: 3745 - protein, 202 aa, Glycine max
MEGTVFTPALQEIEHVKSDQGEILSKPFLDACKHILPVIDKFGAAMALVKSDIGGNISRLETMYSSNPSRFNYLYSLVQVEVETKTAKSSSSCTNGLLWLTRAMDFLVALFRNLIEHEDWPMSQACTDSYNKTLKKWHGWLASSSFTVVMKLAPDRKKFMNVIGGTGDINADIEKFCTTFSPLLQEIHKFLARFRLDDMKAS

SEQ ID NO: 3746 - protein, 624 aa, Glycine max
  misc_feature (141)..(141): Xaa can be any naturally occurring amino acid
PASTHASDKSKLLISLRTDIFKGLASLFFDNTKRGKNVFLDWRTSKNNDKDLNEIIPWLEWMLSHTLLRSAENPQQGLDSFWVEQGGALLLSLMQSSQEDVQERAATGLATFVVIDDENASIDCGRAEAVMRDGGIRLLLXLQSWREGLQSEAAKAIANLSVNANVAKAVAEEGGIQILAGLARSMNKLVAEEAAGGLWNLSVGEEHKGAIAEAGGIQALVDLIFKWSSSGDGVLERAAGALANLAADDKCSTEVALAGGVHALVMLARNCKFEGVQEQAARALANLAAHGDSNSNNAAVGQEAGALEALVQLTCSPHEGVRQEAAGALWNLSFDDRNREAIAAAGGVQALVALAQACANASPGLQERAAGALWGLSVSETNSVAIGREGGVAPLIALARSEAEDVHETAAGALWNLAFNASNALRIVEEGGVSALVDLCSSSVSKMARFMSALALAYMFDGRMDEYALVVTSSESISKSVSLDGARRMALKHIEAFVLMFSDLQAFAAAAASSAPAALAQVTEGARIQEAGHLRCSGAEIGRFITMLRNPSSILKACAAFALLQFTIPGGRHAMHHASLMQSLGASRVLRGAAAAATAPLEAKIFARIVLRNLEYHQIEQALA

SEQ ID NO: 3747 - protein, 373 aa, Glycine max
MALESAPASADIRGVHTHGGGYVQYNIYGNLFEVSRKYVPPIRPVGRGAYGIVCAAVNAETHEEVAIKKVGNAFDNRIDAKRTLREIKLLRHMEHENVIALKDIIRPPQRYNFNDVYIVYELMDTDLHQIIQSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFLGKDYVHQLRLITELIGSPDDTSLGFLRSDNARRYVRQLPQYPRQQFAARFPSMSPGAVDLLEKMLVFDPNRRITVEEALCHPYLAPLHDINEEPACVRPFSFDFEQPSFTEEDIKELIWRESVLFNPDPPIY

SEQ ID NO: 3748 - protein, 303 aa, Glycine max
MAATSTSLFSSNLHSLNSQPFSSSLSFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 3749 - protein, 374 aa, Glycine max
MKCFFFKEKCKSAPELHKKKTPAVNRAANSTGSVSSPKSVKDLYREKEHSFRVFTLQELRDATNGFNRMLKLGEGGFGSVYKGSITQPDGQGGDPIPVAIKRLNTRGFQGHKEWLAEVQFLGIVNHPNLVKLLGYCSVDAERGIQRLLVYEFMPNRSLEDHLFNKNLPTLPWKTRLEIMLGAAQGLAYLHEGLEIQRDFKSSNVLLDADFHPKLSDFGLAREGPQGDQTHVSTAVVGTQGYAAPEYIETGHLKVQSDMWSFGVVLYEILTGRRSLERNRPTAEQKLLDWVKQYPADTSRFVIIMDARLRNQYSLPAARKIAKLADSCLKKNPEDRPSMSQIVESLKQALQYSDTTSQDIAESSSSSRSKLVRKK

SEQ ID NO: 3750 - protein, 377 aa, Glycine max
MKCFFFKEKSKSAPELHKKKTPAVNRAANSTGSVSSPKSVKDLYREKEHSFRVFTLQELRDATNGFNRMLKLGEGGFGSVYKGSIAQLDGQGDPIPVAIKRLNTRGFQGHKEWLAEVQFLGIVNHPNLVKLLGYCSVDGERGIQRLLVYEFMPNRSLEDHLFNKKLPTLPWKTRLEIMLGAAQGLAYLHEGLEIQVIYRDFKSSNVLLDADFHPKLSDFGLAREGPQGDQTHVSTAVVGTQGYAAPEYIETGHLKVQSDMWSFGVVLYEILTGRRSLERNRPTAEQKLLDWVKQYPADTSRFVIIMDPRLRNQYSLPAARKIAKLADSCLKKNPEDRPSMSQIVESLNQALQYSDTSLDIAESSSSSSSRSKLVRKK

SEQ ID NO: 3751 - protein, 201 aa, Glycine max
MIERTSQSKKGVSFMAIEAWLMDESNEDPRLPHRRNPNKSVSLDQLAEFGVLYWKLNPTIYENDEELAKIREDRGYNYMDLLDLCPEKVENYEQKLKNFYTEHIHQDEEIRYCLEGSGYFDVRDKDDRWIRILIKAGDLIILPAGIYHRFTLDPSNYVKLMRLFKGEPVWTAYNRPQEDNPARKEYIKGLTEKFGVPLAAH

SEQ ID NO: 3752 - protein, 373 aa, Glycine max
QDTTIIGRASGLACMTVMFITTFLMTLVAIFVWQKSVLIAVVFLLFFWVIEGVYLSAAFIKVPQGGWVPLVLSFIFMIVMYVWHYGTRRKYSYDLHNKVSLKWLLGLGPSLGIVRVPGIGLIYTELATGIPAIFSHFVTNLPAFHKVLVFVCVKSVPVPYVSPEERFLIGRVCPRPYRMYRCIVRYGYKDIQRDDGDFENHLIQSIAEFIQMEAVQPQFSSSEASSSLDGRMAVISSRNYDYASSLIVSEQEDIGVDISIPSSRSATLQSLQSVYDDETPQVRRRRVRFQLPENTGMDPDVREELLDLIQAKEAGVAYIMGHSYVKARKSSSFLKKLVIDIGYSFLRKNCRGPAVALNIPHISLIEVGMIYYV

SEQ ID NO: 3753 - protein, 579 aa, Glycine max
SQKLVPTKDHNPIKRGFRSLAYFVEDNWKRIWVILLWLSICAALFTWKFIQYKHRAVFDVMGYCVTSAKGAAETLKFNMALILLPVCRNTITWLRSKTKLGMAVPFDDNINFHKVIAFGIAIGVGIHAIAHLTCDFPRLLHATDEEYEPMKPFFGEDRPNNYWWFVKGTEGWTGIAIVVLMAIAYTLAQPWFRRNRLKLPKPLKRLTGFNAFWYSHHLFVIVYGLFIVHGYYLYLSKKWYKKTTWMYLAIPMILYACERLLRAFRSGYKSVKILKVAVYPGNVLALHMSKPQGFKYSSGQYIFVNCPDVSPFQWHPFSITSAPGDDYVSVHIRTLGDWTSQLKAVFAKACQPASGDQSGLLRADMLQGNNIPRMPKLVIDGPYGAPAQDYKNYEVILLVGLGIGATPLISILKDVLNNMKQQKDIEEGMVESGVKNKRKPFATNRAYFYWVTREQGSFEWFKGVMDDVAEYDKDGIIELHNYCTSVYEEGDARSALITMLQSLHHAKSGVDIVSGTRVKTHFARPNWRSVFKHTALKHPGKRVGVFYCGAHTLVGELKRLSLDFSRKTNTKFDFHKENF

SEQ ID NO: 3754 - protein, 319 aa, Glycine max
MPEFCVTGGTGFIASYLVKALLEKGHTVRTTVRNPGDVEKVGFLTELSGAKERLKILKADLLVEGSFDEAVRGVDGVFHMASPVLIPYDENVQQNLIDPCIKGTLNVLNSCVKATVKHFVLTSSCSSIRYRDDVQEVCPLNESHWTDLEYCKRYKLWYAYAKTIAEREAWRIAKENGMDLVVVNPSFVVGPLLAPQPTSTLLLILSIVKGMKGEYPNTTVGFVHINDVVAAHLLAMEDPKASGRLICSSTVAHWSQIIEMLRAKYPSYPYENECSSQEGDNNPHSMDTTKITQLGFPPFKTLEQMFDDCIKSFQDKGFL

SEQ ID NO: 3755 - protein, 329 aa, Glycine max
  misc_feature (274)..(274): Xaa can be any naturally occurring amino acid
MPEFCVTGGTGFIASYLVKALLEKGHTVRTTVRNPGDVEKVGFLTELSGAKERLKILKADLLVEGSFDEAVRGVDGVFHMASPVLIPYDENVQQNLIDPCIKGTLNVLNSCVKATVKHFVLTSSCSSIRYRDDVQEVCPLNESHWTDLEYCKRYKLWYAYAKTIAEREAWRIAKENGMDLVVVNPSFVVGPLLAPQPTSTLLLILSIVKGMKGEYPNTTVGFVHINDVVAAHLLAMEDPKASGRLICSSTVAHWSQIIEMLRAKYPSYPYENEXVKPCQSITLCSSQEGDNNPHSMDTTKITQLGFPPFKTLEQMFDDCIKSFQDKGFL

SEQ ID NO: 3756 - protein, 234 aa, Glycine max
MSSMASSTAFFTPLHDFTQARTTPSPPLPFIKSSFASSKSTFFHPALSLQTSSNFPRLFGKPKFFSVHARAATEKTIYDFTVKDIDRKDVSLSKFKGKVLLIVNVASRCGLTSSNYSELSRLYEKYKNQGLEILAFPCNQFGMQEPGSNEDIKQFACTRYKAEFPIFDKVDVNGPFTTPVYQFLKSSAGGFLGDLIKWNFEKFLVDKNGKVIERYPPTTSPFQIEKDIQKLLAA

SEQ ID NO: 3757 - protein, 288 aa, Glycine max
MRKRSIYAWLVALVCFLLLMIVTPAIPQSQEYHDFADHRTFLGIPNALNVISNFPFLVIGLVGLVLCHHGNYFRLSLQGELWGWTCFYVGVAAVAVGSSYYHLKPDDARLVWDRLPMTVAFTSIMAIFIIERIDERKGTVSIIPLVLAGIISIVYWRFFDDLRPYALVQFVPCIVIPLMAILLPPMYTHSTYWLWAAGSYLLAKVLEATDDVIYEWAQHIVSGHTLKHLVAAMVPVFLTFMLAKRSVEPERQSLLKTWRVSWTKFREGNSNIESYSYSYTNVQAVEPQ

SEQ ID NO: 3758 - protein, 300 aa, Glycine max
MMPSVNPDKDSEPFVETDPTGRYGRYSELLGCGAVKKVYRAFDQEEGIEVAWNQVKLRNFCDDPAMLDRLYSEVRLLRSLTNKNIIALYNVWRDEQRNTLNFITEVCTSGNLREYRKKHRHVSIKALKKWSKQILKGLNYLHLHDPCIIHRDLNCSNVFVNGNTGQVKIGDLGLAAIVGKNHCAHTILGTPEFMAPELYDEDYTELVDIYSFGMCVLEMVTVEIPYSECDNVAKIYKKVSSGVRPAALNKVKDPEVKAFIEKCLAQPRARPSAAELLRDPFFDEIVDDDDENDDCSCSYQ

SEQ ID NO: 3759 - protein, 226 aa, Glycine max
MWIQGFSFWIKGFSLLALISVISALEPGLGSTRVVLQTKYGDIEFGFYPTVAPKTVDHIYKLVRLGGYNTNHFFRVDKGFVAQVADVTNGRSAPMNEEQRREAVKTVVGEFTEVKHVRGILSMGRYDDPDSASSSFSILLGDAPHLDGKYAIFGKVTKGDETLTKLEQLPTRKEGIFVMPMERITILSSYYYDTETENCEEDRSILKRRLAASAIEVERQRMKCFP

SEQ ID NO: 3760 - protein, 240 aa, Glycine max
  misc_feature (168)..(168): Xaa can be any naturally occurring amino acid
MWIQGFSFWIKGFSLLALISVISALEPELGSTRVVFQTKYGDIEFGFYPTVAPKTVDHIYKLVRLGGYNTNHFFRVDKGFVAQVADVANGRSAPMNEEQRREAVKTVVGEFTEVKHVRGILSMGRYDDPDSASSSFSILLGDAPHLDGKYAIFGKVTKGDEMLTKLEXLPTRKEGIFVMPMECITILSSYYYDTETENCEQDRSILKLRPAASAVEVERQPYDEVSRSFDVRWNDQLEHT

SEQ ID NO: 3761 - protein, 536 aa, Glycine max
MASSLRISRLISRSFSSTSFFSRGGNGFLGSRHCKYSTSSAIEEEPVKPSVQVEHTQLLIDGKFVDAASGKTFPTLDPRTGEVIAHVAEGHSEDVDRAVAAARKAFDHGPWPKMTAYERQRILLRAADLLEKHNDELAALETWDNGKPYEQAAKIEVPMLVRLIRYYAGWADKIHGLTVPADGPYHVQTLHEPIGVAGQIIPWNFPLLMFAWKVGPALACGNTIVLKTAEQTPLSALYAAKLFHEAGLPAGVLNVVSGFGPTAGAALASHMEVDKLAFTGSTDTGKVVLELAAKSNLKPVTLELGGKSPFIVCEDADVDQAVELAHFALFFNQGQCCCAGSRTFVHESVYDEFVEKAKARALKRVVGDPFKGGIEQGPQIDSDQFEKILRYIRSGVESGATLETGGDKLGNKGFYIQPTVFSNVKDGMLIARDEIFGPVQSILKFKDLGEVVQRANNTRYGLAAGVFTTNMDTAYTLTRALRVGTVWINCFDTFDAAIPFGGYKMSGQGREKGEYSLKNYLQVKAVVNPLKNPAWL

SEQ ID NO: 3762 - protein, 193 aa, Glycine max
PRVRDGSDAILLGAETLRGQYPVETISIVGKICAEAEKVHNQDLYFKKAVKYVGEPMSHLESIASSAVRAAIKVKASVIICFTSSGRAARLIAKYRPIMPVISVVIPQLKTNQLRWTFTGAFEARQSLIVRGLFPMLADPRHPAESKSGTNESILKVALDHGKAFGIIKPHDRVVVCQKVADSSVVKILELED

SEQ ID NO: 3763 - protein, 556 aa, Glycine max
MFGLIGRKASLLGGSGTRRRWLSFAATATTTSNGGAMEELLSQLQSNVQKALAGGGPEAVKRNTSRNKFLPRERIDRLLDPGSSFLELSQLAGHYLYEEPLPSGGVVTGIGPVHGRLCMFVANDPTVKGGTYYPITVKKHLRAQEIAAQCKLPCIYLVDSGGAFLPKQAEVFPDRENFGRIFYNQAVMSAQGIPQIALVLGSCTAGGAYIPAMADESVMVKGNGTIFLAGPPLVKAATGEEVSAEDLGGATVHCKTSGVSDYFAQDELHALALGRNIIKNLHMAGKDVLANGLQNINYEYKEPLYDINELRSIAPTDLRQQFDIRSVIDRIVDGSEFDEFKKLYGTTLVTGFARIFGQPVGIIGNNGILFNESALKGAHFIELCTQRNIPLVFLQNITGFMVGSRSEANGIAKSGAKMVMAVSCAKVPKVTIMVGGSFGAGNYAMCGRAYSPNFLFLWPNARISVMGGAQAAGVLAQIEKGNKKRQGIQWSKEEEDKFKGKVVEAYEREASPYYSTARLWDDGIIDPADTRKVIGLSISASLNRDIQNTKYGVFRM

SEQ ID NO: 3764 - protein, 170 aa, Glycine max
MVFSFNQRFWVSSSLLLLAVLSVSSLTPTFLSDTVFDSQPAHTGRNLLQAKKGCSVNFEFLNYTVITSKCKGPRYPPKECCGAFKEFACPYADVLNDLTNECASTMFSYINLYGKYPPGLFSSECREGKFGLACPAVPPSAVSADDTANQAVHCPSLLLMLIACFLILLF

SEQ ID NO: 3765 - protein, 121 aa, Glycine max
MPCLNLSTNVNLDGVDTSSILSEATSTVASIIGKPEAYVMIVLKGSVPISHGGSEQPAAYGELVSIGGLSPDVNKKLSAGIASILENKLSVPKSRFYLKFYDTKAHQSQEYAQCLHALHQH

SEQ ID NO: 3766 - protein, 71 aa, Glycine max
MAGGAPKQLFGFGVVALLATLILPLFMPAAVQAQSAAPAPAPTSDGSSLDQGIAYVLMLLALVLTYIIHSA

SEQ ID NO: 3767 - protein, 497 aa, Glycine max
  misc_feature (396)..(396): Xaa can be any naturally occurring amino acid
MAALSNGHGSSFFKMPPIKFTKLFINGEFVDSLSGREFETRDPRTGEVITRIAEGAKEDVDVAVKAARAAFDYGPWPRMPGAERAKIMMKWADLVDQNIEEIAALDAIDAGKLYHWCKAVDIPAAASTIRYYAGAADKIHGEVLKASREFHAYTLLEPIGVVGHIIPWNFPSTMFVAKVSPSLAAGCTMVLKPAEQTPLSALFYAHLAKLAGIPDGVLNVVPGFGQTAGVAISLHMDIDKVSFTGSTEVGREVMRAAANSNLKPVSLELGGKSPVIVFDDADVDKAAELALLGILFNKGEICVAGSRVLVQEGIYDEFEKKLVEKAKAWVVGDPFDPKVQQGPQVDKFSSKSASAYKKTQTNGKKVLERGEIINYTRRQQVVEAKFKGQQFETNEXASPVMALMKFKTIEDAIKIANNTRYGLASGIVTKSLDTANTVSRSIRAGIVWINCYFAFGDDIPYGGYKMSGFGRDFGMEALHKYLQVKSVVTPIYNSPWL

SEQ ID NO: 3768 - protein, 518 aa, Glycine max
MGSTPEVLAQRSCGKLIGTRLLQYLNGGPLSFKTHQAIVLIVTFFAYASYHATRKTTSIVKSVLDPQSAATGLTFFPFRPTNFTESNGSKRLSSNLGDGWAPFNGSDGTSLLGQLDVAFLAVYAFGMYFSGHFGDRCNLRIFLTVGMIGTGLFTSLFGVGYWGNIHNFYYYLIVQMIAGLFQSTGWPSVVAVVGNWFGKSKRGLIMGIWNAHTSIGNIAGSLIASAMLSYGWGWSFVVPGLITAFIGLAVFLILPVTPESVGAREEDEFSGPIKSGEEAAEPLLRQETPVEEKEAVGFIEAWKIPGVAPFALCLFFAKLVAYTFLYWLPFYVSHTAIDGKYLSSGTSGTLSTLFDVGGVLGGILAGHISDHLEARAITAASFMYCAIPALFFYRSYGHVSLIVNGALMFVTGMFVNGPYALITTAVSADLGTHKSLKGNSRALATVTAIIDGTGSIGAAVGPLLTGYISAKSWSAVFTMLMAAALIAGLLLTRLVVSEVATKIEESRSNRAQDCSLNV

SEQ ID NO: 3769 - protein, 356 aa, Glycine max
MVCRSCVRSLVVQAGTFANRVRINGFGRSLQAVQSFSHWPIREYKTTTRMMVDTGSMSRAGPLVDTMPEKDDDGRFASGGWKSDDGRLSCGYSSFRGKRVTMEDFYDIKTLKIGGQSICLFGIFDGHGGSRAAEYLKEHLFDNLLKHPKFLTDAKLAISETYQQTDANFLDSEKDTFRDDGSTASTAVLVDNHLYVANVGDSRTIISKAGKANALSEDHKPNRSDERKRIENAGGVVMWAGTWRVGGVLAMSRAFGNRMLKQFVVAEPEIQDQEIDEQIELIILASDGLWDVVQNDDAVSLARTEEEPEAAARKLTEAAFSRGSADNITCIVVQFHHEKAELANPDKAEAASAQHE

SEQ ID NO: 3770 - protein, 418 aa, Glycine max
MEGEKENPDCNATLVNSFCEITSSSKEEALFFLESHNFDLDAAVSTFLDNANNPLIPQNDDVVVAANPNPNSVSPPSDSHSPDFNPSRSPSPSPSPTRTPYELRSRRSLGKKPSTSRQGKIRTLGDLKRSSRDDDSDSDPDFEPDEYYTGGEKSGMLVRDPTRGNSNNNNSVDDIFDQARQVAVDAPPENPRSSSRSGSFSGTARLLSGERLPSAAAAAPAPQRVEEVTHTVTFWRNGFSVNDGPLRRLDDPQNAPFLESIKKSECPKELEPADRRTAVHVNLTRRDEDYPEPVKPRHRAFQGVGRTLGSTSSSNDEPIQTTGASPSTAPLPTMGLIVDEAQSVTSIQLRLADGTRMVSRFNHHHTIRDVRAFIDASRPGGVRSYQLQSMGFPPKQLANLDQTIEQAGIANSVVIQKL

SEQ ID NO: 3771 - protein, 205 aa, Glycine max
MEKGSVVEAAVTRSPMQMKMGDHELEGNTTSALRTAETFLRLFPVGLCVSALVLMLKSSQQNEYGSVDYSDLGAFRYLVHANGICAGYSLFSAVIAAMPCPSTIPRAWTFFLLDQVLTYIILAAGAVSTEVLYLAENGDAATTWSSACGSFGRFCHKVTASVAITFVAVFCYVLLSLVSSYKLFTNYDAPASRPTAAIEVAAFPG

SEQ ID NO: 3772 - protein, 210 aa, Glycine max
MMNASKFIKCVTVGDGAVGKTCMLICYTSNKFPTDYIPTVFDNFSANVAVDGSIVNLGLWDTAGQEDYSRLRPLSYRGADIFVLAFSLISRASYENVLKKWMPELRRFAPNVPIVLVGTKLDLREDRGYVADHMGSSVITSAEGEELRKQIGAAAYIECSSKTQQNVKAVFDTAIKVVLQPPRRKEMARKKRHRRSGCSFVSIMCGGCAA

SEQ ID NO: 3773 - protein, 705 aa, Glycine max
  misc_feature (147)..(147): Xaa can be any naturally occurring amino acid
MAQNGSGDRVVVDNGFESIDDAYDHEHKLSQKGSTKVKEEEVSVERVFQHLLVPSWRNQLTVRAFVVSFALSILFSFIVMKLNLTTGIIPSLNVSAGLLGFFFVKTWTKFLEKSNMLRQPFTRQENTVIQTCVVASSGIAFSGGFGXSYLFGMSEEIAKQSSDPSHFKDPKLGWIIGFLSVVSFLGLFSVVPLRKIMVIDFKLTYPSGTATAHLINSFHTPQGAKLAKKQVKMLGKFFSLSFFWGFFQWFYTATDQCGFQAFPSLGLKAYENKFFFDFAAIYVGVGMICPYIINISVLLGGIISWGIMWPLIKTKEGDWYDKGLGEGNLHGIQGYRVFIAIALILGDGLYNFIKVLTHTLWGLYHQIREKQRENVLPVADQDSPSNSHLSYDDQRRTQLFLKDQIPTWFAISGYVAIAAISTATLPHIFPELKWYYIIVIYLIAPTLAFCNAYGCGLTDWSLASTYGKLAIFTIGAWAGSSNGGVLAGLAACGVMMNIVSTASDLMQDFKTGYLTLASPRSMFVSQIIGTTMGCIISPCVFWIFYKAFPDLGLERSTSEYPAPYAIIYRNMAILGVQGFGHLPKNCLLLCYIFFAAAVAINLIKDFLGKRGRFIPLPMAMAIPFYIGPYFAIDMCVGSLILYVWERINKAKADAFAPAVASGLICGDGIWTLPASILALAGVKPPICMKFLSRAANARVDTLLGN

SEQ ID NO: 3774 - protein, 682 aa, Glycine max
  misc_feature (248)..(248): Xaa can be any naturally occurring amino acid
  misc_feature (293)..(293): Xaa can be any naturally occurring amino acid
MLLKLLPLLVFLLIPVSSQPNQLFYAGFKGLGSNNMTLDGVAEIEPNGVLKLTNDSSKVMGHAFYPTPFRFKNSSGGKAFSFSSSFALAIVPEFPKLGGHGLAFTIAPSKDLKAHPSQYLGILDSSNIGNFSNHLFAVEFDTAKDFEFGDIDDNHVGIDINSLASNASASAGYYTGDDDSSKQNLTLQSRVPILAWVDYDAAKSVVHVTISASSTKPKRPLLSYHVDLSPILKESMYVGFSASTGLLXASSHYILGWSFKINGPAPPLDLSSLPQLPGPKKKHTSLIIGVSVXCCFLALCGFLFGIYMYRRYKNADVIEAWELEIGPHRYSYQELKKATKGFKDKELLGQGGFGSVYKGTLPNSNTQVAVKRISHDSNQGLREFVSEIASIGRLRHRNLVQLLGWCRRRGDLLLVYDFMENGSLDKYLFDGPKTILSWEQRFKVIKDVASALLYLHEGYEQVVIHRDVKASNVLLDGELNGRLGDFGLARLYEHGTNPSTTRVVGTFGYLAPEVPRTGKATPSSDVFAFGALLLEVACGLRPLEPKAMPEDMVLVDCVWNKFKQGRILDLVDPKLNGVFNEREMLMVLKLGLLCSNGSPTARPSMRQVVRFLEGEVGVPDELRKPGEGGYQEGFDEFLHSLESSSFDQMSTGSYGRNRDMDSSFPSLTDTSLFSPHGKGQTM

SEQ ID NO: 3775 - protein, 289 aa, Glycine max
  misc_feature (99)..(99): Xaa can be any naturally occurring amino acid
MEGNSGGGGGGNDVELLCKTLQVEHKLFYFDLKENPRGRYLKISEKTSATRSTIIVPFSGISWFLDLFNYYVNSDDQDLFSKELQLDTKVFYFDIGENXRGRFLRVSEASVSRNRSTIIVPAGSSRDEGWAAFRNILAEINEASRLFILPNQQNSESSEHLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMAVANVRTIDPPSKMNANLG

SEQ ID NO: 3776 - protein, 283 aa, Glycine max
MEGNSGGGGGGNDVELLCKTLQVEHKLFYFDLKENPRGRYLKISEKTSATRSTIIVPFSGISWFLDLFNYYVNSDDQDLFSKELQLDTKVFYFDIGENRRGRFLKVSEASVSRNRSTIIVPAGSSRDEGWAAFRNVLAEINEASRLFILPNQQNSESSERLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMTVANVRTVDPPQR

SEQ ID NO: 3777 - protein, 120 aa, Glycine max
MAVHSDSASSEKKSSNGVNELLTFNAENMQSNMKIIYYSRTFLSIIGGVVAGILGFTGLKGFVFYLLLMAFTSLGLVAKAKFSTHTYFDSWNRVLLDGFLGGLMSFVLFWTFAYDIVHIF

SEQ ID NO: 3778 - protein, 120 aa, Glycine max
MAVHSESASSEKKSSNGVNELLTFNAENMQSNMKIIYYSRTFLSIIGGVVAGILGFTGLKGFVFYLLLMALTSLGLVAKAKFSTHTYFDSWNRVLLDGFQGGLMSFVLFWTFAYDIVHIF

SEQ ID NO: 3779 - protein, 261 aa, Glycine max
MFYRGKFADGGDGREMAAKRQRTVDPGSSFYGASTGSNFMYNPSPYGYVSQPPPPPPFPVVRLRGLPFDCTETDVAEFFHGLDIVDVLFVHKGGKFTGECFCVLGYPLQVDFALQRNRQNMGRRYVEVFRSKRQEYYKAIANEVSDARGGSPRRSASRAKSYDEGKESAEHTGVLRLRGLPFSASKDDIMEFFKDFGLPEDSIHIIMNSEGRPSGEAYAEFESAEDSKAAMVKDRMTLGSRYIELFPSSPGEMEEAISRGR

SEQ ID NO: 3780 - protein, 501 aa, Glycine max
  misc_feature (230)..(230): Xaa can be any naturally occurring amino acid
  misc_feature (248)..(248): Xaa can be any naturally occurring amino acid
  misc_feature (353)..(353): Xaa can be any naturally occurring amino acid
  misc_feature (477)..(477): Xaa can be any naturally occurring amino acid
KVAASEAGGITQGIGAYKVEVPVDGKKLPCVFLDTPGHEAFGAMRARGASVTDMAIIVVAADDGIRPQTNEAIAHAKAAGVPIIIAINKIDKDGANPERVMQELSSIGLMPEDWGGDIPMVPISALKGKNIDDLLETVMLVAELQELKANPDRSAKGTVVEAGLDKSKGPFASFIVQNGTLRRGDIVVCGEASGKVRALFDDGGKRVDEASPSMPVQVIGLNNVPIAGDXFEVVESLDTARERAEARXESLRNERISAKAGDGKVTLSSLASAVSSGKLSGLDLHQLNIILKVDLQGSIEAVRKALEILPQDNVTLKFLLEATGDVNTSDVDLSVASKAIILGFNVKAPGSVXKSYGENKAVEIRLYRVIYELIDDVRKAMEGLLEPVEEQVTIGSAVVRAVFSSGSGRVAGCMVTEGKILNDCGIRVKRKGKVVHVGILDSLRRVKEIVKEVNAGLECGLGLEDFDDWEEGDILEXPSTHFRRRGPLKRPQPQWHLPWRE

SEQ ID NO: 3781 - protein, 417 aa, Glycine max
  misc_feature (394)..(394): Xaa can be any naturally occurring amino acid
IIIAINKIDKDGANPERVMQELSSIGLMPEDWGGDIPMVPISALKGKNIDDLLETVMLVAELQELKANPDRSAKGTVVEAGLDKSKGPFASFIVQNGTLRRGDIVVCGEAFGKVRALFDDGGKRVDEATPSIPVQVIGLNNVPIAGDEFEVIESLDTARERAETRAESLRNERISAKAGDGKVTLSSLASAVSSGKLSGLDLHQLNIILKVDLHGSIEAVRKALEILPQDNVTLKFLLEATGDVSTSDVDLAVASKAIILGFNVKAPGSVKSYAENKAVEIRLYKVIYELIDDVRNAMEGLLEPVEEHVTIGSAVVRAVFSSGSGRVAGCMVTEGKILQDCGIRVKRKGKVVHVGILDSLRRVKEIVKEVNAGLECGLGLEDFDDWEEGDILEXSTQFRRGGPLKRPQHQWQLLWRE

SEQ ID NO: 3782 - protein, 340 aa, Glycine max
  misc_feature (75)..(75): Xaa can be any naturally occurring amino acid
MGSKSETVCVTGASGYIGSWLVMRLIERGYTVRATVLDPADMREVKHLLDLPGAESKLSLWKAELTEEGSFDEAXIKGCTGVFHLATPVDFKSKDPENEMIKPTIQGVLNIMKACLKAKTVRRLVFTSSAGTTNITEHQKPIIDETCWTDVEFCRRLNMTGWMYFVSKTLAEKEAWKFAKEHGMDFIAILPALVIGPFLLPTIPSSVISALSPINGIEAHYSIIKQAQFVHIEDICLAHIFLFEQPKAEGRYICSACDVTIHDIVKLINEKYPEYKVPTKFQNIPDQLEPVRFSSKKITDLGFQFKYSLEDMYTGAIDTCIEKGLLPKPAEIPANGIEHK

SEQ ID NO: 3783 - protein, 171 aa, Glycine max
MVLSWTKGRVFRRARKGKELKYSGGDMEIEIAIPTHFRCPVTLDMMKDPVTVSTGITYDRDSIEKWIESGNRTCPVTKTELTSLDDMIPNHAIRRMIQDWCVEHRSHGIERIPTPRIPVTPYEVADTCTRILSAAQHGDENKCVELVSKIKAWGRESERNKRCIVSNGAAL

SEQ ID NO: 3784 - protein, 642 aa, Glycine max
MKVQFSIVALVLLGSTLCLSGLIVADLNSDQQALLEFASSVPHAPRLNWKKDSVSICTSWVGVTCNSNGTRVVGLHLPGMGLIGTIPENSIGKLDALRVLSLHSNGLIGSLPSNILSIPSLQFAYLQHNGFSGIIPSPVTPKLMALDISFNNFSGSIPPAFQNLRRLTWLYLQNNSISGAIPDFNLPSLKHLNLSNNNLNGSIPNSIKTFPYTSFVGNSLLCGPPLNHCSTISPSPSPATDYQPLTPPTTQNQNATHHKKNFGLATILALVIGVIAFISLIVVVICVFCLKKKKNSKSSGILKGKASCAGKTEVSKSFGSGVQGAEKNKLFFFEGSSHSFDLEDLLKASAEVLGKGSYGTAYKAVLEEGTTVVVKRLKEVVVGKKEFEQQLEIVGRVGSHPNVMPLRAYYYSKDEKLLVYNYMPGGSLFFLLHGNRGAGRTPLDWDSRVKILLGAAKGIAFIHSEGGPKFAHGNIKSTNVLINQELDGCISDVGLPPLMNTPATMSRANGYRAPEVTDSKKITHKSDVYSFGVLLLEMLTGKTPLRYPGYEDVVDLPRWVRSVVREEWTAEVFDEELLRGQYVEEEMVQMLQIALACVAKGPDQRPRMDQVVRMLEEIKHPELKNYHRQSSESESNVQTPTP

SEQ ID NO: 3785 - protein, 356 aa, Glycine max
MVCSSCVRSLVVQAGTFVNRVRINEFGRSLLAVQSFSHWPIREYKTITGMMVDTGSMSSAGPLVDMMPEKDDDGRFASGGWKSEDGRLSCGYSSFRGKRVTMEDFYDIKTLKIGGQSICLFGIFDGHGGSRAAEYLKEHLFDNLLKHPNFLTDAKLAISETYQQTDANFLDSEKDTFRDDGSTASTAVLVDNHLYVANVGDSRTIISKAGKANALSEDHKPNRSDERKRIENAGGVVMWAGTWRVGGVLAMSRAFGNRMLKQFVVAEPEIQDQEIDEQIELIILASDGLWDVVQNDDAVSLARTEEEPEAAARKLTEAAFSRGSADNITCIVVQFHHEKAELANPDKAESASAQHE

SEQ ID NO: 3786 - protein, 96 aa, Glycine max
MVCEKCEKKLSKVIVPDKWKEGASNTTEGGGRKINENKLLSKKNRWTPYGNTKCTICKQQVHQNAKYCHTCAYSKGVCAMCGKQVLDTKFYKQSNV

SEQ ID NO: 3787 - protein, 66 aa, Glycine max
LFADGPLNGTTKCTICKQQVHQKCLSTCHTCAYSKGVISILCKWCGKQVLDTKFYQTKQCVVDTLC

SEQ ID NO: 3788 - protein, 49 aa, Glycine max
  misc_feature (36)..(36): Xaa can be any naturally occurring amino acid
MVCENCEKKLSKVIVPDKWKEGASITTEGGGRKINXNKLFFQKNRLTSY

SEQ ID NO: 3789 - protein, 161 aa, Glycine max
  misc_feature (55)..(55): Xaa can be any naturally occurring amino acid
  misc_feature (78)..(78): Xaa can be any naturally occurring amino acid
MNARRDGRNNRVALFDGIEEGGIRASSLYSSTSSHEIDEHDNEQALDGLQDRSIXLQQLSGDINEEVDSHTRMLVRMXNDMDSSRGALSGTMNKLKMVFKKNPTPKKFLLRAPFSKVFFIINHLARELVFNTLGRIMLNEKKTPRPIPVISVTCKIFLMFV

SEQ ID NO: 3790 - protein, 71 aa, Glycine max
LQQLSGDINEEVDSHNRMLDRMGNDMDSSRGVLSGTMDKFKMVFETKSSRRMFSLVASFVVLFLIIYYLTR

SEQ ID NO: 3791 - protein, 186 aa, Glycine max
MEGGNNSSINSNPEELAVGCLLSIRTTLGDEFEGQVVTFDRPSNILVLQEPSKPSPRRNLRLLKANYIKDFTFLGHAQDPLDPNTCFLDLTALQQREDVAVRQAEADAERIGVGVTSEAQSIFDALSKTLPVRWDKTVIVVMNEVRVSSPYHSESVVGGTPAANDRVKKVLEFERKRLQLRSSGGQ

SEQ ID NO: 3792 - protein, 186 aa, Glycine max
MEGGNNSSSNNNPDELAVGCLLSIRTTLGDEFEGQVVTFDRPSNILVLQEPSKPSPRRNLRLLKANYIKDFTFLGHAQDPLDPNTCFLDLTALQQREDVAVRQAEADAERIGVGVTSEAQSIFDALSKTLPVRWDKTVIVVMNEVRVSSPYHSESVVGGTPAANDRVKKVLDFERKRLQLRSSGGQ

SEQ ID NO: 3793 - protein, 143 aa, Glycine max
SARGQAFEDGNDELRRSPGTPVFTAPECCLGLTYHGKASDTWAVGVTLYCMILGEYPFLGDTLQDTYDKIVNDPLVLPDDINPQLKNLIEGLLCKDPELRMTLGDVAEHIWVIGEDGPIPGYLCWCKRKSMVTEDSDGSDILA

SEQ ID NO: 3794 - protein, 409 aa, Glycine max
MLNKTLSFAMGCCSCFGFIRTPNRQSQRSKPTTNNNLCQEPLLDDDIEDEEGEPLYNDEVTNNSGDEGAEETRPKRSEEILNFRVENGMICRQFPVKETRKLVRSEDENGNKMINEYIPEYKIGSGSCPIGDPGHRFLEVISFVLQSFHKSHLLKLRFAPSETAMTDVLREVLIMKMVEHPNIVNLIEVIDDPESDDFYMVLEYVESKWVCEGTGHPCALGEETARKYLRDIVSGLTYLHAHNIVHGDIKPDNLLITRHGTVKIGDFSVSQAFEDGNDELRRSPGTPVFTAPECCLGLTYHGKASDTWAVGVTLYCMILGEYPFLGDTLQDTYDKIVNDPLVLPDDINPQLKNLIEGLLCKDPELRMTLGDVAEHIWVIGDDGPIPGYLCWCKRKSMVTEDSDGSDILD

SEQ ID NO: 3795 - protein, 350 aa, Glycine max
  misc_feature (256)..(256): Xaa can be any naturally occurring amino acid
PHKTVFSIFNRDLLSVNLVVIITTITLIVGPEQKHPEVEALLSPPQNKEAGKSLLDSDEVILSELEDEKPKEVDMLPASERQKRIAHLQQRLLQAAAEGAVRVKSRRGPHRGEDFTLTQALIKADFWLLFISMIMGSGSGLTVIDNLGQMSQSLGFDNAHIFVSMISIWNFLGRVGGGYISELVVRDHAYPRPVALAVFQLIMTLGHVFLGMGWPGSMYVGTLLVGLGYGAHWAIVPATASELFGLRNFGALYNFXTIANPAGTLVFSSLIASTIYDAEAEKQHRQNMMLRVLNASEPLKCEGSVCFFLTSMIMAGLCVVGAGLCMVLVLRTRIVYANLYGKASSSRLRL

SEQ ID NO: 3796 - protein, 587 aa, Glycine max
MGVLQEKLSSFYKSRWLVFVAAMWLQSWAGIGYLFGSISPVIKSSLGYNQKQLAMLGVAKDLGDAVGFMTGLLCEILPIWGALLVGAALNVVGYGWVWLVVTSQVPVLPVWAMCALIFVGTNGETYFNTVSLVSCVQNFPKSRGPVVGILKGFAGLSGAILTQIYALFHSPNQASLIFMVAVGPSLVGIGLMFIVRPVGGHKQVRPSDGKCFTLIYGVCLLLAAYLLGVMVVQDLVEVSETVISIFTGVLLLILLVPIVIPITLTFGPEQRHPEEEALLPPPQNKEAGKSQLDSDEVILSELEDEKPKEVDMLPASERQKRIAHLQQRLLQAAAEGAVRVKRRRGPHRGEDFTLTQALIKADFWLLFISMIMGSGSGLTVIDNLGQMSQSLGFDNAHIFVSMISIWNFLGRVGGGYISELVVRDHAYPRPVALAVFQLIMTLGHVFLGMGWPGSMYVGTLLVGLGYGAHWAIVPATASELFGLRNFGALYNFITIANPAGTLVFSSLIASTIYDAEAEKQHRQNMMLRVLNASEPLKCEGSVCFFLTSMIMAGLCVVGAGLCMVLVLRTRIVYANLYGKASSSRLRL

SEQ ID NO: 3797 - protein, 776 aa, Glycine max
  misc_feature (519)..(519): Xaa can be any naturally occurring amino acid
ERDHTTVVSYLGEVLCWGYNRDGQLVYGTENATSNYTPRVVESLKGKTLTRVSAAKYHTIVLGSDGEVFTWGHRLVTPKRVVVSRNLKRSGSTLLKFHRKERLSVVSIAAGMVHSMALTDDGALFYWVSSDPDLRCQQLYAMCGRNMVSISAGKYWTAAVTATGDVYMWDGKKGKDKPLVATRLHGVKKATSVSVGETHLLIVASLYHPVYPPNMIENSQKSKLNNEDYVEEVNEDFLFEHTDSSNIISNRQNDTLSQRSIPSLKSLCEKVAAECLVEPRNAVQLLEIADSLGADDLKKYCEEIVMRNLDFIFAVSSHTVASASLDILANLERLFDQRSSEPWSHRRLPTPTATFPAIINSEEDDSEIEFQRTRDKPMKLEKVLRLDSFLQPKDDPNKEISKVVRAIRKKLQQIEMLEDKQSNGHLLDDQQIAKLQSKSALESSLAELGVPVETSRYKESSSMLPEGKGSKKGKLSKKQRRKSGNSNIEQTEIESVYSKSEAIPKSEDLFRDRNIKAFXQSVEEDAVCEQISADEGGKDLAFVVQKKDALELLKAKGPSPKASKKKRSKKGGLSMFLSGALDEAPKEVAPPPPTPTPKHEGPAWGGAKFTKGSASLREIQDEQSKIKVNKPAGSKDKVEDLSDFGSGGKIKLSSFLPSSPIPVTSSRSSQVSDGETSTPPWAASGTPPQPSRPSLRHIQMQQGKKQQSLSHSPKTTTAGFSIPTCQGSPSETTGVSRWFKPEVETPSSIRSIQIEEKAMKDLKRFYSSVKIVRKQS

SEQ ID NO: 3798 - protein, 556 aa, Glycine max
  misc_feature (87)..(87): Xaa can be any naturally occurring amino acid
  misc_feature (103)..(103): Xaa can be any naturally occurring amino acid
  misc_feature (141)..(141): Xaa can be any naturally occurring amino acid
  misc_feature (147)..(147): Xaa can be any naturally occurring amino acid
  misc_feature (252)..(252): Xaa can be any naturally occurring amino acid
  misc_feature (325)..(325): Xaa can be any naturally occurring amino acid
MSGGGGGEEEATLEFTPTWVVAAVCTVIVAISLAAERLLHYGGKFLKAKDQKSLYEALQKIKEELMLLGFISLLLTVTQNGITKICXVRPSLTRHMLPCNLDXRLWHRLSPTQPRTLKFVTASAKTHPLTPSLFFSFDLIXIHHPSXRLLFCFSLFQNKVPLLSLEALHHLHIFIFVLAVVHVSFSLLTVVFGGARIRQWKHWEDSIAKQNYETGRVLKPKVTQVHQHDFIRGRFAGFDRDSNIVGWLLSFXVLKPKAVQIPQYVLLRHGFISSDYGSALMVNFLKYMIRALEADFKLGVCDNGYFCHFAAIFLLLKINGFSETXLRQHMFCAPGYDYKFVVGVSWYLSLFVVWHTYFWIALIGVVLLLAVGTKLEHVITQLAQEVAEKHAAIEGDLVVQPSDEHFWFHRPHVVLFLIHFILFQNAFEIAFFFWIWVTYGFDSCIMGQVRYIVPRLVIGVFIQVLCSYSTLPLYAIVTQMGTHYKRAIFNEHLQQNIVGWAQKAKKRKGLKADGNPGQGSSQESANTGIQLGSIFKKASAPGGSSSATKADGTNSV

SEQ ID NO: 3799 - protein, 506 aa, Glycine max
MSGGGEEGATLEFTPTWVVAAFCTVIVAISLAAERLLHYGGKFLKAKDQKPLYEALQKIKEELMLLGFISLLLTVTQNGITKICVRPSLTLHMLPCNLHDAPANHESHFQTFFPGTARRLLSGEHSTPESASKIGYCSRKHKVPLLSVEALHHLHIFIFVLAVVHVSFSVLTVVFGGARIRQWKHWEDSIAKQNYETDRVLKPKVTQVHQHDFIRGRFAGFGKDSAIVGWLLSFLKQFYGSVTKSDYVTLRHGFIMTHCRTNPKFNFHKYMIRALEDDFKQVVGISWYLWLFVVIFLLLNINGWHTYFWIAFIPVILLLAVGTKLEHIITQLAHEVAEKHAAIEGDLVVQPSDDHFWFHRPRVVLFLIHFILFQNAFEIAFFFWIWVTYGFDSCIMGQVRYIVPRLVIGVFIQVLCSYSTLPLYAIVTQMGTHYKRAIFNDHLQQNIVGWAQKAKKRKGLKADGNPGQGSSQESANTGIQLGSIFKKATAPGDSSSAPKADGISSV

SEQ ID NO: 3800 - protein, 364 aa, Glycine max
STSSVVVSPLLNGVNKVIEKNLVPFGPSGSSADLTHSLEPFPVEISQSESQLVYFRDSAILLSPYHVKQQTTFIKTPSTRVESFTVMDPTKRAGTELKYGPYENHPPYSYSPVLIHFENNNAFAVVEELEREIEISHWGSVQVTERYSLVHAGARHKGVFSRVEYQTKPGGTGVSSFKHLLAKLPPRVHSVYYRDGIGNISSSHLRTDSWKSELEIEPRYPLFGGWKSTFVIGYGLPLQDFLFESPDGRRYLNFTFGCPLVETVVDKLIVKVVLPEGSKDPTVEIPFEVKQHLEIKYSYLDVVGRTVVVLEKRNAVPEHNTPFQVYYRFNPIFMLAEPLMLVSAFFLFFVASVAYLHIDLSIRK

SEQ ID NO: 3801 - protein, 541 aa, Glycine max
  misc_feature (139)..(139): Xaa can be any naturally occurring amino acid
  misc_feature (236)..(236): Xaa can be any naturally occurring amino acid
  misc_feature (315)..(315): Xaa can be any naturally occurring amino acid
  misc_feature (391)..(391): Xaa can be any naturally occurring amino acid
MAALNLCRMALRSSKLLSRPYHLLSVQLQMQMQPSSPPLTRKMSMDAQSVSFQLNSSGLLRTQGLIAGKWSDAYDGKTIKVYNPATGESIVDVACMGGRETNDAISAAYDAYGSWSKTTAAERSKFLRKWYDLRMVHYXELAQLITLEQGKPLKESVGEIVYGAGVIEFAAEGAKRIYRDIVPAPFSDLRLFVLKQHVWVVCASRPWNFPVSLISRNVHTVLACGCKVVISPSEHXSLSVFASVDMYIPAGMSHSVMNVVMENALNIRDAFLSSPFQRKITFTGSTAVGKKLMAGSAETVKKVSLELGGNAPCIXVFDDADLDVAVKGTLAAKFRNSGQTCVCANRIIVQEGIYEKFANALRDAVQNMKVGDGFSEALSLRPLINEAAVNXLRSLYIHDSLFITGGKVNSWGVKRHSLGLTFYEPTVISDVNSDMHISREEAFGPVAPLLRFKTEEEAIRIANDTNAGLGSYVFTNSIQRSWRVAEALEYGLVGVNEGVISTEVAPFGGFKQSGLGREGSKYGMDEYLEIKYVCFGNMNKE

SEQ ID NO: 3802 - protein, 494 aa, Glycine max
MEYSVETLERDLKNTRKYYGSGKTKEAPWRESQLKGLHNFLVEKEEEIVTALKHDLGKHYVEAFRDELGTLMKTLNLATKSLKNWMAGKEAKLPRIALLSSAEIVPEPLGLVLIISSWNFPFGLSLEPLIGAVAAGNSVVLKPSELSPTCSSLLATFLPTYLDNNAIKVIQGGPEVGKLLLQQRWDKIFFTGSARVGRIVMSAAAVHLTPVTLELGGKCPALIDSLSSSWDKEVAVKRILVAKFGSCAGQACIAIDYVLVEKSFSSTLVTLMKEWIKKMFGENPKASNSIARIVNKNHFMRLQNLLTEPRVKESVVYGGSMDENDLFIEPTILLDPPLDSAVMAEEIFGPVLPIITLEKIEDSVEFISSRPKALAIYAFTKNQTLQRRMVSETSSGSLVFNDAILQYVADTLPFGGVGECGFGKYHGKFSFDAFSHHKAVARRSYLTDFWFRFPPWTLDKLQLLEVSYNLDYLGILLVLLGLKKSKRSLFQACN

SEQ ID NO: 3803 - protein, 264 aa, Glycine max
MAEIEGSPGSSMHGVTGREQTFVASIASPIVPTDTTAKFALPVDSEHKAKIFKLFSMANPHMRTFHLSWISFFTCFVSTFAAAPLVPIIRDNLNLTKSDIGNAGVASVSGSIFSRLAMGAVCDLLGPRYGCAFLIMLSAPTVFCMSFVKDAAGYIMVRFLIGFSLATFVSCQYWMSTMFTSKIIGLANGTAAGWGNMGGGPTQLIMPLVYELIKKAGATPFTAWRIAFFVPEHPSNMNPLMHHVFLFSCTFNVRLIIIIMPLAP

SEQ ID NO: 3804 - protein, 530 aa, Glycine max
MAEIEGSPGSSMHGVTGREQTFVASVASPIVPTDTTAKFALPVDSEHKAKVFKLFSLANPHMRTFHLSWISFFTCFVSTFAAAPLVPIIRDNLNLTKSDIGNAGVASVSGSIFSRLAMGAVCDMLGPRYGCAFLIMLSAPTVFCMSFVKDAAGYIAVRFLIGFSLATFVSCQYWMSTMFNSKIIGLANGTAAGWGNMGGGATQLIMPLVYELIRRAGATPFTAWRIAFFVPGFMHVIMGILVLTLGQDLPDGNLGALRKKGDVAKDKFSKVLWYAITNYRTWIFALLYGYSMGVELTTDNVIAEYFYDRFNLKLHTAGIIAASFGMANLVARPFGGYASDVAARLFGMRGRLWTLWILQTLGGVFCIWLGRANSLPIAVLAMILFSIGAQAACGATFGIIPFISRRSLGIISGLTGAGGNFGSGLTQLVFFSTSKFSTATGLSLMGVMIVACTLPVSVVHFPQWGSMFLPPSKDVSKSTEEFYYTSEWNEEEKQKGLHQQSLKFAENSRSERGKRVASAPTPPNATPTHV

SEQ ID NO: 3805 - protein, 427 aa, Glycine max
MASAMFRRNIITHYSKFASSLSSLPRHSSIYNPLSMSVSSFHSESVGGGGGLPSSMRGAVYWEPNKPLTIEEFHMPRPKAGEVLIKTKACGVCHSDLHVMKGEIPFTSPCVVGHEITGEVVEHGALTDSKTIERLPVGSRVVGAFIMPCGNCSYCSKGHDDLCEAFFAYNRAKGTLYDGETRLFFRNSGKPAYMYSMGGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFEEAGKAFQDLNEGKIVGRAVIEII

SEQ ID NO: 3806 - protein, 506 aa, Glycine max
MLSETLAIPAVLLVILILILSSVLFHLQDERTNPPGPKPLPIIGNLHMLGKLPHRSLQALAKNYGPIMFIKLGQVPTVVVSSPETAELFLKTHDTIFASRPKTLASEYMSYGSKGLAFSEYGPYWRNVKKLCTTQLLSASKVEMFAPLRREELGVFVKSLEKAAASRDVVNLSEQVGELISNIVCRMILGRSKDDRFDLKGLAREVLRLTGVFNIADYVPWTGFLDLQGLKGKMKKMSKAFDEVFEQIIKDHEDPSASNKNSVHSEDFVDILLSHMHQAVNQQEQKYVIGRTNIKAIILDMIAGSFDTSAVAVEWAMSELLRNPSDMKKLQEELNNVVGENKLVEESDLSKLPYLNMVVKETLRLYPAGPLLVPRESLEDITINGYHIKKKTRILVNAWAIGRDPKVWSDNADMFCPERFVNSNVDIRGHDFQLLPFGSGRRGCPGIQLGLTTFGLVLAQLVHCFNWELPFGVSPDDLDMSEIFGLSLPRSKPLLAIPTYRLFIKA

SEQ ID NO: 3807 - protein, 527 aa, Glycine max
MQSSPLLLEEPIRMASILEPSKPSFFPAMTKIVGTLGPKSRSVDVISQCLEAGMSVARFDFSWGDPEYHQETLENLRAAIKSTKKLCAVMLDTVGPELQVVNKTEHPISLQADTLVVLTPDQNKEATSNLLPVNFSGLSKAVKNGDTIFIGQYLFTGSETTSVWLEVSEVNGDDVTCVIKNSATLAGSLYTLHVSQIHIDLPTLDNKDKEVISTWGAQNNIDFLSLSYTRHAEDVRHAREFLSKLGNLKQTQIFAKIENIEGLTHFDEILREADGIILSRGNLGIDLPPEKVFLFQKAAIYKCNMAGKPAVVTRVVDTMTDNLRPTRAEATDVANAVLDGSDAIVLGAETLRGLYPVETISTVGKICAEAEKVYNQDLYFKKAVKFVGEPMTHLESIASSAVRAAIKVKASVIICFTSSGRAARLIAKYRPTMPVISVVIPQLKTNQLRWTFTGAFEARQSLIVRGLFPMLADPRHPAESKSATNESILKVALDHGKAFGIIKAHDRVVVCQKVGDSSVVKIIELDE

SEQ ID NO: 3808 - protein, 114 aa, Glycine max
SSSSCTNGLLWLTRAMDFLVALFQNLIEHADWSMSQACTDSYNKTLKKWHGWLASSSFSVAMKLAPDRKKFMEVIQGTGDISADIQKFCTDFSPIFEENHKFLARCGLDDMKAS

SEQ ID NO: 3809 - protein, 202 aa, Glycine max
MEVTVFTPALEGIKLVKSEQGEILTQPFLDACKHILPVIDKFGAAMALVKSDIGGNISRLESKYSSNPTKFNYLYSLVQVEVETKTAKSSSSCTNGLLWLTRAMDFLVALFQNLIEHADWSMSQACTDSYNKTLKKWHGWLASSSFTVAMKLAPDRKKFMEVIQGTGDISADIQKFCTDFSPIFEENHKFLARCGLDDMKAS

SEQ ID NO: 3810 - protein, 343 aa, Glycine max
MAICKLKSLLSLSKCNSALVSSSIRAFSSAQNVGFIGLGNMGSRMANNLIKAGFRLTVHDLNSDVLEMFSQMGVPTKKTPYEVSEASDVVITMLPTSAHVIDVYTGPNGLLHGGKLLRPWLLLDSSTIDPQTSRNLSATVTNYILREKKGEWEKPFKLDAPVSGSVTAAEAGTLTFMVGGSEEAFLAAKPLLFSMGKSAIYCGGAGSGSAAKICNNLALAVSMLGISEALALGQSLGVSASTLTNIFNCSSARCWSSDAYNPVPGLMEGVPSSGDYNGGFASKLMAKDLNLAVESAKLAGCKYPLTSQAQKIYTELCSVGHEAKDFSCAFRHYYSGIDEPHDQ

SEQ ID NO: 3811 - protein, 145 aa, Glycine max
MVENNLFEDIFRVEKLNPDDKKLFDKVTRIEARSEKFDMFMHLDINSEIYPLKVGQKFALVLVSTLNPDGTPDTGYYTQISRQSLANNFEYVMYGKLYRITEGSGREKAEMNISFGGLLMMLKGDTSHCNKFELDQRLYLLIRKV

SEQ ID NO: 3812 - protein, 426 aa, Glycine max
MSEKEKGNNSEGQSTLLHGKYELGRVLGHGTFAKVYHARNLNTGQHVAMKVVGKEKVIKVGMMEQVKREISVMKMVKHQNIVELHEVMASKSKIYIAMELVRGGELFNKVSKGRLKEDVARLYFQQLISAVDFCHSRGVYHRDLKPENLLLDEHGNLKVSDFGLTAFSDHLKEDGLLHTTCGTPAYVSPEVIAKKGYDGAKADIWSCGVILYVLLAGFLPFQDDNLVAMYKKIHRGDFKCPPWFSLDARKLVTKLLDPNPNTRISISKVMESSWFKKQVPRKVEEVVEKVDLEEKIENQETMNAFHIISFGSRFNLSPLFEEKRKEEMRFATAGTPSSVISRLEEVAKAGKFDVKSSETKVRLQGQERGRKGKLAIAADIYAVTPSFMVVEVKKDNGDTLEYNQFCSKQLRPALKDIFWNSAPASA

SEQ ID NO: 3813 - protein, 370 aa, Glycine max
  misc_feature (150)..(150): Xaa can be any naturally occurring amino acid
IIRAKKKKTKTTRERTWVQVQHRESVCVTGASGFIGSWLVMRLIERGYTVRATVRDPANMKKVKHLVELPGAKTKLSLWKADLAQEGSFDEAIKGCTGVFHVATPMDFDSKDPENEVIKPTINGLLDIMKACVKAKTVRRLVFTSSAGTXDVTEHPNPVIDENCWSDVDFCTRVKMTGWMYFVSKTLAEQEAWKYAKEHNIDFISVIPPLVVGPFLMPTMPPSLITALSLITGNESHYHIIKQGQFVHLDDLCLGHIFVFENPKAEGRYICCSHEATIHDIAKLLNQKYPEYNVLTKFKNIPDELDIIKFSSKKITDLGFKFKYSLEDMFTGAVETCREKGLLPKPEETTVNNELLPKPAETTVNDTMQK

SEQ ID NO: 3814 - protein, 298 aa, Glycine max
  misc_feature (76)..(76): Xaa can be any naturally occurring amino acid
LSLSLSLSLSLSLSLLSQTQIFAKIENVEGLTHFDEILQEADGIILSRGNLGIDLPPEKVFLFQKSALYKCNIRLXAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKVALDHGKSLGVIKSHDRVVVCQKLGDASVVKIIELED

SEQ ID NO: 3815 - protein, 527 aa, Glycine max
MPSSHLLLEEPIRMVSILEPSKPSFFSAMTKIVGTLGPKSRSVETISGCLKAGMSVARFDFSWHDPEYHQETLENLKAAIKSTKKLCAVMLDTVGAEMQVVNKSERAISLEANGLVVLTPDQGQEASSEILPINFDGLAKAVKKGDTIFIGQYLFTGSETTSVWLEVSEVKGQDVVCIIKNTATLAGSLFTLHASQIHIDLPTLTEKDQEVISSWGVKNKIDFLSLSYTRHAEDVRQAREFLSKLGDLSQTQIFAKIENVEGLTHFDEILQEADGIILSRGNLGIDLPPEKVFLFQKSALYKCNMAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKVALDHGKALGVIKSHDRVVVCQKLGDASVVKIIELED

SEQ ID NO: 3816 - protein, 275 aa, Glycine max
MSKEVSQQRKDYVDPPPAPLIDLAEIKLWSFYRALIAEFIATLLFLYVTVATVIGHKKQTGPCDGVGLLGIAWAFGGMIFVLVYCTAGISGGHINPAVTFGLFLARKVSLIRALFYMVAQCLGAICGVGLVKAFMKHSYNSLGGGANSVSAGYNKGSALGAEIIGTFVLVYTVFSATDPKRSARDSHIPVLAPLPIGFAVFMVHLATIPITGTGINPARSFGAAVIYNNGKVWDDHWIFWVGPFVGALAAAAYHQYILRAAAIKALGSFRSNPTN

SEQ ID NO: 3817 - protein, 198 aa, Glycine max
MLGTFDFAENTRAAYPIEYIPNAKIPCVAPHAKNVILLACDAFGVLPPVSKLNLAQTMYHFISGYTALVAGTEDGIKEPQATFSACFGAAFIMMPPTKYAAMLAEKMQKHGATGWLVNTGWSGGSHGLGNRIKLAYTRKIIDAIQSDKKTYQDTLLKLASLFKKNFDGFSRLQDRRGSIVDYRDCLCWSYILMTAFPI

SEQ ID NO: 3818 - protein, 672 aa, Glycine max
  misc_feature (641)..(641): Xaa can be any naturally occurring amino acid
METITENGSDGVSLARNTSNNARRGLPMIQTNMKPTDSEFQVCHDDSTPPVRAQTIHELHSLQKKKSTPSTPLSATQGPFATVSDEERQKQQLQSISASLASLTRESGPKVVKGDPATKAEKGTHVHHHPQPHYFASTAFDVSDSALKFTHVLYNLSPAELYEQAIKHEKGSFITATGALATLSGAKTGRSPRDKRVVRDDTTEHDLWWGKGSPNIEMDEHTFLINRERAVDYLNSLEKVYVNDQFLNWDPEHRIKVRIVSARAYHSLFMHNMCIRPTPEELEEFGTPDFTIYNAGQFPCNRYTHYMTSSTSIDINIARKEMVILGTQYAGEMKKGLFGLMHYLMPKRNILSLHSGCNMGKDGDVALFFGLSGTGKTTLSTDHNRYLIGDDEHCWSENGVANIEGGCYAKCVDLSKDKEPDIWNAIKFGTVLENVVFDEHTREVDFSDKSVTENTRAAYPIEYIPNAKIPCVAPHAKNVILLACDAFGVLPPVSKLSLAQTMYHFISGYTALVAGTEDGIKEPQATFSACFGAAFIMMHPTKYAAMLAEKMQKHGATGWLVNTGWSGGSYGLGNRIKLAYTRKIIDAIHSGSLLNAQYTKTEVFGLEIPTALEGVPSEILDPVNTWSDKKAYQDTRLKLAXLFKKNFDGFTTYKIGGDQKLTEEIVSAGPIF

SEQ ID NO: 3819 - protein, 119 aa, Glycine max
MHDFCFTIPYGLMLVGGGLFAYISKGSIASLAGGAGSGLLLIVAGYLSLNAFGKRKNSYLALFLETVCAAILTWVMGQRYLETSKIMPAGLVAGISALMTLFYLYKLATGGNHLPTKAE

SEQ ID NO: 3820 - protein, 116 aa, Glycine max
  misc_feature (31)..(32): Xaa can be any naturally occurring amino acid
  misc_feature (104)..(104): Xaa can be any naturally occurring amino acid
FLSPKTNSILSVGPGPLDYISTGSIGSLAGXXGSGLLLIVAGYLSLNAFGKRRNSSLALFLETGWATKLTLVMGQPNFGTFQHNPSCPGGGNNCIKTLFYFYKXATGGNHLPTKAE

SEQ ID NO: 3821 - protein, 398 aa, Glycine max
MACPAMANGNGSLKNLKLNDTKGKTITCKAAVVYGPGEPFVVENILVHPPQKMEVRIKILYTSICHTDLSAWRGVNEAQRAYPRIFGHEASGIVESVGEGVSEVEEGDIVVPIFNGECGECSMCKCEKTNLCERFGVDATKKVMEGDGTTRFSTVHGKPIFHFLNTSTFSEYTVVDSACVVKFVSTDHSLSIKNLTLLSCGVSTGVGAAWNTANVHSGSTVAVFGLGAVGLAVAEGARARGASKIIGVDINPDKFIKAMGVTNFINPKDEEKPVYERIREMTDGGVHYSFECTGNVDVLRDAFLSAHEGWGLTVVLGIHASPTLLPIHPMELFDGRNIVGSVFGGFKGRSHLPHFAKQCGQGVVKLDNFITHELPLEEIDKAFDLLITGKSLRCLLHF

SEQ ID NO: 3822 - protein, 87 aa, Glycine max
  misc_feature (12)..(12): Xaa can be any naturally occurring amino acid
  misc_feature (26)..(26): Xaa can be any naturally occurring amino acid
MGTTACFIIVSXNDIPIYEAAPCYLXQREDAAQLHQFILHAALDIVQDLAWTTSAMYLKSVDRFNELVVSVYVTAGHILYTWDSFIV

SEQ ID NO: 3823 - protein, 125 aa, Glycine max
  misc_feature (60)..(60): Xaa can be any naturally occurring amino acid
  misc_feature (65)..(65): Xaa can be any naturally occurring amino acid
  misc_feature (71)..(71): Xaa can be any naturally occurring amino acid
  misc_feature (80)..(80): Xaa can be any naturally occurring amino acid
ARDYCILHQIYNILQFHATLRQREDSAQLHQFILHAALDIVQDLAWTTSAMYLKSVDDTXELLCXIYVTAXHFFFKELMXCRRESNFICMFGKLQTLLNPLYLPGSRITSSHFDTKVRALARKYL

SEQ ID NO: 3824 - protein, 672 aa, Glycine max
  misc_feature (183)..(183): Xaa can be any naturally occurring amino acid
  misc_feature (228)..(228): Xaa can be any naturally occurring amino acid
MELTVFSLFFFFFTFHLPSCFSGQSSSMESVPDLQNTMYASIDGYPCVRLMNLSGTIGCSNPGRDKVVAPILRFENVDKIAEPSAILVSLDEFPTLFTRISDDSSFASKVLGVLVEPTGDVQNKLKGFSPDQKFPQAQFALYHNTSYQWNSIGSGIMWKSYKFPVFLLTESGSKTLQEFVTKXRTKKKSYTSNVAEFDLVMQTVKSGTHDSESCLKEETCLPLGGYRXSVWSSLPPINISSLQRSKPILLTVASMDSASFFRDKSLGADSPISGLIALLAAVDALSHLDGLGDLSKQLVFAVFTGEAWGYLGSRRFLVELDMHSDAVHGLNQTLIETVIEIGSVGKGLSQGVKNFFAHTKGDSSATNQTVAALKRAQESLISENIKIASASASNPGIPPSSLMSFLEKNPAISGVVLEDFDSVFVNKFYHSHLDDLSNVNSSAVVAAASLIARTLYMLASETEDVQNSTLAAINVNVSLVEQLLGCLLDCDPGLSCELVKKYISPMSTCPSHYVGVILDEPLSAPYAGYINDVPRFIWNFLADRTSIPRENNISDCQHGCNGRDEVCVKAETDGKGVCVLSTTRLMYTPYSTRLKFESGVWNVLPPNSSDKMGVVDPVWTESNWNTIGMRVYTVQNAAYDRLVLFGGITLTVFAYLAIATARAFFNKAMKRD

SEQ ID NO: 3825 - protein, 423 aa, Glycine max
MARKKIREYHSKRLLKEHLKRLASIDLQILSAQVTESTDFTELTDQHPWLSSTRLVVKPDMLFGKRGKSGLVALNLDIAQVAEFVKARLGVEVEMGGCKAPITTFIVEPFVPHDQEFYLSIVSERLGSTISFSECGGIEIEENWDKVKTIFLPTEKPLTPEACAPLIAILPLEIRGTIGDFIMGVFAVFKDLDFSFLEMNPFTLVNEKPYPLDMRGELDDTAAFKNFNKWGNIEFPLPFGRILSPTESFIHSLDDKTSASLKFTILNPKGRIWTMVAGGGASVIYADTVGDLGYASELGNYAEYSGAPNEEEVLQYARVVIDCATEDPDGRKRALLIGGGIANFTDVAATFNGIIRALKEKESKLKAAQMHIYVRRGGPNYQTGLAKMRALGEELGVPIQVYGPEATMTGICKQAIDCIMSEA

SEQ ID NO: 3826 - protein, 456 aa, Glycine max
MDHVIGGKFKLGRKIGSGSFGELYLGVNVQSGEEVAVKLESVKTKHPQLHYESKLYMLLQGGTGIPHLKWFGVEGDYNVMVIDLLGPSLEDLFNYCNRKLSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYLLMYFLRGSLPWQGLRAGTKKQKYDKISEKKMLTPIEVLCKSYPLEFTSYFHYCRTLRFEDKPDYSYLKRLFRDLFIREGYQFDYVFDWTMLKYPQIGSSSRARPSGKPVINPGQSGERIERPSGGFSGAVEAFARRNGSGLVLQSEHSRHRSSDDVPSSKDVQADSERPRSSSRNGSSSKKPVLSSSRPSSSGEPSESRSSRLVLSSGRLSTTQRLQPGFESKTSLSRASATRGGRDDTLRSFELLSLGSGKRK

SEQ ID NO: 3827 - protein, 236 aa, Glycine max
MATLDERPSAKRWLPLEANPDVMNQFLWGLGLPVDEAECGDVFGLDEELLEMVPKPVLAVLFLYPITAKSEEERLQQENVKKDYSSKVYFMKQTVGNACGTIGLLHALGNITSEVKLVEGSFFDKFFKSTASMDPLQRAVFLENDREMEVAHSVAATAGDTVASDNVDTHFICFACVDGELYELDGRKSGPISHGPSSPSTLLRDAAKVIQSMIQKNPGSLNFNVIAISKKSKDGH

SEQ ID NO: 3828 - protein, 176 aa, Glycine max
MPSGSRDPLVVGGVIGDVLDPFEYSIPMRVTYNNRDVSNGCEFKPSQVVNQPRVNIGGDDLRNFYTLIAVDPDAPSPSDPNLREYLHWLVTDIPATTGASFGHEVVTYESPRPMMGIHRLVFVLFRQLGRETVYAPGWRQNFNTKEFAELYNLGLPVAAVYFNIQRESGSGGRRLY

SEQ ID NO: 3829 - protein, 437 aa, Glycine max
MAINSSKNPDGSVQNAMPSYFYSPPLDVSAAFPQATPASTFPPCASDYFQLDNLLTAEEQAIRKKVRECMEKEIAPIMTEYWEKAKFPFHVIPKLGALRIAGGTIKDYGCPGLSITGSAIAVAEVARVDASCSTFILVHSSLAMLTIALCGSEAQKQKYLPSLAQLQTVACWALTEPDYGSDASALKTTATKVEGGWILEGQKRWIGNSTFADVLVVFARNASTNQINGFIIKKDAPGLTVTKIENKIGLRIVQNGDIVMRKVFVPDEDRIAGVNSFQDTNKVLAVSRVMVAWQPIGISMGIYDMCHRYLKERKQFGAPLAAFQISQQKLVQMLGNIQAMILVGWRLCKLYESGKMTPGQASLGKSWITLRARETAALGRELLGGNGILADFLVAKAFCDLEPIYTYEGTYDINTLVTGREVTGFASFKPVAQRSRL

SEQ ID NO: 3830 - protein, 325 aa, Glycine max
MKAIVITRPGGPEVLQLEEVEDPQVGDDELLIGVHATSLNRADTFQRKGSYPPPKGASPYLGLECSGTVLSLGKNVSSWKIGDQVCALLAGGGYAEKVAVPVGQVLPVPAGVSLTDAASFPEVACTVWSTVFMMSRLSQGETLLVHGGSSGIGTFAIQIAKYRGSRVFVTAGSEEKLAFCKSIGADVGINYKTEDFVARVKEETGGQGVDVILDCMGASYYQRNLDSLNFDGRLFIIGFQGGVSTQADLRPLLAKRLTVQGAGLRNRSLENKAVIVSEVEKNVWPAIAEGKVKPVVYKSFPLSEAAEAHQLMESSQHIGKILLLP

SEQ ID NO: 3831 - protein, 513 aa, Glycine max
MHTLLRSTLRTKTASSLAYAVVSRSAHENLLQAPLLSRSNSTEASLAKDNSSNDVKNGQGYKGHSMLAPFTAGWQSSDLHPLIIEKSEGSYVYDINGKKYLDALAGLWATSLGGSEPRLVDAAVAQLKKLPFYHSFWNRTTLPSLDLAKELLEMFTARKMGKAFFVNSGSEANDTQVKLVWYYNNALGRPDKKKFIARAKSYHGSTLIAASLSGLPALHQKFDLPAPFVLHTDCPHYWRYHLPGETEEEFSTRLANNLEQLILKEGPETIAAFIAEPVMGAGGVIPPPSTYFEKVQAVVKKYDILFIADEVICAFGRLGTMFGCDKYNIKPDLVSLAKALSSAYLPIGAVLVSPEISEVIHDQSNKLGSFSHGFTYSGHPAACAVAIEALKIYKERNIVDQVNKIAPRFQDGIKAFSDSPIIGEIRGTGLILGTEFTDNKSPNDPFPPEWGIGAYFGAQCEKHGMLVRVAGDNIMMSPPYIISPGEVEELISIYGKALKETEKKVQELKSQRK

SEQ ID NO: 3832 - protein, 234 aa, Glycine max
  misc_feature (41)..(41): Xaa can be any naturally occurring amino acid
MGVTPKIAPSMLSSDFANLASEAQRMLHFGADWLFRAEWVXMDIMDGHFVPNLTIGAPVIESLRKHTKGYLDCHLMVTNPLDYVEPLAKAGASGFTFHVETSKDNWEELIQRIKSHGMTPGVALKPGTPIEEVYPLVEAGNPVEMVLVMTVEPGFGGQKFMPEMMDKVRILRKKYPSLDIEVDGGLGPSTIDVAASAGANCIVAGSSVFGAPEPVQVISLLRNSVEKAQQTLIQ

SEQ ID NO: 3833 - protein, 738 aa, Glycine max
MKNLWLCFSYLFPAAIILVLLTPSSVAQLSPSEGRILFQVQKLLEYPQALQGWNRWTNLCFLPSSPSLKIVCSNGHVTELTIIGNKTSPSLHNPKESAWTSLQTLSGRFSIDSFFTVMTKLSNLKMLSLVSLGLWGPLPAKINRFWSLEVLNISSNFIYGGIPQSLSSMRNLRSLVLVDNLFNGSVPDLQRLTSLEELNLGGNNLGAQFPSVGKNLVTIMLRNNSLRSHIPPQLVHFDKLQVFDVSSNDFFGNIPSFIISLPSLQYLNLASNHLSGNLSVNMACSSSLTFVDISHNLLVGKLPSCFGSMSSKAKVLYSGNCLSTKNRLNDQQHPFSFCKREGALAVKPPAKNLKKESNLGTKLGLMLGIIVGIVVIGGLLVLLVVCIIRKSKAERSPHKMDKSVANKYSTSVSPRPIGTRHIPQAMKQAAVGLPPYRIFTSEEIEDATNNFDPSNLIEEGSQGQLYKGWLRDGSVVLVNCVKIKQKGLPHSIMQQVEVLHNLRHRHMVSVLGHCVITEQEHPQTTSTVFIVFEYISNVSLRDQLSDGRKREMLKWPQRMAMSIGIARGVQFLHTGVAPGIYGNNLKIENILLDDSLNAKVSRYNIPLPSKSAHNEQNATNHISSTNNTEKEDIYQLGVILLEVITGKQITSSSEIEELKEELENGSPEATSVIRSAIDPTLRGTYAYESMKTAVQITINCLSKVSSQRPSIEDVLWNLQYAMQVQESWTSSGNLSTKL

SEQ ID NO: 3834 - protein, 373 aa, Glycine max
  misc_feature (216)..(216): Xaa can be any naturally occurring amino acid
  misc_feature (241)..(241): Xaa can be any naturally occurring amino acid
  misc_feature (247)..(247): Xaa can be any naturally occurring amino acid
  misc_feature (267)..(267): Xaa can be any naturally occurring amino acid
  misc_feature (283)..(283): Xaa can be any naturally occurring amino acid
  misc_feature (298)..(298): Xaa can be any naturally occurring amino acid
  misc_feature (311)..(311): Xaa can be any naturally occurring amino acid
MASPLLTPYKMGKFNLSHRVVLAPLTRQRSYDNVPQPHAILYYSQRTSNGGLLITEATGVSDTAQGYPQTPGIWTKDHVQAWKPIVDAVHAKGGVFFCQIWHVGRVSDSVYQPNGQAPISSTDKPLTPQIRSNGIDQVQFTPPRRLRTDEIPHIVNDFRLAARNAIEAGFDGVEIHGAHGYLLEQFMKDKVNDRTDEYGGSLENRCRFALEVVEAXVVNEIGAHRVGIRLSPFAEYSDVGXESNPNXLMLYMLKALNKNAILYNYLXDKYYTLDADIRNTDNXLLCIRKALNGTIIGXSRHVLQNVIIAVXKYRAVLVAYCRWFLANPDLPKRFALNAPLNKYHRETFYTSDPVLGYTDYPFLDDEESNAVAS

SEQ ID NO: 3835 - protein, 539 aa, Glycine max
MASSLRISRLLSRSFLSASTTTPLFSRGGSGALGAGLSKFSTAAAIEEPIKPPLKVEHTQLLIDGKFVDAATGKTFPTLDPRTGDVISHVAEGDHEDVDRAVAAARKAFDRGPWPKMTAYERQRILLRAADLFEKHNDELAALETWDNGKPYEQSAQIEIPMLVRLFRYYAGWADKIHGLTVPADGPYHVQTLHEPIGVAGQIIPWNFPLVMFAWKVGPALACGNTIVLKTAEQTPLSALYASKLFHEAGLPAGVLNVISGFGPTAGAAIASHMDIDKLAFTGSTETGKIVLELAARSNLKPVTLELGGKSPFIVCEDADVDEAVELAHFALFFNQGQCCCAGSRTFVHERVYDEFIEKAKARALKRAVGDPFKGGIEQGPQIDSEQFQKILKYIRSGVESGATLETGGDRFGNSGFYIQPTVFSNVKDDMLIAKEEIFGPVQSILKFKDLDDVIQRANNTHYGLAAGVFTKNINTANTLTRALRAGTVWVNCFDTFDAAIPFGGYKMSGQGREKGEYSLKNYLQVKAVVTSLKNPAWL

SEQ ID NO: 3836 - protein, 119 aa, Glycine max
  misc_feature (24)..(24): Xaa can be any naturally occurring amino acid
  misc_feature (31)..(31): Xaa can be any naturally occurring amino acid
RPRVRPKISVAAYFNKRHTERNQXTSYSITXTDVCIGWPGSMPDDQVLEKSALFQRANGGLLKADWIAGSSGYPLMDWVLVPYSQQNLTWTQHAFNDKIGEVQKVARDAFALLKGMWNC

SEQ ID NO: 3837 - protein, 538 aa, Glycine max
  misc_feature (334)..(334): Xaa can be any naturally occurring amino acid
MKLPTTFADPESLSYLYTLLQSSFDQMNDPTNNNTSTTGRKRRRKNEDDDDDDDDGDDDGSSNNNNNNNNKRSKKKKEELKGILTSILLLDEQEKLEQQQNNKVSEEEKFSLETNHKKKTKAMLHYYSNLDEYYSHVEESERVKRKKSRGMARAVAVAVAACEREGEGGGGSAEGGKSGAGGSQRRLWVKDRSGAWWDECNKEDFPEEDFKKAFRMGRETFDMICEELNSAIVKEDTTLRNAIPVRQRVAVCLWRLATGDPLRIVSKRFGLGISTCHKLVLEVCTAIKSVLMPKYLNWPDEVALRRVKSEFEGVSGIPNVVGSMYTSHVPIIAXVPKISVAAYFNKRHTERNQKTSYSITVQGVVDHRGVFTDVCIGWPGSMPDDQVLEKSALFQRANGGLLKGDWIVGSSGYPLMDWVLVPYSQQNLTWTQHAFNEKIGEVQKVARDAFARLKGRWSCLQKRTEVKLQDLPVVLGACCVLHNICELKGEKIDPELKVDLMDDEMVPEVALRSMSSMKTRDAIAHNLLHHGLAGTSFL

SEQ ID NO: 3838 - protein, 90 aa, Glycine max
IDPRREFPSLFKQPSPLLVNWACSWLRVEIPKVQPQFKPPFLGFTKTAEVWNSRACMIGIIGVFIVEFIINKGILQVIGVDVGKGLNIPL

SEQ ID NO: 3839 - protein, 527 aa, Glycine max
MEISQIPFFTQEDYSHFYNLYEDTDSNNSLNNNNSNNKRKRNNRKEEGSGGGAEQKGHNGNNNNENSESNLKDLLASLIMLDEEEIQEERNRKVEYEQHRNMYNANFENQTRAMNTYKAQFEAHYAQSEEFEQTITKKARRAVAAATGTGSVMLYESGSVQVQPRTDSEPGSTVQRRLWVKDRSKDWWEKISRKDFPEEEFRRWFRMSRSTFDMICDELDAAVTKKNTMLRDAIPVRQRVAVCIWRLATGDPLRLVSKRFGLGISTCHKLVLEVCSAIRTVLMPKFLQWPNEEKTKQIKDEFEKISGIPNVGGAMYTTHVPIIAPKISVSAYFNKRHTERNQKTSYSITVQGVVDSKGVFNDVCIGWPGSMPDDRVLEKSALFQRASRGNLKGVWIVGNSGHPLMDWVLVPYTHANLTWTQHAFNEKIEEIQGVAKEAFARLKGRWGCLQKRTEVKLQDLPVVLGACCVLHNICEMRNEEMDDEWRFQIFDDEMLPENGIRSSASLQARDHIAHYLLHHGRAGTGFF

SEQ ID NO: 3840 - protein, 280 aa, Glycine max
HASAYVGHPNPLKEGQDLFRKGLLSEAVLALEAEVLKNPENAEGWRLLGIAHAENDDDQQAIAAMMRAQEADPTNLEVLLALGVSHTNELEQTAALKYLYGWLRHHPKYGTLAPPEMADSLYYADVARLFNDAAELSPDDADVHIVLGVMYNLSREYDKAIASFERALKLKPQDYSLWNKLGATQANSVQSADAIMAYQQALDLKPNYVRAWANMGISYANQGMYDESVRYYVRALAMNPKAENAWQYLRISLSCASRNDMLEACDSRNLDLLQKEFPLQ

SEQ ID NO: 3841 - protein, 253 aa, Glycine max
IRLEAIPSSLHPSLFSGWRLLGIAHAENDDDQQAIAAMMRAQEANPTNLEVLLALGVSHTNELEQTAALKYLYGWLRHHPKYGTLAPPEMADSLYYADVARLFNEAAELSPDDADVHIVLGVMYNLSREYDKAIASFERALKLKPQDYSLWNKLGATQANSVQSADAIMAYQQALDLKPNYVRAWANMGISYANQGMYDESIRYYVRALAMNPKAENAWQYLRISLSCASRNDMLEACDSRNLDLLQKEFPLQ

SEQ ID NO: 3842 - protein, 278 aa, Glycine max
FFFIQARSLSLRSIQTLFLFFTIPILWRRFALEVLGKNGCLVEGVLHLPGNPPVKLDSQDLLQIGDKEFYFLLPVRSILVGPVGPRHYPNHAAPGPVVPHYNNYHLGPGPVKKAPRREYYEEEFDDEDDVGGRKMRRDGYDGYGYAGGKSSLSAPMDKKSEGRSRVDRDADNLQLQQLEEKDVVSSVATVLSDLCGPGEWMPMEKLHTELLEQYSSVWHHNRVRRYLTSEDWPGPESKGKPWYGLLMLLRKYPEHFVINTRSKGRVTLEFVSLVSLIS

SEQ ID NO: 3843 - protein, 320 aa, Glycine max
  misc_feature (156)..(156): Xaa can be any naturally occurring amino acid
MSTAAAAGGDMEAGFAKLQGEDFEYYMQTYSIVLGRNSKKSTVDVDLSSLGGGMNISRHHARIFYDFARRRFALEVLGKNGCLVEGVLHLPGNPPVKLDSQDLLQIGDKEFYFLLPVRSILGGPVGPRHYPNHATPGPVVPHYNNYHLGPGPVKKXREREYYEEEFDDEDDVGGRKMRRDGYDGYGYAGGKSSLSAPMDKKSEGRSRVDRDADNLQLQQLEEKDVVSSVATVLSDLCGPGEWMPMEKLHTELLEQYSSVWHHNRVRRYLTSEDWPGPESKGKPWYGLLMLLRKYPEHFVINTRSKGRVTHEFVSLVSLLS

SEQ ID NO: 3844 - protein, 501 aa, Glycine max
MTSLTNGDAGSLNKVPTIKFTKLFINGDFVDSLSGKTFETIDPRTGDVIARISEGDKEDIDIAVKAARHAFDNGPWPRLPGSERARILLKWAEIIEENAEELAALDAIDAGKLYHMCRNVEVPAAANTLRYYAGAADKIHGEVLKMSREFHAYTLLEPLGVVGHITPWNFPNTMFYIKVAPSLAAGCTMVLKPAEQTPLSALFSAHLAKLAGIPDGVINVVPGFGPTAGAALSSHMDVDKVSFTGSTQTGRVIMQAAAKSNLKQVSLELGGKSPLIIFDDADIDKATELALLGILYNKGEVCVASSRVFVQEGIYDEFEKKLVEKAKAWVVGDPFDPKVQQGPQVDKEQFEKVLSYIEHGKKEGATLLTGGKTVGNKGYFIEPTIFSNIREDMLIAQDEIFGPVMALKKFKTIEEAIKSANNTKYGLAAGIVTKNLDTANTVSRSIRAGTIWINCYFAFGDDVPFGGYKVSGFGKDHGLEALHKYLQVKSVVTPLYNSPWL

SEQ ID NO: 3845 - protein, 501 aa, Glycine max
MATRVVAEQKPKTKIVCTLGPASRSVPMIEKLLRAGMNVARFNFSHGSHEYHQETLDNLRAAMENTGILCAVMLDTKGPEIRTGFLKDSKPIQLKQGNEITISTDYDLKGDEKTICMSYKKLPEDVRPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVRTMAKICIEAESTLDYGDVFKRIMEHSPVPMSPLESLASSAVRTANSARAALILVLTRGGSTAKLVAKYRPGMPILSVVVPELKTDTFDWACSDEAPARHSLIFRGLVPVLSAASARASHAETTEEAIEFAMQHAKSKGLCHNGDSVVALHRVGTASVIKILTVK

SEQ ID NO: 3846 - protein, 501 aa, Glycine max
MTGGGITMQSTPGSSGYLDLYPERKMSFFKNPYILGLAAVAGIGGLLFGYDTGVISGALLYIKDDFEEVRNSNLLQETIVSMAIAGAIVGAALGGWINDAYGRKKATLFADVIFTAGAIIMASAPDPYVLILGRLLVGLGVGIASVTAPVYIAEASPSEIRGSLVSTNVLMITGGQFLSYLVNLAFTGVPGTWRWMLGVSGVPAVVQFVLMLFLPESPRWLFVKNRKNEAVDVLSKIFDVARLEDEVDFLTAQSEQERQRRSNIKFWDVFRSKEIRLAFLVGAGLLAFQQFTGINTVMYYSPTIVQMAGFHANELALLLSLIVAGMNAAGTILGIYLIDHAGRKKLALSSLGGVIVSLVILAFAFYKQSSTSNELYGWLAVVGLALYIGFFSPGMGPVPWTLSSEIYPEEYRGICGGMSATVCWVSNLIVSETFLSIAEGIGIGSTFLIIGVIAVVAFVFVLVYVPETKGLTFDEVEVIWRERAWGKNPNTQNLLEQGSSS

SEQ ID NO: 3847 - protein, 490 aa, Glycine max
MAFTALSLVLLLQLSTIFGSEVVLQSKDCGSDWVAHSYSSHGQDLFYINGNVVNKVAFCEALKLYIAKGCDVKDYFGSVKCVMDDSFGRKLLKDLSSESTPQRDSKPMSSNVVVIGAGGALLVCCAVLCPCFYAKRRKATSHAVLSKDPNSMDSVSSEASVNDKIPASPLRVPPSPSRFSMSPKLTRLQSLHLNLNQVTRATQNFSETLQIGEGGFGTVYKAKLEDGLVVAVKRAKKEHFDSLRTEFSSEIELLAKIDHRNLVKLLGYIDKGNERLLITEFVPNGTLREHLDGMRGKILDFNQRLEIAIDVAHGLTYLHLYAEKQIIHRDVKSSNILLTESMRAKVADFGFARLGPVNTDQTHISTKVKGTVGYLDPEYMKTYQLTPKSDVYSFGILLLEIVTARRPVELKKTVAERVTLRWAFRKYNEGSVVELVDPLMEEAVNGDVLMKMLDLAFQCAAPIRTDRPDMKSVGEQLWAIRADYLKSARR

SEQ ID NO: 3848 - protein, 287 aa, Glycine max
LQSLHLNLNQVTRATQNFSETLQIGEGGFGTVYKAKLEDGLVVAVKRAKKEHFDSLRTEFSSEIELLAKIDHRNLVKLLGYIDKGNERLLITEFVPNGTLREHLDGMRGKILDFNQRLEIAIDVAHGLTYLHLYAESMRAKVADFGFARLGPVNTDQTHISTKVKGTVGYLDPEYMKTYQLTPKSDVYSFGILLLEIVTGRRPVELKKTVEERVTLRWAFRKYNEGSVVELVDPLMEEAVNGDVLMKMFDLAFQCAAPIRTDRPDMKSVGEQLWAIRADYLKSARRE

SEQ ID NO: 3849 - protein, 428 aa, Glycine max
MENNNNNHNLIVPNPQDSLWMMNLRTGETMDSGSYPERPGEPDCSYYMRTGLCRFGATCRFNHPPNRKLAIATARMIGEFPERIGQPECQYYLKTGTCKFGATCKFHHPKDQAGIAGRVALNILGYPLRPNEPECTYYLRTGQCKFGNTCKFHHPQPSNMMLSLRGSPVYPTVHSPTTPGQQSYAGGITNWSRGSYIPSPRWQGPSSYAPLILPQGVVSVPGWSAYSGQMGSISTSDSPQQAMRNGQTYGTSRQGELAGSQGAYSQFRSGTVPVGFYTLQRENIFPERPGQPECQFYMKTGDCKFGAVCRFHHPQERLVPAPNCVLSPIGLPLRPGEPLCVFYSRYGICKFGPSCKFDHPMEIFSHNISASPSADAPSRHLLGSSSGTAALNLSSEGLVESSSAKPRRLSLSETRQIPSGDDDIDDDG

SEQ ID NO: 3850 - protein, 309 aa, Glycine max
MAATSTSLASQLYIGLRRPCLKLDSFNSQSFSLFDPNLRLSLSPPKPSRAVIAMAGTGKFFVGGNWKCNGTKDSISKLVADLNNAKLEPDVDVVVAPPFLYIDQVKNSLTERIEISAQNSWVGKGGAFTGEISAEQLKDLGCKWVVLGHSERRHVIGENDEFIGKKAAYALSQGLGVIACIGELLEEREAGKTFDVCFQQLKAYADAVASWDNIVIAYEPVWAIGTGKVATPQQAQEVHVAVRDWLKKNVSDEVASKTRIIYGGSVNGGNSAELAKQEDIDGFLVGGASLKGPEFATIVNSVTSKKVAA

SEQ ID NO: 3851 - protein, 375 aa, Glycine max
  misc_feature (111)..(111): Xaa can be any naturally occurring amino acid
MSAVESAEHNNIRGVPTHGGRYVQYNIYGNLFEVSRKYVPPIRPVGRGAYGIVCAAVNAETGEEVAIKKIGNAFDNRIDAKRTLREIKLLRHMDHANIMSIKDIIRPPQRXNFNDVYLVSELMDTDLHQIIQSNQQLTDDHCRYFLYQLLRGLKYVHSANVLHRDLKPSNLLLNANCDLKIADFGLARTTSETDFMTEYVVTRWYRAPELLLNCSEYTAAIDIWSVGYILGEIITRQPLFLGKDYVHQLRLITELIGSPDDASLGFLRSDNARRYVKQLPQYPKQNFSARFPNMSPGAVDLLEKMLKNIFDPNRRITVDEALSHPYMAPLHDINEEPVCTRPFSFDFEQPSFTEEDIKELIWRESVKFNPVPPVY

SEQ ID NO: 3852 - protein, 388 aa, Glycine max
MALESAPASADIRGVPTHGGGYVQYNIYGNLFEVSRKYVPPIRPVGRGAYGIVCAAVNAETDEEVAIKKIGNAFDNRIDAKRTLREIKLLRHMEHENVIALKDIIRPPQRYNFNDVYIVYELMDTDLHQIIQSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFLGKDYVHQLRLITELIGSPDDTSLGFLRSDNARRYVKQLPQYPKQNFSARFPDMSPGAVDLLEKMLIFDPNRRMTVEEALCHPDVAPLITVDEALSHPYMAPLHDINEEPVCTRPFSFDFEQPSFTEEDIKELIWRESVKFNPVPPVY

SEQ ID NO: 3853 - protein, 373 aa, Glycine max
MSAVESAEHNNIRGVPTHGGRYVQYNIYGNLFEVSRKYVPPIRPVGRGAYGIVCAAVNAETGEEVAIKKIGNAFDNRIDAKRTLREIKLLRHMDHANIMSIKDIIRPPQKENFNDVYLVSELMDTDLHQIIRSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFPGKDYVHQLRLITELIGSPDDASLGFLRSDNARRYVKQLPQYPKQNFSARFPTMSPGAVDLLEKMLIFDPNRRITVDEALSHPYMSPLHDINEEPVCTRPFSFDFEQPSFTEEDIKELIWRESVKFNPATIYV

SEQ ID NO: 3854 - protein, 632 aa, Glycine max
LGTVHSHSSTKQGNNDIESGTQTVTSSQVASCSANSKSGLKTSVLKVVDQFRGSNLSKHFPLAVGSDIAGRHNDKSFFPYELFVKLYNSNKVELCPFGLINWGNRWYANAVLQCLAFTPPLTAYLLQGSHSKSCANKKWCFTCEFERLILKSKDTKSAVSPMGIISHLQNIGSQLANGREEDAHEFLRHVIDTMQSVCLMEAGVNALGSLEEDTTLMGQTFGGYLLSKIKCMRCGGKSERQERMMDLTVEIEGEITTLVEALRRFTSTETLDGENKYHCVRCKSYEKAKTDAWVSEAPNVLTVALKRFQSGKFGKLNKPIQFPEILNLAPFMSGTSDKSPIYRLYGVVVHLDIMNAAFSGHYVCYVKNIQNKWFKVDDSVVTAVELDRVLTKGAYMLFYARCSPRAPRLIRNRILSPDSKRKVSGKTLTTKARSISTNSGVAEHVNSSISPDDSPALDSFYSKFHHLKRILEEDSSSDNSSLISSNSDEGSCSTDSTRDSTSTDDFSEYLFGDSGNGWSSVWRNSDSDTSSSSSSSPLNLRHSPLSDMDRYDSVSPDAEGSRGIDVSRLSSNTTLQHRKLDSRISSNSSSSRETDSCLKLGSNHFNDIDYGVLCRKPRKRTDLYFINREFRS

SEQ ID NO: 3855 - protein, 380 aa, Glycine max
  misc_feature (309)..(309): Xaa can be any naturally occurring amino acid
NSAETEMEGEKENPDGNAALVNSFCEITSSSKEEALFFLESHNFDLDAAVSTFLDNANNPLIPLNDDLAIPNPNAVSPPSDSHSPDFNPSRSPSPSPSPTRTPYELRSRRSLGKKPSTSRQGKIRTLGDLKRPSRDDDDSGSDPDFEPDEYYTGGEKSGMLVRDPTRGNNNNNLDDIFDQARQVAVDAPPENPRSSSRSRSFSGTARLLSGETVPSAPQRVEEVTHTVIFWRNGFSVNDGPLRRLDDPQNAPFLESIKKSECPYVLDPADRRTAVHVNLTRRDEDYPVFPFLFSSLLWFFFFFIYHPIXGFYLFFFLLLICMQEPVKPRQRAFQGVGRTLGSTSSSNDEPIQTTGASPNTAPMPTMGLVVDESQPVTSIQ

SEQ ID NO: 3856 - protein, 441 aa, Glycine max
LWHIFLFFRKILMDSSQSAALGGNGGSGGNGTLISQINDMAASATGADDSMQKLNQVSNSIQKTLGLIHQLYLTVSTFNAAFQMPLLQRINGLVAELDNMVKLAEKCNIQVPMEVVNLIDDGKNPDEFTKDVINSCIAKNQITKGKTDALKSLRKHLLEELEQNFPDEVETFKKSRTAAAAELKRQAQESALPNGNVRVKSTTSGRRRAGNRKEPSSTLAIADYTYPLRRQVQTGAKKLVTMVSSDKDPREEVLQAWYMDDSDEDQRLPHHKEPKEFVSLDQLAELGVLSWKLDADNHENDPELKKIREERGYTYMDVCEVCPEKLPNYEQKIKSFFEEHLHTDEEIRFCAAGSGYFDVRDCNDAWIRVWVKKGGMIILPAGIYHRFTLDESNYIKALRFFVGEPVWTPHNRPNDHLPARQQYVKDFVEKDVGNHAVDAAA

SEQ ID NO: 3857 - protein, 496 aa, Glycine max
  misc_feature (83)..(83): Xaa can be any naturally occurring amino acid
  misc_feature (99)..(99): Xaa can be any naturally occurring amino acid
  misc_feature (121)..(121): Xaa can be any naturally occurring amino acid
MESAALSRIGLAGLAVMGQNLALNIAEKGFPISVYNRTASKVDETVDRARNEGSLPLTGQYTPRDFVLSLQRPRSVIILVKGXAPPVDQTIAALSDHLXPGDCIIDGGNEWYENTERRMSXVADKGLLYLGMGVSGGEDGARHGPSLMPGGSHQAYSNVQDILHKIAAQVEDGPCVTYIGEGGSGNFVKMVHNGIEYGDMQLISEAYDVLKHVGGLSNSELADIFAEWNRGELESFLIEITADIFKVKDEDGEGFLVDKILDKTGMKGTGKWTVQQAAELSIAAPTIAASLDCRYLSGLKEERESAAAVLKEAGLSDELGRVSVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARKSGTGVGALN

SEQ ID NO: 3858 - protein, 306 aa, Glycine max
  misc_feature (171)..(171): Xaa can be any naturally occurring amino acid
MSKEEFLKIQKCVLKVNIHCDGCKHKVKKILQKIDGVFTTEIDAEQGKVTVSGNVDPNVLIKKLTKSGKHAKLWGAPKPNNNNNHNHNNQNHLADQFKNMHINHHKDAGGNHNNKGQHQIQNQPKGGGGNNQPKGGSGGGGGQQQGPTPQQQLQLQLQQQQRLQQQLEQLXRMKGLQDLNLPQFKDLKLTPHNPNLNPNAKAVKFDIPEEDDDFTDDELDDFDDDFDDFDDDFDDDEMDDLPPSKMKLPPMMMNAPPKGASNGGDGKKGGGPVPVPVQVHGIPGNGGGKKGGGGGGNNQNQGGGNK

SEQ ID NO: 3859 - protein, 569 aa, Glycine max
MALSMTQQIGTLAGATVPDSSAGESTAAVSAAAVWKSPTASLKCKVMRTDGCAEGLSPPLSPCRSPVLRADLSAACQAFTAEVAEEEYVAGGKEEKGKGKEGVPVFVMMPLDSVTAGNAVNRKKAMNAAMAALKSAGVEGVMMDVWWGLVEREKPGEYNWGGYVELMEMAKKHGLKVQAVMSFHQCGGNVGDSCTIPLPKWVVEEIDNDHDLAYTDQWGRRNYEYISLGCDTLPVLKGRSPVQCYADFMRAFRDTFKHLLGDTIVEIQVGMGPAGELRYPSYPEQNGTWKFPGIGAFQCYDKYMLSSLKAAAEAHGKPEWGSTGPTDAGHYNNWPEDTQFFRKEGGGWDGPYGEFFLTWYSQMLLEHGDRILSSATSIFDNTGVKISVKVAGIHWHYGTRSHAPELTAGYYNTRFRDGYLPIAQMLARHGAIFNFTCIEMRDHEQPQEALCAPEKLVKQVALATQKAQVPLAGENALPRYDEYAHEQIIRASQLDVDGESGDREMCAFTYLRMNPHLFEPNNWRKFVGFVKKMKEGKSAHKCWEEVEREAEHFVHVTQPLVQEAAVLMH

SEQ ID NO: 3860 - protein, 430 aa, Glycine max
MERIICAKYKLGRKIGSGSFGEIYLATHIDTFEIVAVKIENGKTKHPQLLYEAKLYNILQGGSGIPNIKWCGVDGEDNVLVMDLLGPSLEDLFVYCGRKFSLKSVLMLADQMMTRIEYVHSKGFLHRDIKPDNFLMGLGRKANQVYIIDFGLAKRYRDSSTNRHIPYRENKNLTGTARYASCNTHLGIEQSRRDDLESLGYVLLYFLRGSLPWQNLKAATKKQKYDKICQKKLSTPIEVLCKSHPVEFASYFHYCHSLTFDQRPDYGFLKRLFRDLFAREGYDFDYVFDWTILKYQQSQKNVMLPPLSPVPGASNSRAIPMDIDNHQGLNSYSGHVKERIRAGDATGSGVKIQFKSPVGKNLSYEKPLDKNIFGEANIPSTSFSPASTSKRNSLKQSLSAEASNPGHAQGSKMGPSSSWMSSLQRMSSAK

SEQ ID NO: 3861 - protein, 415 aa, Glycine max
  misc_feature (120)..(120): Xaa can be any naturally occurring amino acid
MASWDQMGELANVAQLTGVDAVRLIGMIVRAASTARMHKKNCRQFAQHLKLIGNLLEQLKISELKKYPETREPLEQLEDALRRSYILVNSCQDRSYLYLLAMGWNIVYQFRKAQNEIDRXLRLVPLITLVDNARVRERLEVIEMDQREYPLDDEDQKAQTVIFKPEPDKDDTAVLKKTLSCSYPNCSFTEALKKENEKLKLELQRSQANLDMNQCEVIQRLLDVTEVAAYSVPAKCSPEKSHKKEEYNYSDANSDKDHSSDEKYHAKIDKHSPSRYSVAQKDLASTGGSYQQEDWHTDLLACCSEPSLCMKTFFYPCGTFSKIASVARNRPISSGEACNDLMAYSLILSCCCYTCCVRRKLRKMLNITGGFIDDFLSHLMCCCCALVQEWREVEIRGLSGSKTKTSPPPSQYMES

SEQ ID NO: 3862 - protein, 114 aa, Glycine max
MPCLNLNTNVSLDGVDTSSILAEATSSVANIIGKPAAYVMIVLKGSVPIAFGGNEQPAAYGELVSIGGLNPSVNKELSAAIASILETKWSVPKSRFFLKFYDTRGPNFGWNGPT

SEQ ID NO: 3863 - protein, 162 aa, Glycine max
  misc_feature (60)..(60): Xaa can be any naturally occurring amino acid
  misc_feature (123)..(123): Xaa can be any naturally occurring amino acid
KIMQAVKKGDTIFIGKYLFTRSETASVWLEVREEKGEDVTCLVKMTATLSGSLFTVHVSXICIDLPTLADKDKEVISTWGVRNNIDFLSLYTRHVEDIRHAREFLSKLGDRKQTHIYAKIENXRGLQHFDEILREADSIILARGNLGIELPSEKEVMQFSLE

SEQ ID NO: 3864 - protein, 435 aa, Glycine max
  misc_feature (34)..(34): Xaa can be any naturally occurring amino acid
MLSIKRVPTVVSNYQKEETGEAAAGGCGRNCLKXCCIQGARLPLYAFKKVDKVCGNELPLLGCKEQHPVAFLDSLVLGEWEDRMQRGLFRYDVTACETKVIPGEYGFIAQLNEGRHLKKRPTEFRVDKVLQPFDENKFNFTKVGQEEVLFQLEASNDGEAQFFPNAPIDVENSPSFVAINVSPIEYGHVLLIPRIFKCLPQRIDHASFLLALQMAVEARNPYFRLGYNSLGAFATINHLHFQAYYLALPFPIEKAPTKKIAKLSGGVIISKLLNYPVRGLVFEGGHTLEDLANAVSEACICLQHNNIPYNVLISDCGRQIFLLPQCYAEKQALGEVSPELLETQVNPAVWEISGHMVLKRKKDYEEASEANAWRLLAEVSLSEERLLEVTALVFQAITSSVEMNVKPQRLEEVDAVSPNAQHAMVAGSHECLVLQ

SEQ ID NO: 3865 - protein, 234 aa, Glycine max
  misc_feature (18)..(18): Xaa can be any naturally occurring amino acid
  misc_feature (188)..(188): Xaa can be any naturally occurring amino acid
GIDHASFLLALQMAAEAXNPYFRLGYNSLGAFATINHLHFQAYYLALPFPIEKAPTKKIAKLSGGVKISKLLNYPVRGLVFEGGHSLEGLANVVSEACICLQHNNIPYNILISDCGRQIFLLPQCYAEKQALGEVSAELLETQVNPAVWEISGHLVLKRKKDYEEASEANACRLLAEVSLSEERFQEXVTALVFQAIASVEMNVKPQLLEEVDAVSPSTQRAMVAGSHECLVLQ

SEQ ID NO: 3866 - protein, 344 aa, Glycine max
GIWGKSREPSNWDFEKPKRRLRVELRATHLRSSSASDRPSSSALTRPTHCYPSVSDSSCLRVAYQGVHGAYSESAAQKAYPNCEAVPCEQFETAFDAVERWLVDRAVLPIENSLGGSIHRNYDLLLRHSLHIVGEVNFAVCHCLMANHGVKREDLKRVLSHPQALAQCENTLTKFGLVREAVDDTAGAAKHVAYHKLQDAGAVASSAAAKIYGLNILDQDIQDDSDNVTRFLMLAREPMIPGTDRRFKTSIVFSLEEGPGILFKALAVFALRQINLTKIESRPLRNQPLRADDSNNSKYFDYLFYVDFEASMAEQSAQNALRHLKEFATFLRVLGSYPVDTSLT

SEQ ID NO: 3867 - protein, 385 aa, Glycine max
  misc_feature (228)..(228): Xaa can be any naturally occurring amino acid
MAASRIVAHPPPYPHRQSPPSDAPPSLNLTLNPKRYRNLGIRASLRGHEEKNKNDLADKPHSVELRATSTPDDVVSRDLLSLPRPLSSTQLSASVSDSSRLRVAYQGVRGAYSESAAQKAYPNCEAVPCEQFDTAFDAVERWLVDRAVLPIENSLGGSIHRNYDLLLRHSLHIVGEVNFAVRHCLMANHGVKREDLKRVLSHPQALAQCENTLTKFGLVREAVDDTCXAAKHVAYHKLQDAGAVASSAAAKIYGLNILDQDIQDDSDNVTRFLMLAREPMIPGTDRRFKTSIVFSLEEGPGILFKALAVFALRQINLTKIESRPLRNQPLRADDSNNSKYFDYLFYVDFEASMAEQSAQNALRHLKEFATFLRVLGSYPVDTSLT

SEQ ID NO: 3868 - protein, 304 aa, Glycine max
  misc_feature (199)..(199): Xaa can be any naturally occurring amino acid
GLVSVSSMEDIQLDISWDDVACPICLDFPHNSVLLHCSSYDKGCRAFVCDTNQLHSNCLDRFKNSCGMPSSPVSNATSTETTENSDDHEVSNGQCNLTCPLCRGEVSGWVIVDKARIHLDEKKRCCDEVRCTFMGSYLELQEHAQLEHPHARPSKIDPARQLDWENFQQSSEIIDVLSTIHSEIPRGVVLGDYVIEYGXDDDARDEFEGFPGDEGNWWTSCILYFDNFRRSRNRRRTRVSHTRRDNRRLSYDTSNSDEGSVVSMEYADYRIEEIDDEIVSTSGSSRGSSGYRRSHRCRSRFYDN

SEQ ID NO: 3869 - protein, 301 aa, Glycine max
MASRDNKKASSSRAGRIRTLSDLNRPSADSDSDSDGPQEYYTGGEKSGMLVQDPSKGNDVDEIFNQARQLGAVERPLDQLQEPPRSTSFTGTGRLLSGETTRSTNNQQPEAVVHNIVFWSNGFTVNDGPLRSLDDPENASFLESIKKSECPKELEPEDRRSSVNVNLIRRNENYREPEKQHVAFQGVGRTLGSSSTSMAPDSPAASTPTNAAPTPSAGLVVDQSLPSTSIQLRLADGTRLISHFNYHHTISDIRAFIDASRPGGRQNYQLQLMGFPPKILIDETQTIEQAGLANSVVIQKI

SEQ ID NO: 3870 - protein, 307 aa, Glycine max
MPLPSHSPLQTLRSLHRLFHTSIVRHFMAAAEPTISPSNTRVGWIGTGVMGQSMCAHLIRAGYTLTVFNRTPSKAQPLLDLGAYFAPSPHAVAARSDVVFSIVGYPSDVRSVLLHPSSGALSALRPGGVLVDMTTSEPSLAVEIADAATAKGCHSIDAPVSGGDRGAKNGTLAIFAGGEEATVKRLEPLFSHLGKVKYMGGSGKGQFAKLANQVTIASTMVGLVEGMVYAHKAGLDVGLYLDAISTGAAGSKSLDLYGKRILNRDLDPGFFVNHFVKDLGNFFVNSLRHNINDKTRKLVNNFSMDNV

SEQ ID NO: 3871 - protein, 310 aa, Glycine max
MAAAEPTISPSNTRVGWIGTGVMGQSMCAHLIRAGYTLTVFNRTPSKAQPLLDLGAYFAPSPHAVAARSDVVFSIVGYPSDVRSVLLHPSSGALSALRPGGVLVDMTTSEPSLAVEIADAATAKGCHSIDAPVSGGDRGAKNGTLAIFAGGEESTVKRMEALFSHLGKVNYMGGSGKGQFAKLANQVTIASTMVGLVEGMVYAHKAGLDVGLYLDAISTGAAGSKSLDLYGKRILNRDLEPGFFVNHFVKDLGICLKECQNMGIALPGLALAQQLYVSLRAHGEGNLGTQALILVLERLNNVTLPPSSNT

SEQ ID NO: 3872 - protein, 398 aa, Glycine max
IALSPLLLPFPFHSSFPSPLRSPNFPQTFSLRRFAAAPLARPPPPPPPLDAMAQKIGKSTRRPGSSSKARVYADVNVVRPKEYWDYESLNVQWGEQDDYEVVRKVGRGKYSEVFEGVHCTDGEKCVIKILKPVKKKKIKREIKILQNLCGGPNIVQLLDIVRDQQSKTPSLIFEYVNNTDFKVLYPTLSDYEIRYYIYELLKALDYCHSQGIMHRDVKPHNVMIDHEQRKLRLIDWGLAEFYHPGKEYNVRVASRYFKGPELLVDLQDYDYSLDLWSLGCMFAGMIFRKEPFFYGHDNYDQLVKIAKVLGTDGLSAYLDKYRIELDPHLAALIGRHSRKPWAKFINVENHHMAVPEAVDFVDKLLRYDHQERPTAKEAMAHPYFNPVRNAESSRTRAH

SEQ ID NO: 3873 - protein, 492 aa, Glycine max
  misc_feature (95)..(95): Xaa can be any naturally occurring amino acid
MGIQCSRLIPCCVDSQVKASVIETPDAEIEDSSEASNWPTFREFTLEQLKNATSGFAVENIVSEHGEKAPNVVYKGKLENQMRIAVKRFNRNAWXPDARQFLEESRSVGQLRNQRLANLLGCCCEGEERLLVAEYMPNETLAKHLFHWETQPMKWAMRLRVVLHLAQALEYCTSKGRALYHDLNAYRVLFDEDGNPRLSSFGLMKNSRDGKSYSTNLAFTPPEYLRNWRVTPESVIYSFGTLLLDLLSGKHIPPSHALDVIRGRNLQMLTDSCLEGQFSDDDGTELVRLASRCLQYEPRERPNPKSLVAALAPLQKETEVLSHILMGIQHSTTFASLSPLGEACSRKDLTAIHEVLESLGYKDDEGVANELSFQMWTDQMQDTLNCKKKGDVAFRQKDFRLAIECYSQFIDTGTMVSPTVYARRSLCYLISDMPQEALNDAIQAQIVSPVWHIASYLQSVALTGLGMENEAQAALKEGTTMESKRNATPKQK

SEQ ID NO: 3874 - protein, 97 aa, Glycine max
MATEEESAVKEPLDLIRLSLDERIYVKLRSDRELRGKLHAYDQHLNMILGDVEEIVTTVEIDDETYEEIVRTTKRTVPFLFVRGDGVILVSPPLRTA

SEQ ID NO: 3875 - protein, 498 aa, Glycine max
  misc_feature (51)..(51): Xaa can be any naturally occurring amino acid
  misc_feature (260)..(260): Xaa can be any naturally occurring amino acid
MASLSCSANDLAPLFNDTAAANYLCAQFDSISRKLNVTTYAVDNTYLLFSXYLVFAMQLGFAMLCAGSVRAKNTMNIMLTNVLDAAAGGLSYYLFGFAFAFGGPSNGFIGRHFFGLRKFPKDSPPSGDYSFFLYHWAFAIAAAGITSGSIAERTQFVAYLIYSSFLTGFVYPIVSHWFWSSDGWASATRSHGNVLFGSGVIDFAGSGVVHMVGGIAGLWGALIEGPRIGRFDRSGRSVALRGHSASLVVLGTFLLWFGCXGFNPGSFLTIAKGYESGGYYGQWSAIGRTAATTTLAGSTAALTTLFSKRLLAGHWNVIDVCNGLLGGFAAITSGCAVVEPRAATVCGFVAAWVLIGLNKLAAKVDDDDPLEAAQLHGGCGAWGVIFTALFAKKEYVSQVYGEGRAHGLFMRGGGKLLAAHVIQILVIVGWVSATMGPLFWGLNKLKLLRISSEDELAGMDLTRHGGFAYAYEDDESHKHGIQLRKVGPNASSTPTTDE

SEQ ID NO: 3876 - protein, 168 aa, Glycine max
  misc_feature (140)..(140): Xaa can be any naturally occurring amino acid
MKESTMGNPLRLQSVNHISLICRSVEQSMDFYQNVLGFYPIRRPGSLDFDGAWLFGYGIGIHLLEAENPENLPKKKEINPKDNHISFQCESMEPVEKKLKEMEIDYVRATVEEGRIQVDQLFFHDPDDFMIEICNCDSLXGEVARSCSLVNLEKMQNQQQIQKMLQQL

SEQ ID NO: 3877 - protein, 172 aa, Glycine max
MKESVGNPLRLQSVNHISLICRSVEQSMDFYQNVLGFYPIRRPGSLDFDGAWLFGYGIGIHLLEAENPEKLPKKKEINPKDNHISFQCESMVAVEKKLKEMEIDYVRATVEEGGIQVDQLFFHDPDGFMIEICNCDSLPVIPLVGEVARSCSLVNLEKMQNQQQIQKMLQQL

SEQ ID NO: 3878 - protein, 249 aa, Glycine max
  misc_feature (183)..(183): Xaa can be any naturally occurring amino acid
MGGIAFGRLDDSFSLTSIKAYIAEFHSTLLFVFAGVGSAIAYGKLTSDAALDPAGLLAVAICHGFALFVAVSVGANISGGHVNPAVTFGLALGGHITILTGFFYWIAQLLGSIVACFLLNYVTGGLPTPIHSVASGVGAVEGVVTEIIITFGLVYTVYATAADPKKGSLGTIAPIAIGFIVGXANILAAGPFSGGSMNPARSFGPAVVSGDFHDNWIYWVGPLIGGGLAGLIYGNVFIRSDHAPLSSEF

SEQ ID NO: 3879 - protein, 272 aa, Glycine max
MAATNASIFASSTQPCLPVPPTIPNTLATPFLNVSSPRSYLVKKKHVKFSKKISAAAVATTTTTEEIQEYKLPSWAKFEIGRAAVYWKTMNGLPPTSGEKLKLFYNPAATQLVPNEEFGIAFNGGFNQPIMCGGEPRAMLRKDRGKADAPIYSIQICIPKHALNLIFSFTNGVDWDGPYRLQFQVPKALQNKPIDFFNKGLAEELSKEGACEQAIFPDTNKIITKCAMIGNLSKEGGDRCDLNFVLGCTDPSSHLYNPLANVDDGTCTIELD

SEQ ID NO: 3880 - protein, 331 aa, Glycine max
MASSTNALPPTGNGLIVSFGEMLIDFVPTVSGVSLAEAPGFLKAPGGAPANVAIAVARLGGKAAFVGKLGDDEFGHMLAGILKENDVRSDGINFDQGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFHGSVEAFHVSTVDTTGAGDSFVGALLSKIVDDQSVLEDEARLREVLKFANACGAITTTKKGAIPALPTEADALNLIKEA

SEQ ID NO: 3881 - protein, 343 aa, Glycine max
MSSQRADLACRIFPEPEIDHFDRLPDSLLLLVFNKIGDVKALGRCCVVSRRFHSLVPQVENVVVRVDCVISDDDSSFSSAASDKSRGPFWNLLRLVFGGIAKPIQTLGQFLGPQRPSSSAAATATAATSPSSTSSLAVGSDEDSDGGVTHHSPTQVLKNFNEIRLLRIELPSGELGIEDGVLLKWRADFGSTLDNCVILGASSVFHPKDLTDPTTTNCNANDDNGSIPDSFYTNGGLKLRVVWTISSLIAASARHYLLQPIISEHATLDNLLLTDADGQGVLYMNREQLEELRVKPLSASSASKRTLVPALNMRLWYAPHLELPTGVVLKGATLVADYTLTFL

SEQ ID NO: 3882 - protein, 200 aa, Glycine max
  misc_feature (57)..(57): Xaa can be any naturally occurring amino acid
  misc_feature (101)..(101): Xaa can be any naturally occurring amino acid
MVFKDEDFAILGPSGFIKTKDNRTVPVSKRKCNGNEESGSIPNSFYTVGGLRLRVVXTISSLIAAFAMYYLIQPVIYEHVSLDRVLVLTDADRQGVLYMNXKQLEELRVKPLSASSASKRTLVPALNMRLWYAPHLELPTGVVLKGATLVAIRPSELSPNTAKKEASDLSWVSTAFEEPYRTAATMLVKRRTYCLEMNSF

SEQ ID NO: 3883 - protein, 495 aa, Glycine max
MGCCQSSTLLRVGERETHPEKEKEKDHQRLSEAEKEGFDFSFSEFSLAELKAATNNFSSDYIVSESGEKAPNLVYKGRLQNHSRWIAVKKFSKSAWPDPKQFVEEASGVGKLRHPRLAILIGFCCDGDERLLVAEYMPNDTLAKHLFHWETQTIEWAMRLRVALYIAQALHYCSSEGRPLYHDLNAYRVLFDQEGDPRLSCFGFMKNSRDGKSYSTNLAYTPPEYLRNGRVTPESVIYSFGTVLLDLLSGKHIPPSQALDMIQGKNNMLLMDSHLEGKFSTEEATVVVNLASKCLQYEPRERPDTKDLVTTLAPLHTKPDVRSHIMLGIPKHEEAPSTPQRPLSAMGEACSRMDLTAIHQILVATHYRDDEGTNELSFQEWTQQMRDMLEARKRGDYAFRDKDFKTAIDNYSQFIDVGTMISPTVFARRSLCYLLCDQPDPALRDAMQAQCVYPDWPTAFYMQSVALAKLDMHKDAADMLNEAAALEEKRQRGAR

SEQ ID NO: 3884 - protein, 327 aa, Glycine max
  misc_feature (190)..(190): Xaa can be any naturally occurring amino acid
MSTAGQVIKCRAAVAWEAGKPLSIETIEVAPPQKGEVRLKILFNSLCRTDVYWWDAKGQTPLFPRILGHEASGIVESVGKGVTHLKPGDHALPIFTGECGECTYCKSEESNLCELLRINTDRGVMLSDGKTRFSKNGQPIYHFVGTSTFSEYTVLHEGCVAKINPAAPLDKVAVVSCGFCTGFGATVSTXFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 3885 - protein, 381 aa, Glycine max
MCFCCQSLDCHFSAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAVVSCGFCTGFGATVNVAKPKPNNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKFMEGRTLKGTFYGHYRPRTDIPGVVEKYLNKELELDKFITHSVPFSEINTAFDLMLKGEGIRCLICMEE

SEQ ID NO: 3886 - protein, 452 aa, Glycine max
  misc_feature (46)..(46): Xaa can be any naturally occurring amino acid
  misc_feature (55)..(55): Xaa can be any naturally occurring amino acid
  misc_feature (83)..(83): Xaa can be any naturally occurring amino acid
  misc_feature (117)..(117): Xaa can be any naturally occurring amino acid
  misc_feature (127)..(127): Xaa can be any naturally occurring amino acid
  misc_feature (146)..(146): Xaa can be any naturally occurring amino acid
  misc_feature (154)..(154): Xaa can be any naturally occurring amino acid
  misc_feature (162)..(162): Xaa can be any naturally occurring amino acid
  misc_feature (169)..(169): Xaa can be any naturally occurring amino acid
  misc_feature (267)..(267): Xaa can be any naturally occurring amino acid
  misc_feature (273)..(273): Xaa can be any naturally occurring amino acid
  misc_feature (297)..(297): Xaa can be any naturally occurring amino acid
  misc_feature (327)..(327): Xaa can be any naturally occurring amino acid
  misc_feature (347)..(347): Xaa can be any naturally occurring amino acid
  misc_feature (366)..(366): Xaa can be any naturally occurring amino acid
MDGDDETSGQMIEKIYARSRGDDGDKLRRSAIKSGERMEMEAYAEXYWGRRRIRXVLFFVEKMNNAGSQIKALRMSYDEIKIXENRQLFWEVLHMTEGRKRPNCCTDEEGSDIVDKXAENKKRKLHXELNVYRTNLIEESIRMGYXNDFRKNYXGHGSIGDXRFKSYVXILRDYCTTSKHIVHMCMSAILVSIEMGQFPHVTSYVSKAEQSPDALEAVTVAKLRCAAGLANQEAKKYKLAAQKFLETGPELGSHYNDVFAPQDVATXGGLCAXATFNRAELKSTVIDNSNFRNFFEXYLEVKELIKDFYSSHYASFLEYLGNFKCNXLLLVIHLHVHVETLYDQIRXHKALFTSTCTFPFVSVDLXNMMANAFKTTVAGLEKELEALITDNQIQARIDSHNKILYARHADQRNATFQRVLETGREFDRDVRSMLLRSNLIKHEFNLRALRKL

SEQ ID NO: 3887 - protein, 294 aa, Glycine max
HGQLGDAFKSYVRTRDYCTTSKHIVHMCMSAILVSIEMGQFPHVTSYVSKAEQSPDALEAVTVAKLRCAAGLANLEAKKYKLAARKFLETGPELGSHYNDVIAPQDVATYGGLCALATFDRAELKASSPLYFIDNSNFRNFLELVPEVRELINDFYSSHYASCLEYLGNLKANLLLDIHLHDHVETLYDQIRHKALIQYTLAFVSVDSNMMANAFKTTVAGLEKELEALITDNQIQARIDSHNKIVYARHADQRNATFQRVLETGREFDRDVRSMLLRSNLIKHEFNLRALRKL

SEQ ID NO: 3888 - protein, 446 aa, Glycine max
  misc_feature (118)..(118): Xaa can be any naturally occurring amino acid
  misc_feature (161)..(161): Xaa can be any naturally occurring amino acid
MDGDDETSGPMIDEIYANGGGDDGDKRSRRAIMSGDQVDIEAYAALYSGRTKIMRLLFFADKMNNAASQLEALRMAYDEIKKGENTQLFREVVQKIDGRLGPNYGMDAAWCDAIDRRXASRRKEKLENELNAFSTNLIKESIRMGYNDFGEFYYAHGSIGXDVFKSYVRTRDYCTTSKHIVHMCMSAILVSIEMGQFPHVTSYVSKAEQSPDALEAVTVAKLRCAAGLANLEAKKYKLAARKFLETGPELGSHYNDVIAPQDVATYGGLCALATFDRAELKSKVIDNSNFRNFLELVPEVRELINDFYSSHYASCLEYLGNLKANLLLDIHLHDHVETLYDQIRHKALIQYTHPFVSVDLNMMANAFKTTVAGLEKELEALITDNQIQARIDSHNKILYARHADQRNATFQRVLETGREFDRDVRSMLLRSNLIKHEFNLRALRKL

SEQ ID NO: 3889 - protein, 134 aa, Glycine max
MAAKKACETFSKSLIEEVNRWGCLKQTGVSLRYMMEFGSKPTNKNLLISAQFLHKELAIRIARRAVELENLPYGLSQKPAVLKVRDWYVDSFRDVRAFPDIKNVNDEREFTEMIKAIKVRHNNVVPTMAMGVQL

SEQ ID NO: 3890 - protein, 369 aa, Glycine max
MAAKKACETFSKSLIEEVNRWGCLKQTGVSLRYMMEFGSKPTNKNLLISAQFLHKELAIRIARRAVELENLPYGLSQKPAVLKVRDWYVDSFRDVRAFPDIKNVNDEREFTEMIKAIKVRHNNVVPTMAMGVQQLKKGMDPKIVYEDLVEIHQFLDRFYMSRIGIRMLIGQHVELHNPNPPPHVVGYIHTKMSPVEVARNASEDARAICCREYGSAPDVHIYGDPDFTFPYVPAHLHLMVFELVKNSLRAVQERFMDSDKVAPPIRIIVADGIEDVTIKVSDEGGGIARSGLPKIFTYLYSTARNPLDEHSDLGIGDNVTMAGYGYGLPISRLYARYFGGDLQIISMEGYGTDAYLHLSRLGDSQEPLP

SEQ ID NO: 3891 - protein, 345 aa, Glycine max
  misc_feature (100)..(100): Xaa can be any naturally occurring amino acid
  misc_feature (122)..(122): Xaa can be any naturally occurring amino acid
  misc_feature (134)..(134): Xaa can be any naturally occurring amino acid
MSCFSCFVSRGKDVRRVEIDNGSRSATSSSEGKGKKSVSNKGTSTAAASFGFRELAEATRGFKEVNLLGEGGFGRVYKGRLSTGEYVAVKQLIHDGRQGXHEFVTEVLMLSLLHDSNLVQVXFGYCTDGDQRLXVYEYMPMGSLEDHLFDPHPDKEPLSWSTRMKIAVGAARGLEYLHCKADPPVIYRDLKSANILLDNEFNPKLSDFGLAKLGPVGDNTHVSTRVMGTYGYCAPEYAMSGKLTLKSDIYSFGVLLLELITGRRAIDTNRRPGEQNLVSWSRQFFSDRKKFVQMIDPLLQENFPLRCLNQAMAITAMCIQEQPKFRPLIGDIVVALEYLASHSNP

SEQ ID NO: 3892 - protein, 145 aa, Glycine max
MEVYGNSMVAAPSNVIYLSSILGQGGPIPGHRCNWKCENEHVCGNMYRCKLTGLTHICDKNCNQRILYDNHSSLCLASGQIFPLTPEEEQAVRGVRRKLDMENSPSDSCGFKRRRDAQFHPSPFERSFSAVSPICSQVGDGMDMK

SEQ ID NO: 3893 - protein, 180 aa, Glycine max
EFPHIPPIPSDSGITFNEQPLMIALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNDVPTGGLANVAATVMNLHGFEAPSDYETTLVEVVDN

SEQ ID NO: 3894 - protein, 559 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIASGGGRMNVTMDRYENDWSVVKRGWDAQVLGEAPYKFTNALEAVKKLRAEPKANDQYLPPFVIVDESGKPVGPIVDGDAVVTFNFRADRMTMIAKALEYENFDKFDRVRYPKIRYAGMLEYDGELKLPSHYLVSPPEIDRTSGEYLVYNGIRTFACSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNDVPTGGLANVAATVMNLHGFEAPSDYETTLIEVVDN

SEQ ID NO: 3895 - protein, 447 aa, Glycine max
RPTRSGHRAAAADPRVQYHRPRAWVTAWERQRIWLRAADLFEKHNDDLAALETWDNGKPYEQSAQIEIPMLVRLFRYYAGWADKIHGLTVPADGPYHVQTLHEPIGVAGQIIPWNFPLVMFAWKVGPALACGNTIVLKTAEQTPLSALYASKLLHEAGLPPGVLNIISGFGPTAGAAIASHMDIDKLAFTGSTETGKIVLELAARSNLKPVTLELGGKSPFIVCEDADVDEAVELAHFALFFNQGQCCCAGSRTFVHERVYDEFIEKAKARALKRAVGDPFKGGIEQGPQIDSEQFQKILKYIRSGVESGATLETGGDRFGNSGFYIQPTVFSNVKDDMLIAKEEIFGPVQTILKFKDLDDVIQRANNTHYGLAAGVFTKNINTANTLTRALRAGTVWVNCFDTFDAAIPFGGYKMSGQGREKGEYSLKNYLQVKAVVTSLKNPAWL

SEQ ID NO: 3896 - protein, 509 aa, Glycine max
  misc_feature (14)..(14): Xaa can be any naturally occurring amino acid
  misc_feature (152)..(152): Xaa can be any naturally occurring amino acid
  misc_feature (177)..(177): Xaa can be any naturally occurring amino acid
MSLPACPAEQLAQXLLGPNTTDASAAASLICGQFAAVDSKFVDTAFAVDNTYLLFSAYLVFSMQLGFAMLCAGSVRAKNTMNIMLTNVLDAAAGGLFYYLFGFAFAFGSPSNGFIGKHFFGLKDIPSSSYDYSYFLYQWAFAIAAAGITSGXIAERTQFVAYLIYSSFLTGFVYPVXVSHWFWSPDGWASAISSADHVFSPGDRLFSTGVIDFAGSGVVHMVGGIAGLWGALIEGPRMGRFDHAGRAVALRGHSASLVVLGTFLLWFGWYGFNPGSFNKILLTYGNSGNYYGQWSAVGRTAVTTTLAGSTAALTTLFGKRVISGHWNVTDVCNGLLGGFAAITAGCSVVEPWAAIVCGFVASIVLIACNKLAEKVKFDDPLEAAQLHGGCGTWGVIFTALFAKKEYVKEVYGLGRAHGLLMGGGGKLLAAHVIQILVIAGWVSATMGPLFWGLNKLKLLRISSEDELAGMDMTRHGGFAYAYEDDETHKHGMQLRRVGPNASSTPTTDE

SEQ ID NO: 3897 - protein, 594 aa, Glycine max
  misc_feature (66)..(66): Xaa can be any naturally occurring amino acid
GTAFPTRPIRPRTSFPSLSLRHAPPCQSHTPSSSASSPLPPPPFPPTTTSLPPPSSSRAPPTAASXSLRASFSPETLVSDNNGAPSPPPPSDPSSIEVDSVTEAELKENGFRSTRRTKLVCTVGPATCGFEQLEALAVGGMNVARINMCHGTREWHKEVIDRVRRLNHEKGFAVAIMMDTEGSEIHMGDLGGASSAKADDGEIWTFSVRAFDSALPQRTINVNYEGFAEDVKVGDELLVDGGMVRFEVIQKIGPDVKCRCTDPGLLLPRANLTFWRNGSLVRERNAMLPTISSKDWLDIDFGISEGVDFIAISFVKSAEVITHLKSYIAARSRDSDISVIAKIESIDSLKNLEEIVLAADGAMVARGDLGAQIPLEQVPSAQQRIVQVCRQLNKPVIVASQLLESMIEYPTPTRAEVADVSEAVRQRADALMLSGESAMGQYPDKALTVLRSVSLRIERWWREEKRYEAMLLPSVGSYFSEKISEEICNSAAKMANNLEVDALFVYTKTGHMASLLSRCRPDCPIFAFTTTSSVRRRLNLQWGLIPFRLSFTDDMESNLNRTFSLLKARNLIKSGDLVIAVSDMLQSIQVMNVP

SEQ ID NO: 3898 - protein, 264 aa, Glycine max
MYGPRGAMLGSGGVSDGYEVGSKRQRMMESNPYFAVSSGTGNLPYGYAGGFQPPPFPVVRLRGLPFNCTDIDILKFFAGLTIVDVLLVNKSGRFSGEAFVVFAGAMQVEFALQRDRQNMGRRYVEVFRCKKQDYYNAVAAEIKYEGIYDNDYQGSSPPPSRSKRFNDKDQMECTEILKMRGLPFQVTKSQIVEFFKDFKLIEDRVHIACRPDGKSTGEAYVEFVSAEEAKRAMSKDKMTIGSRYVELFPSTPDEARRAESRSRQ

SEQ ID NO: 3899 - protein, 475 aa, Glycine max
MAVSLAMRLVRRRSPPLLWRRSFSMSAVDAEKEVVVVPELPPFDYSPPPYVGPTAEEILAKRREYLSPSILHSYKNPVNIVEGKKQYLFDEKGRRYVDAFGGIATVCCGHCHHDVVEAIVNQTKKLQHSTVLYLNHVITDFAQALASKLPSDLKVVFFTNSGTEANELAMLIARLYTGCHDIISLRNAYHGNATGTMAATAQSIWKFNVVQSGVHHAVNPDPYRGIFGSDGEKYARDVQDIINFGTSGNVAAFISEAIQGVGGIIELAPGYLPVVYNTIKKAGGLFIADEVQAGFGRTGSHFWGFEAHNVVPDIVTIAKGIGNGIPLGAVVTTPEIAEVLTRRSYFNTFGGNPVCTAAGLAVLKVIEKEQLQQNAFVVGSHLKERLTALKDKYELIGDVRGRGLMLGVELVTDRELKTPAKNETLHVMDQMKELGVLIGKGGYYGNVFRITPPLCFTKEDADFVADAMDLTLSRM

SEQ ID NO: 3900 - protein, 229 aa, Glycine max
LPWLESIEKTLRNCVALLLDNRGPPGSGKGTQSPIIKDEYCLCHLATGDMLRAAVAAKTPLGVKAKEAMNKGELVSDDLVVGIIDEAMKKPSCQKGFILDGFPRTVVQAQKLDEMLQNQGVKVDKVLNFAIDDAILEERITGRWIHPSSGRTYHTKFAPPKVLGVDDVTGEPLIQRKDDTAAVLKLRLEAFHKQTEPVIDYYSKKGLVANLHAEKPPKEVTVEVEKVLS

SEQ ID NO: 3901 - protein, 242 aa, Glycine max
MANTNLEDVPSLDLMTELLRRLKCSSKPDKRLILIGPPGSGKGTQSPIIKDEYCLCHLATGDMLRAAVAAKTPLGVKAKEAMDKGELVSDDLVVGIIDEAMKKPSCQKGFILDGFPRTVVQAQKLDEMLQKQGVKVDKVLNFAIDDAILEERITGRWIHPSSGRTYHTKFSPPKVLGVDDVTGEPLIQRKDDTAAVLKSRLEAFHKQTEPVIDYYSKKGLVANLHAEKPPKEVTVEVEKVLS

SEQ ID NO: 3902 - protein, 222 aa, Glycine max
EIRVALLLDNGLILRGPPGSGKGTQSPIIKDEYCLCHLATGDMLRAAVAAKTPLGVKAKEAMDKGELVSDDLVVGIIDEAMKKPSCQKGFILDGFPRTVVQAQKLDEMLQKQGVKVDKVLNFAIDDAILEERITGRWIHPSSGRTYHTKFSPPKVLGVDDVTGEPLIQRKDDTAAVLKSRLEAFHKQTEPVIDYYSKKGLVANLHAEKPPKEVTVEVEKVLS

SEQ ID NO: 3903 - protein, 287 aa, Glycine max
MPRYDDKYGNTRLYVGHLSSRTRSRDLERAFSRYGRVRGVDMKNDFAFVDFSDPRDADDARYNLDGRDVDGSRIIVEFAKGAPRGSREYLGRGPPPGSGRCFNCGLDGHWARDCKAGDWKNKCYRCGERGHIERNCKNSPKKLSTRRGRSYSRSPVRSRSPHRGRSRDRSYSRDRSYSRSRSPVRREESPVREDRSQSPDHKNSPQPSKTRKHSPSPDRSPQKRGDTSPDNDRLSRSPARDPEDRGYDSPKVNGRSGSPSCSPRDDDRSPIDDDNNHRHSPRGSESP

SEQ ID NO: 3904 - protein, 287 aa, Glycine max
MPRYDDKYGNTRLYVGHLSSRTRSRDLERAFSRYGRVRGVDMKNDFAFVDFSDPRDADDARYNLDGRDVDGSRIIVEFAKGAPRGSREYLGRGPPPGSGRCFNCGLDGHWARDCKAGDWKNKCYRCGERGHIERNCKNSPKKLSTRRGRSYSRSPVRSHSPHRGRSRDRSYSRDRSYSRSRSPVRREESPVREDRSQSPQHKNSPQPSKTRKHSPSPDRSPQKRGDTSPDNDRLSRSPARDPEDRGYDSPKVNGRSGSPSCSPRDDDRSPIDDDNNHRHSPRGSESP

SEQ ID NO: 3905 - protein, 232 aa, Glycine max
MPRYDDKYGNTRLYVGHLSSRTRSRDLERAFSRYGRVRGVDMKNDFAFVDFSDPRDADDARYNLDGRDVDGSRIIVEFAKGAPRGSREYLGRGPPPGSGRCFNCGLDGHWARDCKAGDWKNKCYRCGERGHIERNCKNSPKKLSTRRGRSYSRSPVRSHSPRRGRSRDRSYSRDRSYSRSRSPVRREESPVREDRSQSPQHKNSPQPSKTRKHSPSPDRSPQRRGDTSDMIG

SEQ ID NO: 3906 - protein, 518 aa, Glycine max
  misc_feature (332)..(332): Xaa can be any naturally occurring amino acid
MDTPMTLTGLLRDVAAKFPSRRAISVAGKFDLTHSRLHQLVESAAARLVAAGIKPGDVIALTFPNTVEFVVLFLAVIRVRATAAPLNAAYTAEEFEFYLSDSESKLLLTSAEGNNSAQAAASKLNILHSTASITQAEDKEAELSLSLSHSESESINSVESLGNDPDDVALFLHTSGTTSRPKGVPLTQHNLFSSVNNIKSVYRLTESDSTVIVLPLFHVHGLIAGLLSSLGTGAAVALPAAGRFSASSFWKDMIKYSATWYTAVPTIHQIILDRHSNNPEPVYPRLRFIRSCSASLAPAILGKLEEAFGAPVLEAYAMTEASHLMASNPLPXDGAHKAGSVGKPVGQEMVILDETGRVQDAEVSGEVCIRGPNVTKGYKNNVDANTAAFLFGWFHTGDVGYLDSDGYLHLVGRIKELINRGGEKISPIEVDAVLLSHPDIAQAVAFGVPDPKYGEEIYCAVIPREGSDIDDAELLRYCKKNLASFKVPKKVFITDSLPKTATGKILRRLVAEHFVSQI

SEQ ID NO: 3907 - protein, 339 aa, Glycine max
MAQLLSPVCMEALKIHNPSLNLCSRSSWRMLVKGASPCTFLTHSGSKRRGFGKVRVTAEDSVSPSETIADDYYEVLGLLPDATPEQIKKAYYNCMKSCHPDLSGNDPETTNFCMFINEVYTVLSDPVQRMIYDEIHGYSLTSINPFLDDSSPRDHAFVDEFSCIGCKNCANVAPGVFAIEEDFGRARAYNQCGDPELVQQAIDSCPVSCIHWTSSAQLSLLEDEMRRVERVNVALMVSGMGTASIDVFRMASSRWEKRQSKVLAKAKLRMMREEGSDKKNSYWDNLWGKQKDYQSSDEEVEERAKRAASAARRWREYSSRGVDKPPTFKLPEASLGKDK

SEQ ID NO: 3908 - protein, 131 aa, Glycine max
DFSALLILGLSLMLLLVSSEVASTNTKEEANGVDDAKYPGGSYGGGYPGHGGGGGGYPGHGGGGYPGHGGGGGYPGHGGGHPGHGGGYPGRGGGYCRHGCCGGRTYNGGCRRCCYNAGEAVAAQTQDKTHD

SEQ ID NO: 3909 - protein, 219 aa, Glycine max
MDGDSSWSARLSSASRRYQSALQSRSDMFMGFDENDGDDDIREEFLCPFCSEYFDIVGLCCHIDEEHPMEARNGVCPVCALRVGVDMVAHITLQHGSIFKMQRKRKSRKGGSYSTLSLLRKELREGNLQSLFGGSSCIVSSSNADPLLSSFILPLANEHASSQPHLHTETRSSKKCSDETVSTRNVETSTLSVKDKEEKAKRCEFVQGLLLSTILDDNL

SEQ ID NO: 3910 - protein, 456 aa, Glycine max
MGSSFSSCYEGESVSPSPKPTKVVATKGGSSSNRVSITDLSFPGSTLSEDLSVSLVGSNLHVFSLAELKIITQGFSSSNFLGEGGFGPVHKGFIDDKLRPGLEAQPVAVKLLDLDGSQGHKEWLTEVVFLGQLRHPHLVKLIGYCCEEEHRLLVYEYLPRGSLENQLFRRYTASLPWSTRMKIAAGAAKGLAFLHEAKKPVIYRDFKASNILLDSDYNAKLSDFGLAKDGPEGDDTHVSTRVMGTQGYAAPEYIMTGHLTAMSDVYSFGVVLLELLTGRRSVDKGRPQREQNLVEWARSALNDSRKLSRIMDPRLEGQYSEVGARKAAALAYQCLSHRPRSRPLMSTVVNVLEPLQDFDDVPIGPFVYTVPAEQQQYNEVAKESETPKERKRENGHHHNRRHHHHRHNGHRHHPLKSPKTPMPSDQSQNDEHRNGRKSGSNSPDTFNASEAQRSMG

SEQ ID NO: 3911 - protein, 615 aa, Glycine max
MASLSGICSSSPTLKKFPNQSPSLTDPLRKDHVSFPARLADRTLSLAPLRAVAREVSDGALAAAVKKGLEKDPRALWRRYVGWLYQHKELGIYLDVSRVGFSDEFVKEMEPRFQAAFRAMEELEKGAIANPDESRMVGHYWLRDPKRAPNSFLKTQIENTLDAVCKFANDVVSGKIKPPSSPEGRFTQILSVGIGGSALGPQFVAEALAPDNPPLKIRFVDNTDPAGIDHQIAQLGPELASTLVIVISKSGGTPETRNGLLEVQKAFREAGLDFPKQGVAITQENSLLDNTARIEGWLARFPMFDWVGGRTSEMSAVGLLPAALQGIDIREMLAGASLMDEANRSTVIRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKAAGEVLALQKRVLAVLNEASCKEPVEPLTLEEVADRCHAPEDIEMIYKIIAHMAANDRALIVEGSCGSPRSIKVFLGECNIDGLYA

SEQ ID NO: 3912 - protein, 476 aa, Glycine max
  misc_feature (148)..(148): Xaa can be any naturally occurring amino acid
MAAMQRPLKRTIAIAKLRACFSSLRPAAAADIVASPPPQLPPFDHQPHPYNGPFADEVLAKRKTFLGPSVFHYYKKPLNIVEGKMQYLYDDSGRRYLDAFAGIVTVSCGHCHPEILNAITEQSKLLQHATTIYLHHTIGDFAESLAAXKMPGNLKVVYFVNSGSEANELAMMMARLYTGSLGMISLRNAYHGGSSSTLGLTALNTWKYPIPEGHVHHVMNPDPYRGAFGADAASYANDVQDHIDYGTSGKVAGFIAETMQGVGGAVELAPGYLKLVYDIIHKAGGVCIADEVQTGFGRTGSHYWGFETQGVIPDIVTMAKGIGNGLPLGAVVTTPEIASVLAQKIQFNTFGGNPVCSAGGLAVLRVLDKEKRQAHCADVGSHLLERLRFLMERHDIIGNVRGRGLMVGIELVTDRDNKTPAKAETAVVFEKLRELGVLVGKGGLHGNVFRIKPPMCFSKDDADFLVDALDYSLSKL

SEQ ID NO: 3913 - protein, 570 aa, Glycine max
MVKSIGVCKRLSGSSSCLSTSTATRDNDIARRLQFHICTCILSLSLHNLTSRVRITRDSLSRHNTNMVIIIKYYTYIYIPTIEKSEQNPTKAAMAAMQRPLKRTIAIAKQRACFSSLLPSAAAAAAADTVAPPQLPPFDHQPHPYNGPSADEVFAKRKTFLGPSVFHYYKKPLNIVEGKMQYLYDDSGRRYLDAFAGIVTVSCGHCHPEILNAITEQSKLLQHATTIYLHHTIGDFAEALAAKMPGNLKVVYFVNSGSEANELAMMMARLYTGNLGMISLRNAYHGGSSSTLGLTALNSWKYPIPEGHVHHVMNPDPYHGAFGTDAASYANDVQDHIDYGTSGKVAGFIAESIQGVGGAVELAPGYLKLVYDIIHKAGGVCIADEVQTGFGRTGSHYWGFETQGVIPDIVTMAKGIGNGLPLGAVVTTPEIASVMAQKIQFNTFGGNPVCSAGGLAVLRVLDKEKRQAHCADVGSYLLERLRFLMERHDIIGNVRGRGLMVGLELVTDRTNKTPAKAETAVVFEKLRELGVLVGKGGLHGNVFRIKPPMCFSKDDADFLVDALDYSLSKL

SEQ ID NO: 3914 - protein, 172 aa, Glycine max
  misc_feature (44)..(46): Xaa can be any naturally occurring amino acid
MAEEHRCETPEGHLLCANNCGFFGSTATMNLCSKCYGAIRLKEXXXASTKSTIETALSSSSLKPSFSTSPPTLVDVLIESPPPSLAEVAVTVAVEASSSISTSSGSVAQPNRCATCRKRVGLTGFKCRCGLTFCGAHRYSEKHACGFDFKTVGREEIARANPVIKAEKLRRI

SEQ ID NO: 3915 - protein, 178 aa, Glycine max
  misc_feature (135)..(135): Xaa can be any naturally occurring amino acid
MAEEHRCEPPEGHRLCVNNCGFFGSTATMNLCSKCYSAIRLKEQEEASTKSTIETALSSASSAKPSSSTSPPPSAVDVLMESPPPSAAEVEVAVTVTVAVASSSISINSGSVAQPNRCATCRKRVGLTGFKCRCXGVTFCGAHRYPEEHACGFDFKTVGREEIARANPVIKAEKLRRI

SEQ ID NO: 3916 - protein, 390 aa, Glycine max
KERTAELVRKSMASSLGFEFLTKKPYSPPSWASHLHPLPSHFFSLAHLPTPIHRWNLPNLPTNTELWIKRDDLSGMQLSGNKVRKLEFLMADAIAQGADSIITIGGIQSNHCRATAVAAKYLNLDCFLILRTSDLLVDQDPGLTGNLLVERMVGAHVHLISKQEYAKIGSVTLTNVLKEKLIKEGRRPYVIPVGGSNSLGTWGYIEAVREIEQQIQKGTGNVKFDDIVVACGSGGTIAGLSLGSSLSALKARVHAFSVCDDPDYFHNFAQGLLDGLKAGVSSRDIVHIQNAKGLGYAMNTSEELNFVKEVAATTGVVLDPVYSGKAAYAMLKDMSENPKKWERRKILFIHTGGLLGLYDKVDQLASFVGNWQRMDVNESVPRQDGIGKMF

SEQ ID NO: 3917 - protein, 315 aa, Glycine max
  misc_feature (18)..(18): Xaa can be any naturally occurring amino acid
  misc_feature (31)..(31): Xaa can be any naturally occurring amino acid
  misc_feature (306)..(306): Xaa can be any naturally occurring amino acid
MWPFSRKGASGFSSSSTXAEQVTEGIDGTGXLTAIVTGASSGIGTETTRVLSLRGVHVIMGVRNMLAAKDVKETLLKEIPSAKVDAMELDLSSLESVKKFASEFKSSGLPLNMLINNAGIMACPFKLSKDKIELQFATNHLGHFLLTNLLLDTMKKTSRETKKEGRIVNVSSEAHRFTYSEGIRFDKINDESSYSNWRAYGQSKLANILHANELTRRLKEDGVDISANSLHPGVIATNLSRHISPVNGLTKAIARLVLKNVQQGAATTCYVALHPQVKGTSGKYFSASNVAKTTSQGTDADLAKKXWDFSMDLTK

SEQ ID NO: 3918 - protein, 446 aa, Glycine max
MAQHPADEMEYAADDNEMAEVEDDMYFRGRVFGDSESESDDDDEYDSMENRMTDTSAAEARKGKDIQGIPWDRLSISREKYRQTRLEQYKNYENIPQSGEQSEKECTPTHRGGKYYDFWQNTRSVKSTILHFQLRNLVWATSKHDVYLVSSYSIIHWSSLNSKRSEILNVSGHVAPCEKHPGSLLEGFTQTQISTLAVRDKLLIAGGFQGELICKYVDRPGVSFCSRTTYDDNAITNAVEIYEHPSGAVHFMASNNDCGVRDFDMERFQLSKHFSFSWPVNHTSLSPDGKLVVIVGDNPEGLLVDSQTGKTITPLRGHLDYSFASAWHPDGRIFATGNQDKTCRVWDVRNLSKSVAVLKGNLGAIRSIRFTSDGRFMAMAEPADFVHVYDAQSGFEKEQEIDFFGEISGVSFSPDTESLFVGVWDRTYGSLLQYNRRRNYMYLDCM

SEQ ID NO: 3919 - protein, 446 aa, Glycine max
MSQYHGDEMEYAADDNEMAEVEEDMYFRGRAFGESDSDDDDDYEYDPLENRISDTTAAEARRGKDIQGIPWDRLSISREKYRQTRLDQYKNYENIPQSGEMSEKECKATDKGGKYYDFWQNTRSVKSTILHFQLRNLVWSTSKHDVYLVSNYSIVHWSSLTSKRSEVLNVSGHVAPCEKHPGSLLEGFTQTQISTLAVRDNLLIAGGFQGELICKYLDRPGVSFCTRTTYEDNAITNAVEIYEHPSGAVHFMASNNDSGVRDFDMERFQLSKHFCFPWPVNHTSLSPDGKLVVIVGDNPEGLLVDSQTGKTITPLRGHLDFSFASAWHPDGRIFATGNQDKTCRVWDVRNLSKSVAVLKGNLGAIRSIRFTSDGQFMAMAEPADFVHVYDAKHGFEKEQEIDFFGEISGVSFSPDTESLFIGVWDRTYGSLLQFNRRRNYMYLDCL

SEQ ID NO: 3920 - protein, 354 aa, Glycine max
PSSPHKSASSSCTSCAPSGAAYQISSKLPGNLKVVFFTNSGTEANELAILIARLYTGCHDIISLRNAYHGNAAGTMGATAQSIWKFNVVQSGVHHAVNPDPYRGIFGSDGEKYARDVQDIINFGTSGNVAAFISEAIQGVGGIIELAPGYLPAVYNTIKKAGGLFIADEVQAGFGRTGSHFWGFEAHNVVPDIVTMAKGIGNGIPLGAVVTTPEIAEVLTRRSYFNTFGGNPVCTAAGLAVLKVIEKEQLQQNAFVVGSYLKERLTALKDKYELIGDVRGRGLMLGVELVTDRELKIPAKGETLHVMDQMKELGVLIGKGGYYGNVFRITPPLCFTKEDADFVADAMDLTLSRM

SEQ ID NO: 3921 - protein, 888 aa, Glycine max
  misc_feature (151)..(151): Xaa can be any naturally occurring amino acid
  misc_feature (174)..(174): Xaa can be any naturally occurring amino acid
  misc_feature (731)..(731): Xaa can be any naturally occurring amino acid
MGGTCADLHHHESDIELTDAERIGTDVGPDSGTKSQGEEAEGQHYVEVTMDIHRDSVALHSVKTVAADDVDMVEEEEEEGDKLGLMGKKRLEKKTSFGASVVQSAANRMKQLKRLASFSKPAPKHFERTKSAVGHALTGLKFISKTDGGAXWVEVEKRFHKLTATTDGYLSSCXFAQCLGLNKESEAYAEKLFDTLARQRGIQGGSINKIQMKEFWDHISDQSFDTRLKTFFDMVDKDADGRITEEEIKEIICLSATANKLSNIQKQAEEYAALIMEELDPDDTGYIMIDNLETLLLHGPEETTRGESKYLSQMLSQKLKPTFADSAVMRWCRDAKYFLLDNWQRSWVLALWIGVMFGLFAYKFVQYRRKAAYEVMGHCVCMAKGAAETLKLNMALILLPVCRNTITWLRNKTKLGVVVPLDDNINFHKVIAVAIAVAVAVHSIYHLTCDFPRLLHASDEKYKLMQPFFGDRPSDYWYFVKSWEGVTGIIIVVLMAIAFTLANPRFRRGRAKLPKPFNKFTGFNAFWYSHHLFVIVYALLVVHGIKLYLTKEWYKKTTWMYLAIPITIYALERLVRAFRSSIKSVKILKVTLYPGNVLSLKMSKPQGFSYKSGQYMFVNCAAVSPFEWHPFSITSAPDDDYLSVHIKILGDWTRSLKAKFTQACQQPLNGQSGLLRAECLKGDNSPSSFPKVLVDGPYGAPAQDYREYEVVLLVGLGIGATPMISILKDIXNNFKANDEEEGGQERVSDFKTRRAYFYWVTREQGSFDWFKGVMNEVAEEDRRKVIELHSYCTSVYEEGDARSALIAMLQSLNHAKNGVDIVSGTRVMSHFAKPNWRSVYKRIALNHPDARVGVFYCGPSALTHELRQLALDFSHNTSTKYDFHKENF

(The sequence listing continues in the following parts.)

The invention claimed is:

1. A plant cell nucleus with stably integrated, recombinant DNA wherein said recombinant DNA comprises a promoter that is functional in said plant cell nucleus and that is operably linked to a protein coding DNA encoding a glutamine synthetase protein having at least 90% identity to SEQ ID NO:478, and wherein said plant cell nucleus is selected by screening a population of transgenic plants that have said recombinant DNA and an enhanced trait as compared to control plants that do not have said recombinant DNA in their nuclei; and wherein said enhanced trait is selected from group of enhanced traits consisting of enhanced water use efficiency, enhanced cold tolerance, enhanced heat tolerance, enhanced resistance to salt exposure, enhanced shade tolerance, increased yield, enhanced nitrogen use efficiency, enhanced seed protein and enhanced seed oil.

2. The plant cell nucleus of claim 1 further comprising DNA expressing a protein that provides tolerance from exposure to an herbicide applied at levels that are lethal to a wild type of said plant cell.

3. The plant cell nucleus of claim 2 wherein said herbicide is a glyphosate, dicamba, or glufosinate compound.

4. A transgenic plant cell or plant comprising a plurality of plant cells with the plant cell nucleus of claim 1.

5. The transgenic plant cell or plant of claim 4 which is homozygous for said recombinant DNA.

6. A transgenic seed comprising a plurality of plant cells with a plant cell nucleus of claim 1.

7. The transgenic seed of claim 6 from a corn, soybean, cotton, canola, alfalfa, wheat or rice plant.

8. A transgenic pollen grain comprising a haploid derivative of the plant cell nucleus of claim 1.

9. A method for manufacturing non-natural, transgenic seed that can be used to produce a crop of transgenic plants with an enhanced trait resulting from expression of recombinant DNA in a nucleus of claim 1, wherein said method for manufacturing said transgenic seed comprises:
  (a) screening a population of plants for said enhanced trait and said recombinant DNA, wherein individual plants in said population can exhibit said trait at a level less than, essentially the same as or greater than the level that said trait is exhibited in control plants which do not contain the recombinant DNA, wherein said enhanced trait is selected from the group of enhanced traits consisting of enhanced water use efficiency, enhanced cold tolerance, enhanced heat tolerance, enhanced high salinity tolerance, enhanced shade tolerance, increased yield, enhanced nitrogen use efficiency, enhanced seed protein and enhanced seed oil,
  (b) selecting from said population one or more plants that exhibit said trait at a level greater than the level that said trait is exhibited in control plants, and
  (c) collecting seeds from selected plant selected from step b.

10. The method of claim 9 wherein said method for manufacturing said transgenic seed further comprises
  (a) verifying that said recombinant DNA is stably integrated in said selected plants, and
  (b) analyzing tissue of said selected plant to determine the expression or suppression of a protein having the function of a protein having SEQ ID NO:478.

11. The method of claim 9 wherein said seed is corn, soybean, cotton, alfalfa, canola wheat or rice seed.

12. A method of producing hybrid corn seed comprising:
  (a) acquiring hybrid corn seed from a herbicide tolerant corn plant which also has stably-integrated, recombinant DNA in a nucleus of claim 1;
  (b) producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA;
  (c) selecting corn plants which are homozygous and hemizygous for said recombinant DNA by treating with an herbicide;
  (d) collecting seed from herbicide-treated-surviving corn plants and planting said seed to produce further progeny corn plants;
  (e) repeating steps (c) and (d) at least once to produce an inbred corn line; and
  (f) crossing said inbred corn line with a second corn line to produce hybrid seed.

\* \* \* \* \*